United States Patent 9,487,797 (GENOMIC PLANT SEQUENCES AND USES THEREOF) - sequence listing, part 98

SEQ ID NO: 83602 - DNA, 18908 bp, Oryza sativa
  unsure (1)..(18908): unsure at all n locations
aattcctgcagccccaaaatcgccctcccaccccaccaattcttgttcttgcctcccgcgtctatatttggtcattcttgcgttcgcatcctcgctcccatgttcgaatcgtcgctcctgtccagctccgtgtgtgaggcgcgctcccttattgatgcgccaacacggattgggggagaaccggcgcggtggatggacgagaagaagtggtgtggattggggaagaagcggtgcggcggctttagagggagaaacggcttggcggaggagaagcggttggggatggggaggagaagcggcggtgacggagctcgtggctcctcaccgggagaccgtgcaggcccccctttgccagttcggccgggggcttagggtgagatctcaagctctctctgtatgtggaaagatcgcgtgccaggaagaaacgcgagacacggacgatgtatacaggttcgggccgctgggaagcgtaataccctactcctgtgtttttggtggatctgtgtaagaacaagttacaaaatatcaaccagccctctcctctcccgggaaaatcccgttctctctctttgtgggcatggtcctccttttatatcttaaggggataccacatgtaccctttcctttccaaactggacttttcttctctttatgtaaatggacggagatttgcacggttgccctccgaacgtccttctgaagggacggcacatacctacctccacttctgccgggggcaggcgcgtcgtgggaacgtggctgtgcgctgacgacatgagcagtgtcagaccggtcacaaatcggtcattcttgtccaccgcgtgtcagcttagcaacgtgcatgtttgcccttcttcacacaacatcttgcctgtaatggttaggatgaagcctggcatatatcgatcggggctaacgtgccatctctgggatgtaacacgctagctccagctggggacgagtgcctagaggctctcgtcttgacgggacggggcgaggcgtgcgtcagaccgccagtcgccacctaaccgttgatctgaccggtctgtgactggtcacagaccggataaaagagcgcgctgcattgcgctgcatgcagcgtgacacgcttgaccagaccgcaataaatgcggttaggtgagccctaccgtgttcacccaacctatgtacatagtgcaaaccccacaaggggtcggggcacctcggccctcggggccggggcaggagcaacccgaccccccctcggggaaatcaggaggagggcggacacctcaccctcgggcccgacgtccccgaaggtgccaggccacgtgggcgattccatctgcctcaagcctccgggcgcaatactcccggtcccatatcaccgacagtagcccccggcgttatgtcagggcgatcatccttctcaagggaagcggtcgggcatgacgccactcataaagcctggtgacaggtgggaccggtctccgtgattgggcagaaacccaacggtctcaaaccacgcatatcggtaacggtgtcttggccgtcagtcatgggcggtctcttcaagactgccacatcacttgagcagcgctcgaatctgggcgtgcagattcgtttcgtctggagatatggtaacgtcgcttcggtcggcgagcgtaattaacgcgcacacgatacgatctatctcgactgccacaaccgcatatccacctcatgcgccgcaagcgggcgaatggaattagtggaagcgtgggcgcgagaaacgagggagcgagatagcgagtaacgagggagcgagatagtgggcacgagaaacgaggagccgggctcagcgatgggaagggtataaagccatcgaggaaaggacttgctcccttcctttcgccactattcccctttccttcgccgtttgcgccctaaactctctctttgctgcgcctcaccttcgccacacacgctcgttctcaaccctctctttctccgacgacatggcacggggctccgctctgctcgacggtagcgtactaccgccttcccgcattgtgggcgagaggcaggctgggctgccgcgccgcttcatgccggaatccgccaccggccgggagatagtgatgctgggcgaggcgcgcccagcaccagattacccggggcggtccatcttcttcctccccctcgcaatggccgggttggttcctcctttttcttctttctttatggatgttctggagttctacgatctccagatggcgcacctcacccccaacgcagtgatgactttggccatcttcgcgcacctgtgcgagatgttcattggggtgcgcccatctcttcggctgttccggtggttcttcaccgtgcagtcggtgtcgccgccgtcggtggtcggtggttgctacttccagccgcgggggccggtgttgaaccgctacatcccctgcgccctccgcaagaagtgggacgattggaagagcgactggttctacaccccccttgccaacgaagcgcgcctccgactcccaagccagcccccggcgccggtctccagctggcgggcgccagtagatctgggggatgactatgacgccgtcctcgaccgcctggcgggcctgcgatctcaggggctcacaggggccatggtgtacggcgactacctccgtcgccggattgcgccgcttcagcggcgcgcccggagcgcatgggagtacaccgggtccgaggactacatgaggacccaccggggagtcagatgggattgggctcccgatgacttcaagatcgtggtccaaagggtgctgaatctcagctccgtggaggcgtctcttattcctcaaggactcctccccctctgctgcgatccagaccgcgcctccattctgaccatcatgatgggggtcggggcctcagaggaggtggctcctaagggccacgacggcgccggcgggagccgccaggaagaatcaaccccaggagggggccgtgcttctgggccccgcgacgggggctcggggagcaaccgccctgccgccgcccgggggaagaggaaacagggaggaacacctcccccatctcctccccgagggggcggggcggtgcgtgccagcagcaggcgcccggagggggccgcgccgacgtcacagcccgagacggagcgcaagaagaagcggctccgcaagacgggggagacggaaccatcccggggaaacctgatttcccctccaaggtggtcgttcaaccgaccccctcgcaggttcgtttcacgcctttcacaaccatcttccctttatcccaatcagcaagttttctcttatccatcttgtttgtcttccggttttttcttctgcttcagcgatgtcccgtcgcgttcctcccgccatcccaagtccggccaatccgaggccaaagatccggcggccgcagaggaacggaggcgagaatctgaccggcgagaggccgcagatcgccttcgggaagctgaagaggccgcccgggaggccgctcgggttcggcaggcggaggataccgctcgggaggaggccgcccgggctcgccaagccgaagaagctgctcgggaggaggccgcccgggctcgtcaggctgaagaagccactcgggaggaaaccgcccgggctcgccaggctgaggcgatggcgtcttccgaggcggttcacgacaagaccgccggcgcgtcgctcgggcccactccctcgggtgacgctcaggcgacaacctccggggcggctcgcgacaaggccgcgggcgcatcgcctgggcccgctccctcgggcgacgcccaggaccaaacgggtccgggggacatccccgagctcagtgcgtcttctggcgggccgagccgcgtcgcattttctccaaggcggctcttctcctcgtcttctgccgccccgctgagtgccgagccccttctgcaagccttggccgccgcaaacaccgcggtgctagatggattcagcgcccaggtggaggccttgcgagcggaacgagcggagctcgaggccgcatgggcgcgcgtcgaggaggggcggcgctcggtggacgccatgtggaggtggccgtaaggctcaccgccgccacatctcggagcttgaagcccgcaaggcggcgctggcggagatcgcccgagaggtggaggaggagcgagaggccgccctcatcgccaccaccgcgatgattgaggcgcaggactccctccgccttcaacacgggagctgggaggcggagctaaagaaaaagctcgacgccgcccagggggtccttgacgccgccgctgcccgagagcagcgagcaacggaggctgaagcggcatcccgacggcgggaagaggcccttgaagcccgtgccatggcgctggaagatcatgccggcgccgtggagatcagcttggcggaccgcgaggccgccgccgctatccgggaggcgacgctggcggcgcacgaggccgcctgcgccgaagaggagtccgcgctccggctccgcgaggacgcgcttgctgagcgggagcgagctcttgaggagtccgaggccgcgacacaacggctggcggacagcctgtccctccgcgaggcagcgcaggaggagcaggcgcgccgcaatctggaatgcatccgcgccgagagagccgcgctggagcagcgggctgctaacctcgaggcgcgagaaaaggagctggacgcgagggagcgcagcggcggggcggctacgggcaaaagcgacttagtcgcccgcctcgcagctgccgaacacaccgtcgcggacatgcagcgcgccctggactcatccaccggggaagcggaggccctccgcttgtcggtgagatagggcccggcatgctttgggatgcagtctcccggctggatcgcgccggtcgggaagcgggcttcttgaaaggccagacaatttcgcgctctaccaatctggaaggcctcgccccgcccttaggaggatggcctgggctgtccaacaactccccgaggagctcgagaagaccatcaagtcatcctcgagggacctcgcccaaggagcggtggaactcgtgttagcgagttaccaggccagggaccccggcttctccccatggatggcgctggaggagttccctcccgggaccgaggacgatgcgcgcgcgcgggtccgggatgccgccaaccacatcgtccaaagcttcgaggggtcggcccctcggctcgcgttcgcccccagctccgacgaggagggcgacgccagcggtgaggacgacggtggcgacgaggccggcgacccgggcgcattggaatgagcccccaggcccccgccaatctccaattttttctttttctttcttctttttgtatagatcaacttaatctgcaatcaaaaatgatgaaaaatttctatgttaactttattttgctatgcatatgagttgaggatgatttgtgccgtggtccttttgcattttagcttgatttaagggctcgtgctcaagtcccgatcctcaaatggctcgggtcggggctagtgcctggggagatccacatgtcgagactggccaggccgggaacatggtgaccgagggttatgggtgacccgattgtgggtttttgccgattcccccccggagttcaccacgccccggggcacggctcggttctgggccccgcttggcgattttagctgaccgaaccgagcccccgagggcaaggttgagcacgagtgaccttatttcaagttaagattcttcagaaggaaaaacggcacagacacaacctttagaaaattgaaactgcttttattgaaatgctgaaataagaaaagtaaggctgtgcatgtgtggtagcccccggctaaccctgcacacccgaggggggtgcggggttagcccgagcccgaccccccccctcaggggtagaagcgacgaaggtgttcgatgttccacgggtttggcagctcagtgccgtcgcccgtggccagccgtacggagcccggccgggggacgccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcatctctacgaagctgatcttgatcagcctcgcagtacatggtggcccgaggagacctcagggtgagctcggatgggagaactgcttctgcgccgtagacgaggaagaaaggcgtttccccggtcgctcggcttggtgtggttcggtttgcccagagcaccgctggtaactcctcgatccatgaatcgccgtgcttcttgagaatattgaaggtcttggttttaaggcctttgaggatttctgcattggcgcgctccacttggccattgcttttggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagagcctgggccggctgattgatttgcttggcgtggaactgacacgctctgcatcgccggaccagatcgactgcatcattgagagctgtcggccaataaaatccttgacgaaaggccttgccaaccagggtgcgcgaggcggaatgggctccgcactcgccctcatggatgtcagcaagaagctcaacgccttgttcctgaggaatgcacttcaggaggattccgttagccgcgcgccgatagagggtcccttctaccagcacgtagcgtttggaaatgcgttgtacgcgttcactcccttcgcggtcctcaggtagagtcttatctgtgaggtatgtttggatctcagagatccaagcaatcaatctaagggagcttggagcgctcccttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccgtgagagttcgtcagctatcatgttatcccgtctgggcacatgccgaagctctatcccgtcaaaatggcgctccatacgccgcacttggcgtacataggcgtccatttgcgggtcagagcaccggtactccttacagacctggttaacgaccagctgggaatcgcctaacaccaggagacggcggatccccagtccggctgccaccctgagtccggcaaggagtccctcgtactctgccatattattggtcgctcgaaagtcgaggcggaccagatatctaaggacgtctccggtcggggaggtcaacgtgacccccgcaccggcaccctggagggacagagaaccatcgaactgcatcacccagtgggtggtgtgaggcagctgcgaggggttcgtgctggcctcggggattgagacggtctctggagccggggtccactctgccacaaaatcggcgagggcctggctcttgatagcgtggcgtggttcaaagtgcagatcgaactcagaaagctcgattgcccattttaccacccgtcctgtaccctctcgattatgcaagatttgaccgagggggtaagacgtaaccacagtgaccctatgtgcctgaaaataatggcgcagtttcctcgaggccatcagaatagcgtaaagcatcttctgggcctgagggtatcgggtcttagcgtcccggagggcctcactaacaaagtagacaggccgctgcacccttcggtggggccgatcctctctgctaggggccgtatccccggggcgttcttcgttcaagtggcctttcggggcgcacttgtcttctgtgccgatgacctcggggtcggaggatgaaaggggcggccttccctcggtggcctcggggccgtcctgggggtcgggggctcctggcatcgtcggacaagcgggcaaagggccaactccggtcgtcaggggcctctggcctccgttcggctcgggggcctcttctccctgctctttcccgggtcgagtcagcacagggttagcctcggggtcaaagggcgttaagtgcggccttcccgcagtggccttggggccctcctgagggtcgggggcacctagcaccgtctgacaagcgggcggagggccgactccggtcgtcgggggccttaggccaccgttcgactcgggggcctctcctccctgcctgctcccgggcctagtcggcacagagtgggggtgcgcagaatgaggattgtcctcatcgcgctccacaaccaacgctgcactaactacttggggggtcgccgctaagtaaagtagcaggggctcatttggctccggggcgactagaaccgggggagagctgagatatgcctttaactgagtgagggcatgttcagcttcctccgtccaagtaaacggccccgagcgcttgaggagcttaaacaagggtagcgccttctctcccagccttgatatgaaacgacttagggcggccatgcaaccggtgacgcattgcacatccctaagtttgctgggggggcgcatccgctcgatagctcgaatcttctcggggttggcctcaatgcctcgggcagagaccaagaacccgagaagcttgcccgcaggtacaccaaacacacacttatcggggttcagctttatgcgggcggagcggaggttctcaaaagtttccgctagatctgaaagtaaagtttcttggttgcgcgtttttacaaccaagtcatcgacatacgcctcaacattacgtcctatttggctacccaaagaaattcgagtagtacgctgaaaagtaggacctgcattctttaacccgaagggcattgatgtataacaataggttcctacgggggtaatgaacgcagttttttcctcatcctccctagccatgcgaatctgatggtaaccagagtatgcatctagaaaacacaaaaggtcgctccccgcagtggagtcgacgatctgatctatgcgaggcaaggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggccttccgccgcactttctgccggaccggccttgcgcccggccgcacggcgagacggtgctcaatcaccttcctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggcaatccgctgcctcggggcgatgggggcggaggtgccaaggctctcgtcaccaccctcgggcttggtcgcagcagcgaggtggtccgcgcgctgctccatgcaagcgagcgtgactttaaggtcgccacggacagagatggggccaccggggcccggcatcttcatctggaggtaggcgtagtggaccgccgccatgaacttcaccaacgcgggtctccccaggaccgcgttgtagggcagactgaggtccgccacatcgaagttcacccgctccgtgcggaagttggctgatccaccaaaggtgaccggtaggtcgatgtgacctaatggccatgtgtgccccggcgtcacaccgataatcggttgggacggccggagcaccatccccggggccttgatagcatcaaaggccgcgggggaaagaatgttgagagccgctcctccatctatgaggacacgtcccaactcgacgttgcagatggtgggggaaaccaccatcgcaacctgccctccccgggcaatgcacggtgggtggtcggtctggtcgaaagtgagagcgacctccgaccaccgcgcccgacgcatcgcctcatgggtaggggccatggccagaagctctcgcttcatagccttgaagctccggcgagagacgtgagcacatgctcctccatcgacggtggcaatggtggccccaggttcttggaaacctaggtcatcatcaccatcatcaatgtcaacagcgggggccttctgcttagcctcacttcgccgtttgccggaaggaaccgccggggacttgccctcacggcgttcctgcctcctgtcctcctcccacttcctcgttcgctcagccaaatttttgactgcgcgacagtccacgagatcgtggagggaggtgttgtggacggagcaccacctgccggcggggcgctccttgctgggagtaccagcctctttctttttgtcgctcgcaggcctcccctttcgggtggcccgcggagcgccctcgacggcgaggacatgaccctcgtcgccggaacggtccgacctcttcttcctcctcctgtcacgccgccctgtctgagcggcggatccgggggcggccgaagctgccactccggaaccggaggagttccatgtccacgcttcctccttacgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcgatcccggtcgtatagacctggagaaactcggtggggttgacgctcccatcgtacttctcggtgatggtgggccggaaccttgggggccaacggacattccgaagactcgccacaaaggctctacagccaacaccaccagccggaggcacggagggctggtcctcacgtccatgtcgaggtgacactctggacgaggaggcaccctccgttgcacggggggtacgccggctactacgccggcgctcgatgttgaggcgggcatccggctccccatgctgatcctcccgagtcgaaggtgtcgacgagggagtagcaaccgaatgacgtgcagccgccgccgctcgccgcgccctccgccttgacgacacggagccggtggtagcggcgccggaggtcttggtggtggcggaccgtccaccagcacccaggcgctgctgtgccgtcatgaccaagttggccacgtcttccagccatcgttgggctggagactccgggtcatggacgacaggcgggtgtcgtaggagcgcgccagcagcctgaagcgcaccctgaggcgtgctgccgtcgccgtagacgaggaggcgacgctccccatctcgccgttctcctgcatcacctgcgactggtgatgccacggatttgtcgaccctctcaagcgcctccccctgcttagggctttggcgcggaggaggtgggggagtacgagctcgacggcgtggattcggctccccgtcgtcgccgctcacacttggagagaggtcgtgcgcttttccttgctcggccattaggctgaacaagaaaaagttggcgcacacggaagagtctgagagctcagaaaacacacgctgagccccctacctggcgcgccagatgacggagctcgtggctcctcaccgggagaccgcgcaggcccccctttgccggttcggccgggggcttagggtgagatctcaagctctctctgtatgtggaaagattactcgccggcaagacacatgagacatggcgatgtatacaggttcgggccgctgcgaagcgtaataccctactcctgtgtttttgtggatttgtgtatgaatgagctacaaagtgtgagcccacttctcccccgctctaggctctaaatctggcaagaatcaaccaaccccttctttatgggcaaggtcctccttttatacttcaaggggataccacatgcccccttctctttctaaactggacttttcttctctttatggacggagattggtgtggttgctgtccgaatgacactccgatgggacagcccacacctacctccactcccggcggagacaggcgcaacgtgggatcgtggctgcccgttgctgacgtgatcagtgccagaccggtcattcttgtccaccacgtgtcagtttaacaacatgcatgtttgcccttctttgtgtaacaccttgcctgtaatggttaggatgaagcctggtatatatcgatcggggttaacgtgccatctctgggatgtaacacgctagctccagctggggacgagtgcttagaagctcacaccttgacgtgatggggcaaggcgtgcgtcagaccgcctgtcgccacctaacttgcgatttgaccggtctgtgactggtcacagaccggataatcgagtgcactgcactgcactccgtgcggcgtgacacgcttagccgatgcgcaataaatgcggttaggtgagcccggctgtgctcacccaacctacgtacatagtgcaaacccctcagggggtcggggcacctcggccctcggggtcggggcaagcgcaccccgaccccccctcgggggaaatcaggaggagggcggacacctcaccctcgggcccgacgtccccgaaggtgccaggccacgtgggcgattgtgtctgcctcaagcctctggtcatgatactcccggtcccatatcaccgacagtagcccccggcgttatgccagagcaatttcccttcccaaggggagcggtcaggtgtgacgccacccctaaagcctggtgacaggtgggaccggtctccatagttgggcaaaatacccaacggtctcaatccatgcatattggtattggtaactttggttgtccataatgggtggtctattcaagaccgccacatcacttgagcagcgcgcgaatctgggtgagcagatttgtctcgcttggagatacggtaacgccgcttcggttggcgagcgtaattaacgcgcgcacgatacaatccgtttcgattgccacaaccgcatatccacttcatgcgccgtaagcgggcgaatgggattagtggaagcgtgggcacgggaaacgagggagcgagatagcgagatacgagggagcgaggtagtgggcgcgagaaacgaggagccaggcccagcgatggcaagggtataaaagcatcgaggaaaggatttgctcccttcctttcgccattgttcctcttgccttcgccgcctgagctctaactctttctctgctacgccctactttcgccacacgcgctcgttcccaatcatctcttcctccaccgccatggcacggggctctgctctgctcgacggcagtgtactgccgccttcccgcatcgtgaacgagaggcacgccggactgccgcgccgcttcatgccggagtccgccaccggtcgggagatagtgatgctgggcgaggggcgcccggcaccagactacccggggtggtccatcttcttcctccccttcgcaatggctgggctggtcccgccattttctcatttcttcatggatgtcctggagttctacgatctccagatggcgcacctcacccccaatgcggtgatgacattggccatcttcgcacacctgtgcgagatgttcattggggtgcgcccctctcttcagctgttccagtggttcttcaccgtgcagtcggtgtcaccgccgtcggtggttggcggctgctacttccagccgcgggggccggtgttgaaccgctacatcccctgcgtcctccgcaagaagtgggacgactggaagagcgactggttctacacccccctcgccgacgaagcgcgcctccgacttccaagccagcccccggcgcaggtctccagctggcgggcgccggtagatctgggggaggagtacgacgccgtcctcgaccgcctggcgggcctgcgatcccaagggctcaccggggccatggtgtacggcgattacctccgtcgccggattgcgccgctccaacggcgcgcccggagcgcctgggagtacactgggcctgaagactacatgcggacccaccagggagccagatgggattgggctcccgaggacttcaagatcgtagtccaaagggtgctgaatcttagctccgcggaggcgtctcgccttcctcaggagatcctccccctctgcagcgatcccgaccgcgtctccattctaaccattatgatgggggtcggggcctcagaggagagagcccctaagggccacgacggcgcgggcgagcgccgccgaggggaacaacctgccccaggagggggtcgtgcttctgggccccgcgtcgggggctcggggagcagccgccctgccgacgcccgggggaagaggaagctgggaggaacacctcccccatctcctccccgagggggcggggcggcgcgtgccagcagtcggcgcccggagggggccgcgccgacatcgcagcccgagggggtgcgcaagaagaagcggctccgcaagacgggggagacggaaccatgccggggaaacctgatttcccctccaaggtggtcattcaaccgaccccctcgcaggttcgtctcactctcattgcaaccatctttctccaaaaagaagttttttcttgctcactttgttcgtcttctggcttttccttctgcttcagcgatgtcccgtcgcattcctcccgccaccccaagtccggccagtccgaggccgaagatccagtggccgcagaggagcggaggcgagagtctgaccggcgtgaagccgcagcccgccttcgggaagctgaagaggccgcccgggaggccgcccgggttcgccaagcggaggaagctgctcgggaggaggccgcccgggctcgccaagccgaagaagctgcccgggaggaggccacccgggctcgccaggctgaggcgacagctgctgctggcgcgtcgcttgggcctactccctcgggcggccctcaggcgacatcctccgaggcggctcgcgacgaggccgcgggcgcatcgcctgggcctacctcaccgggcgacgcccaggatcaaacgggcccgggggacatccccgagcccagcgcatcctccggggggccaagccgcgttgccttttctccaaggcggctcttctcctcatcttctgtcgccccgctgagcgccgagccccttctgcaggccctggccgccgcaaacaccgcagtgctggatgggttcaacacccaagtggaggccctgcgtgcagaacgagcggagctcgaggccgcatgggcgcgtgttgaggaggggcggcgctcggtggacgccatggtggaggtgggccgtaaggctcaccgccgccacatctcggagcttgaagcccgcaaggcggcgctggcggagatcgcccgagaggtggaggaggagcgagaggccgcccttgtcgccaccaccgcgatgattgaggcgcaggactccctccgccttcaacacgggagctgggaggcggagctgaagaacaagctcgacgccgcccaaggggttcttgactccgccgctgcccgagcgcggcgggtaacagagactgaagcggcgtctcggcggcgcgaggaggcccttgagtcccgtgccatggcgctggaagaacacgccggcaccgtggagaggggcttgacggaccgcgaggccgccgctgctctccgggaggcgacgctggcggcgcacgaggccgcctgcgccgaggaggagtgcgcgctccgcctccgcgaggacgcactcgcggagcgggagcgagctctcgaggaggctgaggccacggccaaacggctggcggacagcctgtcccttcgcgaggcggcgcaggaggagcaggcgcgccgcaatcttgaatgcgtccgcgccgagagagccgcactggagcagcgggctgctgacctcgaggcgcgggaaaaggagctggacgcgagggcgcctatcggcggggcggctgcgggcgaaagcgacttagccgctcgcctcgcggtgccgaacacaccgtcgctgacatcagcgcgcgctgattcttccatcggggaggccgaggccctccgcttggcgggcgagatggggccaacagttnggatcggtctcccgcatggatcgcgccggtcggcaagcgggcctctggaaaggccagacgaggacgcgccctagcaacctggaaggcctcgctccgcacctcaacaggatggcctgggtcctcgaacgactccccgaggagctcgagaagaccatcaagtcatcctcgagggacctcgcccggggggcggtcgaactcgtgctagcgagttaccaggcccgggaccccgatttctctccctggatggcgctggaggagttccctcccgggaccgaggacgacgcgcgcgcgcgcgtccgggatgctgccgaccatatcgtcgacggcttcgaggggtcggcccctctgctcgcgttcgcccccagctccgacgaggagggcgacgccagcgatgaggatgacggcggcgacgaggccggcgacccgggcgcattggaatgagcccccaggcccccgccaatcttcttttctttttctttcttctaaggccttcatgcctcttttttgtataaattaacttaatctgcaatcagaaatgacgaaaaaaaaatttttgtgttagttttattttgctatacatacacgatgaggatgatctgtgccatggtcctttcgcgccttagcttgaaataagggctcgtgcccaagtcccggtcctcgaatggctcgggtcggggctagtgcctggggagatccgcatgtcgagactggccaggccgggaacgtggtgaccgaggggtatgggtgacccgattgtgggtttttgccggttcccccccggagttcaccacgccccggggcacggctcggttctgggccccgtttggcgattttagctgaccgaaccgagcccccgagggcaaggttgagcacgagtgaccttatttcaagttaagattcttcagaaggaaaaacggcacagacacaacctctaggaaattgaaacttcttttattgaaatgctgaaataagaaaagtaaagctgtgcatgtgtggtagcccccggccaaccctgcacacccgaggggggtgcggggttggcccgagccaaaacctgacacccgcccccccccttcaggggtagaagcgacgaaggtgttcgatgttccacgggttcggcagttcagtgccgtcgcccgtggccagccgtacggagcccggccgggggacgccgatcactcgatacggaccctcccacattggtgagagcttgcacagtccagcacgcgtttggacgcggcgtaggacgaggtcgtcgacgcagagtgatcgggcccggacgtggcgctgatggtagcgccgcaggctctgctggtagccgcagctcggagggccgcgcgccgccttcgttcttccaagtagtcgaggtcatctctacgaagctgatcttgatcagcctcgcagtacatggtggcccgaggagacctcagggtgagctcagatgggagaaccgcttctgcgccgtagacgaggaagaaaggcgtttccccggtcgctcggcttggtgtggttcggttcgcccagagcaccgctggcaactcctcgatcgcatgaatcgccgtgcttcttgagaatgttgaaggtcttggttttgaggcctttaaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggtactccaaaacgggccgtgatgcccttaatgaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagggcctgggccggctgatggatttgcttggcgtgaaactgacacgctctgcatcgccggaccagatcgactgcgtcattgagagctgtcggccaataaaatccttgacgaaaggccttgccaaccagggtacgcgaggcggaatgggctccgcactcgccctcatggatatcagcaagaagctcaacgccttgttcctgaggaatgcacttcaggaggattccgttagccgcgcgccgatagagggtcccttctaccaacacgtagcgtttggaaatgcgttgtacgcgttcactcccttcgcggtcctcaggtagagtcttatctgtgaggtatgtttggatctcagagatccaaggggctgcaggaatt

SEQ ID NO: 83603 - DNA, 690 bp, Oryza sativa
atttttgtgaatatgaacatgtattatttcctaacatattcttcttggcactccaaaaaagatcaaaataaattgctggtgtttaatccggccaattgcatggagacattctgaagtaaaatcacatcgaaagactgaatttgcaaccaacaaaatggacagcagtggcgatgaacaaaacccaaacctaacccaaccatggccgatagtgcgttagacggctgggctcccgttcctcgcatgggccatataatgggctttcgtgatggatgatgggccaaacaagcctaaataggacaggcagcagcgtgcagcgagtagcgaagcagcgctagttttagtaccacctcgccaattcgagccgcagccaggcgggaggaacgctataaaatagggcgaggttgcaccattgtaacccatatctttctcagccttttggctatttggctattggctaagggtgtgattagttcgcgaaaagaaaatattaaacgtgggaactaaacaagattaactgttctcatcagtttaactaatatctgatgtgtgggccatatgctcacttcgatattaaatttattatttgtgggggagggcttcgatattaaatttattatttgtgggggagggctcatcacagtggcaagcccttgccactggggccctcgcgcgtcgctcaagcgttgcact

SEQ ID NO: 83604 - DNA, 4723 bp, Oryza sativa
aattcctgcagcccaaaaaaaaaaatcaaatgtcaaatcttgtacttagttgccagttcttttattttgaggcacaactgtattggcacctgtctctactgcatatatcatttgttaccatgccactcttgctattatctgctgcatttcagatgatcatcaatttttttacggtcattaagcaccagcttttcctgtacaactctcatgtattgtgactgataattaagccttggtgttggccgatttgtcaggtggaacgctacaaggaagggtgtggttgggtgactaccgagtcgaggtcaattggcaggaggtgctactgctcggccattgttctctgactctcaatatcgacgctgtgaatttagttagctttctgacaagggaacaacaaacagatagttaaagaacttagaaggctcttcttttggctgaatttagagctgtagacatacataagctcttaccctaatcttttgcatgaactagaaaaccgttcaatgttgagctattttgttgatactgcaaaaatctgatgcaaaaatcagtttggtactaaacaagatgagaattccatgaatgaatatttgatagaactgtgattattaactgacatcgttgagcttcagttcagttttttcctacctgtttgaggattttactgaagcagatgtgggtctggctgggttcaccattccagcaatcacaaaccacatttaagaacctagtttactctttgctgtttcttacagagacctcaaagttgtgatgacttttgggggtgttaggcctgtttgttattattcctatgttgatctcaaatgttttgattttgattttaatcaaatgataattgcaagtattcagaaatgcatttgaagcgatacagtcaatggaaaaaaaattctgtcttcagtaaaacacaagggatgggagacgtgcgttccttgttgctgctgctgattctcgaagtcaccggcgatggccgccggcgacgaagacgctgctccggcgctgtcacgctgtgagatggtcaccggcggcgactgcgacggcctctcttcggccgctccctccgaccacgacggcaattcctcccatcaatcgccgatcccccctccgccgccgccgttcccgcactcatcggtttctctttcacctcatgacaccgcccaccccgcgcgctgctcatcgaattgacgcggagatatggggccgaactgacccgaatttatgtgcatcctttacaggccgatgaacgcacacttttagcccaactgacgtgcatggttgggctgaaatgctatttgggacaaatttgttcacacgtttgggccctactcacagaaaatttgggcttacattactagcgcagtagcgctgctctggtgaatggagaaggtccacttgactcactcctataggtcggatctgattcatatttctcgaccgcaaaacaggtataatgatttcctcgaggctccaactgttaaaacaggtacaaaataactcctaaaacagcattaggttttcactaatgtggcacgttgagctagttcaacttgctgagtcaacatgggtccacgtattagtgtagtgaccgatgatagccagtggtggctcctttctctcccctctcttcctcctattgtcctatgggcatggtggctggtgagtggcggcttctcgctttgcattttctactgcaacgagcatgtccggtcctagaactctactaggccatcggcgaacttctcgctaatcctgcaacaccacactgaccccccctccttctgcctcaccatcacgccccgatcaaccaaatcttagtaagatttaatgattgcttccgtggtcctgccagtagccatctccttcttggctagctagtttcatggttgggaagatgcatgctgaggctgagcttgagctccatcgagggagcaagaaagaaaagatcaaagctttcatcgattagtggctggtgctactcctatgtcattgccctcctcgtcggcaccacccttctgatgctctcccactgccttatgcctcgatctggttagccaacgtctctactatctgttgccctgatctacagaaccgacgggatcaagaaaccaactgccctgatccgatctgccatgtgccgccgagatcgagatcattagtgattgagcttggttggaatgatggctaggttgaccgtacggtggttggtgaggatgccacgtcctattcacctctggtgcgggtatcaccagcgtgtcatcgcggtgtgggacagagcgcgaggggaaatgcaaaggaagaagaggagagtggcatggatggacggtgagctagagctcgacggggttcactcgccattgtcgcttccattgggagctcaagctcccttgccactactagagggggaagagcgaggagagggagatatgggggagagaggaaggagagagaagtgaggtagagtgagatgacatgtgggctccacaaaatatttctaatttaatgtgccatgtcggccagcaccacctctcaatattgtcttaggaattatttctctggttttaacaatttgagggatacagataagcgatatgaatatgatccgacctatattttgaaggagttagagtggacccttttgcctagtttattgacgtgcaaatttgggccaaatttatgatcacctttaggcttaacctacgcccactttttggatgaactcgtacccacgtttaggctgaattaacttaaaactagaaaatcagcgcgtctattggcgcgcttgctagttagcccataaatgtgtgtaaaaattgaacttcagtaaagtgtcaaaaatatatttttgtcgttgatttttgctgcatttgcaatagatatattatcattctaaaacttttttaacagagtagaaccgtatttatatgactcaataatacataataaaacagacattgatttttttttagtattgctatttttgtggctcttgattttatacataaattttatattaaaacagtttatgtattgcataatgcactctcagtaactacgaacttaatattacgtgaaaataatacaaatttaatgataccacatacgtaacactattttttataaaaaaaatattagtcagatttttaaatattgaagtttttaaaccgaatcctatattatctttttagtacccagggttaccacgctgtttgaaagtgattgttggccacattatcacccgatccaatctttcacattatccctatcatctagttttgtatgattattgtttttataatatagaaatatttttatccaaatattttacaaaaatatatgtatttttttctagtactatttatttcctcctatttctattttctacctgctcatgcatgagctgcaaagtagcccagggaggaggaggcgatgttcaacgtgcaaactctaattatcaggggaacacataattgggtcgatccagtgcatacgctcgtaatggctttgttagttttctaaaaaaaaagttaaataaatatatagcatccatctatttaatgggctctattggagaccatttggcccagcataaaatggcggacggacaccgttaagcgtatgtacgtgacaattctagaagagattagattggttgaggaacctgcgacttctccgttagctgtcggaatttatctgcaagatgaggaaggacacgtggtccaatcagctggctgggtctccagccagctttagaagtatctagaaatatagattatatatggaccgaattatgcttgattttgggctgaatacttgctcactgatgggtgatgggtcgaattaatgtgcagctatgggctgaatcctatcttactaagttatcccccactaacttcttaaacttaacatgcaaagatgccacatcatcatccactaacaagatgccacatcatcattcactaattaataatatgccatatcatcatccactaacaatcatcacatttaaacatcatgcaaacatgctatatttttatagtttttataatttaagagattttcaaatacaaacatgttaaattatcatccaacataattcacataatgtttcaatgtatatcctatataagtatatggttcatactcatttagttagtgcttaaacgattaatttatggtacaaattatttttctcccttttccctctaattaagtcatatcacatcaattgtttttaggccctctttgtttagacttataagccaaacttataagccgaaaagtccaagcctaaacaaataagcggcttttttgtttggcttttctgaagccataagacattctgacactattaagccaaaagctaggttagagaagcttttttggcttatatgaggtagatgcatgactccaccattaaatttaagacattaaatccatcggcttataaatcatataagccaataagctaacttaaaagtctaagccaataagtctaagcctaaacaaagagggccttagcctttagatgattaatctacggttcaaactattttcctacttttcttcttctataaagtcatactaccttactttttacgtttgaatcactattctacatactatttaaatttaaattatcacaaaccatattaatttacttaatctgatattatctagctatcttacacgttattatttttgttgt

SEQ ID NO: 83605 - DNA, 3674 bp, Oryza sativa
agaacatcttggcactacggtatcatattcctactcaaaatatcttcccatccggactcaaaagattttccacactacttctggatattcacactactaatcttttcaggcagtcttaatcacttgattcgtacccctcatgatgtggcacatagtcatcatcactttcatctggaacaaaatcatcatccgaagaatgagactcctcttcatctggaacatagtcatcatcttcggtagaccgatactcatcatcatcgacaaatccataaagggctggaagaaccacctcgtcccctacctccacagccacctcaagaacctcctcccctacctctacagcagcttcaccgtccaactgcccctcccctcctacagcagcttcaccatccaagtgcccctcccctccatctgctggctcaggcaagagaagagcagcccactgttcagggtctagatcatgtccttcaggaccggcaatggctgcaaagtgttgggcccgagcatctatggctagttcttcgagagcttcaccatgagcaaggcctgacagaatgctagccctaacggtggctctaacgtttggtaggaatttgtactgcaggaaatgatatattaccccatcttcttccataagcaccggcggcaagacgacacggcgtctgaatcgaatcccaccattgatctcgaaagtaggcaatgcaatgccattaggcaagacaagcgattgcacattgttctctggtgtcctggtcaaatcgtcatcagtatagaaacgccaaccagttgcatcagctccattgttgatcatcatcacatttagcacctaggaagataaaaaagcaaaatttaaaaggaatcctaggcatctgccatgtgatattttgataaaaaaaatcatccaacaggctgaaaaaaaataccgaacagacagcaaaaagaaattaaattcatcatgcacaacatcaaaaatcaggtcaagtatgattaccgcatcatcatgcacaacatcaaaaatcaggtcaagtatgattaccgcatcagagactacgatattttcaaactctttgtggtcctcggagtccaatgggggatcagcaactgcatatcttgctccgttcattagtttggcacatacttcagtagcaaaagagaacctagaacccgcatttgccatagaatattccaaagcgccagcagaatcaaagcaatgaaataatactccacgccactgcataaaaaatgaaaaaaggaaagatgagccggatacacgttatatcacccagatacaagcacaactaagtactattcacagattagctatcactatgatgacaaggaattcagacatcacaaaataactgtgaacaaaaagacattcaatctgtacctcatcattggcagcaccagccatcatgaagtcgcgtactggccttggaagtaaaaacctgttagcaaacaacatgtgcaattaaacccaagaataagtggagcaagaacaatctatgaactggatacgaaaccctagcagaacaaaaaagtatataggattttgtatttttgggatctacatagaaaaatatatcctaagctaccacagaagggagatacagataaaaataaagtggaaaacatgaaatcaacttcaagaagcagcatgaatcatagtggatcccgtgagctcaaggaacaaatacaaacgaatctagcggccataaagcgatcaaacaataggcatctggaattcaaataaatttctataaactcatgcattcgcattcgttgcaagcgaatgataactgatatcatacaaagcagatatacgacaggaatatgaacacgttgcatatgaataaatgaggagaggagatcaagggggatcatggcatactaacaaattgcatatcagaaaactaagaatagaagattaacaaattggagaccagaaaactaaaaaatagatagggaatcatgtctatgaacagatcacaattgcacataggaaaactaagaatagacagggaaccatggctatgaacggaacgcaattgtagatcacaaaacaagaatagatatgaacatgtcgcaattgcagatcacaaaacaagaatagagaatcatggctatgaacggatcgcggcacacatcgatgttagggaatcatggatatgaacagatcgcagcatcagaggagaaaacgaggatcacggcacacatcgatgctagggaatcatggatatgaacagatcgcagcatcagaaatcagaagagaaaacgagaagagaaggggagggatcgagatgcacttacagtacttgcggcggcgaagtcaggttgaaaaagtggagaagtgggtatttatatagaaagattgtgagctagggcatcgtgcttatccgtcggatcctcgacggacggacagatttctctcgtggagattatgggaagtgggccacggatccagcccactaggagctcgtcggccgtgtgtgtgggccgaacggttcagaaacagaaagttcagttgaggtccctcatcttgtcacccatagatttataaaatcatccttaaaccaaaatacgaaatcttataaaacgggattaaatttccttcggcagtatacatgcccggtttggctgacgtggatatttgacctgatccactcgtgctgattgggcacttgcatgataaaaataaaaagtaggtcccacgtgtcatacttagggcccctttgaatcacaggaatgaaaaaacgaaggaatattaaaacataggattctgatagaaatacgagtgtaaaacagaggattgtaaaacataggaaaaatataaaaatgaccgtttgattgagccgtaggaaaaatacaggaatttgaaaagagagataaaaactcaaaggattcttaccatgaggtagaacctcatgctaaatttcctccaaaacttgcatagaaagagacatttcataggaatttcatgggattacataggattcattcctctaattcaaaggccgatatagaaaaaatttctataggaatgaaatcctttaaaattcctatgaattttctttgaatcaaaaggaagccttactctattccattcctctcgctctcttccgtttctctttccatctctcgagcgagagacgggcgaccgcaaagggacaacaggcgcgggtggtctaggcgtttggcagcgagggccctcgtcggcgggcttggcggcgctgcgtcgtcgaggttgttgggacgtctccggagcccgaggtcggtgtagcatcgagggacggaggtcgccacgtttggtcggtccagcatattctttgcttgaagagaagaactgttaatgcaaattagatatcccaaaacaaacaaacccacaataaataagatacgtaataaaaaaaataccgattctatttagctctacaatacaaacactgaatgaatcaaaatgccagtgagcacatggacacgcacacgccaggcatcaatgaaaacagacatcacaggtttcatctcagttgagcgtaacatccatgaatgtctctctttttgtcttcgaagaaaaaagaaaaaataacaacagtaataaactctctttttaggcttcatagtttaactgcttttgctgaatgaatatagatttaattggcagaggctgcaggaat

SEQ ID NO: 83606 - DNA, 5413 bp, Oryza sativa
aaatatttcagggtgctttacaactgtcgcggccttcgatggatacgagtacatttgatcttttaacagtgactgccacggctcaaccaacaactaactgctgccgaatctaattcaagttggcccattagctgcttctgcggtggtgaggtcagctgctttagattgaactttgcgagcactgtgtacctctcgatcactccaaccatacatataatctgtccagaaatcaaacaagtccatcagaatctgaagtgaaaccaacttagcaaagcttcaaagcgtaaccagatgtgcaattcaaacaacgtaatgtactagagttcacacttcaaattttgaaaaggaaaaatgcaggaataaaaattagatgagataatcatatcgaatggagtagcaaactgaaaaggagatgcaactagaatgaaccaagagtatgctcttagattcactgagattgggagtcatttactttgcagctggtacatcaatcatgagccatggaatgggttggcaggcacgatatttatgacaaacaagtactacctccgtttcacaatgtaagtcattctagcatttctcacattcatattgatgttaatgaatctagacatatatatctatctagattcattcacatcaatatgaatgtgggaaatactagaatgacttacattgtgaaacgaagtagtcatgaacttgaatgggatggcaaatcatttagaagaacaatacaagaacatcagtttggatcatgacatgtacatgtgttttcactcacaatgtaccaatgtcatggacttggcagagttaaacaaaaggtggaaagcaaaagcatcataaacaacgtttttataagtccattttgtttatccaatgtcggtgccatcaggatgccaaaatggaatcaagccgaaaagatgatgggccctaaattatataatcatgtttataaccctaggtgatcatatctgtcttatctaatgctccattattagaataaatttgcaggtgtgcctggcttctagtacatagagagatcatggagcagtatatgttccttcactcctgaactatataatgccaactaatcattatggcataatttgcaggcatggctgctgcctagatagagatcatggagaagttacttctctcctgaacaataaaatgccaactaatcattatggcacatttcccagactagttaaaaactgctccagtaactgcatgatccttttcagccggtttcagtattggttaacttaaccacagagcagtacgcaaaagaacatgtcatcatattttattaaattgagcagtcaacaagaacttctgagttgcaaagtagagcgtcttcagcttgttcaaaaagtggttaggataacaataaagaaagaaaaaggacctcaatcaatgtaagatgcttcccctgtctattgggcattgaaaacactacaactacaagagtgtattattacttattaaatgcgatcaaggggggtattcttctgcaaaatctgtgtgactaaaaatagctttcagtacaattacatgaaatgtgacagcaactaattcaaaagcttcatgaaagcggttcttacagcattaaattctgaagttacaaagctttaaccgcccatgtgcttgagtcatggatcaggccttggagctatataaattgtttgccagaaatcaaactctaaattccaaacatgttgtattcatttgaataaacaactgttccaataggttctgggtgaaaatgataggatatatgattagtttaataacaaaacattatgtggattatggaccattacactagaaatccacaaacaatcaaaatgcattaaagatcaacgaaaatttaccttctcaatctgcacaataataatcctgtttggactgttaaggtcaaccttgtgaggttgaggaacagatttggatactgcattgataattttcatcctattgattcttgtattcgaccttgcttcataaaacacaccaaaactgcaaagattaaaatatccaagtaaagaagcataattttagcaaaataacatggggaaaactcaattcacattttcttagtactacagtcagctcttgcaacttcctgtatttacttggcaatcgtggtgtatgtcgcatatatttttgtattgggtggataaggggcataaaatattgtttggtcacctctactccctctgttcccaaatataaacatttctaggtttttagcagagattaaggttaaggagaaaagactatggtgccctcctaactgagaataggagggtggttggggtaagattggaagaaatttgactgagtggtggttggtgggaatagtactctaggaatgctttatatttgtatacaccagtaccatattccaaggctcattatgtttgaacttcaaatggagaacaatgtaatgaaattaggaaaccaaacttatagggaaattaaattgaagcatatgagcccacagacaaatcaatgtaccatactcaaaaaggaaaatagatcgaatgtacataccagtcaacctacacagcaatagaaaaggacgttgacccatttggcacaaacaccattgtctgagattttcattagtagcccaattcctatcaatatgccaaatcaaggccaaaagcatgaatgcatcaagagtttagtggtagaaaaaactatatgtagttctttccaccacactttataatttaggtgtgagctgagctaagataattaaaataatacaggcaagtggtgctatttgtagtattatcaaaagtcagtaaagcaaagtgtcaacaggcgagaaatattcacccagggagaagaaaaccatatgttgaataaccaggcctttgcagtggtgttctaccaaggtagcaatggtacattagcaacgaagttatcggtatagctagcccaataaggcagtcatagaaatattttcccatttaaatcagctattgcaatatagaaaacttgcattagctttttttttctccctaaccaggattattggcaattgctctggcatcccaactaataaatcatgctataattctaccactaaactatatgtaattacatctaccatatgatttgcaagaaaacagggcgatggattttgcctggtgttgccaatgctgaagcttgtcagtgtgggtatcctggtcaaatgtcagctgctgattttgctccccattgccaccgattttggtccccattgtcgctaattcaaaatccttgacaccagtgcagcccaaaacagagcaagttctgtgggagtgaacacacattagttttggttcctggaggtttaagttcccttaaaagacagtacatgttctggattttttattcagtaatatgtgtttcagcattaacaccttaatctattctccccccatacatgctactaaaaagtgcaattattagtggtgacatatcctgtaaagatgtagaagtatatgcgatcacaatacccaagtcaccaggcaataatgcctcagagctagggagaccaacctgcatgcactgctttgaattgtgtccaaacaacccacaaacaaagcaaggcttcttccgccttttcattggatagctcacaactacatgatcctccctcctcagcaaggtatctcccaggatcaaaatatcttggtatgccctgatcatgagcagaagcaactaactattatcttgtgcagcttgtacatatatacaaggaaattcactttgaacttacagtactgtcaaataaaggggcatcaggcccatcttcagtgagcactgactctacggtgctggtttttgcctcctgaataatccattcccaacaaagaaacatctgacgtcaattccaactcacaaacataaatcagttccctatatgtaaggtttccataccataataaattcacaattagttcaatacgcatattttctaagagataacaacataagacattatttttaacttggattctacagaactgaaagagcctttccattaaaaaaaacattgcattgtctttcagccattttcaaagacagatattactcagtatagctcacaatccaagtcgattctggctgcgtttgtttaaataaggcctccgattttcttagtcatccatgaatcacagatttgcttgctgaactaaatgcataaatagtacatgaacaagatcaagggaaaagacctactcgtacctactcctcgatggcggccggttcagcctcgggtgcctccttccgcgctgcttctgctcctcctcctccttgcgcccggcctccacgggcacggcgcaaccgggcccgccggaatcgcgcggtaggcggcggcctagcggtggtctagtcacggccatggaaaagagaggagtgacggacgacggactgccgtgcgaggtcggggagaagggcggtcggatcttggagtgttctgcgacgagggcgagtcctgcgatcggctgcagcggctgaacggagcggcgacgacgacggaggtgatcgggatcggcgacgagccgcggcgctagggttagagcgggggaggggcggagcagtgtcagcgcgtcctctcgatgatggtgaggagttcagtgttttgtgtacattttctttgtgcatttaagaaagaaatgaacggcttcgttttatattaaaaaaatagaaacattatattagcatagataaacaaagaacaatagcagttagtatacccacgttactacattcgtcccaaaatataacaatcgaatataggatgtgacataaacaaataattatagtgacaaaataggtagaaaaattcaactcaactgtgcggtcaaatttatcagttggttttataactcttaatcactatctgacacttgatgtgtatggagtgcttgggcgagccggccaagcccgatgaacacagcggcgctgcccgggtacagcgtgatggcctggtcgtactgtcgcagcgcactcgccgtaattgtccttgtaccgctcgttcccagccccgggtcacctcctcctgaagactcactccctttgctgcattgatggggcaggtcaactcgccggagaccttgagtagctgccgtggtacggactagctcccaccacaaaaaagaagcagctcttccacgactctgtcaccattgactctatttattattatggtaaatcattgtatcaagatgtcaatcttagatcttattccagttcgatacatccacctacgattggtaagggggtcgacgattccatagcttctcgaatagtgagattcagttttaagggaggaaggaaattaaaaggaaggagagttgggaaccaatggcaaaaaaagtagagagaattctttatatgccactgaaaattggtctga

SEQ ID NO: 83607 - DNA, 9944 bp, Oryza sativa
  unsure (1)..(9944): unsure at all n locations
cttgccgccttcggcctactcccgcctgttgccgtccactcctcaaccgcgtctccgctgcttccatagccaccgccgcagcgggctcgccttcgccgccacgtgtcgtcttacctcacgcggctgtcgccgtgctccgggagccccgccatgggcgtcgtcctgctcgtgtgcgtcgatggccgccgccgctccggttacgctgcgccccgatgccgccgccgctctcctcgtccgtgcgccgtcgcgatcatcagtggaccccagcggtgcgccgccgcctccccaccgaggccgagccgggccggccgctcgctctcgccgccctcccgcccgccgccgaatgggaagaaggggagagattgagagaaagagagagaagggagatagggaggaggaagaggacagacatgtgggccccacatgtcagtggcccacatttctttttgtgccaatgactaatgggtcccacgcatattttttaatcctactgccacgtaagtgccacatcaacgccacgtggaccgaagactcggtcaatatcgccacataggcgccacgtcggcgaaaccacctcccaaaaccggcgagggagtcaaattgcaccggttttgcaagttcgggggtcaagatttctggtattgaggttgggggatacgatttagattccgtggtcagttgagggagtcaaagtgatcttattccccagcaagaagtgagtgtcattgccacgcgatttcaaaacaggcccaggaacagaattgtcattcccgtgataactgaagatttcgtcagctcagttgtgcctttccgggagctgtaaggcggtgttcttttctcaagaaaaaaaattaagtgttttattcaaaataagttggtatttacgtatgattaattgagttttaatcattacaaactaacaaaaatagattaatttggtattttatagtaactttcatatagaaagttttcatacgaaacgtaccgtttgactgtttggaaagtgtgtcacaagtattcaaaattttatccaatttttattggagaaaagaatagaccctaagattttctctttaatagaggaaggagctcaaaattaagcaatttgctgggtagtcaacgggtgaaaccaggttacctagctataattttctggattacatagcaactgattatcggaggttgcagctagcagagctcccaaacagggtttaggtcctgttttttttccaagagttggaagaagattaaggttttcatggcacgtttttcaagctgctaaacggtacgtttcacacaaaaactttctatataaaagttgctctaaaatatcatattaatctatcttttaagtttataataattaaaactcaatcaatcatacattaataccacatcgttttgcgtaaaaaatttagttttcatcttcaagagaaaagaacaccaccttagtccacgttcggttggagaggttggaaaccttttctctggacacggaaaacagggctatttattaccatatgattattaagcattagctagaaaataacttaaaaattgaattaatatgattttttacaataacttttctatatgctacatcttgattaattagttgataaaatggataaaattaaaggtgacaaccacctcactataaaacttgctcttaaaagtttcgggagaaggtacagctacaaaaagctccaattagagctttttagctcttgtttgtttcatagtcactcttatgacaagattctttctcgttttttaatccaaaatgtcaactgttcaaaaaagtgtggcgcaatcctacttttactagttaaaggtgtgactcacctttttttattagctaaaatttatacatgtatgaaacaaaagtatagaaaatgatgacaaacttagtatggcatccaaccagaagttttcggctaagccggcttagctgccatgtaagaacttcacacatggttcttccggtcccggcctagctgtatactcgaacggtatgaagaaccatgtgaagttttcgcttagctgcatgcctacttacatcagttctttctaatgttgagacgacgacgacgacgatcaatacagtcagctaagacaaccgatgacaattttgacgattagttgtgccgtagctttcgtgggtgagctactgactgtgaatgcacccagccaccacctcgtcgtagaggcatcctgacaggtctcactcactcacggcctcagacgggacacgggcatgtgcacaggggctctgatcgactcatgccgtttttgggtaaatccgttatctgtctacgatagatgcggttcgtgatcactgatcgccgtgttcttccaaattcgcgaaacacgctagtctgtagggctcactcccgtttgctttgcatttacgcgcggtactggctgttaattatcgttcgaagttgacacttgacactcacagatcaagttggtttgtcggtgcgcattgtgaacaattcaacgagatgaatttcgtacaaatttcataggagatcgacagatcgttatattctcaccagatcgaatttttatttattttttaaaaaaaggcaataacacttctggactattattaccgctcactaggttaattttcaagctgaagcctatgtccctttgtcaaagagatatacactctcgaggctagtttcttaacgtggtgtcttcgataatgtgtgtttggttgaaaggatattttgggataaaaaatgttgatggaacttttatgcatgtttggttgatgtgcaatgatggatagggtggtcggaaaagggaatatttcacaaaggtgctggatgagtgtatatgttcaaattaatcgattagcaataattaatatatttggttgttaattactccatccgtttcacaatgtaagactttctagcattgctcatattcatatagatgttaatgaatctagatatatatgtgtgtctagattcattaacttctataaatgtggacaatgctagaaagtcttactacctccgttttttaatagatgacgccgttgactttttctcacatgtttgaccattcgtcttattcaaaaaatatacgtaattataatttattttgttatgagttgttttatcactcatagtactttaagtgtgatttatatcttatacatttgtataaaatttttgaataagacgaatggtcaaacatgtgaaaaaaagtaaacggcgtcatctattaaaaaactacattgtaaaacagagggagtaataattaacatgtcattattaatgtttgattagatataactggtcaatgttgttatttattagtatagattagggttcaattagtgataattaacatattttgttattaatatttattatttttatttcatccattctcatacatccaacgaataaaaaaaaattcttaaccatcccacgataaaaaattgaataaccatatccttgaaaaaaaaactgagacatcgtactcgtaagcacgatgtccctcatcatatcaggtcgtgtttagtttctccctattctcaactttccatcacatcatatcatatcaaaaaatttcttatacacataaactttcaactttttttttccaaaatctcaattttttttaaacttccaacttttctgaggaactaaacacacccacaatacactgttaataaagaaaacatagacctgtcaactttatttcatgtcagccgtcaactttgtcaaactttttgtcgggctgtaaagtcctaaaaatccttctacagtattttccctagcactagcctcgagcactcgatggagtagcgcgcggagaagcaatagtggcgacccaataggtttacaataggattttattgagaacgagaatatgtcacgggagtataccaaatgacgtattcacaggacgtgaatgtagtgttccaatctaaacaaatatataccatgcgagcaattattcaattaagcgtatctctcatcttttattaccagcaaggaagttttgtaataaaaaaaatggtttacatctccgaattgccaatgagcaaataattcatattcattgtgtacacgaggtaaatccattcaaaatactcctagaactacaaatctagacatgttcatatctagctttatagtactagaatacgtcacatctaatcaaaatactttatatttagagatagagcatactcttcctctgtccctaaataactcaaaccctagcttctcaaggagtttttaagaagagaaacaaaagaccacgatgcccttaattaatgtgaatattgtattgaataattggtaggtaagggtattaaagtaataaaatttctcattttgcggattagtggtaagtataagaaggtagaagttgatttattttggaataaatttgaactcttcaagttgatttacttcctcattagnnnnnnnnnnnnnnnnnnnnnnnntaaaacgtgttgttttgaggtttctcaccaaaattagtatccagtgcaaatgactgatttaccctcatttatttcattcgccacacacaaaacaaaaccgccgttggagggtggggggaggcgaagagaaagacgaagccgccgtcgaggacaccgccacaggcgtgctcctcggagtcgagcacaaagccaccaccgggatgcccgcgtcaaagttgtagccacctgcatgttgctcctcggtgagggagtagacgccgtcggcgccgagcgcccaaccaggacttcgcctgcaacctcctcgttctcatccacttgcctttgcttgatgcgcatcgacatccgcttccgccgcctgtccattgcgtccggtcatgctagccagctgcattgtgatctccacggcggcgacgaccggtgaatcaacgcgcgcctgccgcgccactcccgcgttggagaggagaggagataggtgagggagagtgggatactaggattggggattgcatgagggacggggagggggggtggtggcgatggaggagttgaggcgagagggatgacggagaagtcgatgcgagagtgcgagacagcgagaggataagatcgcattaagtggtgagaggtcgctcgctggaaaaataataataaaaaagaaacgagtgattgagggaagtagacttgagccgttaaaaactcaaaagttcgaactgacacaggcgagccgtacacactgtagttatgtggtgcactggtcggttccgctgaccacccgtgactcttaccacgaccccgtccccggtgtggccccacctaccagcgacacacgcaggcggcttcttctcgtgagctcgcggtgaacccgaccacccgccgctgataaacgtcgccccccttgccacgacacgcgctacgcccacccatccactcgcaccccgcgccgcaccaacacacgcagaggtggtgaactggttgatcgatgcttgctgctgctgcgcgtcgaggcggctccatcggcggcaaccgctgatcgatcgatcgatcccgcgggtttcgtagcacccgagcaggtgagcgagcgagcgatcccctcccgcgcggccgcgcctcgatttggtcgcgattggtgctggattttctctctctctctctctctctctctacctttcctgtttcggtgggggttttggtggggttttgtggctcgaggtggtcggggatttctggggtgatgggagaggggctcgcgtggtggtggattgttcgctggaatggcggggaatgctgtgccgtttgggggattgatgccatggtgatgggtcgaaatgctggatggggttgagtttgttcaagtggttttgaattggaatctgtggagtttggggggaaatggggaatggggcttcgagtgcgcaaaggttttgcatgtgcggaattgcagctcgaggttttcgctggatttaggcgtagcttctgtgcgcgtgtttgtttagcgattttagcagttcgtgggctggtgccgccgcgtgtttgaatggtttagcgctttatttaccgttacagttgatgtctgcggtttttctggtgatttatgccagtttttagaggtgaatcgctgtgttttgggggaattctagagcccagggttgggtttatgggggcgagattttagctgttggattttaatcctatattgcgagaagcatgggagaactgcgatccgtcgtcagaggtgaacgctttcgaactctgatggttttaatgtggcagatattgtgaagcttatggtagcttcgttaacttgatcgacgtttttacttgtgctgctcgtgcgttgtggtagatttggcttgtgagagagcaggtggatggggtagattcagattacagagtggtttactgcatgtagcgatgtgtttgagttgtaacttgtgaggctgtaagattaaaatgttggcatgcgtggggtttttgggggtaatattttgttttgtttttgtttttgttttttgctagtgttttgacccaatccatctcccccatctttttttagtggaaaaccgctccctgttggtactactcaagtaaacttaccagaattacaatcctccaacaaaggaataataccctgtgctgtttgttgtgacaacttatctgtacatgatattgctagtttgctactgcagtatacctacatgctcacttatgtttgtttcttttagataatgtcacttatgtttgtgttttgcataatgttgataatttctcgaagaatgggtgctggaaagaagactcagaccgagaacgagttccgtgagctcccggaaaaggagctaggaggggtggtcttttgttgcaataacaacacattcgatgaatgcttcactaaacagttatttggttagtaaaagtcccttttcgcctgtcctaatttcatctaaatgatatgtaaaatccatacgcgtgtgattacttttattcaagaacattgacattgctaatcaacattcttttgaacttctcgtttaattgggaatccattcgtttgccttttgtttgataggtttgcctcaacgcaatatcttgtatgtgaagaatgttaaacctggcttgcctctctttctgttcaattatagtaacagacaattgcatggcattttcaaggctacaagcactggccagcttaatatcgaccgatttgcttggatgtctgaacagtctaatgatgcaaagacaaatgcaaagacaacaccatttcctgcacaggtataatagaaacaacatatactggtctttgttctggttatagtttcataagcattgtgagtatttgtgttcttcaggtccgcttctctaccaggacagagtgccctccacttccagaaagcaaatacaaaagtgtaatcataaacaattatcgcaaggataaacctagccacttccgttttgagctagaccatcgaccaacaagagatttgatttctttgtttctacctgctcctgttcgcgctaatcaaaacaaacttagtattccaaaacctcctgctaccgctcatactgttccaaatccatggaatcgacctctgccatttcttacagcaaaagcacctgttgtttctgataaagtgaagagtgaatccaatgtgaaggatgtggatcagttcaatgtttcatcacactcacatgatattgttcctcataccttgcctgatgtagaagtcgaccttgctagcacaagtacaacatcaaggagcaaccttaacaaagatgcttctggctgtgatgacctggttgctggtttgatcaaggaagataaagaatctgtggatgatgaccagcatgctaaaatggatttaccagtaaagctgcaagagctgtcttctttacaacagaaggaagccaatttcttggaggatgctcctgtttctacttcagctcaaagcatacgtcaagatacacggtttgctgctactctccccaaagattcatttaatgccacatctcaatgtgacacatcattgaaagatacatcctttgtgcaatgccatgaatatgctgaggtgccttaagctattccatcccttattaccattttcccttacgcaccatatttcagtgctacaacttatatattttggtgcgatgtttatggcctgctttttggcatttgtctgtagctgtatcaaattatcaatgatttatccaagaagaccgaagaaatggaaaagatgaaggtacttttcttcttgcttaaaatcagtaggatcttctcttttaaagaagaaaaggtataaatagatgaacccgttttcctaattggttttatctcttgtcagtatgtctggttttgtgggttttaaaccatgttcaaattttaaccggaaaaccaaactagtatatatgtgtttgatattgagttaattacgctgttcaagtgtgcaaactccgatcttgattatggtttgaacgttctaggttgattcagatcaagaaattttgttgttgaagaaattggtaaaggttatggaaagaaaagttgaacatctggaacagcagcttgagaaatcgcatagctcttcagcaccactcttcggtgtaacaaatgatgatgtagaagggccatcaatactcctaacaggtggccataatggcattaactggctgtcatcccttgatcatattgccctgcaacggacatactagaaactctaatgccaatgagctcagcccgtgcatatgcggctgttgccacattaaaggaccatgtcttcatttttggtggttggaatggcattcgcagttgtggtacaacacaggtaaacattcttcaatatgccaaacgtagtgctctatataagcaagctgttgaccatctgcatttgtttattgcagtggagtgctacaacaggggagccaataagtggataggattgccctgcttgaatcatgagaaagggcatcttgctggagctaccttgaatggtaaaatatttgctattggtgggggtgatgggtctcagtctttttcagaagtagagatgtttgatccagcagtggggaaatggatatacagtttgtccatgcagcaacctgtatggttctacttctactcccttataacacttgtatagagtagaatgtaccagcctttttggccaatttaatagggtcctggtcttcgctatgttctcactgtgattttcttgataaggctcaagatttattagatggcccaggaaaaaaacatgttgtgaagagaggctgtttgaactgcatttcctataatcacttacatctttgggttcttaatcttttacaagatgaatagtgctgctcacagaacagtttctactattatttcaatcatttcttacgtgtcgtaaatcagtaaaaaagtttgttctcgtggtgaactatgctgagtgatttagaatttagatagctgtttgagcagtagtgggcaagctgactgtgagttggacattcgcttgagcactagtcttacagggttggttggaccatttgcaaatctaatctaagctacattttgagcacttgaataggcaataaatatttttcaaattcaggctatttcaaattatggaatgcaaattgcaattcatgtaatttcatgggatttatgaggcatatacattgtaactttccagttcaccttgcatgaaatattatcccatatttttaatgtatttttatttttgaccaatatacccacctcaccaacatgtattttattgttccagcgatgtgctcctgctgcggctgaattaaatggcgttctctatgtaattggtggttatgatggcaacatgtacttacagttacgatccaccctcaccattctctccatgctttacttgattttgattctgagaccttcctattgaatgattgatcctcatatgcacaggtcagcagaaaggtatgatccaagggaaggcttctg

SEQ ID NO: 83608 - DNA, 5298 bp, Oryza sativa
agcatttggcaacaggaaaaatggctctaatgaacccagaaatgcagaaaagcggttcgcgtcatggtcctgtttctttcagcttgggattattataatccagattattagtagtaagctgaaagaatcagacaacttattgaagtagcttattataatctggagcccagcttattataatctgataagctcatttaggtgagctttttctagattattgggtgaaaaattacccaccatatgccaccccactccctcattatacttgcaaactcaataatctaggctctaataatctaggaaagaaacaactaacagcttattctactatagattataacaatctagtttatagtagattataataatttcaagctgaaagaaacagggcctatagttagagagaatcctccacctgaatttcgtgtactacctgcctctgaaatctcgtacacgcagcttgtccttcaagctcgagcaaaacctttgctcctgtgctagtactaggcagttaggcagacctgcagctgcaggttaggatatgagaggttaggctcatattcgttgcttagcatcgttgcactgcattccacaccaacacacgaacactgcattgttccacagtccagattccccacgaactgatctgcctctgactagtacacggcgcaaaggagaattcagcaccgccaacagtagcagtaattcactggattactggcgaaattgttgcagctattattcccgcctgctcccagcaagcagaacctgaaaagttgcttcaaaaaaaaaatcaaaaattataccagcttccaagcctcccatatgtactgctatcaccagctaaagtttgttcattcgaacttctctaagtaactagtgtcctgtagacagttcagtttgctccgctacaatcaggtgacaaccaacaacacctatcttcagtgagaaacaacaacgggcagagttaacgcataccagaactcgctacggtgttgtttctaaaatgtaaaaaccgtatgactgggatgcacagaatggatgggccgtcaggcgtcagtgctcagcaatgagcggcaatatttcgcttgagagaaggtaatactgtgaggcggggttggggactggtgctgtacaaaaccggcccgggggttcatctgcacttctgcaatcctgtcaaatggcaacggcgcatgcgaaagctctcttcccggaatgccttggaaccagagatggaccagccttggccctccttgtaaacctcaacctgtgaaataaaaaacaaaacaaaataaaacgagagaaggatgtgagagttcggcgagttgaagcaacagcaatggatgatggagagagtgatcttgggaaagaactcacagtttcaacgtattcttcactgctttggataccaccaatgaggtatgcgttgccgtccaatgtaaccgcacatccgtgtgctcttgggacgctgagtgggctcccccttctccatgagttggcacgggtgtcaaaaatctctacgctggaaaacgtggtatttctattcaggccacccagagcatgtctgaaaatgaaattcccatgttggatgttaagtcgtatattatcaggtttatatcgagacgtcaaataaaagatagtgatataaggctaatagtagcatctaactgccaggtggaatctgtgtgtgtgtttttttgaaatcacatgacctctctgttgattacacacacagataaagcgagcgaaactcacagtgaatcccccaagacaactactgaatgggatcctcttcttgtccgcatacgtggaagttgggtccagaagccttcccttggatcatacctttctgctgacctgtgcatatgaggatcaatcattcaataggaaggtctcagaatcaaaatcaagtaaagcatggagagaatggtgagggtggatcgtaactgtaagtacatgttgccatcataaccaccaattacatagagaacgccatttaattcagccgcagcaggagcacatcgctggaacaataaaatacatgttggtgaggtgggtatattggtcaaaaataaaaatacattaaaaatatgggataatatttcatgcaaggtgaactggaaagttacaatgtatatgcctcataaatcccatgaaattacatgaattgcaatttgcattccataatttgaaatagcctgaatttgaaaaatatttattgcctattcaagtgctcaaaatgtagcttagattagatttgcaaatggtccaaccaaccctgtaagactagtgctcaagcgaatgtccaactcacagtcagcttgcccactactgctcaaacagctatctaaattctaaatcactcagcatagttcaccacgagaacaaacttttttactgatttacgacacgtaagaaatgattgaaataatagtagaaactgttctgtgagcagcactattcatcttgtaaaagattaagaacccaaagatgtaagtgattataggaaatgcagttcaaacagcctctcttcacaacatgtttttttcctgggccatctaataaatcttgagccttatcaagaaaatcacagtgagaacatagcgaagaccaggaccctattaaattggccaaaaaggctggtacattctactctatacaagtgttataagggagtagaagtagaaccatacaggttgctgcatggacaaactgtatatccatttccccactgctggatcaaacatctctacttctgaaaaagactgagacccatcacccccaccaatagcaaatattttaccattcaaggtagctccagcaagatgccctttctcatgattcaagcagggcaatcctatccacttattggctcccctgttgtagcactccactgcaataaaacaaatgcagatggtcaacagcttgcttatatagagcactacgtttggcatgttgaagaatgtttacctgtgttgtaccacaaactgcgaatgccattccaaccaccaaaaatgaagacatggtcctttaatgtggcaacagccgcatatgcacgggctgagctcatcggcattagagtttctagtatgtccgttgcagggcaatatgaatcaagggatgacagccagttaatgccattatggccacctgttaggagtattgatggcccttctacatcatcatttgttacaccgaagagtggtgctgaagagctatgcgatttctcaagctgctgttccagatgttcaacttttctttccataacctttaccaatttcttcaacaacaaaatttcttgatctgaatcaacctagaacgttcaaaccataatcaagatcggagtttgcacacttgaacagcgtaattaactcaatatcaaacacatatatactagtttggttttccggttaaaatttgaacatggtttaaaacccacaaaaccagacatactgacaagagataaaaccaattaggaaaacgggttcatctatttataccttttcttctttaaaagagaagatcctactgattttaagcaagaagaaaagtaccttcatcttttccatttcttcggtcttcttggataaatcattgataatttgatacagctacagacaaatgccaaaaagcaggccataaacatcgcaccaaaatatataagttgtagcactgaaatatggtgcgtaagggaaaatggtaataagggatggaatagcttaaggcacctcagcatattcatggcattgcacaaaggatgtatctttcaatgatgtgtcacattgagatgtggcattaaatgaatctttggggagagtagcagcaaaccgtgtatcttgacgtatgctttgagctgaagtagaaacaggagcatcctccaagaaattggcttccttctgttgtaaagaagacagctcttgcagctttactggtaaatccattttagcatgctggtcatcatccacagattctttatcttccttgatcaaaccagcaaccaggtcatcacagccagaagcatctttgttaaggttgctccttgatgttgtacttgtgctagcaaggtcgacttctacatcaggcaaggtatgaggaacaatatcatgtgagtgtgatgaaacattgaactgatccacatccttcacattggattcactcttcactttatcagaaacaacaggtgcttttgctgtaagaaatggcagaggtcgattccatggatttggaacagtatgagcggtagcaggaggttttggaatactaagtttgttttgattagcgcgaacaggagcaggtagaaacaaagaaatcaaatctcttgtttgtcgatggtctagctcaaaacggaagtggctaggtttatccttgcgataattgtttatgattacacttttgtatttgctttctggaagtggagggcactctgtcctggtagagaagcggacctgaagaacacaaatactcacaatgcttatgaaactataaccagaacaaagaccagtatatgttgtttctattatacctgtgcaggaaatggtgttgtctttgcatttgtctttgcatcattagactgttcagacatccaagcaaatcggtcgatattaagctggccagtgcttgtagccttgaaaatgccatgcaattgtctgttactataattgaacagaaagagaggcaagccaggtttaacattcttcacatacaagatattgcgttgaggcaaacctatcaaacaaaaggcaaacgaatggattcccaattaaacgagaagttcaaaagaatgttgattagcaatgtcaatgttcttgaataaaagtaatcacacgcgtatggattttacatatcatttagatgaaattaggacaggcgaaaagggacttttactaaccaaataactgtttagtgaagcattcatcgaatgtgttgttattgcaacaaaagaccacccctcctagctccttttccgggagctcacggaactcgttctcggtctgagtcttctttccagcacccattcttcgagaaattatcaacattatgcaaaacacaaacataagtgacattatctaaaagaaacaaacataagtgagcatgtaggtatactgcagtagcaaactagcaatatcatgtacagataagttgtcacaacaaacagcacagggtattattcctttgttggaggattgtaattctggtaagtttacttgagtagtaccaacagggagcggttttccactaaaaaaagatgggggagatggattgggtcaaaacactagcaaaaaacaaaaacaaaaacaa

SEQ ID NO: 83609 - DNA, 2401 bp, Oryza sativa
tcttaagatgtccatctagaaaaataaccttatttttttttgcggctgcttaacaggatcgtctgtaaaaatgtgagtcgatttttacagacacagatacttggtccacctgcaatctattgatgtggtcgtccaggaaaattatttttaagtagtgattatttatgttggtagctatattattctccatacagataggttttgctattttacttgtgacaggttttggggcttctttttttatattttgtttataggattttgcattaagattcgtgtttatgtaattctaacttgcaattacactcatttatttaatacgtttcatgtagtattaaagtaccatgacgtcttttttctttgggcctgaaactgaacgaaagaaaatggatgtatttttctcattctttgtagaaaggagccatataaacgctatgtcagctaaaattgggaagctgaggaattttgtttgcacttgttttgaatgttggaagatgcattgtggctgtgcttagttcccttcaaacttccaaatattccgtcacatcaaatatttggacacatggataaaaaaaataccaattgtacagtttccatgtaaattgtgagacgaatcttttgagcctaattacgccatgatttgataatatggtgctacaataaacatttgataatgacggattaattagatttaataaattcgtttcgtagcttacaggcggaatctgtaatttgttttgttattagtctacgtttaatacttcaaatatatgtgtccgtatactttaaaaaagttttggctgtggaactaaacatggcctgtctctggttttcgatcgagggatgattttctaattcggtgataagatgagggatcttcgcagtactttttccacatcaaaattacagattttgtatgggcctcagacatctggcccaacaagggtccgactcattcttcaattttcgaaaatacgtaacctctggtatctgactaagcaaattatgtacgtactcaaaattctaaacttacagtatagttaaatttagcacggttttccaaatagtaagtgatttttaatttgtcctatatatttcgatgtttgtaacaacaaagactaattatagaaaattacattcaaatctcagttcaacggtattaattttatcaaataaaatttaatttatattagatttattggtcgtgagatattaccagggttgaattaatatttatgcataccttgtattttttttggaaaagagggtacaaatggttgactgaaaaccacaacaagttttcttaatcgaaaattacatcaagtttgatttgcagcaaactaataaaatcataaaaaaattacaacacaagcacacaagggcaacaacaattaaaaaatagaaacacaaaagaaccacgtatccaccgtccaattagaactccatgccttccaaattgatgaaactgtaagtgtcgcaaatgcaggcacattcatagggagcctagcccttaggagggcagatcgccggccggaaagcgagtgggccggtggcgtacatgacgttatagtagtcatggtcagcccaccgcttgccctcgtcatggagcggcgcaccctcaatgctagagtagttgatgtttgtggggttgttgcattcgaagtccggcgaggcccgaagccgcacatagcacgccttgcgcggatcgcccatgtagaagtcggtgactttggtctcatcgagctccgcgcggaagtagccgttatcgttggagacggcctgacgacacctcaccatggcacgattcttggcgtcgtggcagatgatagacacttccgccttaggcagcggcttcgcgccttcgaggctgtgtgtgttcctttgcgcgcagctctggcagtacaccataccctccaccttcaccagcagcttgtcgctgtgggccggcggggtgtactgctgtggcggaggtggtggcggcgatggtgatggtgtggtgtagccatagtttgctgtggcgccggcggccatgagggacgcgaacaggatcgcgagaggaaggaagtcagccattgctctgagcacagctccgtactcgactgatgagatgttttgttttgaagctttggctgtgtcgaaacgtagagaagcgtgtgggttatatactgcatgccatagactaaatgtgcggacatgtagatggaaattaaacttgattttggattaagatcacagtttattttttgttattcgattctgacaatatatgatgatttgcccggcgaaagaaatgataacatgtaacgattgatctgtaaggcactttaagagaagaaatgacatgctcatgatctgcttggtgattagttttgaatttgtagactataattctataaagaat

SEQ ID NO: 83610 - DNA, 5475 bp, Oryza sativa
tgagtctagggctgtgtttagatccaaaatttggatccaaacttcagtccttttccatcacatcaacctgtcatacacacaacttttcagtcatatcatctttaatttcaaccaaaatccaaacttccccctcaactaaggttgcgtttagtttagcgaaaagtttggattttggttgaaattggagatgatatgacttaaaagttatgtgtgtattgatgtgatggaaaagaactgaagtttggatccaaactttgaatctagttgagggggaagtttgtattttggttgaaattgaagatgatatgactgaaaagttgtatatgtataataggttgatgtgatggaaaaagactgaagtttggatctaaacacagcctagatgcatttgatgcatctgctactgcactgcagctgcacagttggtaatctgtccttaacttgactggatgacaaggaatttcctcgtaataatatcgcttgcactgtaatcaatccatcgccatctcttcaacgacaagatatgagtaccatacgagctgagaagcctgagatagaggagctgatgtgacagcactcttgaaaggcagaaaaaaaaaagccagcagcatcctccccttttttgtgccatatttttcaaaaattaatgattctcactttctttagcagcgcaaacagatttagtaaagaatttataacttaaagtttgtactgacaaatattctgagtataataaataatttagtaaagtaaaatataaaaccttttcccactgttttggctacagttaattatatactataacacttattaaaggtaaaaaattatgagtaagacttttagatgtgtattacgatgaaaaggcatcaaaaattcaaaatcaaatttctttcttagcaaacaaaagtattctctttgctacttaaaataataagtagtactatactattactttaaaaccaataaaaaaaataaactacaatgaaaagcataaacaatccaatatcaatactgaaattaaggtttgacattcacttttttactgtgaccaagttgaaaagcaaacgccaattaaaatttttcggagcacattcgttccagaaaaagaaaagtttgcgctttgcagagcactcgagccagtaccactcctcccttttgttctccagcgtccaatccgcatcggcgacgacgtcatcggctaaccgatgggccccacgaagcggaactcaggattcaggaagtgggtgggggcccactgggcagctgctcgtcggggatccaagtcatccgtaacgcgtacggacgtggcaatccgagttgcacacgtggccttctagaagcccgagttccagcccccgttcacacctcaggcctggctgtcttccccaattctcccttttccttccccaattcttctggtcatctcatctggtcatatggggtctcgtttggttcacggaggcattgatgcgtgtgtgagtgtgagatgcggtcaagttaccagtttttgccgctcgtggttttgaaaaaaaaaaaaaactgcaaaatccgctgcatcagaaaacggcatttgagtgcatatgaattccaaattttgttctaaatttgaggagaattcgaaatttcgaaccaacggaggagaggagagagagagagagaggcatcgcattctctcgtcgaaatggagggccacccaggcaaagcaaagcaaaaatcaccctccctatcggcctatcgctcgcctcacgccctcaccctcttttgtcggcttccccgtggtgggtcccacctcccaccatccttactatcccccgcgcctcatcggacggtcgaggaagcgagcaccggcgacggccgtccgatcccgatccgacggacagcatcgccgttcaaaccccccatccacgtcaggtcaaaggcgcgaccgcgtacgtgtccctgggccgcgccgcgcgagtcacgcgtgccgtggcgctcccctcccctcccctcccctccccgcgcgccgcacgtgagagggcctctgcaccgtcggatcgcgatcggacggccccggatccgccgtcagtggcacgggcccacggcgtcacgacgcggcagcgctgaccgccgcggcgggggagacggggccgtgacggcgtcaggatcacggcgaggggaaggggagagagagagagagagagagagagagggggggggggtataaaatgcgtggcacctccggctcgggtataattatcgcagcacacgaaaagagaaccagagagagagagagagagagagagagagagagaggagtggaagtggatcggggcatcgctgcggcgtcggggctgtgcagatcggaggaggtgagagctctcgtcctcgtaccatccatctcatcggattccgtgctgccgtggttgctaattttggcttggtttgtcgaattctttttgggctttttttggggtgctttttttggttggtattacccggggtttgcttcttgagggtgaaggcggcgtctccgagcggtttccggtggaagtctagtggtttttcggcgaggagatgggtttcagttgggtgagctaggtttattggacgaatttgttggggatttctgttggtttgagccgattcgatcgcgtccgagagcattttgctgttggggacgagagggcgcctccattttcgggattactgagtttatcctgtgcaaattttgcaaaaaaaattctactaattttggtccgtttcataggtgaatcgtcgcttattgagtggttcgttaggttagctcttaactgcgccgcttgcatttgttgccggaatttattattatctactccacgggtaactcgagggcgtgaagtgaaagctaattatgtcgcccaaagttactgatccctttttttttttgttgaaactgagctagcttaatttgcctctgttggcttgtggagacatgatgcagtacaaccaagtagcagcaacagtttttgccctgtgaaacactggaaccatgatcccccttttttgtgtgtgtttgattaggacataacttacaaaattctatgtttcacctgattagtcaattggcttacctctcctcccgatgacaaatccatcaaagaaattttcttgctggggggtaaagtgccactggagaagaacaaatcgaggttgttctgtgacttggttgtgtagttttatatagtttttagcattgtcaaccaggctccaggatcccagaaatttcactcctttgcttactgcatagactatacaagttgccctcttgtttgagcgatgaaggcgacgttgattccacacggttgattggtcaaacctcttgttggcggaggtaccttcttcagaattcagaggggtgatagaccaatagtcaaacaactaggttggtcaatgatcaatcgtcttcatccaactagagaatcttatagcctgcttgtgagtagtcctaattgtgtattttggaaggatcaaagaacagtccacgtcaattgtcttcaaccaactagagaatgtttgagtctgcttatcttaattgcaagggaagtcgatgaatattttgatgggggatgtataactttttttccttatcttttctcctgttgtttgctctccaaacctcattgttaggctggttctcctcggtagtacttagaatagcttcatttctccagagcttgttgtcctctagttgtatgctatgtggctgagcttgacattctggctagattaattggagttatgtgggagtgattgggatatttcatagataatgttcttcttttggagttgcgagcacacggtatgtgatgcaatgatggacttaagtaagagaatcgctatcagtttgtcttgatctatgttaaataagattagaatgaagatctaatactctttagtctttaacagaatagtataacatggtagtgtgtaagatcataacgtgatgggattctagtcaattggcatgttgactctggaaggcgaactcttgtcatgttggttgtttgcaatctttcttcctatatgatggtacatgctggaaattttggatcttaagctttgacccactcatgaattcatgattgacgatcacttcttttggccgaaatgttcgattttgacttctgtggttctcctttaagcttgaggaaagaaggatagagtgatgacggggacaccttgacagagaaacattgcggtttatgcataactctagagagctactttacaaattgtgctctatttatagatgaatgccaagcagaaaattcactaaattgttttaagtttgttttgataaaataaaaaaaagtgctcgagtcatgaatgtttaattttggtatttaagaaatcacggatgctgttgccgagaattctttttaccttgttagcattaatttcatcatgatctgaagtagctctagcttaatttggtattctttgttagctaagacatgatatttcctcttttggtgcatatgcaaattcctatcttttccccctaaaatctgcaaatgtttaatcagatttttatatgccatctcaattaacatttatatactgttatggattcatctgggtaaacttttttagtcttatctcagtctggttgattcatcttgttccacatgtgacatgtcttgataatgtagtgacagacaagccatttatgctaatttcatacatcctcatgataaccgggctgcgtttgtgtgcaatgttggctgtctgtttgatgtgcttttctttctttctatgatttatatgtttgtaatttgcactgatagagcaaaatgttctgttctgcttgtttgtttttaccacctcccatggaataaatggtttatagtttccttcttttgctatgtacaggtcatgaacgactaatctccgttcatttattatggacttgcaccagttattaaagtacagattgactggcgctaacgttgtgtacgaaattcctacagagaacaacttgcaaaactctccctggcaagctaacccactgaagtacgagttcagcgattccccatacacccctctctcttcccaatttgagtgtgacaatttgtctgctcttaccaacactccagataaccagagctctacagaaaccatttcagcccaaccaatctccccattggaagcagacagctcatatagacaggcgggtattcttctccaggagaacattcaagtgggagctgatccgttgtatgctacatcaagacataatatgcaacacgccttacgggagattgagactgttctgatggcacctgatacagatgatgcaacaactagcaccaagcatgagtttgaggaaatcaagcctgctcagcttgtgaggcagcggtcgagaacatggagtcatgaatcacggcagccgttacctggagttggtcggtcacagtttgcatctggtggataccccacagcaagctatgaatt

SEQ ID NO: 83611 - DNA, 3713 bp, Oryza sativa
cagtagcatataagggattatctcaaaaaagtatcatgttgctcctcggaaaacgcgtatagtagtctcattggccttcgtcgatgggatgtgtattttcatattaagagttcttaaaagttatcaactcaaagcccaaacgctacaatgttcgaaattctcaacttaacactagcgtcaatgctgcttcttgtgcacggagttcctaacgtaaagtcagagagatgtgggagccacttcccttcttgggagccacactgtccctcactagaccattcacaatgctttcatgtgacattcagcagaagcagagggaaacaaatattcgctgccacctcctccaccagcggagctttgccaagactatgtagctcaagtttgccaccggttcctcgtcagtttttgcaggagtggcctacgctagcactccgtgctaccgaaggagaaagagagaagaggagagagatgtgtcgtcgtccccatgctccacgtcgctgagctcgtcgcgaaggggaggagggtgaccgggcaccgtcctcgccggagaagttcgccggctcgatggggaaagcgacggccgcggtgaaggtcgatttggcgccggtgaactcaagaaagaggggagatccggcgagtcgtcgccatcgccgcccgaggctagatccggcaagcacaagccgaatatgcctgccccgccgccactccgcctggcgccatcgctgctctactcagctccgcgaggaccaccacgccgctactccactcggctccgcgaaacgttgctgccgctgtcgtcgttggggaaggacgagagtccatcggtagtgaggaaaagaggggggggtggggagagagaggaagaggagctcgagactgagacgacgaggtggagccccattccatgctgctcgtcgccaccactctgcttgccgccactcgggccgctcgaggaaggggagatgaggcagccggaggaggggaggcgtgcgattagtgggggaggagtggcgctgagaggataaggagagagaaaattacattttttatttgtgtggacctcacttaaagttacaaagcactgttaaacttgtggcaaacattattcttaggtgttattgaacctacgtgtcacatgaggttcggcaaaacatgaagccgcactgctaatacccttatgctaacatggtcatagtccccctcgccggatccaaggctggcgcgtcgctatgaaacaaaaggaaagcattctaggtgcgatatgacatggctggaatgctacgaaactctgctatccttttgttgcatgcattgcaagttgtgcaatatgcttgcaatgggaaatctgagcttaattttatatgagtttgcattttcatatgttcattgttgtgtatgctggttaaattgcgttgaatatgtcgctatatttttttatgaacttataatgtgacttgtggtttttcttataaatttgacttaacataaatccaaactgacttgtaatgtgaataatgtgcaacaaaagaagtagcaaacactaagtccgtcctaaaatataagaaattttgtatggatataacgcataagagattttagatggatataacacttcccttgtccaggtttattgtatatcttggggcggagggaatatacatacatacattcgatgctatataaccaattttatccatatataaaatcttgcatagccaacaatggttgaatttgataacttaaagtagtaatccatatgtcaacaagatacaccactttacacaaacacttatgttgctggtgagaattcaacccccaaaaaaaaaacactaactggaccgcatgtttttcttatcacgctacatcatcatcaatcaataactcccctaaccccaccgtttttcttatttttttgaatttttttaggctttctcgttgttttacacgtagctgctaacccctcctgctcctcgcgcgcgtgggggcaaccgcccataagaggtgcgccggttaatcaaaatttggtcgctgtggtggtgtgcatacgtcgttgagaaaatggggattataccatcctcaaaacagggcttcgctgaaatgccatcctataattgggattcgcccaaataccactttcaactgagcccaacccgctgaaatgccatcccaaatcattttcatcaaaaataaaagattttactctacttttcacatgagttgatgaaattacccctcagtcaatttcatccttagaaatcaatcggctgggagagcgagacgcatagggttagggtttcgtccgcggcgccgatctgggtgccgccgcgcaacctccctagcgccgccgcgccgccctgcccttccctccagccaccgctccgtcgtgccctcccctcgcaccgacgcctcccctcgcgacgacgcggcgcgcctcccctcgcgccgccgctccgtgtcgtcgtccttcaccagcgccaccgcgccgcgttgcggccgtcccgtggcgccgacgaggtcgccgccctcccctcacgccgcggctctcccctggcgccgacgaggtctcccctcacgccgcggctctcccctggcgccgacgaggtctcccctcacgccgcggctcggccggcgccctcccctcgcgccgacgcttggccggcgcgccctcccctcgcaccacggctcggctggcgccctcccctagcgtcgcggctcggccggcggcctcccctcacgccgtcctacgctcggctgtactgcggcccctctccacgccggtctgtcgccgtcccggatctacttgcaggagtgatgcagatggattccaatgtttatgatatatgaactcagtttgagtgattatgcattttgtggttgggagtgatttgcgaataatctgggaagcatgctcttaatgatgcttaactggtgttgtttgaatgctgttaatgatgcttaatgagtgatgcttacgtggtgttgtttgaggcacgctcggtgtggtagttcctaggatgtaaaggtccttttttcatatgttcatcacatcctgtgtatatggtactctatatcctctaaatcgaatgaaccaggggtattttggtcatcaaagttgtgagaaaagagagaaaatgattttgatttactacaaaggaagagaatgacatttcagcgggttgggctcagttgaaagtggtatttggacgaatcccaattgtaggatgacatttccgcgaagccctgttttgaggatggtataatccccattttctctacgtcgttgggtggaggggctgctcccggtgggagcctgggaggaccgggtatttttgtaaaaaaatcctcgtgtttgcacggaatatcacatacgtcctcggacagcctgacatcccgttttatttcttgcatataacccctcgtcttccaagaaaatacaatgtgaagaagagaaaattccgtttctagggataacgctgtaaacataaaaaccatagggggttttctgaaaaacgtcctacactaacccccaatcccgaaaccctccgccgttctctccctcccctcccctcccctctcacctctcctctctcggcgcgggttccggccggagctgccgccggagggcggtggcggcagcggccctcccctccggatctggcgagacggctacgtccgcggctagatccggcaccgccgccgtcggatctggcgacctg

SEQ ID NO: 83612 - DNA, 13115 bp, Oryza sativa
taattttgatttttacatatgcttttacctttattttatccaagtttaaatatatttgtgtattttttatgaattgtaaatttatttcatgttttggatagaataatttattctttaaccttttgtattaaaataatatataatttttgaataagtagtaagcgagtgacaagaaccattggattttatccatgtttaaatattttttgcgtatagttttgtattttatttatgaattgtaaatgtatttcatgtttaggctagaataatttatcgtttaaacctttttttcttaaaagaagatataatttattttgaataagtagtaagggaatgacaagaaccattagattatcactaaatggatttttaaaaagaaaaattgtaaaagcttcaagcatttttttaaacacagaacaaatgcaagtgctcacagcgtgtgcacaccctacccttatgagcatatttgaaaggctgggtcggtatatattgagattggtaaactcatcactggtatctcgctgtcaatgggtatgttacctatcactgaaagaataattagccgtaaatacgagcacccgtgttaagtgtacgacttgagccgaagtgggttagttccatcataagaaacctaatcaattgagttacgctcaccttgcaaaagttgagtatcgagatcacactctattgcctaccggagatgtgtagtggaagtaccactagtcgagatggctgacgagcacgcatggaagtacggaaaaatagaaagtggttttcattaaaaaaacataaaactctttttcttcagacaaatttcataggaatataagtgcaacatcaatttaaatagacatatataagtttaactgtttaagaggagggcatgtggtctatataaatgttctacttactccatcttataacaaatcaacttacttacatgaatttagatataaatgtgaccagattcgtttaaaaaagttaatttgttttggagtggaggaagaagtaggtgatcagtatgtgtccacgtacatacacatatgtgccccacggccacattggcagctaattaaatgtaattatggcgaacgaccaggaagtagctaggaacagcaatatgcaaagctttgccctaggaagcagctagcctatctcaaaataaaaagggaagcagatagccgacgatgcatggcacggcacggagcatgatgtttgtagcgtgtatgggcgcccaccgattcatttcatctgtatcgtccgcacttgttggtcgttgccctcgtgataagcaactaacctagctcgtgataatgatgaatcacaccaccgtccaccccacacccacagtcacacgttcacgtgaataaatgaaaacacaaaacagaacatgtactatgctaaaactagtactaatctactactataccccacgtcccaaaatataataaattttaccccctccatttactttttgatagttatattttcaaatctaaaaaaaatatttttgataggtatattttaattcttaatgactttttcggatttaatgcgtgactctccattcttccacacaagattggctatatggacatcgagaaatgtaaatattaatgaatcgtttgtttacgagaaatgactagtagtatgtttaaatagatgataagtagaattacttatccttgatctgtgtgccaagatgaaatatgactattaaaaatagatggagtgagtagcatttaagatttatcacaaaatataagaactttttcattaacattttttccccaaccaatcacaatcttctaccattcaatttattcacctttcctcacttctaaaccaatcataatatttctctattaaattacaagggcatctttgaatcgcagggttgaaaaaacggtggaataagaaaaacacagaattctgacaggaattgaagtgtaaaacaaaggtttgcaaaacacaaaaatgagattgtaccgcataaaaaacgtaggaatcagatgaaaaagattgactcaaaggaaatctacacggaatgtgttattccatatgaatttcatcggatttgaaaaactacaatattttaaattaaatggtcaaatagaaaacaatttataggatttaaatcctatgaaatttctaaataaatcctttgatttcatggagccataactttttcttcgcacctatatatattttgttggacagagatagtactattagctcgttgatcgatgccgttatccatgcatcttactcctgttcatccgtcgtcacacccaactctttgtgtcccaccagatcgggtgtatcgatcgatctatccgtgtagaaggggccggatatgtactactctgatcctgtaatctacttgagtatagttcaacgcacatcgcctcgtgcggatcaaatctgtgggcatgatcgatcttatgggcaatttggcaccctccgaatcccctgttctacacgtatctggtatacatccatccaaggcatcaattttagcgcacgttcccagtttcgccagtgcggcgccaagttgccagttgccctcgtcaaatcgccgaaaggctgcccatccgccacgtcccgatccaattttatccaaacaccccatgatatccgagagtccacgagagcgaggcataggtgtcgcatctaattttatccacgtaagataaaagacgacatgcatattatattacatctacactatctttaacatactaacccaatgattttattttatttgtttgatcactatactctttcttttttaagtttgtatgtatgctacttctttcaatctactcatatgctctttccttacttctcttcgtcacctcatcatccaatccaatcactataaaaattgattttcctatatgagcccctggttagattccagacagtccataacagaccgcgtctggaaaaaaatcatcctcccatttttgcatacggacccttataaggaccgcacatgaaaatcgattttcgcgtgcgggcctctttaagggtccgcacgcaaaaataagactattttttgcatgtggacctcttaaaagactgcacgcgaaaatattcgcatgcggacatctttaagagcaccgcacgcgaaaatacgggcctcttaagggtccgcacgcaaaaataagactattttttttgcatgtggacctcttaaaagactgcatgcgaaaatattcgcatgcggacatctttaagagcaccgcacgcgaaaatactctccctcctcggtcaaattttcctctcaaccacttcaaaaatttctatattatcctcttcacctactcatccttatcctcatttcttctatctctctcgtcactcgtctctcacgggtggcggcgggctcggcgggcgacgggtgcggggcagccgagagcagcggctggcagcggcagcgtggcctcccatgcgggctgtggccaggaccagcggcgggtggcggcaaagcggcctcgcgcacgctccccggcagtggcgcccctcgcccgcctggacatggaggcagcgcccctctcccacccggatccggtagtgggcggtggcgacatgaccgggagcggcggagggctcggtagccgcccgcggcggccggtcgtggcggaaggcagcgacaccgacaacggcggacgacgacgacgacaacgacgaccacgaggagggcggtggctaggtttaaggtttggatttttttttttttttttgcgtgcgagtgatataagccacccgcacgcaaaaatcagattttcgcgtgcggatgcgtcaccggcatgaaaaaatcggatttttgcatacacttcggtgtagatgggcgggagatccgcacgcgaaaacccttttcgatcgcacggaaaaaatgttttcgtagtagtgaatgtagcacttttagagcaacacgtcaaacaatcttataatacgaatttcatgcaaaaactccaaagaagaattgtgccacgtggcaacaccggtttcacagaacggctcgatcctgcttgcgcgcgtgcagcgtgaaacgctcgtgtgcgtgcgtgcaacgattgtccagaaggtcgtccagaagtttctatcgatggagcaattaggtccatgggggcacagcagaggctatgtgatttctcgcgtagtcgtgttgcgccgtacagctattgcttcctcctaccaccggatattgaggattaaagaagtaatgatacatactttggttagggactaaaagaggattaacatgatgcaatcaaatcacccactaaaattactacgttgcaaacatccatccttttacagtgcttgtgtttccttattttgtatccgtgttcatgtgatttatattatttctttcgtgtgttttcctctaccgaaatcataggaccttttctctttggggcaattttattctttctcctactttaatgtttaatattgatgttgcccagtattttagggttttgtttttgcccatggttttttaaataaagataaattttgcccctacttttgatggacagattaacgatgttaaatctttagcgagaaggcattcaatacccttgctcatgttgcaaacttcccctgtttttatttatgattgagaatttgcctacatttagcacatgaaccttacaattttgataaacttttaccaatataataattttgataaaaatatcaacaaatgtattgcctacatgtgccaagctgtcatcgtcacctcctctcacgaactgccaccaccgttgttgcctcctcttctcaccaagctgccgctgcctcctccgcacgtcgagccgccaccaatatcatctccccgtgctaagctgccattgtcgcctcctcttctcatcgagccaccgccactcctattgacccgttgtcctcctccctgtcgcctccttgacacgtcgagcagccgcgccttctccctgcgctgagctacagcagccgccattgtcctcctccctaccacggcctcttgcgcaatgcctagccccctcctgcacgctgtaattgggttgggtggcctacacctggccgggtcgtccccgttgcctggccggcccacggacactgccatcactatttcacaacggggattcgggttcgggaagggaatagttgatgccaagtgcccaagcctggaggtacaccaagcggtacttgggtatttttaggggtaaaagggtcgatcaataatttaaaatatcgttatctctttctttctctaattctttaccgcattaagtccaatcccactcatttccgtcaaactcattcgtttaaaaaagggcaaaaaacaacaaccctaaaatatagggtaaaatcggtattggatatcaaagtaggggtacaaacaaaattgtccctttctcttttctccctcagtcaaatgcaacctatatatgtcttgtaagggctactttgaaacgaagattgtgggatgaataggaaaaacatagaattctgacaaaaaatcaagcacaaaacaaataattataaaacacataaaaatatatgaaatcatcatttgattggaccgtacgaaaaatgcaagaatttggatgatatagataaactcataagagtctttgcatgatattggacctcacgttaaaaatactccaaaacttatatgaatttgggcattccttagaaatttgataagattcaatagtattcaataatcctttggttcaaataatcatatagaaaaaaatattgtttctatacagaataaaagttcctatatttttctatatttttctttcaaataaaagggccctaattagttactccactaaagttgaatgagctgggttcactttaccatgcgtggcaaagccacgcggtttttctagtatagtacttattttgatgcgtcgtagccttgccaacgaatacacacgataggtcccattattttctaataacacgtggattctactttagttttcattagtatattttttaaactactaaacagtatgcttttatgaaaaatttctatagagaagatgctctaaagtatcaaataaattagttttttaagtttataataattaagagttaattaattatgtgataattataatacaattaattatgtgataattataatacctttctcattttcatcttgtacttactcgtgaatccgcgatcccaaagcggggcacggcagccatatctattaggtcacttccaatgagagttccggtgcgacgttagcaatttgaataatgtgctaaggattaatgaagtgagagataaaataaatttcatctgaatgaaattacgactatattgtttccaatataacttgtctttttttaatacacaaaagaattgtgcatatttgtactaagattttgaaagacgtaaaatgtttacaaaattatattcctgagagtgcccacacaaccaccacaccctgaggaaacacaaccacggccaagaacctcaaaaaacggtgcatccaataagattccaacactaaaaacacctccaacgcccagcccaaaaagatatgtttttcacctagaggattctattaaagaggggaaaggaggcacctcgacaacactctcaagagtgttgcggcgctcaaatgcatcatcattgctggtccaaagttgcactggcttttgtctggaacctgtttgcacctctcttatagcttgtctattgcatgtattgtccataaagacaacaaaattgaaatagttcattatggaagatattttgatcatcaattaaacacattcgccctgtttagagaacttagtattttttagcacaaggaaatagtcctttaataaaatatccctaagttgtttagatccaagagtattttgagagctatttggcctttaatacattttcccatggagagagggggagagaaaaaacacttttcagtgagccccacccgaaatagctctcattaatactcttgatggggatagttttttttaaatagccgtgaaatagcttaactgtttaaaacatgtgagctttttcaggactatttaagaaagaataaaaaataacccataaatccgaacagaatcattgttgctcatatatgatgccttgggaatggaccttatccaaattggaagcacgcaagcacctggctggctcctggctgtggttggctgggtcgatgtggaccaacgttgttcgcgtcgaaccgtgcgctgttccaaccgctgcgcatacgtggcggcccgagttcctaggtgggtccgcgtggcgcggcgtttgttggtgacgtgcgcgctcgcgtgtccgaccgtggagcggctggcagcgcgtgaggaagatgcagtatatgtgaagttgtgaacaggtgtgagcgcctgctaatttcaccgatgagccttttgaccgcggtcaaacaccgtcgtggtattgtgatgatactagtactatacgtgtggtaatgtggtcggcatcctgttaattttgaagtggtcggtactaggtcggtaatatggtcggctaacgcatacactaagtatatactacctccgtttgtttaataaataacgccgttaactttttcttacatagtcatatatttgaccattcgttttattcaaaatatttatgtaaatatattttcttttatcgtggtttgatttatcactaaatgaactttaagcatgactaatatttttaagatttgtgcaaaatttttgaataagacgaacggtcaaaggttgtaacaaaagttaacggcgccatgtattagaaaatggagggagtaatttagtttgtacaagtatatttgcttggaagtcatttcaatggaaagactaatccaacatgtaagtagctttttccttggaacgaatatatacaattaagcaacttgtaactgcagattagtagtattttttttatagtggtagcagtaataaagatttatgaagtctctaaagatactcatggtagcgagcaccatccgtacatgtgcggaccgtggacaagtaatgcaccatccgtacaactgacatggtactccctacgtaaaaaaaaaaggagataatgaatttggataaagagtagaccagattcgttatgaccccttataagttgatttttttttgacgggggagtacaccagaagtagcttcacggtaggctgcgttcgttcacgtaggctggaaactcattccctccgcacggaaaacggagcagtctattagcgtgtgattaattaagtattagctaaattttttcatggatcaatatgatcttttaaaacgactttgatatagaaaattttgacaaaaaacacactgtttagcagtttaaaaagtgtgcgcaagaaacacaagggagatgggttaggaaccctgtgcaaagaacacgacctaagggcccctttgatttgtaggaaaagtgtaggaaatttgaaggatttcaatcctatgaaaaaaattcctatgaaagcctttaaattcctatgaaaaacaaaggattgaatcctatactatcctttaaaattcctatggaatggctaaccctatagagattttggaggaaagttagcaagaggtccaacctcttgaaaaaattcctttgagtctatctctctcatccgattcctgcggttttcctgtggtccaatcaaacggtcattcctgtgtttttcctgtattttccaatcctctgttttacacctgtattcctgtcagaatcctacgtttttcctattcctccattttttccattcctgcgattcaaaggggcactaagtagtacttcttccgttctagaaaaaaaaatcaacttctagagtttgaattttatcttacaaaaaaccagtttctaccatcctactcctcagcacgtaaaacgagatgttttatcccttcaataccctttacctacctaccaacttctattttaataattctccacctatactaagggtctgtttggatcttccaaaatggtaaaagttttgtcattttgaagcactttttgccattttagatctaaacactagtagcaaaagttggcaatttggcatttggcatttgctagtccatggtagcaaattttgccaaaaagtgctccgggaccacaccctctctctttagtgctaaaatagcaaaattttaagatgcatataaacaccaattagtacttttgcaatgttaaatcttttgctaccaaaacttttgttatttgccatttgccatttcaaatggatctgaacatgccctaattccaccttaggatgctaggaatggatatttttgagacggagggagtatgttcaaatttattatacgaagaaatatcgtcacattttgggttgatttttcatgtaaagaaaggagtagttcttgctttggcctcgtcaacaaatttcacaggtcctctccgtctgctgagaacaagctattagagcaggtacaatagcaggctataagccagctgcaaacatattttaagaagataaatcaggagagaaaagagcagcgggctatagatttgtagccagctatagcacggaccccaagacgcagtgtgtctatgacaggtaggactaggtattaatagtgtagtacgtaactattgtatgaatgagttattagattggccatagatgaattggagctagtagttggctatactattgaacttgctcttagcagatcagatcagactgagcaaaagcagattagggggtgtttagatggggctaaaattttttagcccatgtcacatcggatgtttggacgctaatttagagtattaaacatggactaataaaaaaactaatttcataaataagagctaatccgcgagataaattttttaagcctaattaatccataattatcaaaagtttacggtagcatcacattgtcaaaatcatggcgtaattagactcaaaagattcgtctcgcgaattagtccaagcttatagaatggattttgtaattagtgtatatttaatactccaaattagtgtctaaatatccgatatgacagggatttagaataagtcgctggaaatcatacagccctgtcccaatgtcactgcacacgtgtgctggcaaatgtctggtcagtgtcagacacccacagaccaacgctcccgcgtctgttcggcccgcctaaccatgagcatcaattcagcccaaaagtgcgcctcgattcggcccaaacgttcggcccatatatgggcctgaattcggccgtatgggccaaatgtcagcccatccccgagttcccgacgagactcgtcatcctcgacctcgactccgccgaccgccgactccgagttcactctcaccgaggccgccgccgccgccgccgagccatggaacccggggtgggggggtgggggggtggcgcagctggtacgagagggagaggtggacgacggtggcggccggccttgatccggccggtggcagcgggaaaggggggagccggggaggtggcggcgtgctagatatggaaacacttcggagatggcgatggccgtcgaggcgcgcggattcagggtgggggtggtcgagctcaccggcggcaagggactcgccgggtggtcgaggtctccgatcatccgacgcggagagttgcttgggttttctgtttctccatggttggtaaataatagcaattccatcctggaattctcctcctcccattcccgagtttccgacgagacgctttggcaatggcggtggcgccagatcacgcgcccgtattcgtggcgctgccgccgcggattccgcgggatggacatggggaggaatttcccgggcttggacttgcctgtccttctcttttcctcccttgttcttggggtggggttggcggattggggaatcggcttcgagctgattggttttgactgcgccatccgatttcttcgcttttgtggaggggggcagcacggctgtgcatttcgttctcttgtcgtggatgcccccggaatttatccccaattctcgctatacttgctcgtctacatcggtgtgtttcttggagcatttcaagcacttctcgtcttcatcgatgcatttcttggagcatttcaagtgtccagcgtctaaatcgctcaggcgaatttggaggagcctttaggcgcattccgctcaaaatcaagtggaattgttgcatgaatcttcagattgttttggctggattgccaggtttcttcgatcatttttctctacggggctgaggaatttttcgccccatgcccggaaagctccaaaggggatgtttgccacaattttcagagtatctgtgttgagatgatcggtgtggtgtagaaggaagcacgcaaatgatgaggcattgtaggagagaatggctcctcgccctgtgcctcatctctgtgcagctcctcattccaacaggctgcgagggggttctcgtcgcggcaagcaacatgtcgccacctgctttgacaccactcctcatcaatcaagtagaccaattggtaagcacatttccatatattttgatgcatacgtaagcttcaatttgtgtgaaaataccatacaagagatggcagtagcagcttttgtaaggagatgtaggcatagtcgtgtttgcattcagtttcgaaccaagaattaggaccaagtcctttccaagtggatgtgggttgcaagacattaatcgggactcgggagtatgctctcaggagcacagaagcccatggcattccctcctatacttattacggtgtgtgtcgctaggcattaaacgggaatttgctctcaagagcacagaaacacatggcattcacctcctaacggcactgatgtttttgggtaatgcaggactcagggaatcaggattgattcatgaataggtccacatttacttatttgttgtgggacatgcagagtattcttgtactcttgtagtctcgtgtttcccaaattgcatgaaagacagacgaataaggttgctgaagtctgtaggtgattcccaaaggcaaccatgattttatttgtgttgtgtcttatagttttttttttttttttttttggctttggatgacagatcacataaggttaacctttctgtgaacagagttttgaatcattttcttcttgtgttttatggctgaggtagtctgtttgtttttttagaaaatggcagcctctacatccaaaccagtctgataggtgtgcaccattgcattgattgtgatggtgttgtgatttaaacactggcttaacagaatcaaactgttaaatttggcttgcctccttctctcccctccccctcctggcctcctctctcctttaacagcaggtgctagattcctccttgttatgacatgacaaatgaagactcggagagaggaatgtgactagtagtgaatataattattttcgatccaactagtagaacctaacattttgtggcatcaatggctgtttaattcctaactggtgaatgttgccttttgttggatatgactacaaatgttgggtatatccttttttttaaaagaaaaaacattcgtactgattagagtgactgttaattacatttcatacaggtagaacatgcatgggtcaagtgtggattggacaagagaactcttgaagatgttagacgccacttcaactacaaccatgtattggcaattctccgtagaatgtctgggcaagacattaaggacacctctcctgacattgatggagggaccagtgtattatcactagaaaggagggacgctatactgaactgtttaagcaagcagaatttcatgagtatcgctggacaggatggtttaaaaatcttgtccgctgattatatcaaagcacttattgcctcacttagaacagaccttgctcaggaatcttcaactacaaagtcaatacctgaacaagcaggaaaacctgtcccagggaaaacttctacaccaaaacctgtaaacaaaccaaccgacagtgtatcatctccaccagatcgttcatataaatcagctcctacagaaaaggaaaaccctcctactaaatcagtagcggaaaagaaaaaggacagcagtggcatgccaaatgctttcattggtttgt

SEQ ID NO: 83613 - DNA, 2860 bp, Oryza sativa
ggaagcgacggcaacggcgtgctcaggcgctcgccctccccctcttcccaccaccctctcctcctcggccgcgcctcctgccaacgtccccacctcgcgcagattgggggaagtggattcggcagggaggcatgcccacatggaggtcgtcgacgcggaggagctcgcggccctcgacggcaacgcctacagtgcggagtttgccggcgcggggagcagcaggcggcgactgccgtcctccccgcctcgcacagccctccgcctgctccgctcttccctcctcgccgaaccgatggcgccggctgtcgtcccctacctcacggacggcagggcaccgggaaggactgatcgtgccgatccgacctctccgacgggaagggaggggccatatggctgggctgcagtcgattcgtgggaacgacggcgaggccggaggtagtgctatcgagcgggtggacggtcgccgcggctaccgcagctcgcgtcatcggcggatccggtgccgttgaccaccctccccccagcctcgctccacctgtcggcgtcgttactcccggcgctcttcctccgtccgcgccctcctcctccactgtcgagtttggttgttggtgccggcctcgccgtccttctgagccggccggcgcgttggttgggcgttgcgggcgagacgatgcgttcgtctgacatgctgcgcactgcctcgctgtccacaccatcggccccggtctcacgttgctcaatcctcgtcctggatggacgctctcggggtcactgcccccgttgtttgggtctgcgcggtggtcgtcaccattttttttcgggctgcgcgtggtcctcaccgaagctcctggaacacgtcgtcgactcaagtgccttgccttcacccaccaccaatgcagtttggtttcagcctgagccttctcttctttttctttcgttttttctatgtttctatatcattcactctttgagctgtcactggacagtaatggtttgtgtattcttctcgctgccaaaaagtcactgacgatttgcattctgcattgaagaaccaaagcaggaaagtgtgtgcatcatttctacattactgctactgaagatttagataaccattacagtatgttactgcactgctgcttttaagtgaattcattccggtgaaagaagatgtggattccttttagttgttacaggattctgcttttaaagaactgcttgctgctacaggattaccgtttcagtgctgtgtatatttatctggttttacttgctgcagatcttgaggttgaagatgatagttgaggaatactggttgccaatcctgtcactgctgtatggctcttcctcaacctgcgttggtggaagaatgcagttttggatgcatgaagtaaccaattgttaccttaataagtattgtggtttgatgaagaaaatttactcacagctcacccccttttttttttctcttggcttttattcttgtggtgatgtttttactggatgctcgtcagtgaggcatgtggtttccgaatttgttggcagaaatatagttttgctccttgatgttcaacttttaatcatctattaatattgtcaaaatgaatctgtctatcttattaggcaaaaggataaggtaatgacacattttttgtttcaattttccaaataagtatcaagttgttgatgtttaaagaactcttgttcggtattttgacaaatcatgaataattccagtccttgcattagtgaacgattctgaagctacgccaaaaggatctctaattggcgagaagatcccaaccaactttcctattgaccttcttgagtgtattgttccattgcatttgtatgtaatactgcagaattttggacagaaaatcatgtagcatgttggcaccttggaatacacgacaaatgagcaggagcagtcagcagacattttgttattgctttcatttgtgacctctttctttatcaagaagaagacaaatcagttactctgtccagtcgtatttggagtctgaaaatatggacaccgatccttgaatgccgttgctgtagatgaccatacaacataatgtaactcactgtttttttttcaagttgtgtaatgcaattcactgtatggtagtatattacaagttgtgtacatgacataattacacgtctacttgtgcaattaagagtaattaaagagaaactctcttaacaagattccgattatttatataatgtttgtgatcatggtattaacctttttaggtccacatagaatgcttttgctgttaaccagcccaataatgtttacaagttttttcacttgaagttcatcgctacttgaataataagttatgtatataatatgttgtgagattacctgtttaggttaaatgaaatgaaggaaaacttctaatcagtagcaactaatttgtgtttgatagaatctctggcagcttaaaccacctttgttttggggtctggctaaaccgtatggtcaaactgaccttaattacgtatacttttacctatgtaagtgttagggtgcgcggcgtggcgccgcgctcacatttctagtccatcaataacacccctacccgtaccaattttctccgtgttttggaatttttttcggctcctcgggaagggttaagcgtgatttgcaattttgtaaaaggctccttgtgtttgcacagaatatcgcatatgtcctctgaccgcctgacattccattgtgtttcttacgtataacccctcgtattctagaaaaatataacgcgaagaagagaaaattccatttctaaggctagcgctgtaaacacgaaaaccatagggggttttctacaaaacataccctccccat

SEQ ID NO: 83614 - DNA, 12200 bp, Oryza sativa
ccctcctcgccggcggatccgtcctccgctggcggccgcgtgcaccggccgtcgtccaccgtgcggatggcgctgcgggaggacgggccatccgtggccatcgtgggcgcaacgagcgttgtcggccaggacttcctccgcgtgccgtccgcccgcccccagtcgctgccgtcgtcgtccaccctccatccgccgccgcctacctcgtccgccctccccccgctctcctctacggcgagacgtccgcgctgctcgacgcgtggcgcctcctccgcaccgcagactggcgcgcctgcgcggccgccgtcaccgtccgccgcgccgccgctgggcgcgcgccgcgcaccgtcgaccagtgcaagaatcgcttggattacctcaagaagcgcctcaaggccgagcgctccaggtccaaggggaccccggccccgccgccaccgcctccctcggtcgaccgcctccgtgcgctcctccgcctcgccccctccattctccctggattcactccccggggcggcgccataccaaaggtgggagaggatgccccgttcctggccgtcggtgctgaagcggccgaggacggcggtggcgttgctaccgttgagctcctccacggggcatcagcacggagacggaaggacatcgtgcacggaggtggcggcggcgctggataggctcgccggaacatacgagcgggtggaggtggcgaagcaggaggtgacgcggctggaggagcgacgcctggaggccatgcccgacctcgagatcgagcgcatgcggattctcgtccgcgtcgccatctccgcctccgccgtggccgacgccgccactgccacggcggcgtcctctaattggtatatgccgtgagtcatttcattccgtatttttcgtgtgtgtgcatctgtacattgtgcagcagctcgttgggtggtcataacaagcaaccatgtttgaagattcgtgattctggttggaatttaagcacaacatggctggaaaatttgcacttcgctgataccaaaagcttatcatgataatgtaataatcaaatttggtcagacaataatccatcatattaacaggcaatgctgatatttctgaaactactcacgtgcaaaaactgctttcttgtgatgctctgctcaatctgattttagtagaatcccaattgcaatgttcatgtccaatgagcatgaagtgtactgtcaatcaatgatcttttgatcaccttgatggacttgtcatttgttattcacgatgccattgctgctttgtactcctacaatctgtggaggacacaatcccctgatacttttgtttgtcatctgtttcttgccagaggaactaggacagtagactggccatggtagccatccagattccagtctacttttttcaagagacaattgtagtgtggagaaggcaattgacgtgatgccccggccaaaatttacatcggtttagattacagggaaaggttagccagatataagacaatacatggtgagattttttttttctttttagttcactgatagcaggttagcagcaatgcaagatgagagacttgatttcctgaactgaacatatcatctgatttagagtcagttaatggttagctattgctgtaatcccctcttgtattgaatacaacagcatgccccaaagcataagcaagccgctctgaaaagggcaaactgcaagcgttctgcaatgcctccaaaaccagaatctgcatatccaaatggtgcccagaccaagccaccagttaggttgacaactggtgcactcctctgaccataactgaactcgagtagatgatatcatgatattgctgattaaaaacagtggcactctcaattgtggctaggaacaataaaggtacttatactagcatagaaacttatgtaaatatattgatttttgagtaaatcatcaataaaaaaaactcctactgataccatttttgttggcggcaacgatgagcaaggttggcggatgggagcaggaccactggatgtgtttcgtgtggactccggccccacgctcgccctcccttctgcactttcctctcctcctctcctctctggcggcagaaacagctcaggatggcgcggctcgaggcgacgacagtagagcggtggggctgcacgcgtctacaagttatgaaatggccgtatctttttttaaggaaagcaagaaaggtccattcaaagaaacaaaatatcattttcatgctaattagagtttatgtttttggggagtttaattagtattttcaatagcaatgttaaatcatagttggatgtgcaacatgtaggcgaggtatcgtgagtcttgtggtagatacatatatatttaagggttaatttaatacatgccattaaaaatttgccggtttcaaaatataccactaacattcatatatttggaaatataccattataattttacacattcaaaagataccacaacttactccttggatacatttccaaaaaaaaaaaaaagaaccaaactaccccttttcccctcttcttccttcttcccctttctccttcctcctatcttccttctcagcggcggtgagtggcggagcgagtggtgcgtcggtggagcaagtggcatggcggcagagcaagaagcaacgggaagagagaggtagaagataagggtattctcgtccaatacatgcgaaatacatatcttagtgacaccattgagattacaaacaagtagcagtggcatcgttacaaatacgcaaatagtaatggtatatttttaaaccaacaaaatcttaatggcatagatctaattaaccctatatttaaccgtaatgctttgcttataaagctattataaaaccatatttattgatttgtaatctgagttagtaattggtttccatgccaattcatcccctcacaaacaataagttgggtttgatactcttggttcaggcttacaatggttgtggctgcgcgtgtcgtgtcacggcgcattgacattactgagagatcaatgagtaaatgatagttgttgccgttccacattgagcaaggtggtgttttttttttccagttaagaattggaaagaatgctccatttaagcaagattatgctcttttagtttgagaattggaaagaatgtgatctttggttcacatttaattatgctacgtagccttcactaagctcatgcaaaacattgtcgtgcgcggcgtggcgccgcgcatatccttctagtatctataatagatgtgtagcatactgttaaagatggggcaacaaaggtccgtcaaacagccaagaagaaggcatcaaaggtccatgcactaattggacgattaatccagggaagaaggcatcaaaggtccatacactaattggacgattgatccagggactttcaatagagaacacatcgactctgttcggcggcatcgctgccgcagcagttttgaactgctgcagccgcagccgctgctgtaaaatgccccctccgaacacacccatagtttatttgctcctctagatattctggaggaaaagacctcagcggaaacaagagcccatcaagcctacaaaaagggtacaaaatgaattgcaacagccaatatacaaacaaaaccaatatgttcagaactaaaagaaaaggatgtgtatgctaacacaaaataaatgtatcacattgaacagttaaacatattcaaaaccttcccacagctgtcatttttatcataagtaaaaattctattgcatgaccaggtcatcacatgaacacagcaccctgaggaagatgtgtcaacaattaacctacaactgccttttatcataagtaaaaattagccaggtgaacacagcaccctgagaaagatgtgtcaacaattaacctacaactgccttttatcataagtaaaaattaaccaggtgaacacagcaccctgagaaatatgtgtcaacaattaacctacaacttccgaacaaaaggtggacaccacaagagatcttactgaaattgaatacctgactttacgctctatatctttttacccaatatacatacaaaagatataaattttatatcatctttattagtgactcttgttgggtttcatctctagcctaccaaaacttgtttgggacatataggcttttattttcatcatggttgtaattatgcgcttttgcaccacaaaagagtggacgacatgatttttgtgattaacacaaccatgcgattgttaattttaaactattagtaattgtgatgcacaaagctataaagtgcacaataatcatacatctagcaaataacaaagctaaatgcagaaggatatttctaaatttctcaagacaataaactatatacataatgctaggttgtaattgcataggaaataccagcataaacccatcttgatgctgaaaaatttgacatcttaagccaatattgttgctatagcatcagtacatcacagttacagttcatccaaaccaaacaccgtctaacagcactagttactaatgttaactgagtttggaaccaaacagcacaaacttgtatgacacctgaatactactccatccatttcatattataagttattaatgttaactgagtttggaaccaaacagcacaaaattgtatgatgcctgaatactactccctccgtttcacattataagttactaatgttaactgagtttggaaccaaacagcacaaaattgtatgacgcctgaatactactccctccgtctcagtcaaacttatttatgtttggccaagtttatagaaaatatattaacattttcaatacaaaacaaacatattatcaaaatatattcaatgttaaatttaatgaaactaatttgatattgtagatgttgctaattttttatataaacttagtcaaacctagagagttttgactaagaaaaggtcaaaacgacttgtaatatgaaatggagggagtacgtaacaagcaaaagtatgacaattgattatatgagaaaaaagagacagtgacacataacttaccccaaaccgcagttcttgcttcaccaaccaaataggctgtcttttactgcaatacatgattcctttattcctacaggacgagaaggattcatgttcatcaactcctcgaaaaaatctctgggagctaaacaaatatgcagagttgagggctcgacttaccaatatctgcgattgcagcaagtaaagatatgatggataagtgtatggggactcggtggtggtttatggaaaatgtctccgtcactagctggagcccaggtaccagtacctaggtcatattgctcaaaacgaaatatatctagtgaactaggatcgacctgcaaactatgcatgcaaatgatagagttagacaaatcggagggaaggatcttactcccctccttgttatttgagagtgagacacagagacaacgttcatcaaggaacaaggcgtggtctccaatggtcgttactggctcaatccttccactgacaaggtcagcaagtctgtatactagcagctttgaacgagaaacaccattataggcaaccagcaagagctctgaaccacattcagcaaagttgagcaggtatagaaatttgtccattgggcattcagcaatcttcactggcaatggcagatgaagcaatcccttgtcgttatcttggcatggtggattaaactggtagatgtataccttatgtatgtcgtaagatgagagctgcaaagcatagagtttgccttggaaagatacgggtttgacaaaaggtttgagcgtccaggcagagagagtccaccgttggtcaccgggagtggcgtaggctacgcggtgcaggatttcaagggccagcatgacggtgatggtgccagtggaggtgacggtaacagatgcgcaaactttcattagtctgctgtgcttgcttcgctggctgcggtcgcggctctcggattccatctgtggcaggagggaagccagcggcgggaggtcggcgacatcgccggtgaaggggtggaggaggcggatggctgtgtcgtggtcgcggtgcaggagcaggaggccgtcgaccgagtcgatgatgacgtggtcgcgtaggagcggtagatggacacggaccaaggcggcggtggagaggttgaagaagcggacgtagccgcggaggtcgggatggccggggtagaggccgtggccctccggtagcatcatccaccgccgcgggtggaaacgccggtcggtgacgccgcggccgagtgggcggacggtgcttgcgctccagtgagagcagacggcgcggaaccggacgtagtcccgcatgtcgtcgccggcaagcacccgccccccgatcagccccaccagatcctggtcaagcgaagcccaatccggcgacatcttgccggcgtcgctggggatgggcgtcaggcggcggcgcttgctgctccgaatcataggcggcggcaaaaactgcaatcaacgataacggcggatcgaacacgattaacgaaacccccctctctgttgttctctagcagatactcctatcctatatagagagtttggatcagatctaaacggaagaaatatcggttcggaaaacacttacgagacagactctccaaatatccgtccgctgtcgaatcgcatcagaattagtctcccggcctggaactaccagccgccccaaactccatcgatctacacggaatcaatctaaaatggattgctagggtaaacgcaaagggatgaggaggagaggggatggatatatcagccgccatcgccccccgtcttcagagaggttggggaagaggatacttcacagcctgggcctacttgggccgtgtggctcaccgacatgggaagcccctatcagttcactttgggtccctctatttgtcaccccgtccgaatttgaattttgtccctccatcgcaaaatcgagtacgacgatttttttttcccttcaacctatgaaaccgtttaaataagggccctaggcagtattgtgcttggttttgtctaaggtggcgcctacatggctcatgttgactaggttgtccaacgtgtcattgtcgtggcgcttacgtggcaattagatccgcaaaaaataacaaaacctgtggggcccacaagtcagttgcacacacaatttataaataatattgggcccatgtggacccacacgtcgtcctcactatcctctactctctatccccccctctctctccctcttctcactctccaaccggcggagcggggtgggtagtggccgaagtgggcgacagcggtggagcggcagccggagtgggtgacaggcggggcagagcggcggcggacggagcaaagaggtggagtggggcaaagcagaggggcggagtggcgacgaccggagtaggccggcggagcggagcggaccgtcgtcttcaaccacgtcactcaccacgtccagctcgaatggtgaggccgaggcctcctcgtcggcgtcaatcgtgctgctgctgacggcgtcgtcgtcgctcgtggcagacggctcaccacgcggacctcacacaccaaccgcaccgcgcacatctatcgcactcgccggtgaccgctcgagcaggccggagcgaggcgagcggatctatgtcgtcgcggccatcgaccttgccggggagaggagcgacggagccgggcgggagaggagacgcgagcgcaggagcagacgattcgatggcgacgacaacgacattgaagccagtgtgcgcacatgaagcactccagctactcaacagtgcggccgactcgagttacttcactctggtcatcggccgctccaccccgttcgtagcccgcttcagtcgccgcccactccgtcggagagcaagaggagggggaagagaggatagagagaagagagcagtgatgatggcacgtaggtccacatgggcccaccattttttattatttgtgtgtgcaactgacacgtggggcccacaagttttattattttttgctgatctaaatgccacgcaagcaccacgtcaatgacacgttggacaaagacctaatcaaaaagagccacgtatgcgccactttagccaaaaccgaacacaatactgccgagagaccttacttaaacggtttcgtaagttggaagacccgttgtacccggttttgcgaccaagggacgaaaatcggactgggcgacaaatagagggacccaaagtgaatttattcctaggtggaataagtccacttggataggtgaagcatctaagcccccggtgttaattttggtaattaatgacaagcgctaattgtggactaaccgttgtctttgagctatacattttaagttaggtccacgtcatatgtgcgcatggatgattatcgatggattaaaattgacggcgcaaagcaaagggaaagaagacggtaaaactagcgctttaatttagaattgatcgaggtgtagggcgatcaaatttgctagtttatttttagtttcgccgtactattaagaggggtaatgacctagcaaaaagatgattataattgccacattaggtcattgcattttcatttgtgctctcttttttatcacacacacattcacttgcaaattcactgggttcggcctgaccaggggcggtcagaccggccacatagtggcggtctgaccggcgtgccctggccggtctgaccggccgcaagaaggcggtctgaccggagcataaggccggtctgaccggcggcacttgcgcggtcagactggccccctggaggccgagatggtgctgctcgggatggccgatacagagccgacgaagccgtattcggtcagaccgagccgatggcggtctgaccgagccgaggccggtctgaccggccaccccatgccggtctgaccggccaggccgatggggtcctctgacagggctacaacgactagttttctagccgttgcagagtagcacggtctgaccggctacatacctccggtcagaccggcagagcacagagttgggggatttcgcccccaacggctagttttggtgggtgggagtataaatatactcccccaccagcagcaagggggttctcttggcacccaattcaattgcatatactccttgcacctctctcacactcacttgagctttgtgttcatccatctagtgtgttagagggttgtttagccaagagtcaagtgcatttgcttccattgtagagctagtgtggcacttgatcatctccacaccgagtcattgcttgttactcttggaggttgccgcctcctagacggcttgtagaggagttgctcggtgacctctccgtgaagattgtggaggaggcccggcgccggtttgtgagtggtttggagttcaccaccttcggagtgaaggaagaactaccccgagtgatcgagacttgggtagtcctctccgtgggccggctcccgtcttgcccaccccttgacgaagggggcgtgcggtggcttcgtggttgagcggtggagttgggctcgcctcaacggggagtaggaaaccggcgagtttccgaacctcggtgaaaaatctcttgtctcattgtctcatttgattgtcgcatttacatttgtgcaatttatatttctagagacatacttgagatcatatcaccctaggattgcaaaacattgacataggagtgtgatttactttcctagagatataattgagccactatcatcctaggtttgcaaaacataacttagttgcttagttagagttcaccctcaccaagcctagcaacttaggttagatttgattaggtgttatttagtttttaaatcgcctattcagccctccccctctagtcgacatctcgatcctacaatagagaaaaagtacaccgaaggtccctcaacttgtcatcgagttacaaaatcattcctcaactacaaaactagatatatgacatccgttaacttacaaaaccgttcactttaggcccttcagaggttttgactctggttttatccaacatagtggctgagtctgcgtgagacccacttggacccatcattatgtccacgtcaccacctactctctttcccctcttctctttctctgtttctctccttccttccttcctctcgctctctgctcttgcatgggcatagggatgccggtgctagggctggcgcccatggtggtgcggccggcgatgacggctcctggggggtcttagcttccccaaggtggtggcgcgcgggctcgagacagcgcgagctcgctggcctccccgtccccctcgtgcgggccggccggcgaggcgaggcaagcacgcggtcctgccctcgcctgcgacaatcgtcgccgggtgcgacgcggggatcacgatcactgactcctcactgacctgcaccatcaccttctggtaccttctcaccttctcgctgtgctcctcctcttcctgttcattctctctgccccactcatcccttctccttccgtgctggtgaggttggagaaggacgacctcttgccggtgaggctggacagcttgatttcccactcagaacccgagccgtcgccgccgtgggagcacgacttgcttagctcccgtgtctgctcctctagcgccatcgcgatctcgtcaccctcccactgcctttggatcaccttctccaattcttcccgacgaatctaatccaaacaagaaatccaagaacacaaatgaaatcaatcaagaatgttctagaagagccatggtgatgagcaccgacgtacgttgaacgccgcctcctccgcgtcgtcgtcctcctcctcgccgctgaacatcaccgagatggccgagctgaatagctgatgcgccggtcgcaggaaaaggtctgcctagagctcgccgaccacaacagggtaatcgaggacagcctcccaaacatttgaccaacgcttattataatataaattaaattttatttgctaaaaatatatcattgaattgacatttgaatttactttcatatggttataatttttctaccgcagacttataatatatgataaagtataagacaaagattagtttttgagaccgtgccaagtttaaccgtgccttatatcatggaactgagagagtatttactttgaaaactattgttttttctatatttatatttttttgaaaaaaaattaacttatcaaagtttaaatataaacagtggttggtgacatgtatttggaagtggatagagtaattccttgttgttagtaaggactatttttttttcatacaaagcaaatgggattttcctcttaaaactgtactacctctaattttttttataacgcttgactatttatcttatttaattttttttcataaatatgtaaacgtataatttaatgttagagtaatgataaaacaagtcataataaaaatatatactacctccgtttcaagttataagactttctagcattgcatatatatatatatatatatatatatatatatatatatatatatatatatacacacaaacacgtgggcaatgctagaaagtctaataatatgaaacggaagaaatagcatttatataaatctttttactaagacaaataatcaaaacgaatggcataatatattgcttcctccgtttcatattttaagtcgtttgacttttttttctaattaagtttgactaagtttatagaaaaatatattagtatttccaacacacaacaaacgtatcatcaaaatatattcaatgttagattttatgaaactagtttggcgttttaaatattgctaaatttttctattagattggccaaacttgaataggaaaaaagtcaaactacttgtaacgtgaaacggaggagtaaaaaaatggagggagtataacttttccatttcttattgtcaattaattttttttatcgattttgctatatatttgtcgacaaatttttcccccaaaatttgacagatgtaattacagtacaatcgtagtgtaattacactgtaacttgcatgtagttacactgtaactatagtgtaacttgtatgtaactttcaaaaatctctccgttacatgttatttcggtaaaatggaggtcgtgggaacaaattctttcacatatgtgtgtgctatgatttgttttcttcctcaccaaaacaaatcttgcactaaatccaacgattcaaaatt

SEQ ID NO: 83615 - DNA, 6957 bp, Oryza sativa
aatttgtcgacaaatgtataggtagtccctttttttattaatccgagaaataaacaagcacttgaaatggttttcgcagatgggctaattgggccggtggcccggctgattccgacccatccaagcatctcctctcctccgaatctcctccacctctcccacacatctcctctcctcccctcgccgccgtcgacgcagaggcttggctcatcgcggcgccagtgactgatcgatggccgcggcctccatccccgcgagctcccagcccttcaaggtttgctcccgggagcagctccgccgattaatctcttcttgtttgaggagcgaccgagcgagtctaatcaatccgttcttgctacttttgctgtggcttcgtcgcagctgatcctggggtcatcgtcggtggccaggaagcatatactcgccgagatggggctcgaattcgaagtcatggtgggtttgcgccgcttttctcttgcctcttgcccactcccgttctgcattttcgccccccttttttggtggggatttcttgctttcgggactgtctcttgggggatgaactgattctgtggtttcagactgcagatatcgacgagaagagcatcaggagggagaaccccgacgagctagtgacgatccttgcggaggccaaggtgcggccttttctctctttttccccccatttctttggaagtttttacagcttcagcattggcgtcccattcccatcgctacagtagcaaatgcgtcgccgagtgccatgtattaatattacttgtgcataatattagatggtatttatggtgatatttggtctgtaccaagtgcttgaatttctgagaaatgaaaccttggcagcttcaatgggacatttggatcggacttgaccgagtaggtttcgatttagttatggacttgaattgtaactctaaattaaagaatggaaggcactggttcatctctggttgtttctattgctgctgaattggtcctagaagaaagagcataccatgacttcgtgttgatctcctgcattgtgatgctgtttctatgttgtcaattttttccccttgtaacaaaaactgaccactttgacatctttcaggctgatgctatcatgtccagattgaatatttctgattaccagaaagaaggcgacaggccaacactcctgatcacttctgacatagtatgccttgatttcctttgctatgctattttacgtggaacttggatgctttattaatcacaaaatactatgtttgaaatttgaccatgcctcaatttcagttctcctttgatgtttttttcttagctaggagttccatggattgtacatcaatttaagtatgactattttggtgccatgtttttgttattacacatttgtgtagataggccttttcgatatcaccaaatccaaatgtcatacagataaattagtcaattggaatcaatcctgaatatgaaattttaaattcctgagatgtgcattgtcaatgctgaatagatcaatacattcgcttatttaagaatgatgtcctgtgtgaaccataagtttggtaatgatgcatagcgcaagtcattcctgtttcaactttttgttcggcatgttctcttcgttctagagttcatgggcatgtggttgaacatatctgctttaggacccccatcatttgcattatccggggaatagccaaacgtcatatttgcaaacaaaaaataatttgtgaataaaacttttatatacatgttcttacgatctaaaagcaaaggctgaaaaataaactttgatgaaaaaaaccctaaaatcaactccaaatttgaggttggaaattcaaattttggttgataagcataagcataagcgaaaagatgaggttgttatttactagaatgttgtcattcgcattactgtcatactgaactgaagttgaccttgaggtggtcgtccatgaagggattatcagagaaaagccaaccacgaaggaagaagcacgccaattcctgaaaggtgtgcccacatgtcgaggcaacatgcatcttatattcttgttctccaatattttattgtattatttattacttgaacttttactttctccaggttattctggcagccatgtcgcaaccgtggggtctgtagtcgtaactaatctgacaactgggaagaggcttggaagcctagacaaagctgaggtaatttacttttgtagttcagcacttatttgatgagaaaattcctttgatagaagctgtttgtattcaagtcagatttggcaatgcgggtgatcccattgatatgtgcgcccaaaggctattgatcaacatctttgacagaacataattcacccaagctctgcaaatgtgtaaaaacaccaaaggatattttcaccatccagtgactaatgacaattgtagttttcagacttgtttgtgtggcaagctttgttgtgtgcatctagctagatatagctactacggttcttggtcatctttttgttatattaaatcaacaataaaaagtttgtctctttgagtttcttatcgtgtgttcaggaggaactattaaaagatgatgtcattcaaattctattactgcaaagcaacaatttagtttgttctctaatgttagtatttaggacaattatgggaaaattcagtagataatatttaatttctgccagtcaaaaagtaactggattgtgtatgtatatcatggaaaatttagttaaggttgccttttgtcgtcattttgcaggtgtacttccatgatataccagatgaggtcattgaaaacctggttggcctcgtttattccactctatgtaatatattaattgattatttgctaaatctaacatttataattgtagcaacagtgccagttagaatactatcatcataggatccaatctttaaaaaattgcaaatgtttttatgccactgacctgctctctctacccgtttgaatgtcaacagatcgatgagggggtagtatttagggtcgcaggtggcctgttgcttgaacatccattgacattaccatttgttgaagcagtggttagtgtctatctcaccttatttttcacaagtcttatatatacacggcattttaaactaatgcaaacttggtctccttttcatgtaggttggttctagtgacagtgtaatggggatctcgaaggatcttgcaaacaaattaatccaggatgcattgtagcctagcaatatttggtgctctgttcattcatcacatttattactgctcccaaagagatactacctatcggtgaaaatatgtcagggacatggtggtatactggtatctcatagtcatttttgtagctcaaaagcttttgaaggatttcagaacctgacacacgaagacgcatggcgttcaagaacacttcagttcctctgtctactgttttgatgagatttttatcattgtacttacacctttactgaatatatacactgtcattgtgaagcgttcagtcgataccttaatggaaaacgaggatgttgccaaagaattcgcaatttaaatgttaaatcgagaaagacttgtgtcatgtttgcaatgtgtgaattgaactgtttgcagtgaacattttgcaaccattaccttgatgcctgggtataaaatgggctgggttcgatttttattaatttttggcctaaaaatatttaagggctagagttgtgaaagaacccatgcatggcctaacccattaccacccctacctacaaaattacagtctgatcttattgtatacgatctgagtgtgacaatacaggaagtactctccagcttccaaaattctgcaaattccacgtgaaacagttcatttatatgggcccagcccaactttatatgggcccacatgtagattacactaccgttccagaccaacataatatgggcctgcacctcggtgacaatccctttacggcccaacgtaatttgggaccacatgtgggtgaaatcccgtctcggcccaacttggtttgggcccgcaaagaggtgaccatccggtttcgtctccgtttcgtcttcttcttcttcttcttcttcggtgacaatctccgtttcgtcttcttcttcttcttctccgccgtgacacgcacacggcgaagcggaggcagccgccgccggcgaccatctcgcgtcgctcctccggccatctcttcagctcctccactccccgaagctgccgcccgcgcgatccaccgaatgaggccggcggaggaggcggcgagggcggcggcgctggccggcccgctcggcgagctcctcccgccggtggacttctgctgcgcgtacggctccacgctcctccacgcccgccccgaagcgtcctccatggtcgactacatcctcggcgtccccgacccgctccagtggcactccgaggtagggtgggtgactgagccccccccccccctctcctgttctactcttccagattattccatccaattggtccccttcttggtttgatactctttgatgcgatcttggttcttggatggtttcttggttggttaattggtgcagaatttggagaggaaccctgatcactactccggatggatggctcgcctcggccccggcgctgtaagctcccatttcccaccccaaattcacactccttttacttggttaccccggttgattgctcctctgactgtgtgattgattggttgttgcttgtgccttgtggaagttcagattactcgacttgcggataacatcggcgttggggtgtacttcaatccatttgttgagtggagggacaaggttagcatttgcaatgaagcctcctgaattttgtagcctgatgctttgtgtgcattgtggtttacttgtcttcatgtatgtgcatttagttctgagtgacaaaattgtagctatgtggatgcagaggataaagtacggggtggtgaggatgaaggacctggccatggatgtcttgacctgggaccggttctacctcagtggccgactacagaaacctgtatgtatgccctcttgttgatatctgtgggaaggaagatgcgagcactgataatcttgttttgccactgtagtggttcctgatccagggtgtatcaccattcatgtttagttcaacccctgttttaattttagtgcatgtatatgcctggtagtgcagatttgacatcagagctagtatttgtcttttgtattcatgtaggttcatgttcttgttgataattgggatataaggaagattaacacaattaatctgaaaatggcaacatcagcttctctactccttttgccagcagaattcactgaggtttagtgtcactgtatcagcattgttgttacaaccatgatatggttctatgcttgttttcaccttccctttttattccttttgtgcagtatgacctgtacgcccaaatttgcagcctatcatatatgggtgatttaagaatgctcttcgccgaagacaaaaacaaggtaaattgataagatgtatactacgttgttattcttaaatattttcctgtaatttatttcagctcaattaacatcagaaataacattccttcctcacaatagtgacgctgtcaatatggatgtctgaaagccaactctactatacaccttgaaaaatgaaatggcgtgttattttttttttttaaaaaagaagtggaccacaaaaaaaatcaaatattacatgggacgcttcttataaaaaaagcatgggatgcatggtacacagtagttcgtgtaattcattctaagtgtgatgcatgtcattatctaaaaaaaagtgtgatttatgtgatatgtttagtatgtcatcctgcacatacatgcacctatggcatataaaaaaagatgtacaatttggctgtattgagcacattagtgagttactgctgtttgctgggttttgtgggaaggactgacaagcaaattgactgtgtttctgttggaagattatttatagtgtctattgctgttgttagtctgctgtatggttgaaagatcaatatatggttgttattcttcatgctgttttttttttcccatgacaatggaacttatgaattggtgccaattatactctgctgtgaatcaggtcaagaaaattgttgagggtagtttcccatcatttcaatcgatgtacagaaccctgatacaagagtacattgctgaaggactactgaagacatcatcttatggacaacagaaggctttccatcaggcctgtgtttccttttgctcatgcatacagtttgttgaaacagtgttaaatgtttagcctctcactgagatgctttcttgctatcacaaatgcatcattggtggcccaccaagatgtttaaacttttctcgtaatgtttatcatattggcgtgttctcgcaaatgtggtatatttatctcctttgaaacttataagatattttattggcactctatgaaagtctttttcttttggaacttcataaactaaaactgataagagttttatatttgcaggattgtggtgcatctgcaacaaacgaactgttctcttatctcccatggacaatccaaaggcgaacgcaaggaagatttgcatcgaattgcaaaggtactgtcgtcatttgcgtcgagattagtaccgtcgaatctgtaacacattctgataaattgtttaatttccagaaatgccaactggtgccgcagtttcttcaaaaaatgtagcagcaacctgtgtccgcaaggctttgaggcgccgggtaatggtctcaagtgcacgtcaagcggtgtctggactgcttgcctctggtggcactgttgctgctagatatctggggaagaagatatccaaagcctggaaatcaagaacagtttaagttgttgctgacacctgatgctttatatacacctttgttagttacggatttagggtaggttttgctct

SEQ ID NO: 83616 - DNA, 6807 bp, Oryza sativa
  unsure (1)..(6807): unsure at all n locations
gcgccccacgcctgcgccggccgccgccaactcccccagccgctcccttgtgccttcctcgctgccgcggcctcctcgccccaccgcgtccccgcgtccccgacatgtcgtccccactgtcgatgcggccggcagctacggccgtccctccccccggcacgcgacatccctgcccgcgccgacagacgccgccttcccccagccgctccctcgtgccttcctcgccgccacggcctcctcgccccaccgcgcccccgcgtccccgatgccggcaccaccgtccccgcccttcaccggcactaccgtccgatggggaagagaaaaagggagagaaaagatagagaagggagagaaagggaggaggaagaagggttgaagagaaaggatgatacgtgggccccacaatatattgtgtgtgtgaatgacagatgggtcccacatatatttttttaattgtaatgctacttaagcgccacgtgggacaaagactgggtcagcgctgccacgtcagtaaaaccgccctccaaaaccgctggaggagtcaaattgcacttgtttcaatagttcggggagtcgtcatatccggttttttggttgaggggtacgaattagattcggcgcacaattaagggagtcaaagtggactgttcctatacttattccatccattaaggcccactctaaagaggtgagagaggtaatatagacttattagccacgtaggcacgacacaagaaagcgaggacaaaaaatggacttattcccaggacgagcatggtgggcctgtcgccggccccagtgttattggactctgtatgggccgtaggtgcagcccgtgggctgacacggcacggctcggcgtgtcggtcggcccgactgatatcttgccttggtcgtgcccagaccgggccgtgtatagcggcccatttgatcatctgtagcctgaagcccacattgccacggcccaataaatcgcgcgatgacgactcgaccaccggaaaccccctctccgcatcccacagccacaagcggcgccgcaccacttcgtcctcaaccaaaacctccgccgccgccgccgccggagaaggaggaggaggaggagtagggagagtaagcggggagaggaagatgtcgttccgtgcgcgggagatgtacaagaaggtggtgcggcgcgtgggcggcgaggggaagctgccggcggagctgatggcgtcggtgaagaacttgctgcctgacagcaaggtcgtcatggggagggccaagcgcggcatctacgccggacgccacatccagttcggcaacaaggtctccgaggacggtggcaacaagtaagccatctcgcccgtgcaaatcttcactactctactcgtcgtcggatctatgcgcgtagatactgtagggttgagttcgtggggtggaataaagctgtgtgatgcaacgaggtattccgaatccagatttggttggtttggattggagagaacacgattgcgaggacagtggttgagggtagtggtcaggagagaaaactgccctttgcactgtattggtttgattgcatgtctaattgatttgctcctagttactgacttagaaatggatgtgttgaggattaaattgggtttcatcctccattctggtttaccttagtagtttttaccaagattgatagagttattcatgtttgaaatgttcaaacctacacaatttgctagttattttttaatgatgtgcaaattgttagattaccaaaatagaataggtagcttgtttgcactcttttttgctagtgtaaatgcttgactagtatgttgcttacttgcttcatccattcactattgtacaatttggttctttgatcataatatttgaaacttcaactatcagtttcttttggaacgagggaaatgataatccacacaatcttgttaaatcccactgttcacttcctgaactgccaccaccatggcaaactgtcagaatggtttcatgagtcatgatcaacatgtgtaacctcaagacatgcaaagctgcttacttaacgattcctctaggcttgcaagttgcatcctttgatcaatgtagcacatctttaagtatctggagctgcattctggatctctttaagaagaaatgatttttttttcttactactgtaaatgtgtaattgtgcatttggcacacttaaaaatctccttgaaatttgtgtattcaagatacttccttttaaatttccatagttcatgagcctttcattaaaaaaatattgctcttgatttccccctaaacgtatttgtgtccgtggtagtttttgagcaatgtcttattttgttcaggtcaaggcgaacatggaagccaaatgttcaggagaagcgtctttttagctatattcacgaccggcacattagggtcaaggtaaccacccatgctcttcggtgcattgacaaagctggtgggatagacgaatacctcctgaagacaccttacaacaaaatggatactgagatgggggtagcctggaaggcaaagattgagaagatgtattcacagctagctcaaatggaggtaggcttcttctctcctgaggaagagactaagatcgaacagggttttgaggaggctcgagctgccaagagagagcaccgcagggaagcaagaagagctttggctaagcagactcagctagaagctggtaacgctggtggtgacaaaacagctgaagctgcttctaatgttgcagtgaagtcctagcttggacctatctgctcgtcatgattggtaaaatgtgatcatatatcctcattttcatgaatcggcatcacctgtgtgctatatgttgaaagtctatttatatggcaatgccactttttaataaatcaacttcttttggaaccttggtgatattgctaccgcaaagttctactttttacgcctgatgatttaaaatgcgatgtgtggatatggtaatttatctttagtttacatcattgatgatcaatgtgaaacctctttatgactccatagtccatattagtaaaaaccacagtatcattttcggcatcatctcatcaaaggtgttacctttctttgtgatatcaaatcagtgaaggataaaagtttgtatgcacaacaacttcccttgctaaataccatatactttttttgcattttggattgtactattacctgaatatactccctctgtccagtatttgttgtcatggagaacaataaaactactctctgttgataaatacaagtcatggtgtctccaacattaaactttaaccattattttcttttgaaatgtattgtcaacaactgtacaacttgtatgccaatgaacatatacaccctccattcctaaatacttgtcactgaatactattttagcaacaaacttgtatatattaaaaaacatactatgctattgaaaaatatgtttcatgctaaacataacaattcaattttcgtccataaaaatatgataatttagaagctatcaatggtcaaagatgaaacagcactagtccatatgtcaggtaaaagcacactagtcaatggtcaaagatgaagcagcatgttactaggccaatttttagtccaaaatcacagagtttgcacattttgagttcatgcttgtcttatattaatcaataggggataaaattagatttcaaacccactgtatgcatgcagggggccttttgtactccaaataactcgacatactcctcttgcaggtcaaaaggagaatcattgagtgccactgaccaaataatggaggattttcgtttcatataaagcagggatcatatgctgagtcagtaacccctgtttactggcagcagcagcagtgtatggtaagctggagtctaatactatcagcatgtgggtgttgtaagcagttgctgaacaaaatcagttaggtggaaattttgtacacttactgaatactcgtgtcagagttcagataactttcttgtagaattttgtatcttctactactgcccattcaacttaaacgtcgaaataatctatgcttgccaggatacgtggtaatgtgctacggagctatgccgtttttatgctgatttctgtttcgctgctatattttgttaccaattcaggctacaattcttacaaccaagaagaatgcttgacaagttacagatggcaacaccccaattaaattgttagtttggaccagcgatgtgcatatgcaagcgaatgctgctgggctagcatcgccccgatgaaattgtttctttggtttgacagtttttccttctctaaacttgtgatgtgaaatgatgcttctgaatatgaatgaattatgcgatgattttgttcagaacttttggatttctcccttgttttctgataatcgcgcctgcttggagatttagccgtcaacaacaactcaagattgaatcatacgtaagtgcttgctgatacaatatcaacatggagggtacattgccggttccatatgaacaaacataaaaacaccgaaaccccatatggccattatgccgatcctagcctagcttggcgaggacatcgccaagagcagatttggtcaacgtgtagtacttctccgcctcttcggggctcttgatcttggctgcatggtcaagctgcacaaatcacaaagggggattcttgtcaacaactcagctgagcaacagtaatactttttccgtttcatttcatattataaattgtttgtctattttcttaatcaaagtttttagctttgactaagtttatagaaaaaaatagtaacatatgggatataaattaattttattaaatttaacattgaatatattttaataatatgtttattttgtattgaaaatattagtatatttttaaaaaaacttgataaaacttgaagaagtttgacgaagaaaaaaaatcaaacgatttataatataaaatgaaatagagggaataataaattttaagagaagactctgtagtgaagtgaagctaaattagtttttttttgaaactaagtgaagctaaatttagttaccccgtcaatggtggcgaagagcttgccggtgaggtccttgaggcccttcttctcgtccttgggcttggagttgatgacggttttgaggtcgtagcgcaggtaggaggccctgaggcggaggtcgtccctgacgaacggccactgcttcttctcgatgagcggcttgagttgatgatgtcctgngccgactccttcgccctcgccgccgcctccgccggcggcagcggctgcaggtagaacctttccctcagcggcaggtccgtgtccctcgcctggtccgagttcagcgtcccagctatcaccacacaaatcaaatcaaatttgtaagtttcagtgagatattcgtgcgaaatttgtcaaacttaattaacggagaaattctacggttcttcaaaatatatcatgacacactaaaaatttaatataaaatttaatactttatagtatctcgataccaaatttacaataatacctcatgactctttcaaaattgctcaagttaataatactacacttacggagtccaccggagggcggtggcggggggccgagcttgatgggcttggcggcctcggcgagcgccgcctgcgcgagggcgccgccggcgatcccggtggcgacgaggccgagcacggcgcggcggccggtctggacgtcggcggcggcggcgtcggccctgacgacggcgagcctggacctgccgccggcgcgcctgggcccggccggcagctgcacgccctgcgacagcccggtcatggacgccattgcctgtgccatctctcaacctcagctcagacctcacctgactataagctgagaatttctctcttcagatgaaagaagcaaagtctcgagcgcgtggcggaaaaaaatatattgaggaggacgtgttggtgtgcaaccttatctgactggataagttgggggccagtggggaagcgccacgtggaccggcgagccgcgcgatggcctccgtccggattgcgccacggccaatggggaggcgacgcgtgtccgggagcgctcgtgtcctccactctcctttggcctccgttgatttcgatcggcggccgccgcgttggcgtggcagttggcaccgtggcggcagcggtaactcttcggatgatcgtgtggctttatccgatatattgctttcgttcgcacatggaggttcgccccggttgacgggtattttttagttttttttatttttattaatataacttttcaaaaaaatacttttaaaaactgaaccttttgttcacgctagtttggcaacgccagtcacggtgacgtaccttggtgtggcgtgacagagttatttggccacgccagacgggctggtggccaaaagatttagatttaaaaatattttcttggaaatgtttactaataaaacttttaaaaaataaaaggtctaaataataataatattaataagttctctgacggcgcctctacacttggatatgtattgggagcatttttttttacaaaatttgctatataacattaaagaaaatgtacgtaaatagataatggataccgtaagatcgtaaaaattctctcttctcagctaggtgtatatattattttaatctccatagtgtccactattaaattacatgtgttttgaagtgtctttcaaccgtttcacgatcttgcgatgcagctcagctaattacacgttttttcaatgttctatagtaaattttgcctttttttttctaataagagtaatggaaatatagtgactggacaca

SEQ ID NO: 83617 - DNA, 1110 bp, Oryza sativa
gttattctggcaatacatcctgtctaatgcctaccttggtaattttcacactgtttgtcaggtctgctgtaatgatcaggggccatacttttgctttgctcgcggaaacaacatatggctcatatatgacaacaacagaagacccatggtaattcccgatcaactttgcgtatttatgttttgactcacatttggtcgagcattactcgatatcattatttgtgtttgttttgtccttccagtatgctgaatcctgggaagcatcaatccagcagtacagtcaggccaacctctgtcctgaaatcatcttctttgagcgtgtcgaggatccagaattgggcacccaccgcgaccagactgcgccttgaaccattccattacttttaaggtttgatgtggctcagtggctgtagagattggttggttttgccattggaggcttgctgattgttgtggtgcttgtttgctggggcgttttgagtgggcaaactcctgtgcttttgagatcatcgtgcccacggcattcatgctcatgcatatatactggagtacttgacgttctctgcttggcgatggcgagatctggcatttctttgctggcctctggatcatgtagggtaggaaagtagtatcagtcgtttgtttgttcttccttgttgctcctgcaaatacctttattgctgtacatacaacaacgttctgtaacgcacaattctgggttcgtatatacggcgatagagcttgccttttctttgattacgagtactgatctagcaatggatatgcatttgcctgctctccactgcaattttgtatatctccggtactccctccgtctcataatataagagattttagatagatatgatatatactagtactacgaatctagataggcgtcacgtacctccaaaatccttagaattggatggaggcagtaccgcagtagtagtgattgttatacccacccaactatgctcatcagtagtagtgacgcagtttaggcccatccatttttaagcccgtacttcagcccatttttttcggccgaagcacgacgcggcccaaatacaaggcggaacattcaattttttacaaagcaccctcccc

SEQ ID NO: 83618 - DNA, 11010 bp, Oryza sativa
  unsure (1)..(11010): unsure at all n locations
taggggtgtaattcggacttttccctttagaaaatttaggtgatggacaaagcctaactaaaaccactacatatttcgctcaaattgttcttagattagaaaaaatacctgtgcgttgcaacgggtaaaggcgtttttcagtgatacaacggctattaagagccaaggaataaattgaaacattagtatcgctatacattataattgaaaaggcgttgcctcctacctccttttaaattccagaaaacaagttccccatcaaatcaaactgaatctttctcgatctcccaaaattgattaaggattttttatccacttgatctcttcttttagttttttccaaaatcggaacgaatccacgaaactcgggataaaaacagttgggggaagatcactggcagaccatcattcacaaccgttaaacaaatattaaatctagttaattaaatccgaattgaaaggggaaattatggggaaaggatgagggacgagtagagaatcgatttttgcaattaattagagaagaaaacgcacaggaaggtatagatcgatgtggcggcggcgttagggttcggcctgggcagcgcggcggcggtggctggaggcacgtggcaacggatcggacttatacggacgacgtacaaaatcaaatacacgggatgcttgcttattttttttattagatgtacagatagatttgcgataaagagaaatattagtaaaccaactccaacacggatgacatactaaaattttggcagaaacatctttaatttttataatagtagagatttaaatcagagtaattttgttataaaattgcgatctaacacttatataaatgtggaagattttctcttaataaaatataattggtcccttgttatgtctttcctggactatggtgtagtatacatgagttgatagtcagcaatatcaacatgattaagtatttaagcatacacaattaggcaaggtgattagcctggcattggttcaggtttcaagttgctcagtggaaattgcatgggcagccctaatgggcgattgatcgcccgccaatgggggtagcgatcagattcgctacccccctcccctctccctccctccacctggtttcctttttggcaccgtattactttcttattttagtaaatttatacacctaaagtttacacatctaaagtttagagacccaaagtttataagtcaaaagtttatatatccgattcaaatttgaatttgaattcaaatattttttatatatagtatttctatacatctaaagtttatacacctaaagttagtttatagacctaaagtttatacacctcaagtttacacatctaaagtttagatacatgtttcaaatttatatttgaattatatctgattcaaatttacttgtttcatatttgaatttgaattatatccgattcaaatttgaatttgaattcaaatattttctatatatagtatttctatgcatctaaagtttatacacctaaagtttatagaaccaaagtttataaacccaaagtttataagtcaaaagtttacatacccgattcaaatttgaatttgaattatatctgattcaaatttgaatttgaattcaaattttttctatatatagtatttctatacatctaaagtttatacacctaaaatttatagacccaaagtttataagtcaaaaagtttacatacccgattcaaatttgaatttaaatttaaattttttatatatatagtatttctatacataaatttttctaactttttgttttttaaaaaaaatttgtgtggtgtactgtagtaggggaggagggaggagtgtatctagtagtatagggagggggcgggcgggtgatcgctgggcgggcgggggagcgatcacccgcccattagcatttccgagattgcatgcattagcaaacattgatgtgtgggtcctgttgacagaaaacacgaggcctgggagatctgcttaacttcagtgcaggtccaaaactcgccttcgggtgtatgagcgtggtcgttaacaggtctgtacccataaatcagccactgctactgaatcagcagtactgtagaggatctgcattcaggctggtgccttcatgcagtaggacacaaccgcacacatttgttgccatgcgcccgcaactaacttgcatggtaatacatcgattggagtcaacccttacatggcgtgaagcccgagcagccgcccgatctgcccgataggtgaatcggctactgcttccgtgctccatattgtgccgccttcttctccatagcggcaccccctcagtggagatctagtggcacccgcaagatgaaggtctagcggcagcagtcttaatagagaagggcatggccgcgggcaaaaggcagaggagagaaacacgcggacgccggcgataggtagatgatatttttttctgatttctttgattattgtgatcttcttgtctgaaatatttcgtgatttttgtgactcttttgtatatctaaaaatattgattactttcagtcatgatagagaccaaggccgcattgcttagcgttggccatttttcgattgcatgttggttttcatttttagattgtaggaatattagcaaaccaccaatattttcatcacaaaatataaatcaacttcttgattttacatagatgaccaaaatttcttaaaagaccggaaatcgagaccgaccttactgccacccccgcgtaaggtagccaatatattagggaagttggtgttcggcagcagggttatccaaatgtgatcactctaatctcacttattcacgtagagatttacccaggtttgggcctcctgaaaaatagctacgacatcttggcctaataaggaggaaagtgcaagtgaggtgatttgtgtaagtgggcatgcctgttggatggattggactgcacggttttggagcgcgggtttttacaatagcagacctacacctgctttgatgtgttttgcaagtatgacaatggtgctacaatggagcggtagagggtgagtgtgtgaatggtcggtggtccagagatcccttctctacagagatatcaaagttttcttgatcaaaaatcacatcaagtttgatttatagcaaattaataaaatcataatagatttacaacaaatgtcacacaagagcaccaataattaagatagaaacacaaaagaaatacatatccaccatccaaattgaattccacacatcccaaatttatgaaaagcacgcgcatgtaaacgtcgcaaatatagacaccacatttacatggggtgcctagttttagtgcttgggagggcatatcgccggccggaaggcgagaggaccggcggcataaacaacgttatcgtagccctgaccagtccatcgcttaccctcgtcacggagtggcgcacccttgatgtcagagtagttgatgtttgtggggttgttgcacttgaaatccggcgacgcctgaagtcgtacgtggcacgccttgctcggatcacccatgaagaagtcagagactttggtcacgccgagctctgtctggaagtagccgctctcatcggcgatggcccgcttgcactccatgacacgattcttggtgtcgtggcaggtaacggacacctccgccttgggcagcggcatcgcgccattgaggctatgcgtgttccggtacgcgcagctctggcagtacaccatgccctccaccctcaccagcaacttgtcactgtgggccggcggcggcggcggcgatggtgtggtgtagccgttgttggcagtggcgccggcggccaggagggacacgaggatcgcgagaggaaggaaggcaaccattgctcggagtcggagctagcttggtgctcaacttaagatggtttatcttaacctgaagttttggtgtgagaaaatggagagaagcatggggtttatatactgccatggactaattaaacgtgcagacatgtaggaaatcactaactgtcttgattttggattaagattgcattttatttttgtgaagataacatgtcatgattgatttgcaaggcacttctaagagaagagatcgcgtgttcatgatctgctgtgattagttaagatcagtctgtagacgataaagaatgttcggtgtgaagatatgcagatttgtcagagaacgtgctgcccgtgtgtgttcccatctgcactgaaataccacaggttctcggcacaggcaaatgatttttggcgatatagagctacattatttccgttagtactctgaaaattaaggaacagcatatcatcttctgtgtaaaatatacggttcatgtagtatctatttcctttgggtctgaaactaactgaaagaaaacggggtgcagttttctgattgattgtacgcagagcaagtctgtttttttttacatgcggcagatcaatcgtgcgaagttttgtcatggtaaggctgcaacatctgttcgcgaggaggcccgggccaccggatctgacaacctcgacctccccgcacaacacggaaccgggtagcttaaggacacaagccactcccgccgccacctttttctatcactcttcgtctcgccatgcactactcctatcaacgttaagttaggagtgggcaaaatagaccagaatcgaaccaaactaaccaaaacaataatgaaaaaaattatggtcattagatctgactagccaaatttaattgatcaattcgataagtaggctcggtaaaccgaaataccctaaaaacaaaaatttaagaaaaagcacaacataagccgatcaaaccaacaaaagcaaaaccctatccacttttttctttgttccgtaactaccctttcccacccccaccaccctcggcatcgacaacaccacaacgcatcatcctaccgcatcaccgtgccgctccccacgctatcctgtcgcgcatcctaccactcttctgtactgctacgttgtgtcgtgccgccctgcttctccgcaacgatgcctcctcaagtggagatctagcggcactcatgatatggagatctagcggcaataatcgtgatagaggaaagcgcaggtgtaggaaaaaggtgaaggagagaaacatgcggacgccggcgaaaagcaaatgttttttttgttttacagtactgcgattttttggtttgaaattattgatgactattgttattcttttgcttctcaaaatttgttgattatcttcagtcatgacagatacggaggccgcattgctcggtgttggccactttttgaatgcatgtagaccaaggaaactttgatgtggttttcttgatctactcatttgacaatggctagaaagtatgtgattttcattgtacttgtgtaactcagtaaattatttattatataaacacatacaatgtaggagactctccttaaaaaagttttctagatcgaaaatcacaccaagtttattttgcagcaaactaataaaatcagaacaaatttaccacaaatatcacacaagagcaacaataattaaaacagaaacacaaaagaaacattatccacaatccaaattgagaattcagtgcctcccatattaacgaaaagcgcacgtgtaaacgccacagacgtaggcacatgcacggggcgcctcttaatgcttgggagggcagatcgctggccggaaggcgagcgggccagcggcatacatgacgttatcgtagccctcgccagtccaccgtttgccctcatcacggagcgacgcgccctcgatgctggagtaattgatgtttgtggggttgttgcacttgaactccggcgacgcctgaagtcgcacgtggcatgccttgctcggatcgcccatgaagaagtcagagactttggtcacgccgagctccgtctggaagtagccgctctcgtcggcgatggcccgcttgcactccatgacatgattcttgacgtcgtggcaggtaacggacacctccgccttgggcagcggcatcgcgccgttgaggctatgcgtgttccggtacgcgcagctctggcagtacaccatgccctccaccctcaccagcaacttgtcactgtgggccggcggcggcggggtgtactgctgctgcggcggcggcggtgatggtgttgtgtagccgttgttggcagtggcgccgacggccaggagggacacgaggatcgcgagaggaagctggaaggcagccattgcttggagctagcttggtgctcgattacctgaagttttggtgtgagaaaatggagagaagcgtggggtttatatactgccatggactaattaaacatgcagacatgtagatggaaatcactaactgtcttgattttttattaagattgcgttttattgtgtgggctatttaattctgacaaaatataatgattggcctggaggagaaaaaaaagaagataacatgtaatgattgatctgcaaggcagttttaagagaagaaaacacatgttcatgatctgcttggtgattagttaagatcagtctgtagacgataaagaacgttcggtatatgaagatatgcagatttgtcagagaacgtgctgcccgtgtgtgtcctcaactccactgcaataccaggttctccagagagacaaatgatttttgccgatagcgctacattatttccgttagtactctgaatagtactctgaaaaggaacaagcatctcatcttctgtgtaaaatatacagttcatgcagtattgtcgtaccatgctgttccttttcttttggtctgaaactacctgaaagaaaacggagtgcagtttcctgattgtttatacaaacaagagatgtaaagccaaattactggacgcaaagcaactatgtttttttacatgcggcggatcgatcaagagctaacactgcatgattcatggcgctatcgccattgccagtttgtcacggtgaggttgccagatctgctggcaaggaggcctaagccaatacaaccccgacctccctgcacaacggatccgggtagctagaagtaagaacacaagccactcccaccgccaacctcttctaccactctccattttaccatgcaccgtccctatcgacgttcggtttgggtggtagtggtacaaatagaccgaaatcgaaccgaactaagcaagacacaaacaaaaaaaaaaaggtcacttgaatctgtctagccaaatttaatcgattaattcggtaagtaggctcaataaactgaaataacttaaaaaccaaaattccagaaaaaaaacccaagaacagaaaaccaaactaacaaaaacaagccctacgtactcacttttctctctattacatttccctaaacccaacagcagtccaccaaatcaacaaaagcaagccctactcacttttctctcttttccatttccctaactaatctttcccaccccacgctagttggaaaccgccacactagcatcacggcattgagaacaacacaacgcatcgtcctgccgtgtcaccatgccattccccatgctatcccgtcacgtatcccaccacccttttgtgctaccactccgtgtcgtgccaccctgcttctccgcggcgataccttctcaagtggagatctagcggcggtagtcctgacagaggagggcacgggcataggtaaagggtagaggatagtaacatgcggacatcggtgatagaaagttgatttctttgtgattactatgatattattttgtatgaaattgttgatgactatattgtgattcttttgcatctcaaaaattgttgattcttttcggaccgaggccacattgttcggtgttggccaaatggccacttttcggatgcatgtagattaagaaaactttgatgatctacttatttcacagtggctaaaaaatttgtaattttcattgtacatacataactcaataaattatttattacataaatatatacacggtaggagactctccttaaaaagcgttttcttgatggaaaatcacatcaagtttgatgtgtatagtaaattaataaaatcataatagatttacaacaaatatcacacaagagcaacagtatttaagatagaaacaaataaaatgcatatccaacatccaaattgaattccacgcctcccaaatttatgaaaagcgtgcgtgtaaacgtcacaaatatagacaccgcacttgtgtggggtacctagttttagtgcttgagagggcagattgccggccggaaggcgagagggccggcggcgtaaacaacgttatcgtagccctgatcagtccatcgcttgtcctcgtcacggagcggcgcgccctcaatatcggaggagttgagtttgtggggttgttgcacttgaagtccggcgacgcctgaagtcgcacgtggcatgccttgcgtggatcacccataaagaagtcagagactttggtcacgccgagctccgtcaggaagtagccgctctcatcggcgatggcccgcttgcactccatgacgcgattcttggtgtcgtggcaggtaannncacctccgccttgggcagcggcaccgcgccgtcgaggctatgcgtgttccggtacgcgcagctctggcagtacaccatgccctccaccctcaccagcagcttgtcgctgtgggccggcggggtgtactgctgctgtggcggcggcgggggcggcgatggcgatggtgtggtgtagccatagtttgcggttgcaccggcggccaggagggacacgaacacgatgatcgcgagaggatggaaggcagccattgctctgagcctctgagctagcttgctgtgctccgtggtcgactgagatattctgttttgaagctttggctgtgccgaaacgtagagaggcatgtgggttatatactgcataccatggactaaatgtgcggacatgtagatggaaattaattgtgctgattttggattaacagatcaaactttatttattgttagtcgattttgacaatatatataatgattagcctggcgaaataaatgatctgtaacgattgatctgtaaggcacttttaagagaagaaatcacatgctcatgatctgcttggtgattagttaagaatttgtagactaccgaaaatattcaggatgaagatatatattgagatttgtcagaacgtgctgcccgtgtctgtccttaacggcactgcaataccaggttgtctacacaagcagatgatatatatggagattatttagtagctacattattctccataaagacaggtttgctattttacttgcgatagatttttgggcttctatctttttatactttgtccataagattttgcgtcaagatttgattttgcgtcaagatttgtgtttatgtagttctaacttgcagttagactcatttatatagtatgtttcatgtagtattcaagtaccatggcgtcttttttctttgggtctgaaactgacagaaagaaaacaggtgcatttttctcactgtttgtagaaacaagagctttacagccaaattactggatccaaagcaagtctgctttttacatgcagcggatcgatctagccaacaccacatgatgcacggcgctatcacccttgtcaccgtgaggctgatgcatctactagcaaggagcccaaggccaccggatctagtgacctcggcctctgcgcgcaacagatccgagtagctggaggtgaagatacaagccactcctgctaccgtcctctttgatcatcttcgtcttgttgagttgtttcgcggaggcccatcgtcgggaggcttgggccggagcgtggcggagactgaagctgacccattgggccgtgcacctggggacgcctggaggtgcgggggcggagcccccgcgaaacggatcgtcatccattttagggttccaccatatatatacctcatgtaagccgccgtgcggcgttgtaacctctccccagatatagtgaagatattttgctggctagcgtccgtggttttttctctcctactttggaagggttttccacgttaaaatctcgtgtcttctgtgattgatctattgttctttatcgtttgtttgcctatcgtttcctaatacgtctcactctacaccgccctatcgatgtttggttaagggtgggcaaaatcgaactaaccaagatagaaataaaaaagatatgatcactgaatctgactaactaaatttagtctatcgattcggtaagtaggctcagttaaccaaaattccaaaaacagcccaataacaaccatcaagaaaaaaacaaaccatactcacttttctctctattccctaactacccttctccgccccaacatcccaatcatcactcgtcacgataccacatcgacggcatcaacaacacctacatcgtcttgccacttcgttgtgtcgttccccacgtagtcccgctgcgctgtaccaccattctttcgtccatggccgagctaggaattttagaaagggaaaagtccaaattacccccctgaactattgagtgagtacgaattatcctctggacccgaaaatcagacatcattcacccttgactattaataacagacaaagatcaccctgagcactattttggagcggttttgacctaaaattgtacatgtgcatcaacgtgacaatccagtcagtaaaaaaatagaaaaaaaatccttggacccacatgtcatctctctccctcccctgccctctctctctccacagcacccaacatcacttgttacaaaaaccacttcactcctccattaatcagaagcagaagacaacgacgaaggatcgtgcgttgcaggcatcgggagagggagaggaaggcaaggtggacggggatgtgcctcgcatatatgtgtttcacaccgtcgcatggctagtgttgctcacgctcgcgtcgtgccccacttttgcctctgtccccacccccgcccgccgctaccgtgcttggctccccatccgccagctgagagagacggaggtgaggggagggacaaga

SEQ ID NO: 83619 - DNA, 9194 bp, Oryza sativa
actggagactgacatcatagcttttaatttcctaaaccattcatcaggcaatatgcccgagaaattgtttgaagctagatcaagaattcggagatgctgtaattcacagtcatcatctttggtaagagtaggccccaactgtccgtagaacttattggacttcaggacaaggacttgaagtttaggaagaagatgcatccaacatgggaaagagcctccaatttgattgttcccaacatcaagtaccaccaagtttttgcaagcaactaatgatgtgggcagttgcccttcaaatcgattgtagctgaaatccaatgcctcaaatgcacaatcttccttgatattgtgcggcaactctccgttaagttggttcgccttcaagtttagtacttttattgttgaagaattctccattaagcaagaaggaattgaaccatttaagatattgtaggagaggtcaaggatttgaagactcttaacagtgcagaatgttgatgggatttctccagagatattgttcctagaggcctttagagatagtataccggcaagataaggaattaaatcaaatggcatatacgaaaaccgattatttgagtaatctaactccaagtctgaattctctttaggtataggtatgggcccttcaaacatgttataactgagattgatgtatcttgtgtacaagcaggggagcaaagagtcgtgtcctatactggtaaacttattatttgacaggtccaagaagaacaattccttccaagtttcccatgcccatcgaggtattggcccatgcatttggttatttgaaaggtcaattacgtgtagctcatcttgatgctttactgcattgggaaactttgatatgttgcaggatgctaggctcaattctgctactttgggagaacgcactactgagtcattgactaaaccgtccaccacagataatttattatttgaagagcaaggtctgataaatatggtagtctccagaatgaggtaagttccactgtccccacaaagttgttgattggaagatgcaagctatgcagttgtgtcaagttaaatatttgcaatggtatgtttccagtgaagttgctcttgaataaagacattcttctgagattcttgagattgcctatggaagatggtaaagatccagacaaaccacaatgagaaatttggagatctgtcaaagatgttagatttgttatccaagctggcattgatcctactaggccgagccccgaaacctcaaataagttcaaggatttaagcattcctagagaagacggcagttctgtagggaaattatttgcactcagactcagctccttcagatccgtgagattagaaatagagcttggtatgtaacctgagaacttggtgccactgacatgcaatttgatcaaactgctattaggtggaaaattgggcaaatcaccataaacttcatagttgtagctaatatcaatagctgtcagttttctgttctggaagatcctttgtggaaacaaaccctcaaacttatttcttgaaagctgaagaacaccaagggatgacaaatcggcgaagaactcaggtcatacaagtcattttcttgcaagtcaacaacagagatatggcaagctgaagagagactgacagatgggacctgagatcttgcaaaatggtaggctcagaacctgatcttttggagtggaattaaccagagcgttgcaccatccttcccctccattggacatatacacaaagccaagatagagctccctcagattgtcaagatttgcaaccaacctcagaaaatctaccttccagaagccccagttgggaaacgaaggtgccatgattcggcacgatcgtcttcttgattgatcacatagaaaagagttgataaatcgagagaaaccaagttggtgaggcttccaatacctgctggtatctggcctgcgaagctgggtggggagatgttgagatgggtgagctcagtgagcctctcgaatccggtggccgggagctgtgacgcgttgaagtcgttgccgccgaggttgagataccccagcgacgtgaggctgaagacggcggcgtcaaggccgccgctctgcaggcgtcggccgcctagatcgaggaaagtgacgcggccgccgtcgcagcggacgcccgcccagcggcagcagtcggtgccggcgcgccatgaccggaacgcggtggcggacgcggtggtcgccgagaacgatcgcttcagctggagcagcgccgccgcctggtccggcaagcatggaagcgagctcgcgatcaaggtttgtagtaggaggaggagtacaagtaacaacggctcgtactctcgttgggctacccgaggtgacatcttggcgggtggcagctgaatgaatgactatattgtatgatgcttgaaactgatttttttttatacatgtagagctagagagagcctgttcagtactccaagcctgacttgtatgactgaattgtgatagtgtgatggtgacatactatatcaagtcaatgcaaatgcaaataatcaaagatgccgttggcatcgtagtcgtatcgtacgtgggacgtacttaacagattttgatcgtgtcattatgtgaacaggtgtacatgcgtgtagacctttgtcatgatcagacaaatcacaaactgtagcacttatggacgaaaacagattaatccgagagcatatccgctccttgcagatggctgtagtgccgcacacgtgacacgtcgcgtatccgtagattcgtcaattcacctcggacactaatcgtgctacgtttggaaatactgttatttgagaaggaatagtctacttttatctcccttaatcgcaaaatggatgtgccctcacaatcttttaaaaagaactttttttagaaataatacaaatttaatgaaaattgtaagtggttgtctgaaatcacaaatttagcaccttatagaacaccaggttgttcgaccaagcttaaaaaattgggaatttgggatgtgtgtgcatacatgtgagtgggttgtgagattgttaacgaccaaatttgataatatcagcatcggaaagggagattagatcgaagcggaatctaagatgaggattgtcgcgggaacagagcaagaattggctggagtccggatcggctacgattggatcggctaagttcgagtcagacttggttaggtaatgcagccgatttcgataatacgacttggtgtacaacatcaggttgggttgatatgcttcaagatgattgccacgcatggatagagtcctgagaaggcaattgtatctattaattaggatattttatgtaatttccttagagatatatttgggcaaaagtctgccgcaaagacttatgatatcttagagtttgttagagataagagtcgtgtccggtatggacatattttgtaattctcgggtataaatagacccgaaccccatgtaatcaaacaacatacgttcaatacaatctcggcacatcgccactctttttgctttcgttttatttcgacgagttcttgctttcgggttgagctgtatcggtttcgatcttcaacaggaggtaaaacttgttatgacggcttgcgttctcgggattagtgcttccatctttatgacactctaatcttgtttatgtaatttatcgagttatcatatatcttacataatcttcggtaatatcgtcatctaacctacaatcggctaacatctgttaatagaaggcggccgattaggttaaatagcgacgttagcttggattatataagatatccaccactctatgaaacatccaacgacttgattgtctagatattgttctttttttcatacttaatgttgcaacagttgagtttgatctattaaatcgtgcttagaatttcaatctctagcctgtcttccggttgccgattaggatagcatcggggtttcagccgatcttacctgatttaactatagttattctatatgcttgatcgacatgttaaatctgccctttatgttaagatcttgttgcttttaagtatattaggcttctgcttggtatgttctacttgctttaatatcttaatattgagcggtattggagtattagccgatgcatgctagatctatctgatcggctatgctatgaacatatataattttgttgttaatatatatttcgatttaagtgatttatactgtatcggcatggcgaccgatctatcccaatcacttgatttaagtatatatcgacataaggattatatattgttaatatctacagccgatcgggtagatttagttcttttttacttatcaatgactgccgatcaatgcttatatgacatcggctcaaagataaatgatatgtcatcggcacttagccgatcggctatcatttatgggtttaaccacggcttctttgtttctatttcttgttgattgcaggatcaaatcaactggcacgctagcatacccgaaggcgagttttagacctgcactggagttaagcagatctcctaggcctcgtgttttccatcaatatagacctgcagcatagtacttgcttgctctctttttttataatcaagccacctaacctgtcgaatggctgttgttcgtcaggtataaatttatgtctgtcaaacaatggttgtttgatataatgctaaatttgtgatttttatcaaccaatatctgtatagctgagatctatataaataaactttacatatagcaatcctcataatgtataaatacaagatatcattaagagaagagagagaagtcgagatagataatattatttattccatatgggtagtccatatgcatacaagtatcttttgttattttttttatatggaccagttgcacaatggttgtaggtggctaaatgtaatgttttattgcttataaactacttttgcactgcattgtaaatgctccttggttctttgcttaaagacgacggttgctgatgttctggatgactggatccttttggttttaggcttttgttgcaagttagggggtgtttagattaagaggtgtaaagttttggcatgtcacatcaggtgttatatagggtgtcgcatggggtattcgggcaataaaaaaaaactaattacaaaatccgttagtaaaccgcgagacgaatttattaagcctaattaatccgttattagcaaatgtttactgtagcactatattgtcaaatcacagagcaattaggcttaaaagattcatcttgcaaattagtcataatctgtgcaattagttattttttagcctatatttaatacttcatgcaggtgtttaaacgttcgatgtgacagggtgaaaaattttagggtgggatgtagaggctgcgttcggtgggacatgttcccaacttctcctcctcgttttccgcgtgcacgtttttcaaactactaaatggtgtgttttttgcaaaaagtttccatacgaaagttgcttaaaaatcatattaattcagttttgaaaaaaaattagctaaaacttaattaatcatgctaaatgctgcttcgttttgcatgacggggaatgagggttcccgaacacagccttagttccgatggcaacatagttttgtcgaaagtctgcagattttttgtgttgccttaggccatcaccaatgcggtgcttcagcccgtgcccctagcgacggacatcccctttttcatcggtgtcgtcccctgcgatggaacgcgtccctctgctgggggatgcggctctctctgtgcctcactagcttttcgtgggaagacgcagccaggcgccgcgttgtgcgcgtgtggagctcgtgggcacggcgtcgtccccccaaatttccccttacacccttgtctctctcgctctccccttggtctcgtcgcgccgcgcccgacaccgctggcgccgcgcctaccaccgccgggaccgccaccgtcggccttagagagagagagaagagagaggcgacggtgatgacgatggatcggcgacgaccggatccggccaccgcgcgccgcggtagccatcgaccaccagctagcgacgggcggagatggcttgaggcgcctgtgctcgccgcctcgcgcgccttgcccggcctcctccgccggtgccttgcccgccaccgccggcgccacggggggcctagatccacccactacggcgccggatctggcgctcccgactgaccacgacgcgaggcggaggatgccggggaggacgccgacgggagagagaggaagagagaggggcggtggtggacgccggcaacaggagaggcggccctcctcgtcgtcctcgccgtcgctcccgctgctcctgtgacgcaccatgacgccgctcccggtccgacgaggccgccgcggccaaggaccgcgccatcgccgagcacgcctcgagtctccggcgagcggcggcaacgagagggagaaggagagagaggtgagcggcggaggggaggaggcgcgccggtaaatgagaagagagagggggggggggagaacagaggggtagtatagtaaaatacctacgtgggctttttgggctaggggcactcgttaggctactagggtatctttcattgtgagggggggtttcccagagagtactctcagttagtgagggtagtcttagagtgttctgattgtagatgcccttagaccgagttctcctttattcttgaggttgcccttagaccgagttccccttttttcttgaggttgctgcgttgaaattctggatcttttgttttctttagagcctgtttagattgtagccaaagtaaaccttaccaaaggcaagatggtaatattgccaaaattttgacatgatttcttatgtatttaccaaatatggtaacaattaaacgtagatatttttttgacaacttaattaaaaaaaattagtatggttgaaaatggtgaacaggcgcttagtccttttgtttcctttaagaatcttgtactccctccgtcttaaaaaaagacaaatcttagatttttgtgtccaacgtttgactgtccgtctcatatgaattttttttataactagtattttcattattgttagatgataaaacatgattaatactttatgcttgacttatctttttaatttttttcataattttttaaaatgaaacggacggtcaaacgttgcacacagaaacccaggatttttctttttttttttttttttacgaagggagtactagctttactatgatactatctcatctctgtcaatggaaattggggcctcaaaagcccttgaaaaaaaaaactacttcgacggggaggcgtagggcaggatgttgcccggcgacgacgaggatggccggcgccgccgtttacaacaccagatgaccagacgcgaggcggccatgtacgcctccggttgctttgcctctctgcgacgcctccgaattgagagaaagtgaagatgtgcagcggcggttggaggcggtattggctgcaggcgggcggggtctctcccggccatcctcgtggcgagctcggggcgatctccctctcctgtacgccgtggctgaagcgcatgccgcgccctggagtacttccactcctcgtcatccttctactccacctcatcccactcgaagtactcggcggaatgggggcgtgtggtggtagaggggtgagattgaggaggcgacgagggagagagatggtatccaaggttccagatcgtcgcagtcggcaattaacggggtctccatggccatggacatgtccaaggaaatgcgcgcagttcatcctattgccatcggtctcgtcgtcctctcctaccaccacgtgttcgaggaaatgcgcctctcagcggctgcaatgtacaggtgagagcacctgaagcgtttcattttccaaatttggtgtatgcggtgcagtatttgggtttaggattcctagaatactcttccattgttgattgtgcttagcatctatcgaaaacgagctcttactggatgtttgatgccgtggtattaggaatggcagtttacttgcatatgtgattgttcagcacctacaatgacgaactcttgggtcactttctgttggtatcatcgcctacatgctaacacgcacatgtctatttcaattctcactgcatttggcctataagaaaatagtttatctctaatactgaaaatgttgtcttctattaggtcattgtcaatctttctgagaaatcataaggaacttcacggacaaatatgacatatagctcttttattgatcatacaataaaatcaatatttttagagttataccattcctccaaaatatcaggcatactttccaatgaccatgcacaaagatataggatgtatttcatattccaattattcccctagtaaccatccagctttaccttttccattcatgaatgcaatagatatagtcactagagataataattgtagctattctagtcattttcaatgtctcaattgtcatgtacaaggcaagatacaccttttctttggacaaagggagtacttggtgcttggtagatccttttgtttttcagcctattttcggccttgattttgcattgttcttagacgagcccagcttggacttttggcttctgtttttattaaatggaattcataacactggatcatatttagaatgcctgttaatttcttctatgaagccataaaaagggaaaataagaaactggaaactaatagcttctgtggatgtgagataaaactataaaagtttagctgactagtttgctctgtagaaaaacagtatgcaaggtgtatgagagctcacttggagattgtgctatttcttaaaaaaattgttgtagtttggacattacaaaatttaactggctgctctgattggtacccagtaacagtttactgttttcataagttctaattctttgttggactcatttaccaattaagaaaaccataacattcttttaataagtaacatctacaagaaacccagaccttaatttcaacaagcattttatatagcactcataagtgatacctgggaaataaggtcatttctaagttcacgctattattttaggtaaggacacacagtgacggggcaaactgcttttaagtaataactacactattttccaaagccaaagcaaagtagattcagtgatatttctaaca

SEQ ID NO: 83620 - DNA, 10464 bp, Oryza sativa
  unsure (1)..(10464): unsure at all n locations
gctcgnccgagccgccccaaatctattgggccgcgccctagccgcccgagagaagtctatgtccctccctcccttcttttctttttctttttccaaaaaggatttaactaaatcctttttcctttagataaaaaattcaataatcttagaaattcaatatcttcccgaccataagtccgtttgactccgttcaacttccaaaattcctcaaatctcgagatctatctaatggcacgtttagaggtcattaatagggctttattttcgccgtttgttgagttgtcccgtttcgcgtgtagtttcggagcccgaagacccgcagcgcgaggatttcgaggatcaagctccagatctcgagcaaggcaagccacctcgaacatcttgagcctatatttgaaatttaagtatattgcttgcaaaatattatgcattgataggatcgcacttaatctgttgtcccgtctgcaaggcagattggcggacttacctaacttgttgcatttgatcctcccattgttaattgctataccatgtccccttgtaaccacccagttgcgcctcgatattcgtgcactctgtacgagtatcggcggacgccttcaaacttaaaacctgaaaaacaatttgggtaaaactggagttttacaaaagacttggaaaacccgacacctgggtcggtgcttgtgaactaaatgattttccaaaaccgcggaccggggaacgtaccgggtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagcatggtctgggacctaacctgttgttggtctgggacccctctcgtcggcatatggtaaacctgtgtcggcttttgaaatgccttgtcatgaaagcttggaggtctcccgacgtggctgatccccacgggctgggtgacccgggttagtaatgtcatgtgggtaaagtgtaccccctctgcagaggtcattaaactgttcgaacagccgtgcccacggtcatgggcggatgtgaggtgattcctagcgtagttttgtttgactactgcttgtgaaattgctgttgtgaaaaggggttcgatgtttgaaaaaaaatctgcagctgatgggatcagctaggcccgggtggccgtttgaaaagttgttggcccgggtggccgtttgaaaagctgttggccgggtgccaaccttgtttcaattctaaagactgatacattgcacatactccgaccggacgagatgcactgtctcatccgtgtcgtttgagaagcactcacctagttgttttagaaaagagatcaaataaaataaattgcaaaaacaacagcctttccttgaagcctgcattaaacacttatttcccctggcttgctgagtactcccgtactcacccttgctctatataaatatcctcccccccagttgctgaagaagatgaagcaaatcctgctgatgaggagttcttccaggagcaagctggttacgatgagttttagggtttcagcctagttcccaagtcgcgcctgtgatggttggtccaagtcctggcttccatttcccttttgtaatgcagttgtgagctcgggatctgtccgcagcccaacatgactgtactcttactctataataaagagacctctgttgctgtgatattctatcttcctgtgataccagcactgtttcctgggactggtatcgattaacaggttaatttggaacgtcacgggctagttccagtcgggactagttcggggcgtgacaagagatggtatcagagcacaggctttgccctagggcgaaacccgacgcttaggacgaccctaaggatactaagttcaaaactacttgcgaaaagctaaggtttcttttgttttctttattttcaatagtttgtttccaaaatggttactgatctttctccctctttcaaaattgtagatggcagtgaacgccagcttcagttcccacggttttggtgagggtcaccacgtcgcccagcttcgtgacctcgcccgtttccttggcttctcgtgtcccgagtacacggggtactccgtggaccgcgttccccctcactgtgagctctctgtgtacctttacccccgtggaggtatacacggagctggccttcgcccacaccacttcactgtggccaggcctactctccagatcgcgtaccaggacctctcctggactgcgcttcgtcgcctggcccacgactacagccaccgtctcggaggctccgccttccggcagtttccacgccttccttctggccactcagacgccaggtacccttgcccgtacagcgagtctcagccagtgctgactcacatggttgagctttcggaggctcaggccacccagcacgacctactccttgaggcttaccgctctcttgctcgccgctacgccgctttggaggcccgtctggccgaggagggtgtcacctcagttgacactatctcttgggactcaggtcgcctctgccacgccagccacctgtcctcccacagctcccgcggctctgctcgcactcccagtggcccgcgctcccccagctcgcgtgcgccgtactcaccagtgtactccccctacccacacccagttagcccttcctacacccccggtcacaccccagttgcttcctcccgccgtggcccacgctttatccgcactgcgcggaagcgtgttgttggttcttccaccgtgttccgtttccactacccagctcctccaccgccagcggcccgtgctgctgccggccctcgacaggttccgccggccccttcgcgccagccgatcgacgtttcttcgactgaggagccgactacaggaggcagccaggccgacgaggagtagaggaggcagtcttcagcagccgtccgtgtgttaggcccttttgttccgccgccaactcttttggagtcgtggcgaggtagtgcgtgcgtgtgtttgttgtgggtgttgtttggtagtctggttctcctaggtggtgtgcgcacagtcaagctcggcgtagctctgtgacttgtccacacccgttgtatcaggtgtttttatgatttgaaaaatccagtttatgcctagtgtgtgctatctgagttgctatttactttgctccttgccctcctaagtgcttatctaactcttacctcgccctcttctgggagtttagatggctagccgcccccgccgtgcagcccgtgcaccagctcgctttggttttgaagatggtagagtcgaagcagaagcaaatcatgaatcagctaatgagcagtctcaccacagcaaccgttcgcaccgtactgtttcccgcaacgcagaagttgagcaaccccgccgcagcaactgctcgcatcgcacagtttcccgtgatgcagagatggaacagtctcaccgctcttaccgcactgccagtcacaattctggagaagaacgcctcccttccccacctcatgtggaaaacaacatgcaacacttaatggcagttcagacgcaaatcttgcaaggactaaccacagccatagccagttttcagcataatgcgcatggaaatggccacccccacatgggcaacaacagatccaagctgatagactttctgaggtctcgtccgctagagttctctcagaccgtcgagcccgtcgaggctgacgattggttgaaagatgttgatagaaaactcaacttagtgcagtgtactcctgttgagaagacgctctacgcctctcaccagctaagaggacctgccgcagattggtgggaaaattactgcaatgcacatcctgaacccactaacattgcttgggatgagtttgctacggctttccgtgcagctcatgtgcctgaaagcaccattgacatgaagaaagaagaattcaacaggcttaagcaaggcaacagcagtgtcaatgagtacctaagtcagttcaacaagttggctcggtacgcccctgaagaagtggacacagatagaagaagatcaggaaattcttgaaaggtatcgcagttggaatgagactccagttgcttgctcatgacttccccacttttcaacatatgatcaacaaggcactcctacttgaggatgccagaaaagaggctaccgaagaatacaagaaacgctagtctaaccatcagggaaattcttcccgaggcgcacctcgccctcgctacggtcaacccatgcaataccaccagtcggtcactcagactaaccgccagccaggctacgcccctcgtcctcagatgaaccgtccggcacctccgccacagcagcgtgcccctagtggcaatactgcgccaaacagtgttacctctttcaagtcaccacagggaccgtcagcagttcagtgtttccggtgcaaccagatgggtcactatgctagacagtgccctcagaatcctaccaacaccaactcagggcatgctaatggcagcaatgccagaactcctactccagcggcagctcagtctcgtcctagctctcaggcaagtggacaaggttcacgtgcttccaacaacttcggtcgaggccgtgtgaatcacattcaagctgaaaccgctcaggatgctccagaagttgtgatgggtatgttctctgtcaactccgtacccgcaatagttctgtttgattcgggagcttcccattctttcatatcgcaagcttttgtgaaaagaaatggttggaaaacccaaaatttgcgtgtgccaatgatagtacattcccctggaaggaatataagggcaactcaaatatgcccggaagttaaccttagaattgaggaagttgacttcctagccaaaccgatagtcctagactcgcaaagcttggacatcatcctagggatggattggttggcaaagcacaaaggacagatagattgtgccgaaaagtccatcactttgcaaggacctggaggaaagcaagtccgctttacccctaacactcctaccgcaaatcggtctattctaacctgtttacaagtcacctccttggagtcggtgcccatagtctgtgaatatcccgacgtatttccggaagaattaacaagaatgccaccagaccgagaaatcgagttcgccatagaactggcaccaggcactgcaccaattgcaaaaagaccctaccgaatggcagctaatgagttagcagaagttaaaagacaaatcgaagagttggagagtaaaggttatgtgcgacctagctcatctccttggggagccccagtgcttctggttaagaaaaaggatggctctgagagaatggtaatcgactatagagccctgaatgaagtaactataaagaacaagtacccgttgccacggattgacgatttattcgatcaacttaaaggagcaagagttttctcaaaaattgacttgaggtcaggttaccaccaactgaaaatcagatctgaagatatcccgaagaccgctttctcaacgcgttatggtctatacgagttcacagtaatgtccttcggactcaccaatgctccagcatttttcatgaacctaatgaacaaaatctttatggaatacctggaccagtttgtcgtggtattcatcgatgacatcctgatatactccaagaacgagaaagaacatgctgaacacctgaggctgataatggaaaagctcagaaatcatcgactattcacaaaattcttgaaatgcgaattctggttggaccgagtagcatttcttggacacgtgatctcctccaacggtgtcgaagtagatcccagcaaagttgaagctgtacttgcttggaacccgcccaagaacgtgtcagagatccgcagcttccttggcttagctggatattatcgaagattcattgaaggattctctaagctagccagacctatgaccgagctgttaaagaaggaaaagaaatttcaatggtctgcagcctgtgaagacagctttcaggaaatgaagaaaaggttgaccactgccccagttctcaccttgccagatatccgaaaagatttcgagatcttctgtgatgcatcaagacaaggcttaggatgtgtcctaatgcaagaacgaaaggttgtggcctatgcatccaggcagcttaggcctcatgaagtcaattatcccacccatgatctcgagttggcagccgtggttcatgctcttaagatctggaggcattatttaatcgggaacagatgtgaagtatacaccgatcacaaaagtcttaagtatatcttcacacagaccgagttaaatatgaggcagagacgatggttggaactaatcaaagattacgatcttggaatccactatcatcctggcaaagccaacgtggtcgctgatgcgctaagtcgcaaggcctattgcaatatagcccaaatacggcctgaccaagatcacctgtgcaaagaattggagaagttgagggtgaccgtggtacagtcaggtgtccctgccagcttgacggtacaacctaccctagagtcgcaaatccgggaggctcagaaagacgacgaagggataaaagagttaataaaaagaatacaagaaaagaaagacaccaatttctccatagacgatcaaggcacagtttggtgcggtccacgcatctgtgtaccggccaagaaggagttaagagatctcatcctaaaggaagctcatgagtccgcctactccattcatccaggaagtacgaagatgtaccaagatatcaaggcatacttctggtgggctggaatgaagcgagatgtcgcagaatacgtagccttgtgtgacatttgccaaagagtcaaggcagagcatcagaggccagctggtctgctgcaacccctaccgattcccgagtggaaatgggaagaggtcggaatggatttcatcaccggtttgccaagaacccccagcgggtacgactccatctgggtaatcgtggatcgactcacgaaatcagctcatttcgtgccagtgaaaaccacctatgatggaaagaaactagcagaactctacatgacccatgttgtatgtagatttggctgtcctaagaaaattgtgtcggaccgaggcactcagttcacctcaaggttctggaagcagttgcatgaagccctcggaactgatctgaattttagtacagcctaccatccgcagaccgatggtcagaccgaaagggtaaaccaaatcctagaagacatgctacgtgcgtgtgccttggatttcgaaggcacttgggatcgttgtttgccgtatgccgagttctcgtacaacaacagttatcaggccagcattcaaatgtcgccgaatgaggcaatgttcggaagaaagtgccgcacccccttgtgctggaatgaggtgggcgaagccctggtattcggtcctgacatactcaagtcagcagaagaacaagttaagctgatccgagaacgtttaaagacagcgcaaaaccgtcagaaaaattacgctgacaatcggagacgtgaccttgagttcgaaaaaggagatcatgtgtacctacgggtatcacccctccggggtatgagaaggtttgggatgtccggcaagttagcaccccgctacatcggcccctacctcataaccgccagacgtgacgaagtggcttatcagcttgagctacctgaaggtctcgccgatgtgcacaacgtgtttcatgtatcccagttaaagaaatgtcttcgagttccagaagagcaagttcccctgggtaatatcgacctggaaaagaatctgaccaacaaggaaagaccgatcaaggttcttgaagaggcagaacgtcagactcgaaggaagaccatcaagttctacaaagtccaatggagcaatcattctgaagatgaggcaacctgggaacgagaagatcttctccgcgccgagtttccggagctgctcccttaggtgctaaatctcggggtcgagattcttgttaggtgggttggtctgtagcgcccgttccgtcgtggcgcctagcgggaaaattatctcttaaaaaccctaattgcgaaatttgtttctttgcttgttgtctagtgtccgtgccatctcaagatctcaatccccgatctatcgtcgagttcaattccgaatccaattccctccaaatcaattcctccgcaaaagtctagtttgcctcccccgggtttgatgggccgatttccgctcggcccatctctcccccggccccctctccccgggcgctctctctctctctctctctctctctctctctctctcctctcgctccctccccaccccggcgcgtttccccccccccccccgctcgctgctcgcgcgtgcgagagccgcgccgagcgcctctttcttcgctcccctccgctccgcccgcgcgccgcgcgcgcgtgcgcgggtgtcaaccgcgccgagcgccccctcctctcgcgcgagctccccgctcgcaaagccggccccgcgccgttgctcgcgcgcgcgcccgcgtggtttcccgcccgagccgcgccgtctgcgccgtcgtcatcgcccggtcccgctgcccagccgcgccgcccgttgcttcccgcgcgcgtgtgccgagtggccgaccgcccggtcgccgccgtcgtcagcgcctgcggcgcctgacgcccgtgtcgccgctccgctccaatccgctcgccgtcatcgccgtcgtcatcgcccggcccccgccactccgcgcgcaagccgccaagggacggaggccgagctctccttttcctctgccgcgtcgccccgctccctcctctttttcccgtttcggcaaaggggcgagccccctttctctccctccttttccccttttctccttctttccctcgccggcgtcaccttctgtcgccggtggggacgctagccggagcgccagctcgccggcttgaccgcccatgtcggttcctctctcccaaaccgacattgccgcccatttaaacccgtcttccccctcccttcctttcctctcccattcgcctcctcaccattgccgccgctcctgtgctctgcctcgcctccgccgtccatcgccaagcgccgggagagccggtgcgttcgtggacgcggaaggggactccgggcgcgccctcttctcccttttcctcggcctgaggccggagagattactcccgtgccgtcggcctctcgtcacagcgcccctcctcttctcggtgatgcctctctccgttctccctcctcgctccatctcctcccccctagctttcggtagtagctcgagtagaacccccgtagctagccggcgccgccccaaccgtagccttcgctcgccgtgtgctcgccgccgtcgccgcccgagctccatagcacccgctcgtcgccggcctcgctcggcgtagttccgtccaatccgacgctagcgttgagttcccgaagccgcgtagatgctctcaccgccgggaattagcccctcgtggcctcgtcgccgtttcccctttctcccgccgccggttgccgccgccgcaatccgccgccatcgagcaacccccggcaaatccgagccgttggctcgtctcccctcgtctcgagcaaccgcccggtgtgctcgcttttggccgtatcgccgtggttcgctccgccgctcgccgctgtcgcccgccgtccattcgcggccgggtcgtcgtctacctcccgccggcccgcgtggctgccacgtaggcgccacgtcggcgccacctcggccgcgaccggatcagccgacccagccagccgctccctccgtttttccccgtgcgcgtggtccgcggtgagccgtgaggttgcgcgtgggcccgccgcatccgttcctccgcaaaccgcgcgcgtgcaccgcgtcccaaccccgcccgcgcgcgtgcgccacgtgctccctccgcacggtgagccgagccgctgacaagcgggtcccacccgggaccgcgcgtggtgagcccggtccaccggactctctctcctccctcccgcgcgcgcgcttgggccgtcttgggccggccggcccgttaagctcggccgagccgccccaaatctattgggccgcgccctagccgcccgagagaagtctatgttccctccctcccttcttttctttttctttttccaaaaaggatttaactaaatcctttttcctttagataaaaaatcaataatcttagaaattcaatatcttcccgaccataagtccgttggactccgttcaactttcaaaaatcctcaaatctcgagatctatctaatggcacgtttagaggccattaatagggctttatttttcgccgtttgttgagttgcccgtttcgcgtgtaggttgggagcccgaagacccgcagcgcgggatttggagga

SEQ ID NO: 83621 - DNA, 10963 bp, Oryza sativa
  unsure (1)..(10963): unsure at all n locations
aacttgtccggtataaaatcgcccactctgctgcaagataatgtaaaaatttcatctagtggtggtattaactctctcttttgcagctgcttttaaatcgtcccaaggaaatccaattgatgtcaataagcttggggtagtgtcgttgaaatcagaggctggtcaaaatggaaatgtgaaactaatttcgaaggaaggcacaaacaatgtgaatgtggtgcacccagtgagttctgtgtcagaatcaacattgatgccacctccggaaggcgcaaacaacgtgaatatggtgcacccggaaggcgcaaacaacatgaatgtggtgcacccggaaggcgcaaacaacgtgaatatggtgcacccggaaggcgcaaacaacgtgaatgtgaatatggtgcacccagtgggttctctgtcagaatcaacaccgatgcagcctcctgtgatgccacctccaattccgaagcttctttctccaccagcaccccaagctcccatgccaccattaaaggcttctcctgttcctcccccagaaccttcaccacctcctgctccaaaagctgcacctccaccgccaccaccaaaatctactggccctggcccacctcgcccgccaccgccagccatgcctggttcttcgaaaacacgcccaccgccacctcttaagccaggcgctaaggtgggtgctgttgaaaattctaatgaagctaaaacaaagctcaaaccattcttttgggataaagtaactgccaatcctgcacgatcgatggtgtgggaccaccttaaatcaggatcattccagtaagtcttcagattaaattgaagctgtgcctgaacttactattgcaagaacacactagtttaaagtatctgaactgtttcacaggtttaatgagcagttgatggaaaacctttttggttataattcaactgacaagagcagtgacaccaagaaagatttatcatcgaaagatgccactcaactcataaggatacttgaccccaaaaaggcgcagaacctagctatatcattgagggcgcttggtgtttcacctcaggaagtatgtagtgcagttaaggaaggtaaagttcatcctgtatggaactcgtcttttttattcttagcacacactcacagtgctttctagcttcatatttatcatacatacagtatctttgtaaaagttggagaactcagctatgatggaatgctgatgctctgaattattatcagacttctagtttactttgcttgcaataatgtatatggcatacattgtagatatgtgcctatttcaatttagttttcaaagtgacgagatgagggttgctctcttctgagctaagggtgacaagattaactttttttcaccaaagcgaattgtgcaaaagatatgataagtgaaatgattcatttcatctacttcaaccgctactattgagaaatgatttacaggattatactgcaaatagatgcatgttactagccattagaagttagattggtttctggtatacacaaatagtgcctccaaccattttgtttcaagaatttgatgttggatttcaccttaaccatttttcttgccaatttgtaggaagtgaacttccatctgatttgatacagaccttaataagatggtccccaagtaatgatgaggagctcaggcttcgattatacagtggggaactctttcaacttggtcctgcagagcaattcttaagagtaatcatagatattccttatattttccagcgcttagatgcattgcttttcatggccaatttaccagaagaagcttcaaatgtgaagcaatcctttgccactttggaggtaatgaaagattcattgtgaactctcaacttctagattatctcacattgttgtgccagttttgttcagttggcgatgtctagtattctattgatctaacatttccatgaagggttatatccaagtagttagttctgttacaataaatgcacttttactgcacagtttatgcctagcgatcggattcttaaaatatgagcctctgatcagttatgcttttaatgaattttgttccatattgattactattcttatctctgttggcatttcaatcccaatcaggtggcttgccaggagcttagaaacagccgtctttttatgaagttactagaagctgtcctcaaaaccggaaatcggatgaatgttggcactttccgtggtggagctcaggcttttagactcgacacgctcctcaagttgtctgatgtcaaaggaactgacggaaagacaacactattgcattttgttgttcaggaaatcattcgttccgaaggtgtccgtgctgaacgggctgcaaaggagcagaacagtggcgtttccagtgtgaagactgatgatctaggtgacaaaagtgagcaaactgaagacggttacaaacaactggggctgaaagttatctccagcttaggagatgaacttcaagatgttagaaaggcagctatcctagacgcggatcaattgactatgtcggtagcaagtcttggccacaagctcatgaaaaccaatgaattcttgaacatggacatgaaaagtttggacgaagacagtgggtttcaccgcaagcttacgcacttcgtacagcagtctcagactgatattactttcttgctggaggaagagaagaaaatgcggttattggttaaagacaccgtcgactatttccatggaagtgcaggaaaggatgagggcctccggttatttgtgatagtaagagatttccttgcaatgctggacaaggtgtgcaaggaggtgaaggaagcatcaaaagttgctccagtaaaagcaaaagccaaacagccctcccaatcattgcagtcattccgtgatccacgggttaatctttttccggcgattcaacacctgagggcagatagctctagctcaagttctgatgatgaaagttagatcaacatacctatgttttaccgtgcacactcagtgagaaaaattcatcaggaaatgataacgccaaaacaggttaaaactgaatcgatcttctatcgttgggttgttatctgttccgaccctgcattcttcacttttgaatttctgattctatcaagcaaaagagttgcacaaaactgaggctacacataattggaagggatgctatggaaagtaaaatttagcaggaaatggaaggaaactgacctcctagttctatgttagggcagggataaccggctgactgatagtctgacacttttttttcttttacacatttgtacaaccacagaaaggaagatgtatagacattagacagagatagaaaaagcaccacatgaactggcaaaacgggcaaatgtaacctttaaactgaaacatcatgtgttcctatcctgcgtgaactctcctgaaatgcttgttgcatggagaacaattttcaaaagaaaaggaaatatactaaatgtattcaatggtgaactgaatgaaactaatttgatgtcgtagatattgctacatttttatattaaaaaaggtcaagtttgactttagacaaaactcaacaaaattacttatgaaacggaggaagtacataatttcttttttgaatctataccaagtatgcatcattttgttggtcagacaataacccaattactctgacaagattttatttttcttccattcatctctcctgccgttaagccgtttctcctgcagctagttggtcaggcaatagcccagctaatggtcaggcaatagcccagctaagccgtttcttcacacgccaattttcatcttcccgccctggcactgtttcaaatcacaaaaatttcgccactgcccgcgcaaagctttaattttgtagaatctcctaaacctgcaccagatccaagaacagctatacactttgaacacgatgcaaagctttaactaaacataacaaattattcaggaacaccagccaagtcacaactttctatgccaggctccacatgctcgaataatgcatgttacattggaactcccaaaatcagatatacgaatttcacgaccgaagccagcatcaggctaaaaaacgaaaccacacatgaattatggccaagaacatttgccacgattcaaagacaacccgctcaaaatcaaattgaaaatttgagcaaccgaaagattttgagaaaatcatcaaagcaatgatacttaaatagatcatagcgacgatttagagagaagaacccgttcaaatcaaatcaaatcaaaaactggagcagcagttaacatttcaagaaaatcatcgaaaggatgatacttttatatagaacacaggtaacgaattacagagcaactaatccccctgtccatcatacacaagtgcaccttcttagttttagcatcggtacaagcacaattaagcatctaattcagatcctactagagatcaacgcaacacctaggcatcctagaacactactactactacacaacatatcatccatccatccactgcatccacatccaccgccgccgccatcgccgggaagcgtcagaatctagttgtcatcgtcgccggccgccgccttggcgctgccgccggccttcttggggaggagcaggttgtggatgttgggcatgacgcctccgctggcgattgtgaccgtgccgagcaggcgggatagctcctcgtcgttgcggacggcgagctggatgtggcggggcactatgcgggtcttcttgttgtccctcgccgcgttcccggcgagctcaagaacctacacagtagacacagattccaccgattagccccaaatcctcgctaattcgagcgaacaaagcgaaccaatccacgcaaacacacccgaattcgaatcttccgactaacccccaaatttcccccattggaaaccctaaaattctacccccaattctgtaaccgcgaaccccccgcccaaatttcaccgcgcaaaaaccaaaatcaagaaataggaggaacagaatcgaacatacctcagcggcgaggtactcgaggacggcggcgaggtagaccggggcgccggcgccgaccctctcggcgtacttgccggccttcaagaaccgggcgatcctgcccacggggaactggagcccggccttggagctccgcgacatggccttcttggcggcgcccgagccgatcgccttccctctcccggccatggctaaaccaaaccaaatcaaccaaccaaaccctccggtagtagtacggaatccgcgggcgaggcgacgaagcaacagcagcagaaaaatctgtggagaaagtgcggcgacgcagcgagcgagcgagcgagcaatcagtatacggcttggtaggttggaggtgggggtggggagcagaggggattatataggagggcgcggccaatgagacgcgagtacgcggatcggtgacgtggcgttggagggcgtgggggctggggatccatcctggccgtcggatcgggagagagccgtgcagcggttgggtttttggtttttttttttttttttttgccgcgcacagcgtttcgggcgccagcggtgggccccacccgcagggccgtatcgatcgtgggcccggattctcggcctgtgggctgcgggatccatggaaatgtaggagtattcgcccggaagtcaagttacgactagtttggaatttttcaaatatttcgtcgaaaactgtcgattttttgcaaagactgccttcttttagaatttgatttagtagtaaaataattttatttttcacccatcgcataaatcttaacgcaactataaatcactttatctatttctaatataattattttttactttgacaaactccaatacaataattatttaaagataaatttattttgagaagctaaaaatgaatatggaacggaggaagtataaaaacgaatctagaaccgaatgtaacatactaatattataaatctgaacatatgtatatttaaatttaaaatattaagatatgtcacatccgatattaattcgattttttatatgacgggggagtagtgcagtgctagcagacttgctctgctgttcatactcttcggccgtatcacgaccgaatggattggtaaagataccgtcagttcgtagccatcaatcagtccagaaccctagatgcgcgagtactaggtgacacgtggagcggggagggggcaagtgtcaagagcgtggtaatctgagccgtcggttcggtttactcgaccatgacgccagcagaggtggctcgtctccaagaaccacgaattcgcactaaacctgcagctagtggtaaacagtcaggatcaaacgagcgattgcactagtagtgtcaaccggcgactctgatccaggagtgaggagagagcacccggtgaaaattactccctccgtcccaaaataaatatagttttacacggttcatgttcaacttttgaccgttcgttttatttgaaattattttatgattagtatttttgttgttattagatgataaaacatgaatagtactttacgtgtgactaattttttttaatttttttataaatttttcaaataagataaatggtcaaacgtcggacacagttccccatgactacacttattttgggacggaggtagtacaaggattgcagcgaatggatacattgttgacaatgaacaatgaaaatccatcttcggtcagttcagtgagaaccgcataaatttcgttagttcatcgcctggaggactgaccaaattagtacaaaacaattgcgtatcgggaattcgagaccgagcaggcaaacacgataaattgtttctaatattacacaaacaaagcagtaatcttgcattgcgaaaacagtttgttcagcgcaacgcaacgagaatgcatcaacgaccaaaatgatgaggcagagacaaatagtggctcaaagtttcagtttgttcctcatttcttcaaccattaaacaaaccaacccaacatgatcatcagttcatcacaggcttacatctttagataaatacccacaaaaatttcgccgtattcacatcctgatcaggccaccaaaccaccaaccaagaacttctctctctctttttccccttcctactgctcagcgcaacaacacaatgcaaatccagacgaacagctagcaaaagatcctactaatgcagaaggcgcccgggcggcctagttgtcgtcgtcgtcgacggtggatgccttggatgacccggccttcttggggaggaggtgctggtggatgttgggcatcacgccgccgctggcgatggtggcgccgccgagcagcttggtcaactcctcgtcgttgcgcaccgcgagctggatgtggcgcggcacgatgcgggtcttcttgttgtccctcgccgcgttcccggcgagctcgagcacctgatgtcgaacaggagaagacccaacgagttagcaaaagagaacaatgcacagttctttctttcaatctacaagatgcgagcaattgaacccagcaaatgcaaatctagaatacccaaacatttgttccccgataacctcaaatccgtatggatttttttcaagcgaggcaaacctaatcgacgaaccaaactgaaacaaatctaacaacacccgaaataacatcgcctagatcggacgaacagaaaaaaatccccaaatcacaccgacgcatacctcagcggcgaggtactcgaggacggcggcgaggtagacgggggccccggcgccgacgcgctcggcgtacttcccggccttgaggaacctcgcgatcctgccaacggggaactgcagcccggccttggagctcctcgacgtcgccttcttcgcggcccccgcgccgatcgccttcccacgtcccgccatatcactcgccgacgagaggagaggagaggcgcacgcgctacacaaggaagaagaagaagaagccggcggcgagaaggggcagcggcagcggcggcggcgctaggtcaagaggcggcggcggcgtggattcgcgtggcgcgagaagactagggaagggaagagctgagatgctgggatatataggggtcgggggggttcggggcggcagccaatgggaggcgatcacgcggatcgcggacgtggaccgtcggatgcgtttggacggacggcggatgcgaggggggttttcgatccggaagcggcgggagtaggaggaggcggtttcgtttggatttttttgggagcgcgccaagtggaaattgacccccggatcggtgacgtggttctctcttgtgggtcccggcggtcagtctctctctcgtggtttgagttctttgttcctcgtgggttgaacacgggcttgggcctcttttttcttcttcgcggggttggttacttgggcctcgaggtaatttggggataagtccaatttacacccccgaacttttatgtttgtctaaattacaccccaaaactataaaaccgggtataatacaccctctaactatcaataccagctatttcatcccctggagcggttttaaagactggttttgatttaattggacgccacgccagcattgtctcaccaagtcaaagcaacgccagcatgcatctcactgtggagatgggcaaccgagcaaggaggaggccaggagggagtggcgacgaggaaaacgagcagcggaaggtcggaggcagccggcgtgctccctccctctgtccnngggcatcctccctcctccactccccacgagcccatccatggcgaggtgcatgcagcagcgcgggagaaactacgacgagcggcggcgcggcatcagatagggcagcgcgggagaagctgtgacgagcacgagacaagctgttggatcttgaactcgtgctcgccggcgacgaattcaccggtgctcgggagtgcggctacagagggggacctgggggaggggggaggggggatctggaggtcaccagttcttggaagggcgatgcagagggggagatcaagctcaccggcgctcgggggtgcggcaatagaggaggagctcaagctcaccaccggtcactcggggacgagagaaaggaaagaaagagctcaccgccggctgcactgtgtggggtaagagagaaggaggagaggaagagaggaggaagaagaagatgacgtggaattatttgacaggtgtcatcctacgatacgtcctcgtgtagcaaaaccacggtaaaacagcttgaggggataaaatgtccggtattgatagttagggggtgtattatatccggttttgtagttcgagggtttattttagacgaatataagaattcgggggtgtaaaatggacttatcccgtctgcaaagctagcctataaaaccgggggctcctagctagcgcgtgctcggctgctcgctgctatcgagcactcctcccatattaactacctctattaaaactattagttaatatacttaactacctttattagtatttagtaatgatagtaattaggaaagattgtggagatttttttactaacaaattgaaaaaattttaagttaaatttgaaaactttcgatttaaattttaaattagattaaaaaactttcgatttaaattttaaagtcaaattttgaaaactttcaacttaaatttgaaaactttcaacttagattcgaaaacttttaactcgagattcgaaactttcaagtccagatttgaaaaatttgaaaagtttcaatttgagatttgaaaactttcaactcgagatttgaaaactttcaactcgagattaaaaaactttcaagtccatatttgaaaattttgaaaacattcaactcgatatttgaaaactttcaagtccagatttgaaaactttcaagttcaaatttgaaaattttcaactcaaaatttaaaaactttcaaactcaaaacatgctaaagattacaaaaaataatcagaaaaaagtggaaaaaatgaaaaaaaatgggtaaagaaaaacgaaaaaaaaccgtgggagggggcgcgcaccggcgctgggccttatggcccggaaacgcgcgccgattagcgatcgcgtataaaagcacaaaataaattggatgtgagtatttataaatttttgaattcataatataataactataatagcaataataaagtcaaagtcatctttgagaagtgctggtttctctagaacttatgaggacgtggatttgttttcatggatgaagttacgaggttttttacttagatattcaacttgtttgtacatgatatcattgttctgttttaaattcattatataatgaatttatagtttgaataccttattaaaacagtttacctgatgtgatttatcctcacacccatataatagttttttcaggcgcctgatgtaacatgctcgcttgtgcgatgagagtatctacacttctacatgtcatgatcacactaaatatatggagtacatgtttatgatggggttatagttgagtttgttatcctagtgtattagtttaacactagatatgttcatcattattaaatgacttgtttgccaaagttttggttctccactacgaatcatacgtttccgttgcggaagttaccaaagaagttagagtctctttcaaccatttttctccttttcgctatcttgcttcttcccttgcagagacaaagtcgggtcttcacaaattcctcgtggcataccacaagcttgggtgctcgccgatgactcctatccatctaggaacctatatctctaagagtaacaaacacgatcgagtatttacatgctatgaactcaatggctcaaacaatacagtgaggctcgctagctctcaaccttacaacctctcaatccaacccttctcttttcttctcatatcactctcacaaagagctaacactaagataaggtatttgggagggctacaggctttggataggtcttctcttgcctgcccaagaacaacaaggggctgcaggaa

SEQ ID NO: 83622 - DNA, 5457 bp, Oryza sativa
aagatggttgattcggtttgattgtgactatatagtatagttgcctaaactggcaggtaacattggaatgttgccattcaaacaataactggtgctgggttcttagaattcatggtagatagcttggatccttatattagtattggcaattggctgatgggtattatctattagattactcttgaaatcatttggccattttggtgaggcacatattcttaaaatcattattatatactaagtcttagggggctgtaaatattatattatggattgtattttgatgcatatagattgtgttttagattcacatgtgagggaagaaaatatcatctgctggaacaaaatgttctttcagcatgctaattaaagttgaagcactgtgcttttattttacgtgcgtcactgcttatcacctaacaatggcaacaaaaacagcaatagtaacaagaagatgacgaaagagacatgagaatctcatctgaacacaattttcccacaatgcagttgcgtgctgcagtttggcttgagtcttgaggtcaacagatagggaaatatcaacttagggagctgccaatgttggtgccaggggaaatgttacatgcagggtatcaccataaacgcattatgcatctttgaggtggcgatgattaagttatggcaaactaactcctgctaggtttcaaacccctctagcttttcttcttcatggaaaacaatggttccctgcaaaagaaagagagaatgggaaatttggtggtatgcctgatatatgtttgtctatttgactggtttgctacattaattctgtgtacatttggcgcactgtgaaaattaccccataagggagacatgccacgttcaaccccatggaggatataaccctgcaaaggaaaaacaaagaatccctagccacatttaagaagtaatattagccacatgtacaattaaattcagaaacttccttaacaatgaccaaattgatgagaaaaccaaccacaacattgaaaaaaaccaacaaatgccagagataattcactataacaaccccccaatactaggcaagcaagaatgagaagctatgctcatctgaatcatcatccacacctacctaatctgcccatgggaaaaggtggatcctgcgctgtttgggcaaacaagcctaagctggccagctgtgtttttagggtccataagttgggatttatgataatctatttggtaggtttcagtacctaaactaccacaaagcatttagtgttattggaatgattttcttagatgatttatcctctgttgcataaagaagtttaagccttttccttctggttagaaattattttttcttctaccacttctctcaactagtgagtcaatgtggcccatctgttcagtaattatccatgcctgttcttttgctccattcttgaatttttttctgaagttgactcggttgtctgctgaccatgttattttataggaaaatcggaacctgctgttgaggttcagatatgcagggttggaatagcgccaatgttttatcggtcttagcaaggtatatatatatatcctgaaattgggattctgttaaacttctttcagtatctgatgcacacctgtgattgctatgaatgttagttaggttattcccaatttaggttctagttcattatctttgagtttttcactgagacacttatttgtgactggctacttttgttacagtaactgaaccatgcttacgatatctatattttacgttgactaatttctggtatgtactgcactgactatctactttttcatagttcagtgggttttgcaaagtttgtccatctagggttgtaacttctatatttgttactggtagccagggtttcccttaccgcctttaaccgcgcggttaccatggtaaccggtcttaccacgggtgtacagtaatggttaccggcggtagggtttggggaattttgaccaaattcaaaatttccaacaaaactgaaaaaaatccaaaagaatcatggatgtagttcttgctttttagtggcggatggtgaagaattttttttgaaaaagagtaagataacacatttgagggcaaaaccgaaagtagtttagaaaatgggaaaaaaagaaataaagtaatgggcctgaagttgcaatgtttatcggacccattaaggcccaatagtggagaacatatctcccgtgtggctagggctctcctctcgttctctctgtcggcatgaggtgagggggcagagtttcccttaccttttggagaggggttatcgcatccccgtggtaaggcagttacagcggtaaccgccaaaaaccatgtgaaatacgtcgtaaaacatttgaattcaaaaattcggcggtttcacggtttggtcacggtttggcgcggtaaccgcaatatttgcgtgataaccgtgatttgtatagtagaacataataatgctaaaaaaattgaaaaaacactaagatgtgtagaaattagagataattataagattatatatgatactttaaaacctaacttttcgatgaaaaatgcaaaaaatcggcctgaccttttctatattatggactttgaagcaattcaacgattcatagcatgataattaaacaacaacaattcaacaaccatttcaaagcataatgatgtccacatgtagctcaaacaatagagttcacaatataatgtccatgactacatatatgatagttcattatgacaagcaacacgaatataaaaatagtttgaaacgaaggatataaataaggacatactaacatagtgcatagctaggtgttccactgattgtatgccatgttgtacttctctgtggacatgagcaacaagttgtgtgagtgtagcaacctcgccttgtattcctactaactttgacctgtccatgatgctgttgattgccactgaccgtacaattgagcataccacttgggctcttgccactcatacacccatgtaggaggataatcagaagcttgaggacggttgtacacgtacattggatatcaacatttcaatgctaaaggcactgaatgagctatagctatgctatggtgtgtcaagctgctgttgttgttggcctctcagagtaacggtagttcattgagagcttggagcaccatgatcttggtcccgagcatcgtgagtgaagtcagtctcacttgcaaatcaaatagtaggaagaagattaatcggtcgtgaattgcaaggtgaaggttgaaataataagtaaagaattgaattaggttgtggtcatctaacactgttgtgtgacccctagaagtcacattagtggcaccttggccttcttgaccatcgtcgtctccgttatctgtatcagttcttgagctactttcatcggactcttgatagtctgggctcccttgagtctcttcatcgctatcaacactccttgaccgtgtagctaatctgattgttagtgtcgtagaatgataggtccgctggcctttgaaggggatcgtcatcgtccttcctaacttgggtatttgtttgctgaatttgaaggcgaaggttgtagttgacatagacaagtttgttgagcttgttgtgtgtaagtttgttacggatcattgtatgtatggatgcaagtgtgctccaattccattcacatccacttgaagagcaacactgatcaatcaaacgcaacacaagtttcttcaaattcggcatgcccgatgtaaacatagaccgccattgtgctgcaaatgccgagtaacatgtcattttaattttgaatacgtcgaaagcattcggacttttgatagttgcattatctgaaacataccaagccaacttttcccatccatcaccatctttcttgcaagcggcctcccaaattcgctactcttacatcgatacatctcaacctccagcaaagtggcagcaaccatttcaatgttcgtcatccgctcgaaggcctgacggaggtcttggaagacggtcgcacttgcaatgtacgcgtagtgcatccgagggtttagtgctgcagctacaaaacatggcacaagttaggtaaagggttatttactatgaatacaagattatgttaagaacataagtgctagctacttgctaacattgatgagtgtatcattggtcaggtcgtgcaaacttctgtcaacaatatccatgtaagctgcgtactagtccctttcactcgcgaatagactgacatactccattttaatcaattgatatctcagaagaacctcactcaaattggggttcttgtcctcgtcagcaaagcggagggagtacattgcttgggtcgttattgcctctatgttttcccaccaccccttgctagataggtaggtgtgtgcatatctaccttccgctgtgccactgaattcgctttgcatgaagctagaggaagccatgcacttcatgaactgatctcgcttcctaaggaaactctgaaggaacatgtagtttgtgccgaaccgtgtagcattccacttaaccaattcaccacctatagttgttgtcaccatagcatgaagcttcgaatgattgtataaccatctgcaaattttcctagcactctgaatcaccatgtcatgatctggcatttttccaacctccttaagaatcaagttaattgtgtgagctacacaaggttgccacacaatagttgggtactcttgccgcagtagcctgcaaacctttttatagtttgacctattgtcagtgataatttgcacgacatgttgagggcctacttcacgtaccaccttccttatctcttgcattagaaaattacaaaataaacataagtccattaccctaaacttgataacatatggggtaaatttactgcatcaatgtcgtcaccttctatatgaagttagcattctggctttggcccgttgcatcaatggacttgtgaaaaaacattattccattgcaatatatcaaaaagttgatgacaaccatacccgttggtcgagttgaggaatcacacattagagtaacaccatactcagcaaaatcacgcttaaacctcttgaattgcttctttacgtaccttctctgtagcatcaaggtacttgccatctatctccctaccagttggagaagttatgttttcacttttcacctataattaacataccaaataattagtctctaatctgttagaaaaatgtaaatccatattaaatgcatatgtaccccacttctgtgtctctcatacggtgctgacgaagtttggattatcggcatttcttgcaaggataccggagataaaaaaagaaacttatcttggactcaccaatcacctccctaccttggtttccctctttgtgaagaatcctatgtcaatgcatagtagggatgtgtgggagcatggggagaacataccaccatgctttcgttgtaagtattggggctgcaggaat

SEQ ID NO: 83623 - DNA, 608 bp, Oryza sativa
cataaatttagcatattcttttgataaaagatctagtttatatattgattttggaagcacagtataagtggttttcatgtttcgataaatatttgtggttgtattcattccgatttatatttgctatatatgtatctttattcagtaatattcaatcaagtttcttaattttatctgaaattatcgtttactattctaatttgaaaaaaaatatggttagggtagtgtcgaaacatgaattcggcaataataaaagggggtagcgcacgagacctaaaagtggatggatgcggagacaaatgatttagacaggttcaggccctctcaatgagaggtaataccctactcctgtttggggatttgaatccgccgagtatgtattgatctgacgatcaggttgtctcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccgagtcatgatctattacatattccatagatataagttatccc

SEQ ID NO: 83624 - DNA, 7406 bp, Oryza sativa
gagcgcgatagaccgatggtgcggtctctgaacaggccgtgatgttgtcggcccatccatgtgtccatgtgctgtctaggcagtgggccgtttactaggtcaactacttcgacatgtacgggccgagatgtttggaggcccacggaaagcctgttatgttgcggcgaacaccagacggggccgcggccatgtcccgcctccggctgctttcccggcgacccggccggcgattgaagatgtgcagcggcgggtcagaggcggcagcgtctgcacaagggcggggatctctcccggccatcctcctggcgagctcggaacgatctccctctcctgcatggtgcacgccctgcctgaaggctgaagcgcatgccgccctggagggcctgcggcggcgccgccaccagctgcggcgagacttccacccctcgctgtccttctcccccacctcaggcggtcccgcacatcccaatccgtgataaccgccaccacttggacctcgccggaatggggcatgaggttgtaagggggtgaggatgaggggggcggagaggaaggtgagatggtatccaaggttccagatgttgcacttttcaagcagatattgcagtcggcaatcaatggatcgctactgggatgtcccgtcctgtccgtctgcttcgtcatcgccctcttcttccaccaccacaccacgagggccaccaggtgttcaagagaatgcgccaccggcccaccgcacaggttagcgcaaagagcacattgcttatagatggcgccactagacctgataatcacatatacaaaactatgcaaagcagaaggctgcattcttatcaacagaaaatgaatttaaattctcactaattacgagtacacacatacacatatatcatgtccgtaggtggataaacaccatacatatagtgtatactaacaatcatcgttttttgcgattccatcgttctatgtggcacaatgattcgaaccagactgccaatatgaagcccactgtgaaccccaggccagaaaagatgaacaaaaggatcacgccaagtctgtcctgccagaaactgttggtacctgaaggagctgatgcacttggagatgttgagcctggagtatcacattgtttagagagtggctttccacagaggttgacattaccttcaaaggagctgttgctaaatgacccgaactggttaccctgcggtattcttctggtcaagttgttgtacgaaagattcaaccaagcaagagaagttagagaagctaactcaggagggatttcccctgagagtttgttccaagagagatccaatgactccagctgagtcagagaattaagctgcgatggaatgtgtcctgtgaaggcattgtgtgacaggttaagtccacgtagtgaaacaagcttccccaatgactttggaataggaccaccaaatgagttatctgagagatcaattactttgaaggtggttaggattttagtgaacataagagtgccccctttgtaattgacaaccgtaatatcctgatagagcaatggtatttttgtgtttgtggtatgctctaatatgtgtccctcatcgttgtcattttccatcattgattgaaaatgctcaaaccattctggatgtatgttgccagagaaatggttggaggccaaatcaattatttgcaaccttttgaagtgattacaattttggtgacaacctttaagaccccttattgtgccattgagtttgttggatcttaagacaaggactcggagatttggaagtttacccaaccaaaatggaaaagaatcaacaatctgattatttccagcatccaggagctccaaatattggcagtatgatagtgatctaggtagtttaccttcaatttggtttccattcacatctattgactgaagattgcacccctctctactattgttaggtaacaccccatggaattggttgtctctcaatttcaatacgcttaagtttacacttcctgtaagacatgctggtactgatccactgtagttgttgccagataagtccgtgataatggctttgcttgcattacaaatcgaagatggtacattgccacttagtttattattggagaaattaatatagctggcgttttcaagatatatgccaaagttcggtactattgaaaagaagtggttgtttgagtagtccaatgcgatctcactggatgtggttagctggtattggtatgcttccttgaagtctattgaaactgagatcaagataagctaaattggacatattaacaagagaaggagattgttccaaagtagttaacatgttgcacgagaggttcaaaatattaaggtggcccttccaattctcccatatccaatttggtatagcccccgttatttgattactcgaaaggtcaagaagggaaaccgcatcaagatattttaatgtgcctggaatttttgtaaggttgcaagatgacaggtataagtacttgatgttaggaagataaggaggcactgtttaaccttcatcatctatgagtgatatcaaattgtttgacaggcttaggataaatagattcttctgcttccagacagagctaagttcaactgtgcctgtgaatttatttgattcaagaatgagataattaagatttgtaagatgaaaaagtgagttgggtatcgggcctgatagttgattgttggctaagtcaatacataacagagatgaagttaaagggtaaggaatgtcttctagtgaaccagaaagctggttttcttgaaggtaaacattttccagcctcggaagagcgaacaacgattgtggaattttccctgcatgcaagtgcagtatactagtcaaaaagttcaaagatgaatgttcactgaactgacagtctggtaccttaggacgcacttgaaccaagacaactcattcgtccgagttaaccaaactaagctgattttccgtaatattgcacatggttacattaacatttatttaaaatattgtatttgataaaaagaagcattgcttttggttctatatatataattgtttgctagagatactaaaacattttttataaaattctactaacaaagtttgatttagttacttggaaggcactaataaagatttaaccatgatcactactacaaaatcattttttgcatgtgatcaaaatcaattttcgcaggcagctagacggcccgcctgaacctaggtatatgcgaaaatcaacattttcccatgcatgttgagtaaccgcatgcaaaaacatgatgttcacgtggtcacctatgccaaccgctgcgaaaatgattttggagaaaacaaataaaagttcccaaaacaatttcggccaaaactctagcttcccatcctctttgagctcgtcgttgcccctcgaggacggcgctgtcggatccaccgcccgccattgtcgtcgcccctcccggggcatagggcggcgccaccggatcagctgccctcgaggtcgttgctgtatttgctgtcgccggcactgtcgtcacgcgcgtcaacatcgcacctgagtgagcctactgtcgcctccatctcagtcgctgaagaagagaagggagggaatgggaaagagatgaggagagggagtaggagaggagtgatgggaggtggagccaaggagagaagagaaaataagtagtgtgcgtgagtggagaggagaaaaaaatatgaaaaaatgtagtgcggtgacgcgtgtggcccacttgctctccatgttgctcacttgcgaaaatctattttcgtaagagaccccttaaggtgcaacattgcaggcaggcctcttaagggtcatctgcaaaatatatttttgcatgcgacccttgaaccgtactcaaaggagcaatttttacaggcgaaagtagttatggtccacctacaacttggagggggtctcgtccaaaaatcaattttgcagtagtggatgtgtcacatcaacgtttgtaaaaaagttggtaacaaattgttcatacgtttagcttttcccttttatataataaaaccatggaccaataagcatcttccctttaacttattaaataaataaaaaagaaggctccatattcgctcttatggcctagaaattctcatattaatcgaagaaataggaaaaaaagagtccatacaggaataaaatttaaaaataaaagtagagaagataaaatttaaaaatagctgaaattcagaattaaaaagaaggaatgtagtaagagaagactagagtccataccattatacaatagaactaatggaagttcggaattaaaaaaataagaaaaaaaataaaagtagaggttagagttcatatagaaatacaatttagaaataacgaaaatttgaaataaaaaaaattcactctcatggtctaaaaattcttatattaataggatagaaagaaatagacagagttcatatagaaatacaatttaaaaatagctgaaattcagaattagaaataaggaatataggacgagaagactagggtctgtaccagtatacaacgcagtatacaatagaattaatggaaattcggaattaaaaaataagaaaaataaaaatagaggttagagttcatatagaaaataaaatttagaaataacgaaaaatcgaaatttaaaaaaaggaatattgaaagaagaatatagagtccatatagaaatataatttaaaaataattaaaattcagaattaaaaaaaagaaatattgaaagataagtttagagtctatatagaaataaaatttagaaataataaaaattaggaattaaaataaggaatattggaagaagagtataaagtctatataggaatttagaattaattaaaattcagaataaaaataataaaattaaaagtagagtttagagtaattatggaaatacaatttacaaataactaaaattagaaattagaaaataaaatttggaacaatagtctagagtccatataggaatacaattccgaagtaactgaaatttgaaattaaaaaataaataatatcgaaagatgagtttagagtctatatagaaattaaattagaaataatgaaaagttcattttttttaaaaaagcaatattataattatagtctacagtccatatagaaacacaatttataaataacggaaattcggaattgaaaaatatgaaatattggaagaggagtctagagttcatataggagtataatttagaaataactaaaaatttgaatttaaaataaaaatataggaacacaatttataaattatagaaattcataattaaaaaaaattaaagaatgttggaagaggagtctagagtccatctagcaatataatttagaaataactaaaattcggtattaaaaaaataattaatacctatcacatatatacaacataatatgaatattgcacattgatagtttattcaagttagtacaattttaaattatcttgttatttatgatattttaataaaaaataagaaaaaaaatatatgctactataatataagaatgctagccgcgcaatttgtgcggggcaccatgctagttgttataatataatatggacccgttccgattaatccgtgtgcattattctctttttttcaccaattaacatggtaacttctagggctctcaaaacaaacatgttactccttttagcattctattataatattttagtagcaatagatttctaagctcctagattagttgtagataggaaaatgttgtaagtttttgaaaatagacgccattgatttactgtaggtggatgttaatatctagatgcgagccacaattatcaaacagaacgtggaacttgctccaccactaccagtctatcatgttatctactatgtgtgttttcacgttccaaatcaaaatacagaaatatatatattactacttaagcttttgagtgttcgacagcactcgcttggtggcattttgaataaatttattttatgatgatattttaaattgcatatgtatgaaggaagaagtagccgtcgtataaagacttaccgttgagttggggattagatgtgatccgcagactttccagttgggtcagattccctattgttgagggtatcgacccagagaagccacaactatccatctctaaatttgccaacttcgtaaaattaccgatccacggtggtatttgctgtccaaagaactcgcaccctctaaagtccaaggtctccaattttgcaagattgccaatctgatatggtattattgacccagagaaattgcagtcccagatccacaaaaacttcaaattcgtcaaattgcctatccaggagggtgccgattcagagaaatcgtacgatacaagctccaaagcagtcagctgcttaaggttgcctacccaagataataccgccttctccaagcctgattccgatccttgcaattccagttctgtcaatgaaggaagcttatctaataaagagggcagctccttggaagttcgtgccgtgctcatacccaaacgcttcaaggacttgagattggcaaatgaggacggtatgtgataagataaattggttgctgctagacctagtgtttctagattatttccatcagggaattctggtaggttaatagaaagattggggttatgagacaaatcaagcgttctcaaactttttaggtggaagatttttgttgggaactgcccttcaaaagaattgcctgcaatttcaagaatgctcaaagaagataattcagcacagaactcaggaactttgctggggagtccaaaattgtatccaaggttgatcacctttaaggaacgaagccttgagaaggaagagtgaataggaccagatatacggcacgcaaacaagctaagaatctcgagttgaggaatgttgtctgctaaaacaactgaccaagttgatccgaaaatttctatctcatcaagatggagctccctcaggttgctcatgtttgccatgacggtttggaaacttggttcatcgaaatacaacccatcattactagaaaagtcaagagtgacaagtttcatgaggcaagcaagtccaatggggatctgaccataaaagttgctgtgtgagaagttgaggtggatcatatctgtgagcctctcaaacccagatactgggagttcggctctccaaaagtaattggaagcaaggttaaggtttgtaagagaggtgaggttaaagagtgcagcatcgagacgattgctcatcaagttcaactcactgaggtcaagggaaatgaccctgccggaggccataccacatgtgatgccctcccagtggcagcagtccgatccagctcgccatgacgataagtttgcattattgatgaaggatttttgagctgtaggagggaag

SEQ ID NO: 83625 - DNA, 1671 bp, Oryza sativa
  unsure (1)..(1671): unsure at all n locations
cttcagggtaccacaaagaaagaatgattttggttcgaagatcccaagttttgtgggctttttttttgaaatagtatgtatgaagaatgttcatttttggtttcagatttcgtatgcacgattctatgccagccagaatgggagctgtgaggtagatttgtttgctgtgcaatcagatgggaagaagatcgttgaccagcacaagcaaagagcgctgtgttgtcggctgaggacaaagctccaccgtccgttgcgcgtggcattggtaaacagaggccctgacacggaactgctggtggctaacccagtggaggtgtcgggcaagggtagaccgctggtgttttacgacatcacccttgctctcaagaagcttcacaaacggatcttcttggtacgcatttcaacttactactgtatctgtataacttacttgcatttgtgccttgagtcctttaccatcgattgattgacgacacctgttgcatgcatgtaggctgagattggtcggcatgtggtgggtgatagggaatgggaggtttacagggtgcaccttggtgagggagatcattcttcattgcggagcaagattgttgatggagtcaccaacatgctcatgggctgggacgacactcctccatcctaatcctactagtagtagttctagttagtttttttatggaacacacgtcctttgccttgtacatagttggtagtggctgctgtaaattgtgtgccttgttaagtcgttcgtggtagaatgcgttggcagtagctagctttgactaatcaatcagcagctaatttcagtctgtttagttagggagcactcccctctagttgtatcactatcaaaactgaatagtgctcaagttatctaacaggaggaaatgcttactcctaattactaaagtggtagtgcccgcaattagtaagcaagccagtgaaccaattgaatgcattcattcaatagccttgttggcaaatggagctttggttttgagtagagagttgactggtcgtatagctgagggccaacatgcacgacactcgtctcttgtccaaacacttgacatatggcgcattggaatgatggggccaggctcttgtttatcgggacgggacgggagtactccactccactggcaagtccaaggcagggcagctggtgtagtagagagaggggtggaatcgtgcagaagttaccacgtcattcctgggcggctgccgcgtgttcacccgtatgtgacgtgccgcgcccccgcgtcgccatggacatggaaatggtttgcagcttcaacccataaatgaaaggaaaggagaggagctttggtaaataatccactgacttgaagcagaacccaaataagccacaggttgacgtaggtaaatggctccgaagcagaaggaggcagcgaacaagaagaagaagaagaaggaggtggcagtgttggtgaaaaccaagaccaaggtggtgcagctcaccaccaccaccgcggagctggagctggagcccactgtcactgtgcaggtggacgacaacaagacaggtgcagctgcagatgagacccccccgttgtggcgcttganaagcaagagacgccagaccccaacgagccccaagcggcnggagcgaaaaagaagaagcgcgcgggcatggaagaaaaagagtag

SEQ ID NO: 83626 - DNA, 1640 bp, Oryza sativa
tgcgttaccgttacccaacagctgctagctactctatatatgtatgcaataagtctattttttctccctcattcttgccttcgtcgcttcgcatccctcagccataaaaccaggtataacacctccccaaatccgaaaaccggagtaaatatactgtcggttttagcttgtcatgtccacatggtatattgactaggtcttcgtcctacgtggcactcagcgtaaaaaaaagtggaacccatataggcctcacctatcagggattcatcttcttccaccagcctcctcctcctccacctctccctctcttcctcgtgctctccagaccatagaatgacagtgagagcggtgatggtggagaactcgaccccgcacacggcgcactcgtggacgtgtgccctgtccttctcggccgccgcagcggcggggtcgctcagcagcttcgcctgtagccgcgtgtggctcgtcatgtacccacccagtgcctggaacgacgggaacctcttgttgcacgtcttgcactcaaacaccaactccgctgccaggcgccagcgtggcccgtcggcgtccacgacgacgtcggtgctgtcggcgcgggtgacgacagcgtgagcagcgggctggcgtgtatgacggcgacgatgacacgggaagactgctccatcatctcccgctcacgcgcgctcaagacgctagcctttccccttcatctactccaaaacaacggcgcacggtgtgcggaaggcggcgcctagcgagagaggagtcagtgactccgcaacaggcagtgggcggcgcatggcgggagaggagtcgacggcgtctgcagaagcggaaggaagcggggcacgaggttgtgcacggtggcgggagatagcttcgccatggctcccctctcctttcctccgttgctgcgctgctctgccacacgccgacgccggcctcctgcggcgcctcaacgacctgcttgatctcctcgaatcggagctcggcctccttgatggagttagaggtacgcacgagcaccgcgcgcgcgtcccgcgtcgccggccgccggacctcctctcccgcctcgccccgacgatctcctccccaccggacggccggcttgcccagagagagagagagagaggaggaggaagggagaggagggggaagaggtgtgcgctgacgtggtatcctgacatgtgtggtctacgtgggtcccaagctgactcagccgccacgtaagataaaattagggtcaaaaccactgaagaatctattgtgactggttttgattagttgggggatgccggatatctggttttgtgtttggaggatgattttgtaactcgatgacaagttgagggaccttggtgtactttttcctattagatactacaagcccatcgagtaatattattgtgggccgtctcggcctgacccatatcctcgttcctaaacttgttaggagtagagtattgagtatcagtacgtaccattgtgtgttttaacgtactaattaaatggtactccctccgtcccataatataagagattttgagtttttgcttttaaagtttgaccactcgtcttatttaattttttttgaaattattatttattttatttgtgactagctttattatctacagtat

SEQ ID NO: 83627 - DNA, 1132 bp, Oryza sativa
  unsure (1)..(1132): unsure at all n locations
ataaagaaagatttacaacatacaccaagtcaatatcctagcaaccaatcagcattacaaaaattacaggttgatatggcaaatattccatgtggcagcaaagcataagttcatgggttatatttacaagaacactttggttaccatgtgacagtaagatcacctgggtagagaaatgctggtgtctcaaaactaggtaatagacaaggtattaaaaggataatcattcacatatcttcacaactcacaaggcatgtacctttcaagcccaaagcgtacgaggcaggaggtggcatcatcacttttgcagtatttacagcccttganctatcttgatggaacattgattatctgctaacatctgcaatatacaggcttcaataagatatgactcaaaactctcaaagtagggaacacgtaaaacaattatgactattcatccttgccaagctatgtattgacgattctacatgaattctgacagaggagaaatgtgattaatcattagctgctaaattttggctgcagttctgtttttcatttgtgcaaatttcaacaaatgggcaaagaggaaagtaacttaacatacacacacacagggaaaaaaagagagagaagccaaacgtactttaaatagcaaagagcggtgtttgcagaaaccgataggtaactttcccagatggagaacgatagaccctgtacttgacttgatagcatcactgcactctttccagcgtggaagaaaactctcttcattggaggttgtaccccttcatgattgaaacaaaaaaaatagtattagaaaccacagaaacaagacgatacaaagacacttttgatgagtagattagttgtacaatagtcaccccattctggaagacacaagcttggctagctggtttatcacatccttcatgtcggcagaactggacaagaagctggaagcgtaattctccagcatacctaaatcgaaatcggttcttctatcgatgagaatggcttgcatggaagaatcatctgggcggacagacttgagtgaatcaatagaaggtatgcggttctcctcgagtagatcagtgcagagtgaccagacaaaggggtccatgccatgaatcaagtaaaaaccatctgg

SEQ ID NO: 83628 - DNA, 1818 bp, Oryza sativa
cttcttagtctgttagtcatgcaacctaactttgttgagtcaagtaaaattagtagtattagaaggacaaacatcatgccattgggtcagttctgcagttaaagatagttgtctgaattgatgaaattattgactgcaggttatcttttaagcagtttgtagcttcttgaacggttatgtaggtgccatggccatactattgatcttgttagaacaaacaagacaacctgaatgtgcccaacaactagacaataccacataacttctgaattctgatattaacgttagtgctgcgaaaatcagggaattgactgtattgtttcttcttgattcagaaggcgctctcaagctttcagcaagcctcatcttctattgattttggcatgattgagcgcaccaagttagcctcgctaaatgaaagtacccaccgttattgactactatgatacacattagttactaaattttcagaggcttttaccttaactttgttcagaatataatggagaactctgttaacaggactcgtaatggggcgcatcatgctatgattcataccagaagtgatgttgacgtcactcaatgaagctacgtaggtcttgcataaagggattgatcagcttttctctgatgcttgctcatcaatgaaacaacaggcattaggcctttttattttcaatcaagcatttaatttgctaacattgacgccgtgtacccttagtagtattatatactagaaaattatttatatcatgtctttgggacaaacttacaccgagcagtggcggacgcaggtttagaatacagatggggcggcagagttagccttaattaggttaatggcggacgcaggtttataatacagatgggacggcagagctagccctaattaggtgatggcacaatgcacaaaaaccatagtcgctggttcacggcattggcgcaacagcgcacggcacgaacatcgagaaagttaacaacaaagattgatagtcgaacaaacatatatgacttatatgtagagagataaaaaaaaaagagaaatgctgttaaacaataagggcaaccacttccaatagttttggggggggggtataaaatgagatgaaaacttatttaggggtttaagtgcttcgtcaaaatagttcaagtgagtaaaatggatttttttatatatttaccaatttaactatttactatagactgtattatgtgctaaagaaatagaaagaaaatcgaattttatgtatggcaaaaatcaggtactacttatacacgaattttcataaatgtttttcttcctacttaaaacacttgatttatctgattattcaatagtagactgataactaatgtgttagaaatagtactaaaatgaggtttggaggcgtggggagacaaggactgtagctgggccagccgacccaccctgcctaatgggtgtgtccgccactgacaccgagtgattattttgcctggtgtgatttgaaattgaggcatattctttttcccgttgcaacgcacgggcacccaactagtagagattaagctgaaaaaagaaaagataagataaacttatttggatactgacaaaaaatggagaattcacagtaaaatctttctaccatgccatgaaaatgcaggacagcggtttcccttttaaaagactttggaaatttaggattccagtaaaaagtgaggtgtttgtatggctggctcttaagaaccgtattttgactaaagataacctcatcaaaaggtggtggaagaagttttttttgaactttgtgtttttcttaattttaaaaacaaaccatt

SEQ ID NO: 83629 - DNA, 559 bp, Oryza sativa
gtttcactctactctgaaacgaggtgatattgttggtgtatgtggttatccaggtttgtaagcatctattcaagttcattttgaaattattacatagtcagatgttccaacatcaaaattaagtaggtacttatattctttcagttggaatgccaataggacattttgagtacatggatccttatctgattgagtttgtaattttatttaataaataacttaaactttatttgtagcttatgcccatacttgattgtacagtttgtttgttttaaaacaattaggagtataaatagtttgatggttactggaaattcttatattgttttactgtgtctgataatgacgacttctcaattttgatgaataccaggaaagagcaagagaggggagctcagtatattcccaaagaaaattgttgtgctctccccatgccttcatatgatgcctccacaggtgagaatcagatttttttaggaagagatgtttccagatgaaatacctaatatctcagagcaatttacttcatattgggcatcctctagagtcgacctgcagg

SEQ ID NO: 83630 - DNA, 646 bp, Oryza sativa
aacaggatcatttaactctgtatatgcattgcacacctaaaaaatggatttcataacactgtaaggaaacagaaagggggccaagtatgaaagtatcaatgaagacttagtatatacctcatgcttgttaacaaagagctcaaacctctcagtcaatccaggtcgagacctatgccactttgccaatggactcattatctctggatggttgataataaacgtgggattcacacatgtctcctccaagaaatggccaactagctgttagagcagagcatataccttattaatttggctaaggaataccaaaagggaaacaaaagcaaaaggtatattaaaatttaagcaaatagcttcaggttggattttgcaatataccccagatcttttatttgtttgtgagctaatgtgaaaatgttcagaaatgtactgtacattatggaagcaacaaaaaggattacaccggacattcttcttcatatcaaagtggctagcttatcatatatgtaaataagatattataagatagcaaaatcacctaacgaaaatcatatcaaaatacagtgtaaaaagaatgtgtagtgggtaaagaaacaaccttatcaagcaaccgtgttgtagtctggggatcctctagagtcgacct

SEQ ID NO: 83631 - DNA, 749 bp, Oryza sativa
gcttccgcaacccgctgagcatgaacatgagcatgccgatgcccaacgccaacttcacggtgaccaaggccaccatggccgagttcccggcgctcaacggccagagcgtctcctacgccgtcctcatgtatcccccggccaccctcaacccgccgcacacccacccgcgctctgccgagctcctgctcctcgtcgacggcgcgctctccgtcggcttcgtcgacacgaccaacaagctctacacccaggaccttgccgccggcgacatgttcgtcttccccaaggggatggtgcacttccagttcaactccgggaaccagccggccatggcgctctcggcgttcggaagcgccgccgcggggctcgtgtcggtgccggtcaccgtgttcggcacaaacatcgacgacgccgtgctcgccaagtcgttcaagaccgacgtgcctacgatccagaagctcaaggcaggcctaactcctcccaagaaagcctaagccctccccgttggtgttaattattcttgtttttcatcctgctgctgctgctgcttgaaataagagaccttccaggctaccaactactgaagaaggtaaattatgatttgtgtggtgaataattctgaattgtggttgtattgtcttgtctgaagagctttgaaccatgtatctatcagtattaattaaggcgttgtgggaatatatatagaccagttcagttgtaagtgttgagagtttctctgctgtaacggcttt

SEQ ID NO: 83632 - DNA, 1479 bp, Oryza sativa
tcaagatacatgcaattatgttaagtcaaccataacacaagtatgactaaaatgctaagattgctatagaaaatgctcttttatttggcaatgggatagaaattcctgaaatttcaatttttatttgcatgtacctgctccaatcttctccttcaaaatcaattcgttccatggaatgatcagatcatccacagcaagtgagagatcactgactgtacttcgtaagtactgattcccctctattaatttaaactctttctttttctcagctttcaagttggaggaagtaataagcggtaaaacttctcggggagcctctggcagaatagcatctgagcttacagctgcttgacctacataaaaaaaatgactcaagacaaacacacacacacacacacacacacacacatatcgaagtatagtggtcatgcaactgtttatatctttggactttctagcctaggcagcaaagtgataattttggagtacatactttgttgtgccattatatggatataagctggttcagaaaagaagatatatttaataatagtcaacaaaaggaaacagtttgttcacgaatcctagtagattgtcatgagctatattaccttttactggcacccagctgctcataatgtcatcccttgtgtcatgctttctagtagaatacggttggtccatagcaactgccgcattactattagcacctgaaacataagagatgtggggtctgtgtcacacctgatagactgcatagacctaactatcctagatgacaatcctcttttcggcctataacgaattaccaactacttcatggaaaattatatatgtgatgaagcactatttttttttttgcgggggtgatgaagcactattgacacttaaacagtgaagagataaactcagaaaaaagaagtgataaaagtaatgaagttaaaaacctgtggaagcttcgttaaataagagattgagagagtgacaatctgagaaatactgcttggcaaccgagctgaaatttgatgtgatctccaatgacctaaattttggaggccggagaggtgagggcactgatagtgagtagggtccattgacaaacgaatcaggatcagataattggcctggatccccaattagatcaaccaaatactccctgccaaaatgaaaatataaagaaagatttacaacatacaccaagtcaatatcctagcaaccaatcagcattacaaaaattacaggttgatatggcaaatattccatgtggcagcaaagcataagttcatgggttatatttacaagaacactttggttaccatgtgacagtaagatcacctgggtagagaaatgctggtgtctcaaaactaggtaatagacaaggtattaaaaggataatcattcacatatcttcacaactcacaaggcatgtacctttcaagcccaaagcgtacgaggcaggaggtggcatcatcacttttg

SEQ ID NO: 83633 - DNA, 641 bp, Oryza sativa
cgatcacggcgcggatcctggcggggctccgcgggcacggctactacaacctgggagtgcgcgccgacatcaacgaggtcatcgcggcgctcgcccgcgaggccggttgggtcgtcctccccgacggaaccaccttcccctcctcctcctcctccgtttcccagccgccacccacgcagcagcagcttcaggtatggaatcgaacgaatgcagcagcagatgtgttcctgtctgttcccctccctcccactcttctcttctccttgtccgctctgctctgctatgtttaaagctggctggcaggcagctgagcctgagctcagtgagctggaagccaagtaccggagagttatttaccctgttcctttcattattttatttatttttgacgtcataaataggtcgcatccggtactgtaggagatatgttttcaagtgatgatgacaaaagcacccctcataactcatttatgagcccttttcgcctcacggagagtagatatatattcattattattttaaatcaggcttccgtatccaacttacggagaagcatatgtttgtctggaaggacatataacgctgaaattatagagacggggtatttcatattatggtaattttgaattaaataggtacat

SEQ ID NO: 83634 - DNA, 678 bp, Oryza sativa
gatggcttgatttttccaactaaaactaagttgcaagcttgcaatttctgttcagtttcatttctgttattttatcttcgcaactttagataatgtggtatgcttgcataatttcaggtgccttatggcattggctgttgtgagaaacgacttctatgatctgcgcaacaagtttcagactatgcttcaggtagtaccttatcttctccattggcttttgacttacaaaaattcactaactatgaggtgccacacaagggtcgatagtatatcatataactcaaataatgtcctttgtttttttttagactgataatctccttggttatggcatatatgatttgacagttgacaccaagttatgttggaagtttctgaaagctttacttgagggtgtgtttgttaattttcttggatatgtttggatggttgtataggatagtcccaagcagtcatcagtgtttttctttacctgcttaaaaattgaagtttaatatctggatagcaaccaaaactttggaacttgattgattttttatgtgaattttcgttctccagctgctcattcagctttcatgttgagcatcataaagctgctgttgatggttcctggatcttaattattgacatggtgtgttttgatgtagctggagcagcaaatccaggcttatgatccca

SEQ ID NO: 83635 - DNA, 534 bp, Oryza sativa
ggtgaactccaaaccactcacaaaccagcgctgggtctcctccacaatctcctcggagaggtcaccgggcaacacctccacaagccgtctatgaggcggcaacctccaagagtaacaagcaatgacacagctcggagatgatcaagtgccgcactagctctacaatgaagcaatgcacttgactcttggctcaacaatcccgcaaacacactaaatggataaacacaaagctcaagtgggtgtgggagatatgcaaggggtgtatgcaagtgaagaaagtaccaagagaggtcccttgctgctggtggggatgtatttatactcccaccaaccaaaactagccgttggggggtcaaaatcccccaactcagtgcactgccgatcagaccgccgttgtgtagccagtcagaccgaactactatgcaacggctagaaaactagttgttgttgcagtgcatttaatgcactgacacaaggagggctggtcagaccgcagtagtgtgggtggtcagaccggctgcgactctggcggct

SEQ ID NO: 83636 - DNA, 769 bp, Oryza sativa
aacaagattttcttaattaacaaaggaacttatgacggtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatagtctacttatatatacaaggacctaattaattaaaggagacgtatagtaagaaatctaactgaacgatatacttacaaaatccagcaactcataatagagacgtcgagggcgtccagctggtatagttcatagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttc

SEQ ID NO: 83637 - DNA, 529 bp, Oryza sativa
gctttgtttatataataatgttgtgacttgcctgtaattagaatagggattaaattttatactcttaccactggatcactgattagcatgacagttcaaccatgccattgctccaaaaaaaaaaagaaaaagaaaataagagtctcacaagctattggcagtgaagtgatataatgaagtaaattatatttaaattaaaatagtattctgctaagtcatcagactaggcttgcattgcctacacaaccactttgtaaaataaaaaggtttacagtggcctgcccttcccctaagaggttaatagtatctcccggctctgaaactaatccaagggctagctttgcggtactgtacattcatctgtcatttcccctgcgggcaacacaattgtacaaagtttcctcagtcgagttcaattcccagaagttgagttgaatgaaaatcatcttggttcaaaaagatacctgtcctgaaaattattaggtagaaataacaggccttggaggagggggaggaagaggcatccttg

SEQ ID NO: 83638 - DNA, 534 bp, Oryza sativa
agtccctgtaaagattgagacgaatcatcctgatgtcgtgtcaattcttatgccaaaagaaggcaatggtacacatggtacccatgaacgttttgtgttacaggtatgggcttgcccctctaatcgagcttcaatattgttttggaaaaaaaggtccatttttataaccctgaacttttgcaaaagtctgaaaaaaaaagagtgagtctggtgggaagttcaggctgtaaactgggtttttagtggatcttaacgctttctcaattgtaatgattgctttaaagctgtgacaagaataatcaaggaatattttggtgaaactaattctggaagttgtaacaagaatttgagtcaatcttgagtacggataatttgagtgagacttccatgcaaaatgtgttgtgttttgttgtcctttgcaggcaagaagtcatggaactgctcttgtaaggttgcaaatcagccatattcccaagaaagccgatttcataatggtaaagtgctaaagttcaatgctactatcccagagttctt

SEQ ID NO: 83639 - DNA, 1238 bp, Oryza sativa
caaccttaagagtgtacataacacgtttagtcgttggcatacaagcatcagtgtaaaataactcggaaaagaaaggtgtgataactattaaacctaaaaaaatcagtagtagaaaattacactttcatttgccaccctttccttctcttcaagatgctttatttgcttccgtagctgggcaatctctttttcttgcccttccagtcttgtccgaagtagaccagactccgcccttgaaacaagcaaagcacacaattaggataagtttaaaaaataattatatagaatcagtgcacgggctggaacaaaatcaggatattttgaagaagaaaaatgcactaggtgataagtgatagcatttagcacattgcagctcagttgtccatatcgagatgtcaagagtgttgcatttcccaatgtttcattgtaaatcgtagatattattgtttcttacacagaacttcaaaagacaaatgcttcagaccacatgtctaattgacagcaagtgtgtcttggtcttttaaaattctttgttgccatgtagttcaacaggcagcgaaagtgacaacacaataaaggaaacacacagttctagtgagtttcctgctacccttcaaactaaacttatggtacactgggagtaaacagaacaaaaattcgtcagtggagatagctaccttagtgcttcaacaagatgttgcagctcaacaatcttaacttgggactccttcatgctattctccaattcccctgcctgcagcattgagtgcatgatagataatttagttgtaccgtattaagtggtccatgaacctgcaacattatagcattacaaagatcttactagggtatagacttcatctttctccatgctccctggcctgtgctccctgcgctctttgagcccaacctcaattccggcctcccttagtccatcctcagcaaccttgagcacctcgctggtgtttgattgcagcgcgctgcggagcaacaccccaatgtgctctttctcccgcaatagctcatccaccctcgcttccaaatccctcactttgctttcctttttatcaacccatgccccaaccttgtgcagggcagtggtagcgagatcgtacgccatcttggtcccttccagggacaccttgaggctctcctacacgtaaggctccttccagaccaacaccgagtcagaaagcgcgctcgcggaatccgcgtgcactaacttgaccacctcacgt

SEQ ID NO: 83640 - DNA, 571 bp, Oryza sativa
ctgaaagaaattactgcatatcaccacagttgaagcagcaggcaacttcataggccacaagttgacgattcaggtttttctcaagaaatcttggagcaaacttattccgtttagttgatcattgtagtaccccctaccattttaaattgaattagcaaacgtcaaatacaaaaaacagagggagtacaaccttttcaccccagttcttgaaataaacttgtacagttgaatttcagtctgaatatctgatgaacatcaaggatgatgcaatcaaagtttcagttactcagtgaattcaaatctcatattggttctcaagaagttttatttcttctcttgctcagcactttctacaatataatccttaacctgctacacaagtgtttgttatctcacagggcacaacacacaacgtatgcaaccataagagaatcaacaagtatgcaaactcaatgagatacaaatgacaaaaaaagtacaattctcatacaacagttattggttcaaatattacccaaccagaagggcatttgaataacaatcatatattcgtattggtgtacctgaacaa

SEQ ID NO: 83641 - DNA, 573 bp, Oryza sativa
tctcttcaagactgccacatcacctgagcggcgaatgaatctgggcgacccgatttgcttcgcctggagatacggtaatgtcgcttcggtcggcgagcgtaattaacgcgcgcacgatacgatctatctcgactgccgcaaccgcatatccacctcacgcgccgcaagcgggcgaatgggatcagtggaagcgtgggcgcgagaaacgagggggcgaaataatgggcgcgagaaacgagaagccgggcacagcgttggcaagggtataaaggcactgaggataggatttgtttccttcctttcgccatcattccccttgccttcgccgcttgcgccctaactccttcttccctgcgcccttctttcgccacacgcgctcgctctccatcttctcttcgtccggcgccatggcacggggctccgcactgcttgatggtagcgtgctgccgccttcccgcatcgtgagcgagaagcaggctgggttgccgcgccgctttatgccggaatctgccaccggccgtgagatagtcatgctgggcgagggacgcccggcgccagactacccggggaggt

SEQ ID NO: 83642 - DNA, 5440 bp, Oryza sativa
gaacgggacgtcgtgagccgacgccgccaccgccatggctgcagctgccaccaccacacccagcaccaccaccaatgatttcctcatctctccgtgcatacagtatatgactatgctggattgctgatgctgctagctagctatagtagtcgattgacttctcagatcagtcgatcgagcattgcatgaatatcttgtggaaggggtgcatgccatttatagagctccatcgtcgactaatttaatcaaaaccatgggcgaattgacgacaacgtacgactatttaatattatatactcaattttctctttcagattattctcactgggattcctatctttaggagttaggattaggatttagaagctagagctagagttaggattaggagacaggagtaccgtttgagaggtgaaagatttaagagtaaatttttcacataacttcatctattatggtcaaaattcgtcaaaaacataaggttttgccacgtgccatattcccttaggtattgtggccataaagtttcacaaaaccatatgctagtactatttattattttgactttactttattaaaattttaagttctacaatcacatcttaaatttatgggttctttatataaatgatgcatcaatataagtaatgttttttaaaaaatatataggagtgtgttaaattggttaatgatgttgttttgtgaaactctagtaccataatacatggattatgtatcatgtgttaaaatttcagtggtttcgtgtaacttggaacataatagataggattttattaaatttattcaagatttaaatcaaatcatccaactgaacacgcatgcaccgatcagaatgaacatgactgttatatttcaacataacactaaatacatatacctcacaccttatcataattttgacagcccaataaccaaatttcttactagttaggttaaaaaaattttcaaaaatatacatatatacatatttgatgtatatatatatatatgtatgtatatatgtatgtatatatgtattatgtatatatgtattatgtatacatgtatatttcaaaaatatacatatatacctttacatttcgtccgtcttatttgaaaattttttgaaaaaatttaaaaccataagacacgtataaagtactattcatgttttatcatctcataagaataaaaatactaattattaaaaaagttaaataagacagacaattaaagttgggcacgaaaattatggttgcacttaaaatggaacgaagggagcagcattaactatatttagtgaggatgaactttatagatatatagaatgcctcgtcgataggttaaatctacattcatctttgatttggattttctttttagtctagatagatactcacttcttctcatattgatcatcatataagaaaatgcaccaagactaagagcaagtataatagtgagctataagcctactataagcttatgtggaggagagagataacaaaaaatcatggacgttggctctcagagcaagtttaatagtatagccaactactagctctaatttatctatagccaatctaatagctcatttatacaatagttacatactacactattaatacctggtcccacctgtcatacacactgtgtcttgaagtccgtgctacagctggctataaatttgtagcccactacttttctctctccatgtttaacttcttaaaatatgtttgcaaccggcttatagcatgctattgtacctgctctcatgcaagagctagcttaacacaagctcctaagtaaatacattaaatgcataggtgagagatagagagaggagaagataattgtagccaactttatagctaatctattatatatattggctttaagatgggctaatagtaggaagtgagctctactattatccttgctctaaggacagcacagcctagttaattctggcattaaaaccacatcgaacaattaacagtcggtttgggtctcatgcaaagagtgtcacgcctaccgtcggatgaaagtgcattgtggcatgcaaactcctttgatccagcgattgcatgcaaacgcctacacacattaattccatgcaagcatgcatacgttacgaggaggcatcagcgagattatcaatggcactagctctatgcgacgatcaatatgacatttttagtttctgctagtaggatgggaaggagggagtattgtctttaacatttttttctgatccggtctgattttgtatcagttttgtcatatatgacgtggtgtataaattaatgatgcatgagaatttggttggatcagtttgtttgcgcgtgcgtcgcatagaacaggaaccgatcgacgaccgacgggccggcctagcgagaggtcggaatcgcaactacgccagcgcggagaatatgaggacgatgcggacacaggcaagcatgacacaacaagcgacagacgaaaatttaaaggtgatgattgaagaattattattcatttttaaagtaggtttgattagattagataggctcaaacgtactctctccgtctaaaaaaagacagatctctggtttccgtgcccaacgtttgaccgttcgtcttatttgaaaaaattataaaaaaaattaaaaagacaagtcacgcataaaatattaattatgttttatcatctaacaacaataaaaatacgaattatacaaaaaaatcatataagacggacagtcaaagttgaacacggaaactcagggtttgtctttttttgggacagagggagtactacgttaacgagaagtatacacacgtacgtaactacctggggttaaggatatagcaggccaaacgggcggcccggcccagcacgacacggcacgccgacggcacggcccactagggcacggcccattaggcacggctcctgtagcgggccgtgccgtgccggcccacgtgccaaggccacggcccaagcacggcccaagaaggtgctgggccgtgccgggccggcacggctactgtagtggcacgtgggctggtagccggcccactaatacatgtggcccataaaaattgaaatttgaggggaaaaaaagaaaaaaggcagaaaaaacataatataaaggaaaaaatgataaatataggataaatgtgaggaaaatttaggaaatatatcataaaatatatggtacaaatatgataaaatgtggaaaaaaataaaaaatatgagaaatatatggaaaaattagaaaatcgtaggaaaaataaatgggccggtgggccgtgccatgcctgggccgtgccgtgccggcacgctacagtaaacgtgccgtgccgtgccagcccacgggctgaggcatcggcccaaacacggcacgggataacgggccgtgccggcacggcccacaggctggcgtgccgtgccgggcctgggccggctacagtactgccgtgctcgggccggcccggcttggcacggcccatttggccaggtatagttaaggatcgatcgatcgatatgtgttgcgtgtaggttttaaaatcgatcgatgaaggcatgaagcatatgcatgcatgcagccagcatgtgccattttaaaacatgatgcgtttgcacgtcgacaggtaacagaggcgccgcaaaacagctggccaagtcaagttgaactattttactatccttaacaggtagtacgtcaggtatcatatgttcaatatctcgatcggtacctctctccagtataaatttaatatatagttataaatttttgcactaaaatttttatgttttttaagagctattaaatttctctaattaattagggtatacttcactgtactgtgttaatagagtcacatgattcatcaaagcataagcgaaatgaactaagtactcccaccgtcccaaaataagcatttttagaatagtgacaagtcaaactttttagatttttactattaatagaaaaaaataaaaaacattaatcatgtaaatttgatgttattatattagcattaaacgaactaccataatatataactctttttatttaaaacattttacttttatatatattatcggtcaaagtagcatctcggagaccttgttgaggtcaaaaatactccttccgattccataatttttaatattttaaacaaggttaagctcaaaattttattctttttttgactatcaacaatcttaaaaattattcgaaataaaggtactatataacaacatatataaatttatcttacaaaatactataataaaagtaaaaatatattataataaaaaatataatcaatgatgtaatttaaataccatgtcattatccaaaacgttaaaccttataaaaccggaggaaacagtacaagttctatcatgggtgatatggaatcggggaactagtatagtttggcagttcactactaccaggatatatatgccaagttcccgagaaaaaactcttgggaaacagcctaaatttccctgggtaaagctgtgtttagattcaaaatttggatccaaacttcagtcattttcgatcacatcaacatgtcatacacatacagcttttcagtcacatcatctccaattttaactaaaatctaaactttgcgctgaactaaacacagtctaaggataggtatctcttgcggatagatttcaaaacctatggacgatatggtaatatagatctctaaactgttgttacaaagttgctcttggttgtacctgtcttttaattgagtacggtacggtatatatgttgggttcgcattatttggtcgccatttaatttgcagtcaaaagagatcgatcgaggatcatgccaatcatgcgtgcatgcatctacttttcaatttgctttgctaggacgatggagacccagctttcgctatccgcctatccgttacaaaaacacattgttttggaaagtcaaaaactccagaaaaactttcagtattaataatactaccttttaagacatttagattggattcatgatcaattcatagatattaatttgtatacatcttattataataatatactgaatatgtatttcatagatactatatatataattcgttgagatcacttgtacatattttaatttgcaatatacaaatatagtggtcaaaatatgtattgaaagaacgtaacacatcggtaattttccctcgaaaaaagaacacatccgtgtacgtactcaaaacgacatattttcatgaaaagggagcgcaatacgcagtactcgtgatacagcctacaaggcgatcgagtattaatttatttctgcacgtaatacgaacgttcgcaggatggacgtatgtcagcttaatctgaacgagttaataatatataataattaattaattgatgatcacttcgatttgtatttctactgacttcgtcattacg

SEQ ID NO: 83643 - DNA, 2393 bp, Oryza sativa
caagaagaacgccaggtacatccatgactttaacaggaagaaaggcatgtcctacaaactcggcctcaacaagttcgccgacttgacgttggaggagttcaccgccaagtacaccggcgccaatcccggacccatcaccggcctcaagaacggcaccggctcgccgccgctagcggctgttgccggcgacgcacccccggcgtgggactggagagaacatggcgctgtcactcgtgtcaaggaccaagggccatgcggtacgtacctacgtactatacatgattacaattaatcttaatactccctccgttcctaaatgtttgacgccgttgacttttttaaacatatttaaccgttcgtcttatttaaaaaatttaaataattattaattcttttcctaccatttgattcattgctaaatatactaatactaaagtttttgaataatattcataaaaaatcaaatgtgtcaaacatttagggacgggggagtacaattatacaaatacacacatgttatttatgcatatatacatatataggtagctgctgggcgttctccgtggtagaggctgtagaggggatcaacgcgatcatgacagggaacctcctgacgctgtcggagcagcaggttctcgattgctccggcgccggcgactgctccggcggatacacgtcctatgcattcgactacgccgtcagcaacgggataactttggaccagtgcttcagtcccccaacgacgggggagaactacttctactaccccgcctacgaggccgtgcaggagccctgcagatttgatcctgtatgtaattcattaatttaattgtctcaacatattatatatatgatgaatggactgataatacagtttgtgtatatatcgtacgcatgcgcagaacaaggctccaattgtgaagatcgacagctactccttcgtggatcccaacgacgaggaagctctcaagcaggcagtgtactcacaagggcccgtatccgtcctcatcgaagctagctacgaattcatgatctaccaaggggtaggctatactgctgtttgtttacagtacttctccctctatattttaatgtatgacgccgttgattttttaaccaacgtttgatcactcgtcttattcgaaatttttatgcaaatataaaaatacttatgtcatgcttaaagaacatctgatgataattacataaattttttgaataaaacgaaaggtgaaacgtttatcaaaaagtcaacggcgtcatacattaaaatacttgaagtactaattaattttctcccaaatatatatatatatatatatatatatatatatatatatatatatatatatatatatatatatatatatatatatatgaccagaatatatttacattatagaaaatgtggacacatgcatatagaaacatatgtagtcatgtattaataacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgtgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtttgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcagaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagc

SEQ ID NO: 83644 - DNA, 1404 bp, Oryza sativa
gcgaattcgataaatttcaacgaatcggcagacaaacaggagttgttatgttattatcccacccgagccacgttatactacccaacaagtgatgaagtaacccactcctcgaaggcttgtgttccgccgcgtcgccgtcgcaaccgaatcgcatcgcatcgcatcggtccaaactcccaaccggcgacggcgaggccgacgaaacccaaacccagctaagcttccctcttcgattccccccatggacgacgacggcgacgccgtcctctccgacgtcgacgaggaggaccctctcccgcccccgccccctccctccacctacttctaccaaaaatccccatctccttcacaaccccaaccccaaccccatgcgcaggcgcagcgcctgcacgacctggccgccgagctggaggaggagcgccgcctccgccgcaaggccgaggaatccctcgccgaggccgagaagcgctccgaacgcgtcaaggccttagcgcagaacgtcctccgcaagcacgacgacctcaagaccgaggcctccaccgcctcctccatgctcacttccggcttcgagaggatctccgccaaggcctccccctccgccgccgcttcgcccgcgccgctccccacttcccaaaagtactcctccggcctccccgccatcgcttacggcgtcctcaagcgcgccaacgacatcgtcgatgacctcctctcccagatcgacgccgccaaccgcgaccgcgacagggcgcgcgagcagatggagcaccgcaactaccagatcgccatcgaggtctccgagctcgaggcgtccctcgcgtccaggtccgcccactgcgactccctctccaagtccctctccgacaaggacgccgagatctcggacctccggaacaacctcgccttcctggagaccaagctggacgcgcagaggcccgtgctcgccgaccagatcgcctgcgcctccaaggtgtacgacgagatacgtgaggtggtcaagctagtggacgcggatgccgcgagcgcgctctctgactcggtgttcgtctggaaggagaccgacgtggaggagagcctcaaggtgtccctggaagggaccaagatggcgtacgatctcgctaccactgccctgcacaaggttggggcatgggttgataaaaaggaaagcaaagtgagggatttggaagcgagggtggatgagctattgcgggagaaagagcacattggggtgttgctccgcagcgcgctgcaatcaaacaccagcgaggtgctcaaggttgctgaggatggactaagggaggccggaattgaggttgggctcaaagagcgcagggagcacaggccagggagcatggagaaagatgaagtctataccctagtaagatctttgtaatgctataatgttgc

SEQ ID NO: 83645 - DNA, 826 bp, Oryza sativa
tattttcttagcacaagagcaattattcacaatattcgtaataattttattcttgtgccgagaaggaaatcaaaccacagaaattaaattagtggctagatcaaaaaggaggaatttggatattgggatttagaatcaaaggatagggttaaaatcaaaggatggattaacaaataattctaatgagattggaattattttgggttaggttcaagggcaaaattgggaaggtttcttggaccacaattcataaaaataataaaaaggggttttcaagcaaaattgactaaaaggaatttagtcaaaagaccgttttgaacgaaatcaagaaatacctcactttaaccaaaacatatttttaagtgaaaaacacaaaagagattaaataccatagaggctttcgtacaagtcatttttaggaggtcccgctaattatattttcctaggtttagaaggttattaataacataagaatcagcatgatgcaaaattagcagagggctaatttttgggttgttacacacggctaggccatatcactttgtgcaatgagtaaataagctaatttagagtggttgcaaaagagggtgcaaaaatatcggtctacaaaaaacgatattggtgaaactattgaagattttgataaagtagaaaagcttggtcaagggtttacatcggccgatccgttggaggaagtagacataggtgatggaactaaaccaaggccgacttttgtaaacaaaaaaatgagagccgattataaggttaaaataatcgagctacttaaggagtatgttgattgcttcgcatgagagtatcatgagat

SEQ ID NO: 83646 - DNA, 680 bp, Oryza sativa
atagcatagatctaattaattactatataatttctcatcagatcgtccgacctggtggcatggagaggccaacggacgctttcaaggagacgcacaacctggtggtggcagttgaggacacctacgtcggtggactcgtttccaaccttcaggtggcggagctcatcgcgtgcatcgccagcaacaggagaacggcctactgcaaggtggtcgaagcgatcgcagagaccaccgcgccattgctgcccacggaggatcagctcgccaacataccttcaaagcgggtatacccatgcctattattagcatttaatttctccatttcatattataatttgatatttttcacagtcaatattttttattttaagctcaatcaactttattagaaaaatatagcaacattttcgataaaaaatcatatattatcggaatataatttaatgttagtttcgacgaaactagggctgcattttttcgcttagatttgagagagatttttcaatgcacgcaaaacgagaaagattattagtatatgattaattaagtaaataattataaacttgaaaaatagatttatttaatttttttaaacaacttttgtatataatttttttttgcaaaaaaacaccattgaacagtttgaaaaatgtgctaacaaaaaaaataagcaagttaaa

SEQ ID NO: 83647 - DNA, 998 bp, Oryza sativa
ttctgagtttcttacccataaaatatttgcaggaagaagatgccatggacagggatggaaatgatcttgatggtgatggcttacatccacagaagcatgccaaaagtcctgaactggcaagagaatttcttttagatgccgcggcagttatatttaaagaacaggtaatttgtaatcaaagtatagaaaagaaatgttggaagcaatacttgttgtaatgattgtggctgtacaaagaaagaaaaaaaacttgattttctaaaccacagctcccaaatttgggtgcacaacctgcatatcatacattccatttcaataagatatattttccttcaattgctacttcataatgaaggaacagtaacttaccagtgtttgtgattgctatatgaagtcctccacccacatacaccgtgtgatttgtctatcttatcaaatggcaactgagtggtatgttatttccagcagcactactcctttacctaaggttcatgaataaaagttgttttttgttgttcttgtttctacccgtcttgcccccatcatagcattgtcagtcactttagtcacttctgaggttgtgttttctagccactgttgtagccattaagtacatgccaatctagttctggacctccacatatcaaagtcaattttctttttttattattcaagatatttaatgcaataaaaaaattaaagaacgattctccacagagatatgtacataaggggatccatattcttttatcctgtaatattactagtagtggttactgtagttactaagatcaaatcaagatttatttattgagggttttgctaaaatttcagatgcttatgttacaagcttaagcatatgctaaatatgggttattgcaggtcgagaaggcattcagagaaggtacagctcggcacaaatgcacacagtatttttgtgtctcttgcattagaacttttggaagagcgagtccatgtagcatgcaaagaaattatta

SEQ ID NO: 83648 - DNA, 567 bp, Oryza sativa
aaggtcctccttttatatcttaaggggataccacatgcaccatttctctcttttttgtggggacttaccccaccttttcataaacagacggagacttgtatggttgctgtccgaatgaccttctgatgagacgggccacaactacctccacttccgccggaagcaggcgcgacgtggaatcgtggctgtctgctgacgacatgaccggtatcagaccagtcacgtcggtcattcttgtccaccacgtgtcagcttagcaacctacatgctcacccttcttcacacaacatcttgcctgtaatggttaggatgaagcctggcatatatctgaccaggactaacgtgccatctctgggaggtaacacgctagctccagctggggacgagcgcctagaagccctcgtcctgacgggatggggcgaggcgtgcgtcagatcgcctgttgccacctaacccgcgatctgaccggtctgtgactggtcacagaccggataaacgagtgcactgcactgcgttacatacggcgtgacacgctcagcccaaccgcaataaatgtggttaggtgag

SEQ ID NO: 83649 - DNA, 684 bp, Oryza sativa
tctagtagtagcaactaaagtgaggtcgcagaatattatgcctaactagcgatggttttgtcatagtcacgtcccttttttttatctaatcattctcttatttttatgccttactctctccgtttcaggttataagatgttttgactttggtcaaaattaaactgcttcaaatttgacaaagtttatagacaaatatagtaatatttacattaccaaattagttttcttaaattaataattaaatatattttataataactttatcttggttcgaaaatattactattcttttctataaatttgattaaacttaaagcagtttgactttgactaaagtcaaaacatcttataagttgaaatgtagggagtattagttagaaaaccaaaaattttgcgattttgctaaatatttatttacagatttttttttggctaaaaatcactcggtattttttaccgtccgattcattgatgatttctgtgcttcgttattagccgcacagtttctttgcgtgtcctctttccttttccctgtgttgtatgcacatatttattcgttcactacccgtgattggttggctatcgtttgagagatagaagatgcatattctctatttactagctgctatatgactatgcgaatggcttctgctgttcttttgtgagactagcatactactttt

SEQ ID NO: 83650 - DNA, 532 bp, Oryza sativa
  unsure (1)..(532): unsure at all n locations
tccagctgttgatgcttatcagaagattctctcgtccattcctgagttctccgggtttggaaggctcttcaaggtctgtagcttctataccattaatgattttgattgagtacacatgctaaacccctctctttttccccagtcctcagaacctgtggagctgacagaggcggagactgaatatgcgattaatgtggttaagcacatatacagtagccatgttgtgttgcagtacaactgtacaaacactatacccgaacaactgctagaaaatgtaagcagcaaacaattaagtacaattaaatatgttcttggaggcacagctgtcaactcacactgaagattttttttcatatatgtatgttgattcttgtaggtgactgtttatgttgatgccactgatgctgaggaattttcagaagtttgttcaaagccacttagaagtttgccttatgattcacctgngcaaatttttgttgcttttgaaaagccagaacatgttcctgctactgggaaattttcaaatgtgctg

SEQ ID NO: 83651 - DNA, 507 bp, Oryza sativa
tgaattagaacctgtgaagaacaagccattagtcaactggaggagagtaccaatctaaatcctctttaagtgaagatgcatgtactctcatgagctgcaaggcaggttggctatatgccttaatgagttctattagctttaattagcaaagatgctatcctgtagagcattcttaaaagaacacacctttgtgagcttgactattggttgtactcttgatattttaggtgaatcttctagtaagcttactaagagaccaatgagtatgacttatacactctacccgaggagcagtctactgacggtctagtaccagataagactctgtgtgaaacttgcttgcacaagacttgcaattcaaggcatagtccattgttcaagttgtgagtaagtgtagcttgaagttctaggtggatgttcaatcttaatcggtctccatcaacagttggtatataaacagtacattggaaaaaggcaaatctcagtaggattttgagatttggtggg

SEQ ID NO: 83652 - DNA, 1217 bp, Oryza sativa
catgattctcaatggtttcaatggtgaacctacggaggcgaaaggtatctttttgatggagcttaccgtgtgaaacaagacgttgccaaccgctttcttcatcgtcgatgtgcaaggtaactacaatgttattttgggtcattgttggatccatgccaattgttgtgtgccttctaccttgcatcaatgtttaattcgatgggacggtgatgatattgaaattgttcaagcggatatgtcggccaaagttgcaatggccaatgcgacattagagtggcgtcatgggaatattcaatgcttatcggggatggatctttctagctatgattttattagtattttcgatggcaaatttgtacctatctctgtaaagccagctagtgtagcacggtgtcaggtcctgaaactaatgattcggaaaccgacatgtttaaactgtatcaagccctggattagtaaattggtacatgttcaacaatctggatcttcattgcatacgtttgaataagactccaaaggatatattattacaaaatatatgggtatttaaaaacttgtggctaactaatacagcaaaagctatagaatgacttaactctaatgtttggctatagacctaaaccatctatctaatctagacttgagaattaagttagaatgaaactaacttatgtgattgaactcccagctttggcaagaactccaaaatgactctgaaaaaggtggggttgaagcaagggtgagtacaacgtactcagcaagctattatattcaatatgaatgtatgaaatagtagcatttaagtagggctagatttaattgcagaaagcagaggatgtagaagaagaaagcctgtaatgactttaatgcaacagtatttagtaaaatcttgaattaggtttctaatcaaataccatatgagtcccggtactcaattccgtgagcacgactattcgaatagtttcatgaatattctactgcagtagatgtacgctttacccgcagtccacgacttgccaattcattaggttagtcatggcctattattaggttattaacaattgtggcacttggtccatgaactctagtccccatgcgctctgaacgtaacgttatcagcagcgagaggagttctggcgttcccggggtctttagagagaactgatcgtatgacaccatgtcatcgcaatcagggttcacaaacagactagtcatca

SEQ ID NO: 83653 - DNA, 617 bp, Oryza sativa
tcctccgacgggttcaaagtcaagcagggcgaaacaagctctcacccaaatgggaaggaccgtacacgatcacacaagttctgcggccaggcgcattcaaaattgcagacggcgatggtcgcgagttgtcaaattcctggaacattgatcaattacgtaaattctatgtataagttaatagtatccatgcttgtaagacatcttacagcttcaataaagcctatttttaggtacagactacaatcaaagtgttccttcccgatgatcccttacccagatgacacctagcgttgaaacctatcctcatgtccctttacgccgtcttgacaaggcctccgaggaacctaagggaacttcggctggggatgcccagagccgataaggccttgtcggatcctgtagagacgaaagaccatgtaagatctggtcgtgtaagagttctcgccgtgcgtattaaccaagccgtgtaatcaaaaataaactttccaacttcacagctgggggctaggattagtgcttgttcaatcgaggcaggtcaaaggtacaagagccttatctcccgagaagaattctccgatgacaaggctgggggctagggagagtgtataagtcaaacg

SEQ ID NO: 83654 - DNA, 509 bp, Oryza sativa
tcttcgcgctcccaagtagcttcttcttcggcgtggttgctccactgaaccttgcaaaaacgggttactcggttcctggtcctgcgctccatggtgtccaggattttcactggcctctccacataggtcaagtcttcgcgaacttcaatttgctctgaatcggcctgctcggatggcattcgaagacatttcttgagttgcgacacatggaacacatcatgcacgttacccaaggaggcgggcaactccagttggtaagcaacttctccacgtcgagcgatgatacggaagggacccacataccgaggtgcgagcttcccttttgtctgaacctgtgcacacctcgcaatggcgtgacccgaagatacacaaagtcatccaccgcgaattccagatcacggcgacggttatctgcataacttttctgccgagactgtgccacctttagattatcccgaatgattctgactttagcttcagcttctctcaggatatcagtcccgaacact

SEQ ID NO: 83655 - DNA, 614 bp, Oryza sativa
gaactgtgctatgctgtcatagcatcttataagcagcaaaaagttggcattattggtttccggtagtatgttcctttctaattcctttaggataatcatgtcaaaggcactcaaacaaaatcatgttttgcaaaactaccatagtatttttctgcacaaaactggttcagctgctcacattaaagagcactaaaatccagggttaatttggagttaggtgcccaattgcattaattgttggattcaacagctttattttttttcctcatgtatgcagcacagctgcagcatggtcaattggagcatgctgatggaaatggagactgggttttaactatatttaaagctctgtcactggtaagtatatttttttatagatttttttgtggcatacttgttaataagcttaaatttattcatagttcgttttccgggtccctttaatgatagtccttttttttggttgcttcacctaatgttcgtctgaaacgcatcttctacgcttctagcacaatggtcttcatctgtgtttctagttaaggttgactatggtacatgtgtttgtattttgttctcattacaaatctatcatcgtacaagtaggaagtgcaaca

SEQ ID NO: 83656 - DNA, 1226 bp, Oryza sativa
cctgcaatgccaacaaaaaattgatgtttaagcctaggttgaacaccattcagccaattaccaaaaagattagtaatgctagtaggcggatggatcccaaaggttatagacacagcattccagattaatctaaccaaatgacaatcaataaaaagatgttgtatcgtttcattagaatcacaaaagaacacttagtgctacctttccaccttcttttttgcaagattatcttttgttagagtaacccctttttttaagtaccacaagaaaattttaatcctcaatggaattctaagccccaaaggaaagatttccttggaattactccgttaaaaatgagagctctgtacatggagttgacggtaaatatttcctttttattggctttccacacaaagacatcattttgttctgtaagttgagttgacataacttttgagaccaagttataccaagctgctaggttatcccctacaatagctcttctgaaaaaaacgtttaggggcaccttttccaacacttcagccaccattacattttttttcctgactagattatacaacgaaggatacatcttaaaaagaggaatcaccactccaacaatcctcccaaaatctcagttgtgtgccattacctacttgaaaagcgccacaagaaagaaaagagttcttaacctccatcagccctgcccaaaaatgagaatcccctggttgtttttctacaagtgtaattgttttcttagccaagtattttttcctaagtagtttttgccaaaccccatcctcattgataagcttatacaaccatttactcagcaaacatttattctgcacatttagattctgtattccaagacccccacaatccttaggtgtacaaatcacactccatctcgccaacctatattttcttttatgtccatcactttgccaaaagaatctagacctgtagtagtctagcttcttgaggatacctttaggtacctcaaagaaggacaacataaacatggctaggctactcaacaccgaattaatcaacacaagccttcctcctactgagagacatttccctttccaactactcaacttcctctggaacctctcctcgataatttgccaatccttattagagagcttcttgtggtgcataggaattcctaggtatctaaatgggtaagtcccagatctacacccaaaaagcatgacatactcattctctgcaaattt

SEQ ID NO: 83657 - DNA, 1535 bp, Oryza sativa
tttcttttagctgtttcactgctcatgtggtttctgtaatttttcaattgaaggccaatgagcaaaatagtatttggagatatgtcacgactgttctgcttatcaatctccaataaattagtgatgcaatgtaaatttttgttcctagctcttgtgatccacgccatctgtaattttctaccacatgataatcgtgaacttttaaaattggtaatttacttcttaatttttagcaaattcatgtcgttgctttaaggacgaattcttgaaattcttcaggttatttttgacattttcttacagtagatatatcatttttcactgtggcgtgtgattttttttaccagatggcgtgtaattttcattcttcattcgtagattattgagctgttacttctaataagtaggagatttctgtaacaaaatgccatgaatacgggatgcctaatctgtgtagagttcatcgaatactttggtcattgcaaccttcatgtttcgtttgttgcgattggctgttgtgacaggcatttagtgccgtggtttatttttatttttatttttatttttttttcagttcagttccagcatagcattcatgctatagggctgagcggatcacagtcgtatcactgaccggtgattgcgctccagtgatgcatagtaagagcttgatccgttggtctaattagtcaatgccaaaaatcaaaaattgaattttcatatttaattttaaagttaattttaagaaatttttggcacagttttttatattgacttttaagtcactaagaacatttctataaaaagtttatctataaattaattcttgttctttaacaagctgtttttatctataaaagtacgaattaccctctgaactatcgtggtggtccgaattaccccccgaaccacaaaaccagacatattagacctcaaactattgaaactggataaattacccccctcactcaatatgaagtggtattgatcctacgtggcatatacatggcgttgaggtggaaatccgatcaacattttcttttttaaaaatggtgggggccacctgtaagacctcatcttcccatcttcctccctctctctctcatcatcttccacgcggtcttggttcccgacggcgtgcggccacggctgcgcggattagacgacccccggcgtgcccaccgccttccaggaccccgacggcgtggtccagctcggtcgcccgccccgcacctcccgctcctgccgcgggcagaagtagaaccacggctccccctcctcgccgctgctgcccagcatctcgtggtgaatctctgcaggtgtatacaggtgacgcggcgctcgcgcgacgacgtacgacgaacgcaatgcacacgtgtgtgctggtacctgagagctgcaacgggtcgacggagtatatgtcgaagacggggatgacgcactcgatgtcgtcgtggaggccgtcagcttgttgcggaggtagaagcatatcagctcctcctctgttgggtagaagcggaacccgagagccagcc

SEQ ID NO: 83658 - DNA, 1823 bp, Oryza sativa
cagttgctgatcaataaaagctgatgctgaagccgtctgcttgacattcgctgttgtcgataactctctgccgcttctccttcctcaacctatttcattctgttgttgctacttttgctgctcctccctgcagttgcaaatagcttctctgggaagcttgctgaggccatctccacctcctattgatgtggcatggtcacggtctggttggccaacaggataaagctgatagggagatgtcgaggtggccgatgatgtggggagaagcctgtgagaaacaaacggcatggggacagagagaggtggccagctatttatagtgataggctgagctgggctaccccacctgatcacctcttctcttccagagggcaaaaaccattgtacaaagcatggtgagagactgagcttgcttggcccacctggctatgtccattcttcgctgccgtccttttgttcgccaatcaccagcaccacctctgttctctgcagcatgcatggcgctctgttgctaacataaccattacctttcccttttcccctccgttattctagcatcatgcttttcggcctgcatatgctgttcgaagtgaggagcccaactacgctagtatgcgttggttcacatgtccattgatgattttggtgagacaatccatttcctcatttccccacataagtaaacttgcggtttcaagttctgaggtattgattatcaattcatcgtctcattcttcaagccaaacatgacattttcaccagattctgtaggaaaggttgagcttttgtaaaccttatgtgtccctcatgttatttacagactacgggaagttttcaatagtcatttttctaagtagttctagaattgaatgactaagctttatgtgtttgtgcagcaaagtgcagccttcaagatcttgagaactcggctgaagactgtgcctttcagtgaaaatttgaaacgcacatcttcaacaaatccatactctcagattctacaagtgacagaagatggtaatcgaaatcacgacactcagagctacaatgcaatcaatttcccatcccggctccaccagtttgagagcatgcagcagcagcacagagttcatctaaagaatcaactgcaatcccaaaaatctgcttcagctatagtattatcacaggtaatgtttctcttgcattaagccattaacatatatctgattatattgtatacctatacgtagttgcttcccccattaaagtgtaactaggtttttagttgcgtactgaaaatggttccttagcttacctatgcaactaagatctgtgttttcttggtgttgaacacttcttcttcttcttcttctttttttttttttggggggggggggatgggggggggtggtctttaatcctttcatctacaattggttgtgagagtttcttcgtgttaagttgtaaatccttctctttgcagatatattaaatatctgatgtctcccgtatcaactgtaggtctacctgaatcatcatcgcatcataatttaatcttgtaacacatttgttagtccctttgatttgctactaaaatgttatttcccagaaacctgactgttttcagaaatctgccaactgcaactaggaaaagttgctcttgaatggcttctttgattgtgtaccatagtttctcactgcaaaccttcataacttagtcaaacaaaggttgccactaagatgcttattctttgataggaaaaccgctatgtaacttttgtgaattgcatgcaggaaattcaaagatacgaagaagcacattcctcctcgacagggctgcaggaatt

SEQ ID NO: 83659 - DNA, 556 bp, Oryza sativa
gtccccaagctggagcatctggaaagcgagtcttcacaacatgatagtcctcccaagtagcatgatctgctggtaataaagaccatttcagcaacacctggacatgagctgcattgccgcgcttcactagtcgacgctccaaaatcgcctcaggaacaacgtcagcagcatcaagaaccactggggatggcaaagaagtataaacaggagtatgatctggcacctgagctttgagttgagaaacatgaaacaccggatgcacagtgctgctggcaggtagatccaaacgataagccgccactccaatgcgctccaaaacagtaaaagggccaaagaacttataagccaacttaggatatggtctattaactactgaggactgagcataaggctgtaacttcaagaaaacagcatcacccacagcaaaaacacggtcagaacgacctttatcagccttgttcttcatacgcagctgggctcgagttaactgctgctgtaaaaattcagacaagccctgccccttcagtctaaacatccaccacatcaggcagagtag

SEQ ID NO: 83660 - DNA, 532 bp, Oryza sativa
ctgttttggaaccagacctccacctgccttggcctgaggttcagttgcttcgctaaagcgactttctgcttctgctcgaagaaacaaaacaaaagcggtggttcagtgacccatatatattcgatcaaaaaagatgaacaaaacacaaattaatatgcgccatgtttttatcttaatttgctccttgtgttctactacaagtgcagctttctgcagctaggctaagcggcggcaagtcaatagaacgtaaggagaacgcgcggacgtacgtgacgtaccgggttgagcgtgctgtgctcccggaagcggtcctccaggagcgcggactgctccttggtcagccggagcttcttgcgggtgctcccgtcgtcgtcgtcgtcacgcccggccgccgtcgacgacaccctctcgccgtcggactcctccgcgcgctccctcttcacggccgccgccgccgccgcgccgacggacagcgacgacacgctgtgcgcagggccgtccccgccggacgcggtcgcggtcgcggtcgcgg

SEQ ID NO: 83661 - DNA, 1968 bp, Oryza sativa
ggcgcctgctcctgctctgcctcgtgcccccgcccggcgtcgttgtcagatggcgcgtaggaggaaggcgaggccggcagccagggcgaggcggcggccggtggtgtgcgaggtggtgctggccggacacgcggccttggcccgatgtccggcggcgtgaggctgtggaggtgctgcgcgaggagcaagccggcggtggtgacggggtcatcaagtggctggctgccattggtgacctcagtggctttctgcagcatgcaggaagcggtttggcagtgaagagttcatcctctgtattgccagcttgacctgcggggtggtagactgagcttgggtgttgaagggatggcgtggtggtctggcgatggtcgttgtgcaggatggttgtgtggggttttgatgggaaaccgctggcgaaagccttgccaggccatgggctggcatgacgacggcgacgccatttggcgccgttcccctccttggaggcgtcgtcctggcattgacccctcgtaacacgaagaaccctctacgcgcaatggtagccttggtggactcctgcaatgtccccaaagctcttcaggtctagggtgtttgacgaggcctcacttccttggcttcgttccttgctacaacgggtgttcatcactcttatctggttactgtggggtagagtcggaactgctttgctgggggcgacgaagcttggcaacaatgacacactgcaatttctttataggattgttgatgctagctgtgtgtaggagtggttccttggtagcttgggctgatgtccttcgtgggtgtcgttcttgtttgttcattttggcgttgggatagcatcacattgaagtcgaagctgctgtgtcacttgggtgacaagcttggcaacgataacatgtgtaagctgccgtgttgtctcaaatggcaagcttggccgatgccttgtgtcgggctctgtcgtggtagtttaggataggttagctgttggtgtggtgttgtagttgtggttttcgctcagttttctctaattaactgaggtgttgtagttgtggttttcgctcagttttctctaattaactgagcactgtaaagtttgatcccgttttcttctcaaaatgggatatcttcttcttaatataaaatgtcggcaacggcctgaccgtaggtttcaaaaaatatacgaggcagtttctcttttgcttttagcctgcaacacgctagctcaaagtgcaacactttgcacatttggcacagacgtttacatccatccatcgaagttattcgcatcagtcagagtgacatgtaaagagtggagaagatgtaacccgatcgaacaaacagacaagctgatcgaacaaaaaaagacagcggttttccatatatataaatcacgatataggaaaatcaagaacatccgtccctacggaaaaagcaaatccgttttacaaagcattattattcagagtacacaaaatgacactcggtgaacaggacagactagtaataaaattcaaagggccttgtcgacgccaaggatagaccgagaccgaaatccaacgttgacacatcacggctgatgcacgcacgcgtacgtttcttttttttgttttttttgggcgcagaaatgcacgggagaggcccgccggacggcttagttctgcttccacagcagcgtggtctcggcgatcatgccggtgacgacgtatgggtccatgttggacgccggcctcctgtcctcgaagtaccccttgccctccttctccgtgtcgcgccccacgcggatggacgcgccgcggttcaccacgccctgcacgcacgcacgcaaaaaatggttatgatctcatggtaggctagccgatcgatcaacgaacggggggggtatgcgtggatacacgtacccattgaaggtgttgatgtcggcggtctcgtggcggccggtgagggggcgctcgttgccctcgccgtagg

SEQ ID NO: 83662 - DNA, 982 bp, Oryza sativa
tatggtaagcctcaaatcattgcacgtttctttcagacgacaatgctagtcaatttgaaacagtgggatgtgagaaccccacaaggaataaagaagatgagacagatcaatataaaaagacgacttgggcaaagtcttccagtctacatcttcattgataatgctaagcccatccatggcatcactattaggcaagagaagcacagctatatacatcattatgcatagcaaagcaccttattagcattgatccattcacaacttggagtacctcctttctgcttctatctctcctgcaaatggagaatagcgagcaagagaggacggactcaccattggagtatgatttgaggaagtacctccttctgttggccacccttgtggccacggtgacatatggtgcaggattcagcccgccggggggtgtctggcaggacaccgaggccgggcacctcgctggtgactccatcatccgggatagccagtatcgccgataccttatgttcttctactgcaacgcgactgcattcgcgctgtccatcgtggtcatcatcctcatcttcatccttgctatcctgcatgagaaggggaagttacagatccccatgcttccactgcgagcagccatggtgctggacctgctaagcctcattggggcctatgctgcagggaccagtcggggtgttctcacagccggcaacgtctctgcacttgtggctactttcatctatatggtggcacagatggtggtaactttatggcttgacaagaaacagactcaggatataagctcaggtaatctactaatcctcctaattcagcgcactaaatatggaccatgtcaatattcagaggggaaattgaccaggtgatgagaagaaaaaacggcaccgcaaggtactgatgcttctcgcaacatttgtggcaagcatcaatacatggctgggctgagagcaccgggtggctactgggataacaacca

SEQ ID NO: 83663 - DNA, 889 bp, Oryza sativa
tcaaaaaagaaacatgccacacgcaaatacttgatgctgctaggagtcttggctgcaagtgttacttaccaggccggtctcaacccacccggcggtgtgtggcagggaaatagtaatgatcatgcagcaggtaacccagttatgcatgacaaaaaaagataccgttatctcatcttcttttacagcaactctacttcatttgtggcatccattgttgttatcatcctgttgctaccagagaaactgctgggggaggcatggtcacttaatgtgatgaacataacgattgtgttggacttacttggcctcctactagcctacatggctggctcaagaatgaggttgcagtcttctggatatttcgtcgtgtttgttataggtgcactaggctttgctgcaattcacaagatttggtcatatttgcaaaggaaaagaaatgatcagcacagactgttagaccaacccagatagtcaagttagggagtttagatgttctagtgtgctttgtaattctatccatccatgctttctttgtttagtcggatgcattatgttccaatatatcattagctggttaaagtcagactcaatcacgctactacttcattcttatctccccattaacagcccataaatcaaacaagagctacaaatgttaaaagttaaatcgctatacatattaacttaagtgctttctaaaatttttaggactttaattaactctgtattttttgaaagcccttacccattttcagaatccaaaacagatttttcttttccaaattttcaaaagtatgtgacagattaagtcttgtacttaatatatgctagtatctattttggaaaatacttgggtgccttaggatataagctactagtccatatgtct

SEQ ID NO: 83664 - DNA, 621 bp, Oryza sativa
ctgaagtcattaaccatcttcagatactgaagaacacaagaacaccgttcaattagtctgatggcaaaacaaatatatttgcccaaactgctagctattattcaaaattgccgagattaatatgcttttatatatactattagaatgcacaaaagtaatttttgtggggaatattagtaagacacaaacaaagataattagcattaattagtataccgtttagtggcggcgtagacggagtagagtgggaaggaagggatggcctccgtggagccggagccgatgttgacgacggcgcccctcccccgcgccaccatccccggcagcaccgccgccgtcacctccgtcaccgcccacaggttcacccgtatcatcctcacccacgcctccgccttcgcctcgtgcaggtacaccgcgcacggccgcgccacgcccgcgttgttcaccaccaccccgacgtccagccccgccaccgcctcccgcagccgccgcaccgcctcgtccccctccgcggtggacgccagggccaggtcgaacaccacgctcctggtctccacgccttcgtcgcccagcttggagatggcctccgagacgtcgcggagcttggccgggtcgcggccg

SEQ ID NO: 83665 - DNA, 6251 bp, Oryza sativa
aaaaaaaaaaaatcaagaaaccggagattgctcctcctatcctatcttttttaactgcagcttgtggttcaggttggaaacatggaagtggtcgttgaactcggagaaatcaagaacgaactttcccgcttgctcttgtccaggaaacaatccactctttcccgctcgcaccgcctccaatcaatcaatcaatcaatcaatcagtcaatccatcgagattaaaggcgccacgaactcagcgggaaatggcaagaaacgagggcataaactagaaaccaacccccaatcaatgagaaaaaagaaaatcaggagaaaaaaacaaacatcagcagcaggcagggcgggcgtttgcggaggccaatcagaatcagagagcgattggagggggggagcctgggtgaggttttgtgtggaagcaacggatgggcggtggtcggcttcgggcacggaagactttgatttgagccgccggcgaagaggaagaggagaggaggtgaagaactgaaaaatgaaaatgaaaaaatgagaatgaaaatgttttgaggactcaacacaacagtcaacacaacgcgaggcgtacggtgtgtgtgtgtgtgggtcttctctcctctgctgactttcaaaaccgctccgctgcccgttagcgtttgcttttagcactggtacagttttactatttcgacttttttttaaaaaaaaattacacttttgttcctctatgactacaacctctccactaccaccgagaaaaaaaaaaactctacctcactttacctggcaagcacgaatggctggttcagtttgttatcatttctaaccttttcaaatttcaatattttaagggtaacaaactaaacacggttcaattttattgagttttgacattttccgaaactttctactctcaaatcattaccgaaatagagtctaacatcacaattctcaccttatcttatatgagatacacttgatagtacatagtacattaataaaggtgtgtagttttaactatgagttcctgtattcaatcccgtacacggacatctctacccctctaagcctctcttttttttcaccttacatactgtactaggtaatacctcattttctgtgctttatatgaaaatttgtccgagttagcttaacaactctatcatttcacttatgcttgaatttataatttaatatttaatatttaattttgtggtttttttactgtggcttatcttatagcattttcttttgaatagttaacgacatgtctataatatttttacttataaattattttttattgctaataagcgaaacgatggacacgtaaggctgataagacgtggagaaatgaactaaaaaataatagtttagacacctttttatacacatattcttagctatctaaaagtcatcgttgaaaatttaactacgatgaaaaaaaatcttaaattaaatatacaattatgttttaaaatttaaatttcggctgtggctagcaagacaacaagcagcagacaatgaaaagcgccggccaaagggaggaagagtgcaagacatgaaaaaaatactattgggtttttttatgaatcatttagattttattagatattcataagaatctttcaaaattttatagaaatttgtgaaaaatattatgtgtttcaaaagagatttgtgtttagatgagtatgctgggatctgtttatccctgcacgcgaaatgaaatgacccattagcgtatgattaattaagtattacctatagaaaagaaaacttgaaaaaaataaagaattccctatagatttttttaaaaacaactttcctatagttttttttaaaaaaatacatcgtttagcagtttgagaagcgtgcacaagaaaaatgagagaataaaagttgagaaaatgtagtatcgaacaaagccttactagtcgaataaggtcctattcaaaggcaggaaaaaaaattcgggacttcatttgaacacaggaattccacgtgtatcaattctaccggatctaaaaaaacacgtggcactcaaatgagggtgttatatgggaattgaagtgtttcaagtgaagttattgggtttcaatcaggccaaattacgagttgtcaaaagattttctttttaggacaaaagaaattgtgcacttgttaatccctgtctagaacgcaggaaaaatccctctttcctgtggaaaacataattattttatatgaaatcaatgtgttctagacaatgaccagttcttgagcatgcttcaattatcaggagcagtagccagtaggattggagtgccatgttgactttttttttaaaaaaatgggattactgttttttgtccttttttttaacagggataagatcactttgactaattatgcccatcttcagatatgttgactaataagttgggtccatattaaggtacagcactgacagcagctcttccttcttgaatgccttcatgtcactgtgggttcttctgggactaatcattatattcttctctataaagttcatgtgaaatcaagcttttaaaaaataattaataatcctattagattaaacaggtaatcaagtgccaaatgcacccaacagtatgcagcacgagaaagctggaagctgtcataaaaaagcgtgacacatcgacacgatgattatccaagctagaggcaagctataatcataattccacaggacaaaactaaattccaaattagcagaatgagtagtgtcttttttaaataaaaaaaaatctcccaagaagtactttgtcggttgcagctgtgtggtcatgactggactgggtaaagaagaggcagcttgacagcaaataattttcagctaagaaagtttgacagggagcatttgtgtcaacgtcaatggacacagcacacggacagttcgaagaatatgacaataattaatagcttctctctagatgaactgtgctaaaagatggagtattccttggaacaaccaatatgacctctagaagaagtacaggttttacaggtgtgctagccacaagggctgttaaacaatcaactctccagatgcagataaggtttagcaacttgatagatatacacataagattatgacgtgatttttccccgtaaaggaagtgttggaaaaaatttcaaaactaaggagtgtactggttccagtttcaatttttcctggaagttgcagaaattcttgcaaaaaccgaaaaggaggttaggttactccatatcaactgaagccatgtttagatcaaaagtaaagctgcaaagcttttttgagcgcaagctaacacggcagatgacatattactccagtatttgccccaaggaacaattcagggtaatcgttcacccgcaaactcaagtgtcacattaagaagcgaagtaaaaaaaaaaagcacaaacctagagtaggagcagaaacagaggtgattagctatctgaagtctggacagttaccttttgcagcacaagtgcaaggaacaggagtcttttgtgaagatgtccaggtttgactctatgaattcttccagactgcttgatattgccatattggaacctttcagcaagcacagcgcgaatcgaaaacaacagtgaaagaaaagagagtgattcctcaagactaatttcattatttgtactaaaaattacagaagttggatgcaggtaataaggcgcatcagaactagataacataacaacatcaacatatcaacaatgctaatatgcagtttattcatttcattgaccatagcaccaatcttactaatactgtacattttggttccaatcaactagaggggattttccacagataacaaaaccaaaactatggaaagatcaaatgcagattaagtagcattgtagcactacagagagggaaaattacaaccaggataagtatcacaactggtgcaatgcaaactcaactatggtacaagggcaaagccatcatggaaacagagtaaaaatcctacatgtattccctcaggacaagttgttttccatctcatgctagctgctggtctcctctgaatcagcaagcacaaactctgtgtacaggttcttcaatgccatcaccactgtcattataaggggacctaatattgcaccctgcagagttacatcagatggtcagcccaatgtgagtaaagaaaatatcaattctcagatgctcggtggaatggcactctagtacattggtgtgctccatgttccaaggactagaatgattccataagaattttctggacagtaaacaaacagatgttgtacagagtacaagtgtacaacacacacagactatacagaaaatcattcaacataatacattagtgtccattttttgtagcctagaagaaacgcaatcttttcagattttagctactagattatttaaaagacttccgatatagaagttacttttaaaaaatcaaacaaatccatatttcaagcttgtaatagttattacttaattaatcgtgcgttaattacagaacttcactgataagatacgtggctgatcagccaaaaccctcctcaacagggccttaaaatgtataacatcataggcatgaaggccagatagagtataacttttttttttggagtacaaaaatgattggagttacacccataaatagggttgaaaaggtatagatttttggagcaagaaaaaagcagcatgtatgaataggggatataggtaaaatagatatgcttttggtgcccacagtaggagattctttagtatcaaatgcaaaacgtaaagcatttattctagattatgtcttctgattatccacaccatatgtaaaatcatacaattgaactaacaaaagttcatcttcaaagcacctaaatgttgtctgaacgaaaatggtgaaaaacatttaacacaacaaaagtgaatagatttggtataaaaagtcagtacctccagagcattggggaacaatgccatgccaccaattatgctaaggccagtgagatatccattgtacccgggtatatcctcctgaatgactgtagttccataatccatgattatgagatgaaccactgtcaccacaatagcgagcacatatctcccttccatgagcagctgtcctgcggcaaatatcgaggacaaccatggtgggagtattggcagaagtgcactgatgattgcaaacacagttgatgtgtacacaaaatgcaccttgaagagcttgaacaacagccatgtcaggcatccctggaaaatggcaatcttggcagtggctaacaagacactactaatggcatggtcgatgacctcgacgcatcgatcctttacttgttttgacaatggcaaaagatcaatgacctgctctgtagccccacctccctctacagtgatgaggtagtacagcacccacaagaaaaccatcaactgtgacacaaaattgagcacctcagctgcaccagagacaatgtggagagtaatggataacatcagattggcactaccaccgagcaccgatgtgctgctagacagcagactttttgcgatctcagccccctgcaatgccaatcccttggccttcaccaccaaatcctcccttgtgattaacagctccctaaagaatgagtccagctccctgtaaatgtccatccactccctgttcttcacatgcttcgcaataacctgtagcttcatcgagtacgggtgtggtccggatgtgatgagctccttgccctttgcaccagatgggtcaactgattggctgatcaagaaatgccggaatccgctagtgaaatcggtaaggttgtactgcactgctaactgatctatctgctcccacacggtatcgtagagcttcgcggaatactgatcaaccaagccggggatgtcattgtcgtcaagccacttcttgaggccaatcttttcagagtagttgccattctcgacatgggacttgagggacatgacagcgtccttgccctcgagcccaatcttgtaggagaagaagacgctgccggataggaacccgagtatcatcccgagcatgaggccgacggcgacgagcgtcttgaggtggcggaggatgccgccggtaaggaagaggcagcgggaggagggtgttcgtccggcgattcgggaggaggcggcgcgggataggaaggaggagggcttgggggatgcggcgaaaaacgcgagggagagggcgaggaggaccaacgcggtggcggtgccgaggcggtcgagcaggaggagg

SEQ ID NO: 83666 - DNA, 5995 bp, Oryza sativa
agcgccgtggcgagccccgcgtgcgccatcgcaatgtacagcgccagccgcgcgtcgggctccagcgacaagcccccgatatcgtcttccgccggagacgccttccccttcccctggggctttttggtcgtcgtcggctcctcctgcttcggcagccgcagcgacgcggagcggaacatctccgaccaggggaggtccatcacctccccgtccttgcacgcgcctccgttgggctcacccttagccacgagcgccatgtcaccggcgccggaatgcctgcgccgccgacttcgccgccgccgccgcggagggcaagctccgcctccgggtggtggtggaaatggaatgggagggaggaggggatttggggggtgattagcgcgggtggggtaaccatgatgggagagattaaggaaagattaattaaattaagcgggggattaattaggattaagatgtcgcgttttggaaagggaggggaaggagacgggttaacgccttaacggtggctaaccgggtacgcgctccgaggctgacgtatggggccccaaggggatggtgacacgtggcaactccctttctcgtcgtcggcaatggggagcgttgctctgacagctgtgtctgtttgggcaggagaatacgaggtggactgttgatgaataggctaggaggttttgcttaaactgattataaaccataagagtaaaaataatgaaaaaaaatactgttcgtaatttaaaagttaataaaaaaataataaataaaaaacttttaaaaccaactctagaattagcttttaaagtttaaattttttttatggtttattcccttcattccaattcccaaatatttatggagtttttcaaggaaactaaaataaataaaattgagatgtctaagtgattccaacgatattaaaacatatatgtcataattttccagagattgttatattttgagacaaattttaaatgctagaaattactataatttttgataaatagagtaacaccctaaaattaaatccagtatattttatagagacctatctcgcacttgttataattttatttgttgtcaaaaagggttagaatctaatatttaagtatattagcatatgcaacccagaagacaccacattcatttctcgggaagactagttcgcaaacgctctcaaactaggcatctcacgaatgggttttcaaccgtgtcacaacaaacacacgggttaggattaaggtagggttttagggatgggggtagtgattagggagaagggtggtgttggggagagaaaagaggggatcgggtttagaggaatttaacctgaaaaacagcagatcggtgatgggcggtggaaagggtgggcgcagttgatcaacgaggctatatatgcattaaatctgctgattaataaactgtctagttgacaaaactaattaaagtgtcactaattaagatttagactatgcatcaacgggtgatcaacgagagtcacgtggaatcggatcttatagctagagggcagttccaactctgctaattaaacactccttgtcaattatatgtttttagtctcattaaggagaggatggcaaatcactgtcacgcatatgcacgtttctttcttccctatctgtccgagaccggcaaatgctgtcatgcatatgggtccggtttacagttgcattattttgccaatatacagctggacgcatctacgaagtcttcaattgattttggggagaaaaatacttgagaagccttttttttccgtttacacgtggaacacacaaacaccactacacacataataccacactcgcacactgtaaatacgttcactaacacatgcttaaaaagacgaaaacaataatacatccttgatcggtctcactaaactcgtgttcaaaacctatatacttgtgtgtgcgtaagtcaccaccacaacactagtgcttttgtaaaagatggtattttaaattcagagagcatgcatttttatgtattaaactacgtatgccacaatacaacatgcattttttatgcaagcctcaatgggatgcattttgtaggcagcgatttataaacaaagatatctatatatttaaaaataatattgacataagattcagtctgctaatttcacatcacatatactatggtcagacaatgcatgtgtaatactacttctcatatgtaggtcccacttgctcttgctctcaggctcacatgacagtgagcagcactttgctatatggcctgtggaggatctcaatccactattttgaccgattgttgcctataaatactacggtactggtctgtgatctaggatgaagagctgcaaatttctacactaagcaaagaaaagaagaagaagaaaataagctaaaataatttttatactagttaagtttgaaatttgacattgtcagccgcaattcaaacgagagcatgctccaaattaaacactttcaacaatcaatatttccagaaaaacaaaaccatcaatataatttcttttttaaagaaatgtttacacatggtctggtgcattggaaatggaaattgtacggcatgattgccaggtgcgatgcacatcctcccaaacaaaaataatgtactcctactagctaggatgaacataatcttctgagaattttttacttaaggactaaacaacatctaatctttatcctccttattttagagatggtatgccactattgtaccacactaacatgattccagacttccagcatatacaattcatatcagttgcaccaactttctggagctttgctaagaaagctggcccctaacgaactttgtcgaaaacaatctgcatcgtgctgctgctagtctttggatgcatggatgtgtttaatttatgggttaatttgatccatgccattgcaagtttatcgatttagaaaaactaccactactattcacgatatcggttgggtatcactgatattttacaaaattaaaaccgtaccattgtcatcacattttccatccctttcgtctttttccttcttctccccatcgaggggttaactgcaaggaggccgaccaaagagctctagcgaagcgagcggcgccgaagcccgggagcgagagaggtcaatgccagagagggatgacgtggtgaggacagcgtcagggacgacaaagcagcaagtgacaaggacagcagccggtgcccatgaagaacatggaggcggagcagcaagtgacgccagcggcgaccaccatcacctctccattcacggtgaggagtaggaggtgaagatagtagtggcgcctagttttaataggaatataagcataaaacaaatgattgaaaaatttaaaaattgttacaaaattgaccatttaagtagaccgcaggagaaaaaacacaggaattgaatgaaataaaaagacacaagagatacttttcaataggtttggaggtcttcctaaatttcctctaaaatttatgtagtctataggattgtggataaattttaaagggaatggtaggatttaattcttgatttcttggttttaaaggtttttctagccatttttcctacggaattggaatcctctaaaatttgaaccttcttttacaaattatataaattaaggcggcttactgtttacatgattaatttgagtgggtatggaaaagtgaccacgcatgataatacattaatattgtagaacaatgcttgctagggcactgtttacagtcggtcaatcccaaaataagtcaccctttatatataaatctaaacacaaactgtgtcaagatttatgtacagagttgattctttttgacaagggtgtactatgcatgcacagtgatagtgagtgtacagattgatctaaaattctgaaccattagatttttatccgtcgatagatacaagaacctaatgtccatgtcaaaatcccatggtttccttgcattagtacatatactccatccattcatattataagtagttttttctagtagtcaatctttttttatcaagtgtataaaagaatttaacaacatgtgtaacaccaaataagttttaattgaatataacattaaatatattttgataatatgtttgttttgtgttaaaaatattactatatttttctattagcttttaaatttgactaagataaaagttaaaaaaagaggttagagattataatacaggtagtatcaataaaggtagtagagtaataaatacagagtataatacttcctgatgaaatttatagagatagatgggccgattaatctgtgggccctaattcttggtactattgcgaacataggagaagggtgcatatggaaaagtgaccacacatttttaacaattatatatgtaaagaggaaaacaacattacaattttgtactggcaaaagagaaattacctctacaacggtagaattaattttgacttgcaggtgatggtattctttttcccctcaaatctaatcgtagtctgtggtggtggatccaacacttatcttaagcctggcaaaccttatgtaagtacttgcaaatctacatttactatagaagcacaccaatttaatcgattatagtcttatataagagaaaaaacaatgcttaaaatatatcgattaaatgatgatattatattgttgatgcgctagattacattgagttatttaagtattactccctctataccataatataaggcgcggttaaagttgacatggtcctcaaaactaatctttaacttataatttctcatatactataaagtttgtagaaaaaaaattataaccatttgaaagtaaatttaaatctcaatctaataatataatttttaacaaataaaactcatttcatattatgctaacggtttgtaatgcgtgcacgacttatattatgggatggagggagaatatactctacttagtgttcacctagaagccagacgttcactagacggacccatggtctagagtctagacagtctagagattagtctagacgatatatcatactatatactatcaacatcagtggcggatgcagaaagaaatagcagtgtggtctgagcaaactagatagagttacagtctcaccttcaatctatatatgctaaaaaattttagtggggtcttcgtgggggctctcatagtcttcacgtcagtagtgggggctcgagaccccgccgcccctgtgctggatccgcccctgatcaacatgacatgtagatacacttaacttgtttcatataatattggagaacatgtggtgttgtgaaaggtgtagccactcgcatagagccatgggttggagagaggaggaagcaaggtccacggtgacaactagcagaggagaggtgacatgacttcatggcagcgcgatgtttagagcagagaagaggggtttggaatggtgtcaaaaacccaaggcacatggacctagggtggaacacaaagttttagttactaccacacaaaaaatgtattggttgcctagaccatagtctaaacgatagttttatagtctacatttatctcgtttttgtttaattgtgtggtctagatagtctaggatcatctttaattatctagacggtcaaacggtctaattcacggattaggtcctaaactagacgataactcatcgtctagcttttagacgcggtctaaaccgtctagactacggtatttggttagacggtagacactactacagcatatggctgagaagattggtgcctaactgtgataattaaacactaatactctactactggtacatataatggagcccttgattcaccattatcataaatgcttatggcaactataactttttctagaattttctaaaactttctttagaacaaaccagatttttttttcaaaacatatagttataagatccaaaatatgaaatagaaggcttgagaaaaaaaaatctttttcagattctcgcaaaccgtttctatt

SEQ ID NO: 83667 - DNA, 665 bp, Oryza sativa
ttgacatagcgcaagatgcgcttgaccaaggccaagtgagcgtcacgcggagagtgcatgtgtaggcacacttgctggacggcgtaggcgaggtcgggccgggtgagagtgaggtactgaaagccccggcgaggcttcggtactccgttggatcacggagaggttctccatcagaagccgagagcttggccttgggtatccaccggggtggccgtgggatggcactcggccatgccagcccgctggagaaggtcgacggcgtactgtcgctgagacagatgaaggccgttgggggtgcgctggacggagataatcggcgtcgctgtaggctgtgagcgtcgatgccgtggtagcatggagaaagagcccttgatccagtgaccccttgacatagcgcaagatgcgcttgaccaaggccaagtgagcgtcacgcggagagtgcatgtgtaggcacacttgctggacggcgtaggcgaggtcgggccgggtgagagtgaggtactgcaaagccccggcgaggcttcggtactccgttggatcacggagaggttctccatcagaagccgagagcttggccttgggtatccaccggggtggccgtgggatggcactcggccatgccagcccgctggagaaggtcgacggcgtactgtcgctgagacaga

SEQ ID NO: 83668 - DNA, 1906 bp, Oryza sativa
atcttcttacccctcgacaagataaagatcaccatcaccgtacggacttatgtgctctacgcgtacatcaccattgctcttttaggccttgtgggggcctatgtggctggcagctgcagaaagcctgacactaccatctatgtactcagtctggttggtgctgttcttttatgcataggcgccctccaggcagtcctattttttctgccacaactttcaaacatatcctgcttgccaataattgcaaagttatcatgttcaccgggagggccatcagatagcaggtactgaacacaaacatttttctgctgcctatcctgttgccatctttagtttaatgttaactttgtttgaattaacagttccagaaagaatacaagcagtaagacagatattctggagaaggcccaatctcttgttgtactgcttgccactcttgtggcaactgttacttaccaagcagggctagtcccaccaggtggtgtctggcagaaaaaccaagatgggcacatggctggcgaaccaatactcttatccacacaagccaaacgttacaaggtgttcttttactgtaactcgacagcctttgcagcatcattggttgtcatagttttggtccggtataaacctttgctcaggcgccgcattctagagataactatgattttggatctgtttggtctcatgggtgcatatgctgctggaagctgccgggacataaccacatcagtttacatcattgccttggcaggcggtgttctagtctatgtggtgattcatgttgtgttcttcacgcttgaagacaatgacaaggagaaggaagttgggaacacgaattctgtacgaaatggttcagttgtgcgcacccaaaataattcagctgagggcaatcttgctgagaaagattcatgtattgacaaaaggcgcaagaggctgctccttttcgctgttttgggcgcgaccctcacttatcaagctgggttgaccccaccgggtgggttcagagttgtggatgatggttttgggcgccatgctggtgatccaatactcttttacaactttccacgccgttacaaggcatttctctattgtaactcggtaagcttcatgtcatctctttccctcatcatactcctcgtgaacccaaatctgtataggccagctatacaaagctatgctctttcggtttgcactgtagcaggcttgtttgctcttctgggagcctatgctgccggaagcactcaacatctgaaaacatccatttatgtctttgtgttggtagctgtggtgcttttcattatgatcatactcctggtgtgtttctatcaaagtgagagcaaagagaagcgagatgacatatccaaggagcccgttgagaaagacaaggacagagccaaataccatgccaagcgcaagtacttgatgttgctaggggtcctggctgcaagtgttacttactcccaggctggtctgaacccacctggcggtgtgtggcagggtaatagtgacgggcatggtgtgggtcactcggttatgcatgacaataagaggtatcgctacctcaccttcttctacagcaactcaacttcttttgtggcatctattgttgttatcatcctattgctaccgacggaactgctaaagaagaacaggtggctaagggtgatgaatattacaattgtgctggacttgctcggcctactgctagcctacgtggctgggtcgagcatgagatgggaaccttctggatatgtcattgcatttgttattggtgcactaggctgtgctgcaatccacaagtttttgtcatttgtcagaaggtctcagcaacaggggcaaggaaatgatcagccttctcggttaccagaaggcggcagtcaagcttagatgttgttggcatggtaac

SEQ ID NO: 83669 - DNA, 5843 bp, Oryza sativa
actcttgttcgccctgatgactcctccctcgtaggctcaacgagccaggcaagccgccgcttctctcgataccaccgaaccagatctcctactttctcttatctggtggatcgtttatcttaaccctatatctcttctccacagagaattgtcagtcagttttgcatctcactcttccttctttactaagctctataaagacatgttactaaacatattttacatgtactctgtcgaagattcaaggtcgttaaatttaaaagttttttttgattttggctaaacgtttaaggctacgagtataaactttctaaatctgagcagaaagttttgggtttttagttttagttgaaatatttagatttcaattaagttttccagtttaattgaagttgaaagttttcatgttattttggctaaacatttgaggctatacccggaaactttccaaaatcagagtagaaagttttgagtttttagttttagttgaaagctttagatttcaattaaaagtttttatgttttagttgaaattttcaaattttgaattaaattgaaaagtgaagatttctctattgaaatatttgcaatttagatcttactttagttacatatattattatctatagaataatactcaaatgacaattagatcttactttagttgtatccagtgcttccttcatcagtgaggcctttgttctcttcagcctcccaattaaaacatcggcaaatatctctccttacactgtagcctttatgtgtacccagttccatgaagggttagcaaatataaacttgcaatactcctcagtaattctccttgaggtcactctcttaggatcaattttgataaagtttatcacatttcttaggcttcagttgtgtttagttccgcgccaaaattggaagtttgactaaaattgagggcctctttgaatcgcagggttgaaaaaaatggaggaataggaaaagcacaggattccgatgggaattgaagtgtaaaatagaggattgcaaaacacaggaaaaacacaggaatggtcgtttgattggagcgcaggaaaaacacaggaatcgggtgagagagataaactcgaagaaaattttccaagaggttggagctcttgctatattttctccaaaatacacatgcaatgtgccattccataggaatttcatagtatttggaaagcttcaatcctttgaatcaaatggccaaataggaaaattttctatatgatttgaatcatatgaaattcctatataaatcctttgattcaaagaggccctcaaagtttaaagaaaaaagttggaagtttatgtatatagaaaagttttgatgtgatgaaaaagttagaagtttaaagaaaaagttaggaactagaccgggccttcgtttgtagtatgtaagtactagttggcaactcatttttgcggttaggaactttggtactgtggatgcactattgcgcactgttcatggcagacagacggggaaggcatcgacgacgctgtttgcccgccgacaaaatccgtcaagatgcaggcgatgacccggcttggcgcaaggctttgctacacgcacatgcgtatcgtcgcttgattgaaaaggaaataattttgtgaagggcaattatatcagacgataagcggaaggcttgtaatgcaaacttgcaaagagaaaaaagaattaatgaaatgaaacatttatttatatggtttaaatttcgtaattatgcgatgtaacatcttaaaccatgtcattagtctgttgtatttgttaagaatttattcttgataagatgttatgagttcttgcaatatattgagaagaaaatgattatttttgttgccgaaaatattactagacagacaattatgaagaaatgatttatcacacaattgacacaaaaatgagtgcatcaaaattattgtgaaactgatgacataaatttgtactctttttcggtgctactatgaaaatcaccacacaaatttaagccttattgtaatattgcaaataatatgaaaaaaattaacacagaataatacaaatcccaatttataagatagctcacttctgaaatgcgaaatccatgcataataattaaagacaacacaaattgaatttcacaattcaaatctcactactgactagaccgtacataaatcactactagttgaaaccatacaaactcttcgggactaataaaaacagacgtaacatgcattagggataacatgtgggtcacttagcacctactgatagcgatagtaggcctcatcggcaatgcagtcacacaaggtgctcatagcctgcttgctatttgttgcatagtacatttgatcgaacgattcgttctgcagcggcacgggatagccgttgtacatagcattattttgacaggagttcacatccttactatccaacctgaaattgtgcagagcaaaagcagcacgtatgaaatgtgtgtggcaacaccctcctctggtaatacggtatttctttcattatttttcacattttttttgacgataccaaatgttctttcaacgatacctcgcaacgacgagtgtcaatggttaaatgtctcttctcatccttcgggtggcgacgctctatcatcaccaagttgatccatgtggtatcatacatgtgagtacggtgcaggaaatcccatcctactaggaaatctagagtccacaagtagataccttcctgtttaacgtgagagaatattttttttgctttacaagtcaagcttgaaatgtagtaacatatgccattcaaatattttagggaaaaaattgaactcaccaaacggtagccgtgggaaatcgtcggggtaatactgcactgcctcgttcagaatcctttggtcgtgaaccgatcctggtcatctagcaacgcagaaaataattctcccgtcatgatcacatatgactagaacatttttcatcgttatgtggtgctgattcttgtgttgcataaacctggctgaagaagtcacaactgaaacatgcatgccgtcaataacacccactgactggtaaaatggtttgaaccaacgttcgttaagaatcaaagggtgatattcactgaagttgggatccattggtttcaaaattttcctagccaggtcgttcatagacaccaaaacttggtggaagtaaatagacattgttgagttggagcggatccaccgattgtttgcatctctgcagggacgatttccagccatagtgtacaagaaaatcccaagtttttctagtgaacataccctggatgttccttcgaggccgtacgacgtgatcgggaggtcatgtaaactgtgtatccgttctgcaattagccggaaaattgcccaacattagcttcgatttgccatcgtttccaccatccaactgatttcggtttgaaccggtattctcttggtgctctctcgtttatctcaatgctagcggctagtatgtcactgatggtatcgtcctcgttgctgctaatgtgccctcctgtccagctcgatccaccagcgacggaactcatgcacggatatgtagaaaaaaatacttgcaatttgcacaaatggagtaataaaaccgcaattgttggacagcacctcgtagcaaatgttagcacgcataaattgataaacataatgacatgtttatttttaaaacaacacactgcacaattgacagtgaattggaagtacaaggtacaaactaatgcgtgccaccagatgaggaatctgctccgtttccacgagtagagatatattctaggcgagttgcggcgtcctggaggcaaacgaaacagtggcagtggaattcatcacggaaaagacgacaagtatcataccacactagccctccagtacggtgcccaacattttccaccaactccaagcaagcctcaagccctttagccttagcggcatctgcctcccttgtgcggctctgcatggactgctctcgcagggctgcaagcctccctatctgcagtcggtggtgctgatggagatggcatcggtggtctataagcggcactgtactgctccttgcggtgcggcgctggggcagcccccgtgacggccgagtggttgccgacaacggtgcgcccactgaacaccgcttggtgaaggtcaatgtgcttaagaggatcatttttgaaggcgctcgcacctttcttgacctgtcacagttatagacatgcacaagttacataacagatgatatgcactgatgcaagcaaagacacagacacaaggatgcaagaaagctgaatcaacgtatttcctaatttgtgtgtacactgttattcttaattagtaataaatacttcttttggctcatgtaatatagattatcagtgcaagtactcacgctgtgacatagcccaactgctgctgcaactactaccacacaatataaatgacaccatatggctagcatcacccttcctagatcttttcaatttcattcataaatatgaaacaacacaatattcagagtttcagacaacacaatattcagatctcttcaacaagattttcagataagagtttcagacaacacaatattcagagtttcagacacacatccatacctctactccccttgacagacacgacaacaatggctagtaccaagctaaggaaggaggaagaggagatcaggctctgctcccatgcatccacaggtttctgcggtctagggctatggtcgttaggaagtgttgttaggaaacgataggcaaacaaacaataaagaactatagatcaatcacagaagacacgagattttaacgtggaaaaccctcttaaagtaggagagaaaaaaccacaggcgccagccagcaaaaatatcttcactatttctggggtgaggttacaacgccgcacgacggcttacaagaggtatatatacgggcctccgctccactacggcagaagctggcctttattaagtgcaaatgaatttggatcacaactcaacaaactccaccttgagacaaatttcttcttgtagcatgaaacaatccttcaccctgaacacaacaaagacaaaaaaacactttcggcgccaaatagcctcttgggataaaccactataccaattaagcttgagcaaagctcaaacttagcaacaggaacaggctttgtcatcatatcagcaggattatcatgagtacttatcttgcatacctttagcttaccttacacgactacatcgcgaacataatggtacttgatatcaatgtgctttgtcctctcatgaaacatctgatctttagtgaggcatatagcactttgactgtcacaaaacaagttaatgcaagaatcaactccacaaagctcagcaaacaatcctttcagccaaactgattctttacatgcttcaacaatagccatgtattctgctttagtggtagactgggcaacaacagactgcaatgttgccttccaactcacagcacaactaccaatagtaaacacataacctgtgagtgaccttctcttatccaaatctgcagcaaaatctgaatccacatatccaacaagccccttatcagtcctcccaaacttcaagcaagcatcagctgtgcctctgaggtacttgaaaatccactgaacagctttccagtgttctttaccaggattagccatgtatctactaaccaaactcatagcatgagataaatctggacgggagcaaaccatggcatacatcaaagaaccaacagcactagaatatggaactctagacaggtattctacatcctcatcagtactagcacattgtaaagctgataatttaaaatgaggggctgcaggaat

SEQ ID NO: 83670 - DNA, 2072 bp, Oryza sativa
acatttagaaattttatttcccacatttaactttacttgtaaattaatgaatatttaatataaattgtagaaataatttattaaataatttataaatcctgaaacgaaaatcagggtgtgtgttgatgcgaaaaacacacaccggcctgagatatgcttaactctagtgcaggtccaaatcttggtttcgagttcgagggtatgccagttggtttgatcctgcaacgaacaagaaataaagaaacacatttaaatccataaacgatagccgatcgggcagtcaccgatgacatatcaattgtaacttagccgatgtaacgtgaattagatcagcaatgaaatataaggtaaaaggaaggttagacctagtcgatcggctatagatatcaacagtatataatatatacctcaagatatatttaaacaagtgattgggatagatcggacagcttgccgagatagtataaatcacttatgtttaaaagtaacttgaatcagatattatatatgttcatagcatagccggtgttttagatctaacatgtattggctaatactccgataccactttatactaagataacaatataaacaaaatatattaaatagagatcaatcaagtgttaagatgacttaacagatcaataacaagcttaatatatttaattacagtgatatcttaatataaagggcatatttagcatatcaagtaaacataaaataaggtaagatcggctgaaaccccgatactaccctaatcggcaaccaattaacaggctagaaattataattctaaacacgacttaaacacgacttaatagatcaaacttaactgatacaacattaagtataaaaagaagaacaatatctagacaatcaagtcattggatgattcatagagtggtggatatgctatataatctaagtcaacattgagatctagcttaatcggccgccttccagtgatagatgttagccgatttgaggttagatagcaatattgatctagattatatagaatatatgataacttgacgattcacataaacaagatttgtggacatccctagtattataccatccagtgtccaacgcgaccaccacatactattggagaagtgggatctatacacgcataaatagccactcatcctcaatgtgtccattatcacagttgacaccttctactataataaccggaatgccgagtagtgactgcgagagataaccataagatagcttgccagtccactccgtcatatgctcgtcaaaccatatgaaggcggcgaccaaaaacataccccagtaactcgatccaaaagcgctatccccaagtatctcaagcgatcaaaacctgttactcatgcttagctagtccccaggaatgcgactagcctcacactttcatcgcaagccattagtaaacatagcaagtaccataatagggtttaagtgcagcaagatacatgacacataatagggtccgaggtcccaacatacaacacataaatatagcagcgaaagtctcaaatagagttcataagcaaaagataaaaccggtggtgccacaaccccactagggcaaaccaaccgggcaagagccaaactgcaagagatcactcatcgccctcgccgccctcggcagagcaatgaccacacaagaagcataactcataaccggtatcctcacctgaaacagcggcgccgggttaagtacaagattgtactcgcaagtcttacccaaaattaaatatacataagggagagagaagtatgcaagctttctagccaacagtgggtctctaggttcaacatttgcataaagctaattttattgagcaattaatgagtaaaataagtaaggacaagtaaatctagcatcatttttatttatggacagcaagtatataattctgagatgtataagcaaatgagcccaaacggcgctctcattatcaaccatggactaccaaagtccataccaacatggcacaacatggcaacaccaccatcaaatagaatcccatccataataatccatatttggtgctaacataactgactaacacatc

SEQ ID NO: 83671 - DNA, 2121 bp, Oryza sativa
tgcatctaaacgaactaagttactgaaataaaaactacagggaacaaaactagtggtagcagcattcgcagctgctgaaggccatctcatccctacagaagaaaatcaggcgatcaataattcaaaatcggttagttgatcaattcgtttgtatataatcatcacttgaacctagccctcatagttttaatgaagcaaataagtaatttaataattaattcacttgccttgcagttagaatataacattccagaaaggaaaatttcattgagttttgcccccaccaccagagcacgctcctgcattacttcctgtgtattaagaagcaaatgttgaataaattgtaaattattattagatcatcatagtacccatattcaattagacatccagaaatataaaatcaagtaatttgaatacctaatagttgcatattaacatcatcgtcctcaaccgtatcagttagaattgaatagggatcaccaaaacctaaaacatcagaattccaaagttcaacataaataagtttatggcccataatataagtagcaatgaacaaggtaggctccataccatctgctcgcatctaatcttgaaggcaaaccaatgcctccacagttccattagccagcctactcctatagtcactaatgattctagatccagtagaaaatgcagaatctgatgcaactgaagatgcagggacagcaagcaaatcaagcgccatgcgtgataatattggatatttgcatgagtttaccctccaccactggagtatgtcaaaatcatcatcagggaaatcattttcttgaggaatatcttcgagatagctagttaactcagtctttctttactcttgctttgatcatgaagatattgcctccagtcagcaaattggctgccaccaacattcactccactagttgatgcttcttgagaattgattgcgcttggaccaccaatttgtgaagaatattcaacaaaccaactgcggactatcctcttaattctagacagatatccatttggaccagttgccttatctccaaaacctgctttcagcctaaactcaaggaatttcaacttaaatctgggataaaaaataacaggaacacaaatctgcaggaactgcagatcccaatatttctgaaattttgtatccattttagaaaccatgctagcgacaagaacatcctcactgttggactcatttagaagcatcaccttcactttccaaaattcatgaaagtagcgagaaacagtgggatatgatgtcccggaaaccacaacagttgcatcatagaagatcttgagatgtttgcaaagaacttctgcattgtcccaatcaaaaaatagtggagcatcttgaaagtttggatcaaaccgatccaatgaatcaaaagccctcctgaataataaggatgaggaaagcatcaaataggtggaattccaacgagtggacacatcaagtgaaggacgcttctcttcaacaattccgacttgtgcaatgatttcttcaaatttttgctcacatgcttctgatgcttttatatactttacactttcccttatcctagatatggcaccactgatagtactcaatccatcttgaacaataagattaaggatgtgagctgcgcaccggaaatgaaatagctcccctttgcaaggcatggcaagcttacccaagagatttcctttcaattccacaaccatagaatcattaacagatgcattgtctactgtaatactgaacaacttactttctatctgccaatcctgaatacactttagaatttcattgaagagagctatactatcatgtgggtacgcacttgagtgaatcttatgatcctcttttgaatattccattcattgtcaatgaagtgacaagttatacacatgtaacctaggttttgattagatgaccacatgtcagccgccagtgaaacccgagaatttgttttcctcagtacctcaaacaaagctaacttttgttcttgataggcagccaagcaatcaccctttatagtaattctggaaagcaccctaaagtacgggttcaagcttgcacaaaatcttctaaaaccagggtgttcaacaaaactgaaaggaagttct

SEQ ID NO: 83672 - DNA, 1412 bp, Oryza sativa
aatttctgctgaaactgagatgaaaattttcttatgaaactgaaccctaattttctgttgaaactgaactaaaaatctctacagaaactgaactaaacttctactagtaaagattcctgatgaaagtgaactaaaaacttctgctgaaactgaattatcttagctacatgaataaacaggggctaaatgaccaaatctccaaattcagaattagaattgcaggtgcacaaacctactaaaactaaccacagaatgtaagtttaatttgtttgggtggaagataaactacagaattatatatgcaatacatcaagagtaaagaactaaccagaacgatgagtcacaacatgaggtgttgattgagttgactcccttggctgagtttcaacatccagctcaattgggatagcagacggacttgatacgaaccttgccactggagacatagatctagctcttggagactctgcacttggggacatctgaccagcaacttgtgatctctccatgatgacttcattttgggaaataatttgtcgcactcctggagacctgactattggcaatgcaataggtgatcgtcttcgctttgctgttggaggattcgatgctgctaactttcgttttgtagccaataactgtgttgacgatgataggcctcccgaagagccctctgcaatgacctctttgatatgtcctccttgcggaacttcagctaatgatgtcgacatgggagaaaaccaaagtactgcatgtagaacaagatggacaaaattttaaataataaattaccaaaatacttgcataatatatgaacctcagcccatccactcggaaatcaaaaacttcatgacaaactagaatgtgccaaactgaagaccgattataaactaaaagatatgccaaactgtgcgctagtactccctccgtcccaaattataaggccaatatttttttacacggtcttcaatgacatactttgaccattaatttattttatgttatgttcccaacaaatatgaaattagcttcacataaaagtactttaaaagatgaatcttgtaatataacatgcataatacttaacatatatatggttagtacgattattagtcaaaagttaccgagtttgattttccttaaaaagatggcgccctataatttgggacggagggagtaatatttaggacttcacaaaactgaaccgtgcaagcatatatgactacaaaactgaattcattcttcacagactaatgcaatgagtaagaaccaaaaattaacataaccaatagtctcaactcctcaagataaaatcatgtaacatttgcagccaaaacactaatcaaaacacaagaaaaggcaaagactgatacgctctgttaagctagcagcttgaaatgagatacagatac

SEQ ID NO: 83673 - DNA, 1707 bp, Oryza sativa
ttgatgcaatattccttctgatgaaagaaagctactaaattcattgtttatatactcccctccattatcagttctaataaactggacccgagcattaaaatgatttttaatgtatgcatagaaatttagaaaacatttaagcacctcatccttatgtctcataagatataaccatgtcatgcgagagtagcaatcaataaagttaacaaaatacttcattccactcatagagaccacaggtgaagtccaaacatctgagtgaattagcataaatggtaacatactccggagtcctctactcacatatgatgttcttgtatgttttccatactcacatgcatcacatactaacttatgtttatccactctacttagttctgctgggaacatcttactcatagtttcaaaagatatgtgccccagtcgacaatgcaaaagtaataccttagcctcttcttcacttgtagaagccatcaatgcaagacatacatcttcacttgtcgcctttcgatccaaataccaaagtccatcacgcctgacgtcaatcccaagtttcttccctgtttccctctcctgaattaaacaattctcacgatcaagggagacccgacaattcatatgatcaacaagagaacttatcgaaaccaaattcactggaaaagaagggacatataacactgatgataaagtgattgaaggagtacactgtactgtaccctctcccttaactgggcatgatgtcccatcagcagtttgaattgtttcttttcgtgtaaatgggtatggtttatatgatgcaaattctccacacatacccgtgacatgtctagatgcacccgagtcaagtatccaatttgaatgagaactattgatagacataaatgtttggtttgagttacctgaagaagaatgaacaagattggcaacatcaacatttgtagatccagaacaacccttttcaagagtgaccacattagctctgtgatcacttttatattcatagcctctacctctattacctctacctgcataacctcttccacctcttgctccacccctatcaccaaatcttcctctcccataactaggcttgcgaggagcgcggcaatcacgtataaggtgccccatttcaccacaattgaagcactccctggtctctttactttgtgcaactacataggtggggcttggtgaagatggtgtggcactaggcaatactttcttcttaagctcctcctgtgccatagctgcaatagcctcatccaaggtagtaagggtggtttgatgaaacattgcatcccttcttccttcaaactccgaatttaagcccttcaagaactcaatgacccttctacgctcaatccattttctcatttttgctatacaatcagggtgctctaacccaagaggatcataatgatccaaatcagaccacaaatgcttcaattcagcaacatattctgcaatagaacgctccccctgtctcaaaacacttatcttctcctgtgcctccaccattaacatcacatttccttctcctgagtagagattagtaagagttttccacatctcacttgcactagagatggtctcaacagttgtagcaatagcagggataagtgaggttaacaaccatgctactactaacgagttggtagtcctccaagtcttccattcaacacttgatatgttctcaggctcctttac

SEQ ID NO: 83674 - DNA, 722 bp, Oryza sativa
cagaagatattatgcccatgtcgtaagtgtttgaatcggttacatcaatataaaggacgtgtggaggatgacttacttatgtacgggatgtctaacacatacactcggtggatacatcatggagaaccattggtcattgtcactggaaatgttgagcatttgaatgaagatattggctgcaatgttgagcatttgaatgaagatgttagctgcaatgttgaatttgagacgaatgagcctccggatgacccaaagatgatcaaatgtaccgtatggtacaggatctgtacccagatcaaaatcatggaccaagaacaaagtcaaagtttgccaccatattagaagagatgaaacaggtgctacaccccggtggtccctatactaggttttcttttgtggtgaagttgctccacatcaagtcattttacagaatcagcaatgttgcattcagtgctttttttgaccttttaagttcagcatttccaaattgttctctccctgcatcctatgctgaagcgaagaattttattcgtgcattaggacttggatatgagtcaatacatgtgtgtccgaataactgtgttcttttccgaaaggagttggctaaaaaggatgcatgcccaatatgtggtgcttcaagatggaaggatgcagatagccgaaggaagattccagaaaaggttctaaggcatttcctttgattccaaggttgaaaaggatgt

SEQ ID NO: 83675 - DNA, 670 bp, Oryza sativa
ttaaatgggcggcaatgtcgggttgggagaggggaaccggcattggacggtcaagccggcgagctggcgctccggctagcggccaaaacggcgacaggaggggacgccggcgagaggggaaaaggggaaaagagggagagaaaaggggagctcgccccttgcctctttgggaaaaaggaggaggggagcgggagcgtcgcggcagagggaggagggctctgcctccgtcccttggcggcttgcgcgcggggaggcggggccgaggtgatgacgacggccatgacggcggggcggtttggagcggcgcgacgacacgagcgacaggcgctgacgacggcggcgaccaggcggtcggccaccacggcacgcgcgcgcgggaaacaacgggcggcgcggcggatttgagcggcgcggctgatttgagcggcccggcttgggcacgcacgctggcttgcggggccgggcggctgcgcggctgcaggcgcggcagggcagcggggccgggcggcacggacggcgcagacggcgcggctctcgtgcacgcgcgcgcggcgcgcgggcggagcttaaggggaggcgctgggcgcgtttttcacgcacgcgcgcgcggcgcgcggtcggagcggagggggagggagagagaaagacccagcgcgcgggggagggaggg

SEQ ID NO: 83676 - DNA, 634 bp, Oryza sativa
aacgagcttttctcacctccctacgtgctatttgggagcaacgcggtgctgtagggcgatatgacaccgttcctcccagggtttcccaagtactacctcaagctcgaagggatctcctatggaattgttcgtcttgacatattcggcagcaatgccgctgccgccgaccaatatcatcagcaggcacaattttgtcgtggaccttaccttccagatgctcagttctatgccatgtcagtcgagtcggcaacatttccgctcatgctgccgagtcgcgcatacgagctgcttgaaaaggaatttgagcaagacaatcctcttcttatcaagtctcgcctccaacccatgaacacttgctacaaaggcagtgtcgacgatattgctgacaatgccactataacgctgcatttccatggtggcattgatttgcagttgtccaggaatgccacctttatggagatcacctccatgaatggcgaccaagaagagcgctatgtgtgccttatcgttcacaagactgtggatgggacagctgtactgggcttatcaccccaacttgaccacaacataaggatttgatctggagaacaagcagatctcaatttatcgcaagatatgttagtttgtcccctta

SEQ ID NO: 83677 - DNA, 618 bp, Oryza sativa
gagtaccacatagtactcaacaagtccattggtacctcccaaactgcagtcatggctcgcgtaagcattcggggtagaacacctttagaaagggatcgccaatacactggttatggttgggatagtaagtctgctatgcaaaactgtgcttatgttgctattacccaccttcgctgtgaattatctgagtggcaggaatgaagtcttgtgattttttctctggaagcttcactttctctattgccattctcacttacatatacatgggatgggccctcttcaatagatgggccagcacacaagacacacacacataactagtctatttacagcccaacactccccctcaagatgggtgatagatatctatcatacccatcttgtcacatgaacaattacactctttaacacctaagccctttgttaaacaatcagcaacttgtccaccagacgttacaaatcctaattccaacactccctcgtctagtttttccttgataaagaaacgatctatttccacatgctttgttctatcatattggactggattattagcaatgttaatagctgacttattatcacacaatagcttcatgggagtgttctccaaaattttca

SEQ ID NO: 83678 - DNA, 1249 bp, Oryza sativa
ccgtttagtagtttgggaagcgtgctaacggaaaatgaggaagttgaagtttatagttggagtatagaacagggcctaattcttggacatattgctactgtgtaattggtactatttgattctgagagaaaattaacaatatgccaccctattggatgtccttataaagatgccactccatagagcataccccttaatctgtttagaggttttttgacagaaatgacacgcgaaatgacaaaagtacccctagctcctttttgcaatgttcgggtcagatttctccctcaaattacagcagcatcaaatacaaatcagttactaccacacagcataaattgcaaatcagttaccacctcgtttagcacacagaagtccaccatacaaataaattgtgcatttagcacacaatagtaaagcatttgcagcacacatcagtatagcatttgcagcccatacaccatagcacgatctgtgctccctcaaattgcagcgcacacaacagtaagcatttgcagcacataaacaaataaattgcagcaagcacacagcagcacagaggtctccagcagcacatataggcatagtattgcagcacatagcacatagcattccagcacatagcacatagcatattggtacatgaagcatcaaagagacccaaaagaaatacagttcacaagcctaacaaattcagtagttcagtagcttgacaaatacattacagtagttcacatttacaactaaaatacattaggttgacttcattttcttgggagtcattttttcttggatggtcctgcagaagtactagccatctctctcggctctctagccccttccactccagaagtactggtcactcccaaaagcattgcaagtcgcctatgcatgtatacccaaaagccaagttacacacacaattgatttgaagcatgcacagcaaggagaataattctaacttgtcatttgaccatcaacttacctccttgtaaccattccgggctttcttgcattattgtagcttcattggttgttctttgtggtgtggaaggttcaggtggaaggttctttttgttgtttttcctaggcttccttttcctgcatatatttatacatataggatgaagtaccacaaatttaaaaggatgtaaagtgaaaaaaacagaaatattaaaaccttttttttggaccattcagtgggcaattaaaggtagcttgcctatgacctttttcaccacattttttg

SEQ ID NO: 83679 - DNA, 1529 bp, Oryza sativa
agatctgagctgaagtgatcatgttcataaattccaaggccaaattccagtgaataccaatgtgttgccagacattgttgtgctaatggacaggagaaaaacaaatgtgccatgctttctgtggtcatggaggttcacatcaaacagtttgtgccatcttatatgttgaattgctttttatgtaacatttcctttgtgttgagtcgattcattagcatgagccaaagaaaaactttaagcttcattgtgcatttgctttccagagtattgatagatgcctggcaacttgaagatgttcaaaaaacattgagtaaactttcttgggttggtattgatctgagttccataaacatgaccatttgtcaggctaattgttaatctgtaagctttgcaatctgtcatttaaataatgtcattagtatattccaaagcatttatagatatatctttcccttcctctattatgggaatttgaatgcttgttttgtgaaaaagataatcaggacttaattatgagagtagcaatataatttgtcacactttctagtttagtgtgaaatttactgtaatgaaaagttaatttgaaatggtacctataatttaattttatttatatcctctagtcatcaattaggaacttaactaacatatatatactccgtacataacattaacttttagtgccttgggccaaaataaactacaacaatatttttttttatttgtattaccctatatttcctctcttttttgaaccagtacacattgctgcctcttacagtatatgaggaacactcctctttgagtctctagctcctcagcctcattgtctagcacttgagatatcactagttcttactgaaaagctgagccaaaccaaaccagggaaatcaattcatttttattcaaactgaataattttaattctaaaataataaaatgggaatgccagacaatttcgatatatccaagacatcctaaaagcgtctttttttcacacttcatatatttttcgacttggtttttattttttttaagaactttgggcttgtattctagaggatgatttatgtcctagggatggaaaaggaacccatgcatcctgacccttgtcactacatccaaacgacacactgatatttgtgtagactttatggatctctagcaagatgcgacgtgtatgttatagaaatactatacatgaataatgtggggaggtttaaatatatgtgaatttattatttgcaaaccgctagtggtgcaatctcataaaacctttgggaataaatttagctctatttgtatctggggactagtccctgtcacatcggatatttgaatactaattagaagtattaaacgtaggctaatgacaaaactcattccataacatggactaattcgcaagatgaatctattgagcctaattaatctatgattagcatatgtgatgctatagtaaacatgtactaattatggattaattatgtttaaaatttttctcacaaattagctctcatttatgtaat

SEQ ID NO: 83680 - DNA, 964 bp, Oryza sativa
tcatcggtttttctttttcccgattttataatagattaaatcttcggacaatcataactaaataaccgtagatccgttttaggtggttcaagttgttaattttttctaaaatcaagatttacatgttaaaaatatccacatgtactgtttatgcttgtttttgtactgttttgttgatttttgtttaattgctttagtttctgacgttccggaggagagcgtttcctttgaggaaggttccgaagcgtttgcggaagcccaaggcaagtcacacagatcccaaacaaccctttgagcatgttgaacccgtttaaagctattattttatttcaactatgcattgttttcgaatgtcatcgggtggtgaacctttcccaattaaataatggccgaagatgactttattttcctatgggttataatttgattagcatgaaccttatatattggattggttcagctaaatgctatatgtaagtttgcttagccatgcctagaaacatagctaattaaagggattaattataaactatgttatattaatgttttaattatggttacattaaatggtagctcacgatggttaatcgtgtgatgttaattaattgataattaaaacctggttaaggtgggttgtgagcatatggttttgatggttgtgctcatgacaattaaggaccggttcgcgagctactgttgtgaaacatttatcgtgccaaccacaagccagcgtgggcaacggctttatcttttgtatagcgtgattcattatagtgcgtcagactgagaagtggcgagaagtccacgggggtcgctggggagtccatgccttgtttataaggggggtgattatgatccaggaaaggtgcgctgtaatgggttatgttgtgcaaggggtattgtcacaactcctttccgaggtaccgtggtggtattgaggcccatgctgacatgatgtggggtt

SEQ ID NO: 83681 - DNA, 1342 bp, Oryza sativa
ctccaaacctttgcaacagatggctgacaatgagaaaggcaataaggtcagaagtcaggacgttggtacctcaagctcccgagtgaacgaagcaccagacaccagttgtgtgacactggtccaacacctgattaaccagaaccgattgcttatagagatactgcagcagcatcagacgccaattctgaacctgagtcagatacaacctcaagtgcagttggaggcagtccaagcacccacaccacaagtcagcatgccgccagcatcccgaaggacccatggtgacgtgccacatgttgactcaaaagaagcaagtatcatttgttttatgtgtgatgagcaagggcactatgcaagggagtgtcctcagcagaaaagagaaacaccaatgcgaaccgaagatgaagtccgtaagatgatcattaccagcacagaatggcctccaccaggaatgacaaaacgtcagagaagaaataccttccgaggtgcaccacagttgacagagcatcttttagctaatggaggtagagtgtctgatagtgaagattcagatcaagtctcctcagatgatgaagacgagaagtctccccaaggtttcaaccaggataaaatggaacgtaaggcatgctctcgttgtggagaaatcggtcatgttgccagctcgtgtgccactacatgcattcattgtgaggaagaccatccacccgacaggtgtccaacgagcaggatcacttgtttcttttgtgaaggaactgatcatgtaccaaaagattgtcaattcagttttctgttgacgaagaagatggccaaccaacctgccagttccaacggagagaagcatcaaggccacacaaatcctccccaagattacagtttcagcctaactccagtgccaggacagaggaatcaaaatgagaaaagaaaatgccgagtccgggaagatatctgttgcttcaattgtcaaggaatgggtcatttcgccgacaagtgcccaaaaccgagaaacatagctgccagcacgtcagtccacgcaactccctgcaatcagaagcttgctcctcagcgaattgtcatccatgcatcccgaagcagtcctatagcccgcggtgcaacagctccaactccagctagtgcattaccacaaggtgtcaatgctcaatttcagccgcagccaccagttgacaagacagaggccagtatcggcattgtacctttggatgttccagcacagcagccaagaaatcaagtacaagatgaagaacccgagcgtaagaaattattgtcggttacaactgtagtacctgttaaggaaacagacatgccaatcgccaagtggtcactg

SEQ ID NO: 83682 - DNA, 1107 bp, Oryza sativa
attttatgtctggttagttgctaaatgaatgaattttatttctggattttgtgatgcttgtggccttagcagcaccagttgaaggagatgcaatgcgggatgagttggtggtgatgatggggctggcgcgggagttgacggccatgcagcgagctcgagcaatgacttgatgacatcatcgttgcaatgcttaatagcgtagctcaatggcggccctcgctcgcctaatatcacgcccagaaattcacgagtaattttcgaactaatttgtacattaaatccttgtccaggaatcagcccaggtacacaaactgacaatttaatatacagattcatcaaaataactaaaacgataaatacttacataaaaggcacttagtcctcatcacgaagaaaactgcaacggaaaacaaaatctagcgaagcttcagctccactcccacaggcagctcaactgggatctaagccaaaggtcttctccttctggatcctttttcttcaactgagatttgatgattattgcaaggtgagtaaatgacatactccgcaagccacacagcaagtatgcaagtgcataggaataccaaaggatggcataatatagggttcatttgcgaaagcagcatttagcaaagatttaagagtagtaaaactgtagaataattaatcatcaatattaatcaatcactgaacagcacacccaatgctgcacaggcccaaccaaacctgaacaaccaactccggtcgtacagatcaaacctccaaaccaggaattagccattccaaaccaggagccaaattaactttcacattattatcattgatgagtagtgtgggactaatcacgaaaaatattgttagacccgcccataaccacgggcacggctattcgaatagttttactctggccagaggtgtaccactgtacccacaagacataacctcaacatcatgtctaccatgcgtcgccatactggaaagtacccgaatagaggctgtgacaatactccacacaacacaactcaccacagtgcaccgttcctgtatcataatcaccccctcaataaccagaggcatggactccccagcgacccccacggacttttc

SEQ ID NO: 83683 - DNA, 628 bp, Oryza sativa
tcctgcagccccgcgcgcgaggaggaggccgatgggccgcgggggagaggagagagagggagggaggtgggccgagccggcccaaaaggggatgggggaaaaagacttttagggtttttctttttataaaaccactttaactttgtttatttcttcttatttattatttgtgctctgaaaattccactaaatttatttacgcattttaggcttttaggaaatatacaaaaatcctccaagccttatttgacttttaaatttgcacattttaattgttggaggctttcacatggattttacttattctttgcataatttcgaggatgtattttagagtcgttttgggacgtgacagttattgtaggaggactcggcataggggagactcttatcccaggtcttcccgaaatgtaggacacatgcgcgaagcatatcttctaggatctgatttagacgctcggtctgtccatctgtctgcgggtgatacgcggtgctgaaatttaatgggatacccagctcatcttggagcttcttccaaaagtgagaggtgaattggcttcccctatcagatgcaattttcttaggaacgccatggagactcacgatcctagcgaagtagagctcggct

SEQ ID NO: 83684 - DNA, 1491 bp, Oryza sativa
accgaaccattctggccggtgttgaaagccggccaatgttcaggcgaaattcctgatccttacaagcaaatgaaatatcaatatggcaccgacgtttctggtgcttcaatcaacaacgtgcttgtgtggtgatgaatgctcaagaagctatcaatcatcagtgatcactaaattgtccacgtttatgtcctctttctgttgtctttactttggtcacatcaccattttgcaaacagtagatactgctcttccatatataagcttgtcagttgtcacacacgcacaataagaaagctgacatgagagaaagcaaattaggaaggaattaagacacatgtgaagaggcttatatatgagattaactgaattctaatttgaaaagagatatgctgcgctaactgttactctatgcattcatcaatataacgaattttgggtttcaattttatccacaaattataagaaattcgaaaatactattttacttaaatttcacatgagcttatctccaaccacctcccatttgatgagggggtatcctatttttttcccttcaatattaatcctcaaaaaatctagaatagattatatttatgaactgagagagtatatggtattttacttgctgtactaatataattttttataaaatataagtgaatcatcttatcaatttatatgcaccacttttttttaagatagtggatttaaaaccgggcctctaagtctaagcacggattttcacggtcagtgtaccacaatcttatatatgtactcccttcgttttttaatagatgacaccgttgactttttctcacatgtttgaccattcgtcttattcaaaaaattttattcaaatgtataagatataaatcacacttaaagtaccatgagtgataaacaactcataacaaaataaattataattacgtaaattttttaataagacgaacggtcaaatatgtgagaaaaaatcaacggcgtcatctattgaaaaatggaggtagtattaatttatacgtaccacttcatatgttcatgagtgcatattttcatgggatactgtatatagcagcatgtcttttttttttactggcaagtgcagactttcatctgtagccagtgaaaaggatcaccgacatcaacacatgcatacaaccatatattgatatatacaattgagatcctctgcagtactgcatgctctgctcaatgcctgaatgcaactttcatttatagccagtgaataaggatgatgttgccatcttccacttgaactccatctagtctaggacgtctaggagtatataaactagctaggtgatgactaatccaatcaaggattctgcagcttccacatacatcagttcagatatatagcatcaaccaagtgtatccttggagcgtcttagccatccattttttattttccatatgaattgaactttttgcattggtgttcatcatgggctctgaagatttctgccgtgt

SEQ ID NO: 83685 - DNA, 948 bp, Oryza sativa
cagtgtggtgaacatataaccatttttgtttgctaaaagaatagattcatctcattctatgaaacttctttttagataatgaaaagattctcagccttagcttcaaacaagctacaaccacttattactgaatggggaacataaaaaaaaatcaaaagactagacaataactaatgatatcaacacaaaatatagaagacatttattcaaatttatttgtaaatctccatccgatgttggcaaatatctgcatgaccattatttctagcttctggtacgtagtatatattagttccttgtcctcatcacacctttacacctttatagttgtggtcaaaattggagcagtacattatcctgaatagtacctgtatataagatttcattagggatttgttaaaaaccatatcatttctacttagccaaagaacccgacatatagtagatgctactagtagaatgtgtttctttgttttttagtcaaagtgtacaagccaattcccagaaacatgagaagtactatttggaggtttcaaaccaaaagaaatatgtaatgatctccacaggaatctagcaaacaatggcactcaaaaaaataaatgatgtatagtttcactcttcattaaaaaacaacatctcatattgtcattccaattcattcattattgctaaattatccttcgttaatattactcctttgaactgataccacataaaaatctttattttaagagatatttttaatttccataaagttttgttgcaacggtacaagagcttggtaggtgtgtgtgatttagtataagaacttgaaaaatgagtacacgggtacatgaacttgacaatcaagtgcattttagtcaaaaacactaatatatacctttgattaattctggtattataatagatcattggctcatggattcaattttgtgttttaccatgttc

SEQ ID NO: 83686 - DNA, 715 bp, Oryza sativa
ttcctgcagcccgctcgattgaacgatcagcggcttggatatcgccaccaattgactgatcgaaagcgtccgcttcatggcttggacagcagccgccgccgacaagcaccacttcagcagctggcaccgtcgccgcgctggacactttgcttggcgcgctacgcgccacatcaatcgattccctggccgcttccgaatcgcaagcctcgcactgctcgccgagcagatcgatccagccttcgtcggagtcccaatccggcaaggccgaaacagggcacgccaatgacttgatcctatcgcagaggctctctgttatctcgtcgacctcctcctcgtcgtcggtctccgactcccagaatgcggcgtccagtgtgctcttcggagagacccacctgggcttcggctgcgcggccttgacttcgtggcaggcgaatgccacgaacggatgctccaagagctgtgccgcggtgctccggtcgccggcgtttctcgcaaaacacatggccaagaagtccttcgcctctgcggacagccaaaccggcacctccggcacggcgtccgtgtacccaatccggtggacggcggcgaggacgtcgtccatgtcgctccacggcgcgcgcccggtggccatctcgatgaccgtgcagccaagagcccaaacgtctgccgctggcccctgctcctccccgcgggcaacctccggcgccatgaacgc

SEQ ID NO: 83687 - DNA, 500 bp, Oryza sativa
cgagctaacgctgaaactagagcatccttgtgcctgaacttcctcagcaacttatcgtgttcagcaaccttcaccttcttaggcttctcaatcacaaggtcaccttccttagccttcgcattttgtccacggaggaagtacctatagttggacggtgccaaccgccgcttctccggcttggttggtgcccaatcaagctcaccaccaacacccttaccctcttcctcgtcctcccctgtcgacttctttttcctcctacccatataaattgtgccctttgaagatccagcaaccagcactgtcccacacggcgagcacgccaaggaaagcaattccttaggatatcgcatcgagtgcgtgagcttaagctcgccataatcaaagctcttgacataaccatcactccccgcgctaagcagccgcgtctcggccgtgttggtcatcttggcgagcgcgagggccatcaccgtcttgacatggctctccaccgagtggagaag

SEQ ID NO: 83688 - DNA, 649 bp, Oryza sativa
ggcgaattcgagctcggtacccggggatcatatataactgcgcctgtgggaagatgtacttaacactattgtgagcggggtatgcttgacatatgtcaccggacaaatagagcctgccgatctgaacagcatgaaccacggctgccaatgcaagatcatgggtgggataatagacttcatgaggcctgagctgcctggatgcataggccacaacctttcttttttgcattaggacacatactaagccttgattcgatgcattacacaaaatatttaaatcttttgccatctctggcaaggagagaactggggctatgaccaaccttttcttcatttcttgaaagctgactacactggctgctgaccattgaagagtcttttgcttctttaacagctctgtcataagtctggatagcttatataatcctccaatgaatacttccatgatatgcaactaagccaatgaagctgaaaatctatggcacattcttgggcgggatccaagctagtgcagttattaacttgcttgtatctacctcgacaccgttggacgagatcacgtattcaaggaatgcttctcgggctaaccagaattctcatttatagaatttagagaatggttgaagatccctgaactattacattatta

SEQ ID NO: 83689 - DNA, 753 bp, Oryza sativa
aagaaatgcccattcactggaactgtttctatcagaggtagaattattgctggaacatgccacagtgccaagatgaataggacaatcatcgtacgcagaaactacctccattttgtgaagaaatatcagcggtaagtaaagcaatggaggactatgaacttacatttcttatctgtgatggcatcttatttagaaggtgaacttgttcatcttgtagatatgaaaagaggcactccaacattccagctcacatttctccatgcttccgtgttaaggaaggtgaccatgtcatcattggccagtgcaggtaatgttctctagctgatgctgtacttagtacatgttttctgttttgttctgcatacctgaatattgggattacatgacttgaaagttccactgaattatctgttttctttaaaatgttcttgaaaattaagaaactaatttatattttcatctgctctgtcattcctcttgtattacattgttgatgccataactcagaaccaagcatcatattgttttggatgaggctgttctattgtcttaaccaggttaaggtcctgtttggcacagctccagctccagctccacccctcctggagcttgagctcagccaaatagtttcagctccaccaaaactgggagtggagttgggtggagctctctcacagaatatactagagttgtggagctgggtttaggtagctccacaactccactccagactcaactcctggagcaatattt

SEQ ID NO: 83690 - DNA, 2077 bp, Oryza sativa
ctatacccatgactatgagtacaccttagagatttcatctctacatgtaatgtttcttggagttttgcaaagctacactctctcattcgagaaagttgtggtttcctgcctgcagagactaggcaaggttgatgagcactgaacagctgtgtttatattcttctacactatatcaaatgattgttgcatgggcaaattcatgcgtgtatcctttgttagttctgcgtaatgtttatcctttgtagtaatgccaggtatttgtgcacagtattatctctatgccatataactaactgatcatggtttctgaaaattcattttagttgctcgaaggagctcttgatgcttctggagatgatttggattcagcaataaagagtttaaacaatctgcgcttggagtctacagaggctatcttatcagctactggttgcaaatctgaaaatgggctccccacagcagtttatccgtctgttgaaggttcagcttttaaccaaaagctttttatttctaggatctgtgcatataattctcatgcactagtacttcttgcttttgtcacacttaaattttagacaccgcagtaccaatctatcataatgatccatgtgggtcatgatatactctttcaaattgtctatcaatattattcagagatctctagccttgctggtttctttgatgtctgttcttatgtttatattctgcaacagtttctttgatgtctgtcttatgtttatattctgcaacgtaatgcgctgttcaattaaagacactgcacacgattcagtcaattatgttatatggagtgtgcatgattaactagacataaattctgatgactgcatccacatatcttctatcttccattcttttgtattcaccatatttagaatagttgtgtattccttctcagtgtgtccccaagctgtcaagttctcgcgttgcattttctggctatatactacccaagttctttgtattttttctaccaaaatactgccaggctttgtccagcaatgttaaactatattattaaaagaataaaatatttacagaacgattacaaggaaagagaaaggaaaacccaagccaattctaaactatcgtttcctctcacaacacatgaatcggttgcatctcactcccttgtgcaaatgtagcatactgtatatatgacaacagcaactattttgcatatcttggcaggtattgttaataatggtggtgtgagtacagctaatgaacacccagctgctgcagatagttgccagacaggtaataatggttctgaatgggttgagctatttgtcagagagatgacaaatgcatctgacatgggcgatgcgcgtgctcgcgcctcaagagctttagaagttttggagaagtcaatcgtggagcgtacaggagctgatgcagcacaaaacttgcaaaaggtacacgtgtgtctatcttctctagggtgtaaaaaacatcgtagtgtttggtcagcaattcggcatgtagaaaacatgcatcaatgcatgatttaggagtaacaataacattgaatactttcatatttttctttctgtacaggaaaatatgatgcttaaggagcaattgaccgtcgtgctgcgagagaacgctgtcctcaagcgagcggtcgccattcaacatgagcgccaaaaggagttcgacgagaggagccaggaggttcagagtttgaagcaacttgttgtgcagtaccaggagcaactgaggaccctagaggtggcaaccacaatcctatctccttttgcaagtttctttctttttctgcctaacatacatactgatgaagaatctactggggtaaaaaatgctgcagataaacaactatgcgctgacgatgcatctgaagcaggctcagcagaacaactccatccccgggcacttcaatcctgacgtcttctaacttttgccgcaagacggtctgtccagaataataatctctgaagatgtcatgtgttgttggtgggaaatgaataataatctctgaagatgtcatgtgttgtgttgttggtgggaaattgcctactgcctctgcgataggaga

SEQ ID NO: 83691 - DNA, 600 bp, Oryza sativa
tgggccgccagcccatattcctccccctccccgctgggccggccgaaggccacggcccagccggccgcccgagcccccctcctctctcccagggtcaccgacaagtggggcccacctgtcgggtcctcccccaacctccagtcgccgccgcgcatcccgcaaccaccggcgccccctcgctcccgtgcctcccgggcaacgttgcccacatcgccgcccgcgcccgccttccccgcgcccactccctctctttcccgcccgcgcccgcgctcgagacgtccaggattcaatttttgaatcccgcctctctctcctctccccctctccccactccaccggcgaaatcgcggccatcccggccacgatcaacccttgcgagcctatataaagcacccccgctctcccctctctctttttctccattttcgccgagctctcatgtgccctctatcgccctagcgccgtcggcctcctcttcaccgctgtcgccgccgctccggtagccgctagccgccgtgccgagccgtgccggtgccgccgtcgggttcgcaagcccaagggccacgccgtctggcttttcggcaccgcttttcgccgcgg

SEQ ID NO: 83692 - DNA, 1211 bp, Oryza sativa
tttgtcagcgatgaacatcccatccaatgggtctgaatgggctgagctagttgtcaaggagatgtcctctgctctagatttggttgatgccaagaaccgagcctttaggttacttgacctattcgagaaatccactgcagcatgtatcagtccagttgaaatgcggaagatgcgcgaggtaacaaatactactccatccagttataataatgtcgtcttgaattatcaatatcttccagttatgaaagttatggaagcttgactgatcaacttgactgatacttccaggaacacaagatactgaagctgatgttaggaggccttctcgaacagaacggtgtcctgaagcgcgcatttcttaaacagcacaatcggctcaatgattatgaaaagaaaatgtcgcaggagcggtcgcagattatcgacacgtacgaaaaggagataaaggcgctacaggtttgtgcgtttatcacaacattcattaattttcagttcttttatgttatttctaatgcttgttctaacaagaatcttggttgttcatctcttatcttgcagcataggaattatgtcctgtcattacatcttgcccaagcgacgcaacacggcattatctccggccattgcaatccagacgtcttctaggtgatagtgctgctacaactgctaacttgtcatctacaccgcactgaagatactgagcttggaagatagcaagatactgaagctgcaagctgagaaagatcctattgtaatcagattatggcgcattttgatcttccgaaaactgtacttagacctcgtctatgtgaaccgaaatcgagtgaacaaaggacattttttatcttctgaattctgctagcaacctcgtgccatgcacagagtcctgtttgttatggaataagcatggcacaactgtagtggagaattgtttaatgctgtgtaaaatgacagaataatatatgtatgccctttgttttagctgccacaatgcttcttgatctgaatactaatcttctatagcatgatatactatagtccaatcgcaattcacatgctcatctttaaatacgatatcgtccgtaaacaattaacaatctgttccgagcatgtactgcatgtttaaatacaatatcgtccgtaaacaattaataatctgttcaaagcatctactgcatgttataaggtttatgcacaagcgaaattgcatc

SEQ ID NO: 83693 - DNA, 741 bp, Oryza sativa
ctgattaatattatttttaaaacaactttcatatagaaaacttttataaaaaatacaccgtttagcagtttgaaaaggagaaaagtgagttgggaaagaggggtaaacaacacagccttagtataggcatatggatttcagctaaggccttgtttagttcccaagaatttttggatttagttgtcacatcggatatacggacacacatttgaagtattaaacgtagtctaataataaaataaattacagattccgccagaaaactgcaaaacaaatttattaagcctaattaatccgccattagcaaatatttacggtagcaccatattgttaaatcatggcgtaattaggcttaaaagattcgtctcgcaatttacacgcaaactgtgtaattattttttttcttttgtctatatttaatactccatatatgtatccaaacattcgatgtgatgggtagaaagtttttgtttttgaaaactaaacagagcctaaacatgtgaaaattctaccttgaggtcagatgatgagatgagcccacatttaactcgcccgcggtggatgggattgccaaattaaccaagttggcctaaaaacatattacgaaacaaagctggtgaaagatctatggtgttaactaaatctgcgaggcagttcctatatgtagtaaaaaagaaaagttagtttttctatttagtgtttggtgatgtattatgaaagtacattgcatatagcttgtta

SEQ ID NO: 83694 - DNA, 569 bp, Oryza sativa
ctctttatttgattgcagattaaatcagcctataacaagaagggggcccgaaggcctcggaagaagaatgaaaagctattaagattggcggaggcctgggggctcactccgacgcgcctgggtagccggcctcgccgtcgctgtcgtccgcaccgtcgtcaccgcactcctcgttggagttgaaggcaaacgcgagccgaggggccgctccttattgtcggtcggttttcccttgctgatgcgcgcgatttgcgaccgccgggattctgcccgaagagagagagagagcagggaggagaggcccccgagccgaacggcggcccaaggcccccgacggccggagctggccctccgcctgcttgtccgacggtgccaggcgcccccgacccccaggatggccccgaggccactgcgggaaggccgcgcctgtcgccctctgaccccgaggtcgtcggcacagaagccgagtgcgccccgcgtggcctctcggatggagagcgccctggaaatgtggcccctgacgaagaagatcggccccgccgaaaggtgcagcggcccgtctacttcgt

SEQ ID NO: 83695 - DNA, 601 bp, Oryza sativa
gtaccacttctcaccgtttcactggcacaaccatcacgtgagtagagattttcgggtatcaattgggcataaaatttctagtgataagtgcttgacctaagctttcaaacagttccagcatgcaacactttgtactttcagcaacatcactcaagtattctatacaaaaagaaccattatcaattaatatagatataggatcgtcctatcactatcatttcctcataagcggcaatatcttcttcagttcattctgaaagagaaataagaagtatcaaaagatttgatgatatttttgtgtgataatccagctgattcatgtggccatggatttctctgtggttttgtaggtgggtggcggcgcaaagtgtgttctaccacttgtacaaccaagtgtcctacatgtcattggacgagatctcaccactgacattcagcatcggcaacaccatgaagcggatctccgtcattgtcgcctccatcatcatcttccacacgccggtccagcccatcaacgccctcggagccgccattgcgattctcggaactttcatctactctcaggtagattttccgcacatgttttaccaaatcacatttt

SEQ ID NO: 83696 - DNA, 607 bp, Oryza sativa
attttatgaaagttaattttcaagccagataaattctcaaacacaaataagatcaattttagattctttgcttgttgtaaatcttgctccaagaaaatgatagtatcatctgcatattgcaacatagacaaaccatcatatactaaatgagggattaccccattaagaaaatcactatctttagcccttttaattagcaaagctaacatatcagctactatgttaaagagaattggtgataaaggatccccttgtctaagacctttatgtgtttgaaagttgtcaccaatttgatccttagctttaataccagcatgtcccccttggataaaagaggatatccactcacaccatttgggagagaaacccttcatcctcaaagtctgttgaacaaatgaccattttatcttatcatatgctttctcaaaatcaatgttaaaaattactccactcatatttgtacgatgcaattcatgtaatgtctcatacaaaataaccacacctgcatgatgtttctcccaggaataaaagcaaagatggtggcataacatattttttgagaccctctagcgtgcacgtatgtgcgatgcgtgtagcataataaccc

SEQ ID NO: 83697 - DNA, 2420 bp, Oryza sativa
caggaatttcccagaaaaggaatcccccctgctccaccgaagcatgccttttcaagaataaattcaagcagggtgcttctagaagaggttagccgttatgtatattgattaatttttgctttgttcgatgtcaaatactacattcagttgtgcttagcctttttgaccggtggttcttgaaatgttttgtttgcagagaaggaacgctttggaggagtggatgcaaaagctactttctgacattgagttgtcgagaagtgcacctgttgctgcttttcttgagctggaagctgctgcacgctcatgtatgttccgcttgacatattctattgaagacactttttcctgattgtgcattgatccatttattaactaaaatttcttaacatttttagcaaatgtttaattacgctatttttctgaatgaaagattaccaagattggaatcagcgcccttctgaagtgggttcttcagcaaaaagtagtgcagattcttctccgcgtcctgatgaacatggttcaggtgttctctctgagtccagtcaaatgaattcagcctttgctcatggtaacggtccgacaggagcaactggtaatggtatgctgggagagtctatcttagatcagcccaatgagcgggctagtagcatgtcaaatcacaggaaaaagaaccatgtctttttggaacatggtgttaggaatggttccatagatacttataagggagtggtttccgaagaggatcacgattctaaccctggccatgccaggaaggactctgctgaaagtataggaagtgatttgagttctttgaggggcagtgaattatcggttcctggagttagtagttccctttgggatggtcctgtggatcttccaagtggaattgatggacatagccaaacagaacaatttacaggtttagatatgcagcttttatatgatatggatgcacaaatcatccttcctgctgatcaaaggccgaagttgactagacttttgatcagcatggacagaagacaggtgacagcaaaaactgatatggaggatctcatagcacgactaaatcaggaagtggctgtcaaagaatatcttgcgacaaaggttacgttttctacctgacattcatttgtgatgcctatggattatgcttaaacacatgatatgctttgttttatatgtcacgagtttaaaataaattgatttgtgtttttttgttcatactttattgatgtacgttgttcttgtgcttctctgctattctgtgcaggtcaaagatttggaggttgagttggaagctacgaagaaaaaagacaaagagattctacatcaggctgttttgaccgaaagagagaaaattacccaacttcaatgggataaggatgagctctacaggaagtactctgaaatggagtcaaacctgaagattgaacaagttggttttcctctttgtctcctctttgtcatcatggcttggtttcttactatccatcttacaagtattttcttacatttctttctacttaattgcagaatgagaaaactcgtgtgcagtcagagaaaacaactgctagcggtgaaaaagaaatgttactggaagagctagaaactaaacgaaaagaagttgagagtttgcagcaacatattggagaattcgaggcaaagtctaaagcagatataaaagttcttgttaaagaggtgaaatctcttcggaactcccaaaaagagatgaagaaagtgctgaatcagtatcatgaggagaagactgaattagaggtataaatgtaaatttaaagcttttctttctcgcagaactatgatagtatctataaattgtgtgaaattgttgctatggctggcctctcattgctcaaagccaggagagcataaccctttacaagttgcaaactagattttggttgtagctaagagaaagtggcttgtcaaagtcattagacaagtccccacaaaaaaaaaagtcattagacaagagtaagcctttgaaagcatgcaagccatcttgagtgtttgcttttccacttctaacttattaccctgatttctgcatctccaccacccatgcaacatgttgtccatttttggaatattatcatgaattgttgtacttgcctacttggtatctgacaagatgagcttaacagtcttcttttgatcaacaaacatatggaccttttcccttttttattatataaccagcacagccatctattctttatgtgattccttttgtcaaggccggctgaataaagatttctatctacacaagctagattcaacagcgatttctttatctatatataatcactcttggaggacaattgaattaatttaatgctacctgtttgtacaccacttaactaaagaaattgagagagagaatgaaggggtgaggtgttctt

SEQ ID NO: 83698 - DNA, 3637 bp, Oryza sativa
tgtataaccatattgcacgatgagcatactaagaagctaaagccataatgttgtggttgtagccatggctgccgccgttggtttgataattgtttgtaggcagggttgctagcttgctgattgctcaaatggcacataaagagtaaactctcgatttagttgatgtagtaagctctacatggattgatggatatgctttgaaccttttagattttcccctgtttgcaccaaaagagtaactcatatgcacttaacagactcatatgagtagtgttccgcttgacaaccaccaagccgaaataggtgctctgtgttatagctgttcacctaggctgccacttaggcgcttaacccacttggttaggcacttggcaccagcctgttgccagagcctagcaccaagggcagcaccagaatcgagatttatgtcggttattggtttaccctgataaatatttataggcaaatgcttgatttttttttatgatgatgtggaagctagaaattagctcaacatcaatcaggttgacagataacttctgggcagttgggaaatatgagctgaaattcctgattgataatcattagcctctcaacattttaacaatacaatagcctttttatgattggcatagtagtaagtaaagtttgcatgctaagacttgtgatttctctgtgctattagtaaacagctttcttcattttgtattatacaattattgggttaggggtaagtttatctaacttttttcgatacatggaaaattcagatttggaccatacttctgccagcctgttatcgctggacttggagaggacaatgagccatttatttgtaccatggactgcattggtgcaaagtatgtatcagttcaattgtgtttttgtttttattcaaattaatttcttttggatctattcatacacatctggatggttatccattgctcatgttctgcaatttactgcattgattaatatgcccgccttagtcttattccacatttagatggttaggtggggagttatctacatctttaatttataaatatgtttgtcatatctaacaaaggttacctcccaaatttctaaatcatcattaacaaaagaccccatgtgaatgaacaacgtgatttatgggttcaccattcttgtttctatcctgaattccatgacacccaaacacgattggctccgtctctgtcccagagaaatgtgtgcatgcttgacattggtaacttgctctatcagagatttgcttgattccttttttgttcctttctgaatttgatatattttttctatctgcttcatcatgtactgaaacaactttgatactattattccaatagcatgccacctgtttaagtttttggtctaagtccgtgtgcctgatatgtctgattaggcgtttgaacgcttgtttctcatattcttgtgagctgattgaggatgtttatttctgtgcagggaactagctaaggatttcgttgtatcggggacagcatcggagtctctatatggtgcttgtgagtccatgtacaaaccaaacatggtatgcatttgtttgtttgtatgatcacatttagcccgtgtaacattctttatgggataacatcatgggctatagcaatttcgcatttctgtttggatctgtataatatattataattctgttgcattgtactgtttagatttctaccactattttgaatgatagatgttacatgacaacatattatttttcttgacaaaggaacctgaagaactctttgagactatctcacaagctctgcagtcatcagttgatcgtgattgcctcagtggttggggaggctttgttctgcttgtgtaagttcacttcactaattcaagattggatgagtggcttcatttttcttctgttaaacagcttttgaattaaaatacgttatgcaccattattttatctaccgttctgcaataaattggtagaagttcatcagtaatgatttttttcccaatcaaatataattggagctcaaagtcctaccgcattccgcattttagttgtttcagcacttcatttgagcatcaatacgtttcttttacataatcttcttttgggttttcaggacaccaaccgaagtaaaagagtgtgtgatcaagggcaggatggactaaatttatcattgcgaagagttcttggaaccatttctgatgcctgctgttcctggtctctcagcattactatccgtgttgtatgtggattccgagggaaccttgtaatatcaaagatgttcattcacccgtagaagaaactgttgttttcttacttttctacgcttcctatgaatgaaaggacttctatttgttgcatgagatgtgcacttcttggcagtccttggccttgatgatgacgattatactgatcagtaagccggctactggttaattagctaagaatacgcgtatcgtggtgcaatgagctactcatactcacccttctcaggcatttgttcgttcaccgtttctatatcttggcaacactttttctgaaatggatgttagtgctttgtcgagtatggagccgacgatgtgaagtctattctgagtgcgagtcgttgcgactcagattttaagttacagtactaactacagttcatagcttgtagtgctcagagttcaatggtcttggctgctttacaaaaattggtaaaaaccgaggacgacttttggtcaattctatacaactaactaaaactgcttgtttttcacaaattggtctccaatgatttcatggaaatggagcgattttcgttcagtactgtaaaccctagtattgcaaaccctgttagtgcttccttcgttattttttactcaaactacaaaaaatacccatgcgttgcattgcaacgggtaagtgctattttaataataataataataatattatatatggtttgtgggaactcgcttggatccgtatttcatctcaagttagtatgcgagtttttttaaagagatttcttatacgactccttttgtattttcaaaatcaaacgagcttaaaatccaactcaaacacaacgaacttaaaaccgactcaaaacgtaccaaaatttttgcaaaaacaactctaatttttataatagtagagaagagatagagatatacatgttttttttgttattgtttcgagcatcaatacaatctcaaatatgtgtttggtcattgtttcctccaactatagatgtattgaaccccataattttttctacttagatattgtttagattctaacttttttcttcaaacttcgtgtgtgtttagttcacgttaaaattaaaagtttggttgaaattggaacaatgtgacggaaaagttggaagtttatatgtgtagaaaaaattagaagtttatatgtgtagaaaaaattgatgtgatggaaaagttgaaagtttgaagaaaaaatttggaactaaactccgccttataacttttcgccacatagaactttcgtacacacataaacctctaactcttccctcacatcgtttaatttctttgaactttaattttagtgtggaactaaacacagcctaatagtatgtactgaaccaagtcgtcactaagaagtgcataccattatctgtcg

SEQ ID NO: 83699 - DNA, 966 bp, Oryza sativa
atggctgttacggaatgtagcgaattctggatgaaatgtactttctaatattaattgatcaaatttgagtatggaggccctttgcttgtcgactaagtgacaacgtcatggctagggatgcactggtgtttttatatttggatctcaagccctcgtatctggttctccagctgaatgtgttgatgcgatgactgcagcttaccaatggatgactctgtcatcttttcgctggcttgaagaactctgcagagaagcagaggtaggatatgttgacatcaggtgcttaactgaaacccgaatagaatccatttattttgacttcaaactgatgttcagatctgacatttggtgcacaacatgcagttgggggttttgacgtttcttaagtttttttcattgaacttgatcagccaaataagctattttagacgtgattcatgacctgttagtctgaagcgaaagcaaaatcagattcaagaaatgcagatgtagaactatcccatcatatcgatcgagcacaatctggtcatgccattcccagacattcattcttgcacaaagcaaacttcactcaagaatgttagataatgcatgtacaaaatttttgcccaattaagatgaaaaggatatatgcttttctctgctgaactgcatattctgaatcaatcatccatggtcatcaatactcaaaaattttgttggtatatcagtcatgggaattacatttgattttttctccctttgcacgtaaactcacagtcggcataaattttatacggtcctcacctaatgtttgggggttagtattagagtgggcaaattcatacatgtgagtgttacctccatatgtatatctgatgtacacaagttcatactgagctggtattatccaatgtacacaaaataaaaaaccttaaatttttttgagttcttataatgaacttagtagatatgtacttacaaaat

SEQ ID NO: 83700 - DNA, 756 bp, Oryza sativa
gcaatcaacacatgtatacttttgttgccttatctctctctctcttcttaatttgttgcatcttacaacgaacgaataagcaacagttgcttcttgtatgtacaagtttcgacatcataacaatcaataaatccttgtcattaaccggacgacacggtaatatctcacacttgatgaccgactcctgcaagctaaacaaacttaaaaattttaaaaaaaaacctcacaaaaacaaaaccactcaaatcaattaattcgatcgtctaccgctgtatatatatgcttcttgtgtactctgctgtatcgaattatcatttggttcatcgatccatggagagaaatgttttcttgtgtgttcgatcgctagcttagctatggcgccgggcagcccatctcgtcgcgtgcctggatgaagacgatggcggcggcgtagtgcgcgagcgcgccggcgatgacgagcgcgtggaagatctggtggctgtggccgcacaggtcgaacatgccggggcgccaccgctccgggacgcgggtgaggtagaacgcggtgccggcgaggtaggacgccgccatggcgccctcgtacgccagcgtcacgttccggcggggctcgtgccagttgacggcgacggcgtgggcggcggggacgacgccggagaggcccatggcgacgaacagcagcgcgcggtgggcgcggtacctcgccgcgctcagcctgggcgacatgagcgcgtacacggtgccaccccggcggcggtg

SEQ ID NO: 83701 - DNA, 737 bp, Oryza sativa
caagcagaagagtttattccagagagatttgagaatgctggtattaatttcaaaggaacaaactttgagtatatgccatttggagcagggcgacgcatgtgtcctgggatggcgtttggtctagcaacgttagagctcgcacttgcgagtctcttgtaccattttgactggaagctacccgacggggtagagattgacatgaaggagcaaagtggggtcacaacacggcgagtacacgaccttatgcttgttcctatcatccgagtgccattaccagtgtagacgcacgtagctgctatctacgagttattgaaggggaaaatatatagtgcaaacctaaaaactagcataggatccaaaaatagacgtctaagatttgtctacatcacacggagtaaaattttcactccaaattttaaccatgagtaaaagttttactcatggtgatgtatatggataaatcccaaacatccattttttctattgtacggtaattttcaggtttgcactgtatatagagtttgcgctacatatttggatattccccctagtgaagcaccccaacatctttgggcactactgttcatataataagagtttgaacccaaacaattaattatttttggaaccagttcaattggctgtgcaacttacatgtgtaggccccattatgtatttgaatatatagttctatttgctattcatccttatcatttgtttatatatagttttattat

SEQ ID NO: 83702 - DNA, 1478 bp, Oryza sativa
ctaataaatatgacacataaatctgcaaatataacaataacaaaagatgaatagcacagagaaactgtatattaaaatacatatcggaatgtacaaatgtaattaattgcacagtgagttgaagtagttttgtaataatttaattgttaaggtttgaacataggtaaacattagtgaaccaatatatttggtcgctttatcaagaaataaaaaatcacaagctacttatctagcacctagctagctgcgcgagtctaacggtaacggcactcgaatcacagggacaagcaaaagatcatggagtcgccgtgtggtggcccccctctcctgcgtcatgtctaggtcaccgacttattttgtcagataacttccagtcaaagtgatataagagactcgctagtacgagctctaaattcactagaccaaatgccatcccagggcacatccgtcgtcccgctccaaacggcatatactcaaagttcatccctttgaaattgatatcaacatgctcaaatctctctagtataaactcttctgattggtcccagtacttaggatccctatttatagcccacatattcacgagcactattgttcctttaggcacatcgaaccctagcacttggcaagtagttcgacactctcgtggcagcagtggtggtcttggcgggtgcagccggagcgcctctttgatgaccaagtacatgtaactcaaattgcttaggttttcttctgtgactttgtgctgaccaatgaatactcgttggacctcatcttgtgctttttgcataactcttgggtttctcatgagtttagccataatccattgtagcgtcgtcgctgtcgtctcactgcccccattgaacaagtcctgtgtaccatgaagccaaattttcaggtaactacattttgtggaaaagccatggtaactttttgctaatttgcttggtaaccctgtaaaaaaattatggtgctgaaaaatatcattgtatcaaaaaacaaaattatagtatatatgtgtcattgacgtgtaggttcagtcctcacgcgttattcttactagcataacactactaagttacaacggatttcttttaataaaaatagctcattgtatatattttttgaagcccataacaaattatttttattatctaatatattatatatgattatgttaattttgctgttactttttaggtgcctattgagctagagctcttaggatttgtgggggttaggaaataagcaaaatctctcgtttgtgtgtcctacaaagtggcaggttattactagaaaaaaaatgctcgtacgttgcaacggataaagattatttttatcttattattattatatggtttagttaaggtgaaattcactgtgagaattcgtttcgatatatatttttctagaaaatcataagctgcaattagaaatctggtcatctcaaattagcatgcgagctttttaaaaagact

SEQ ID NO: 83703 - DNA, 1028 bp, Oryza sativa
cccgccttgtgctttccttcctatcctccatcaacagaatgtataaattttatgtagcactgtaaatatgcatgtttccttttaacatgcactaacatatgcatgacatgcattggccaggacatgtttgcaggtggaagtgaatcaacatcaacaacacttgaatgggccctgtcagagcttgtgaggaaccctcatgtgatgcaaaaggcacaagcagagatacgacatgctttgcaaggcaggactagggtaactgaagatgatttaattaatttaaagtacccaaagaacataatcaaggaaacactacggttacaccctgtagcacctctacttgtcccaaaagagtgtcaggagtcgtgtaaaatcctcggctatgatgttcctaagggaacaatcatgttcgtaaatgcatgggctatcggcagagaccctagatattggaacgatgcagaagtgtttatgccagagcgttttgagaaagttgcagttgatttcagaggcacaaactttgagttcaaaccatttggagcaggacggaggatgtgcccaggaataacatttgcaaatgcaacaatcgaaatggccctcactgctcttctataccacttcgattggcatctccctccaggtgtaacaccggatgggttggacatggaggaggaattcggcatgagcgtttcaaggaaaagggatctttatctacgaccgacactccatatgggacttgaaacaatatgatgaatacacgcgtgttgtcatggaaaatgttgataatagccgaatggtgtatgtacctagtagaaaaaaaatactttctgcaaattatagtacctatacttacaagatgtttgggaggtaggaactcctgagatattcagatattccagagctccgagtgcattagtatagaaattcatgcacgaacacaatatatataaggcgttgctgtcatgtacaagagctgtgttttttaaagataaaagtactgtacgtttccagttgtaatgtaacaaaagtttgca

SEQ ID NO: 83704 - DNA, 741 bp, Oryza sativa
tacgactactgcctggtcctcgaccagcgatgtagcgtttctcccactacttccaccttaagtggttgagttacgactactgcctggtcctcgaccagcgatgtagcgtgtctcccactacttccaccttaagtggtcgagttacgactactgcatggtcctcgaccagcgatgtagcgtctctcccactacttccactttaagtggtcgagttacgactactgcctggtcctcgaccagcgatgtagcgtctctcccactacttccactttaagtggtcgagttacgactactgcctggtcctcgaccagcggtgtagcgaatctcctattacctctatttcaacaaagttgatagcaggtatacaatatcgccaagtgttttacccagagatcccttaccacgacgacacctagcgttgaaacctatcctattgtccttttacgccgtcttgacaaggcctccgaggaacctaagggaacttcggctggggacacccagagccgataaggccttgtcggatcctgtagagacaaaagaccatgtaagacctggtcgtgtaagagttctcgccgtgcgtattaaccaagccgtgtgatcggaaattgagttttccaacttcacagctgggggctaggatcagtgcttgttcaaccaaggcaggtgtcacacccgaagttttcctcccaagtcaaaatggtaatttgcaaatgaccctaagaaaatgcaggtgaaatcagg

SEQ ID NO: 83705 - DNA, 749 bp, Oryza sativa
tttagtttctagattttacatgggtactcatatatttacggttattctttttaagtgatagacgacgtatacgtaaatagcgagacacatataatgacctcgttaattttaagatatgccggctcagtctcttctgaaggtgttcataagatatgagtatgtgcgttcaaggagtacgtgttatagcgtctgtatttatattgcctttaaaaagagtgtatacaactagacacgcatatttaatgtacgtcatactcccatcatcaaacatttagggtgttttggaggggttctctccgacacgcaaaatgaagtatacattaacgcattattaattcaatatattagttatttttaaaaaaactaatatgattttttataaacaattttttatagaattttcttaaaaaataaattgttcatagaagtttggaaagtatacgtgcggataaacaaggaaggagaagttgtgaacataggccctgtttaatttctaaaaattgtcgcaaaaacatcacatcgaatctttggacacatgtgtggagcattaaatatagataagaagaaaaactaattgtacagtttgcatgtaaatcgcgagataaatcttttgagcctaattagtccatgattaaccataagtgctacagtaacccacatgtgctaatgacgacatgattaggctcaaaagattcgtctcgttgtttccaggcgagtagggtaccgagctcgaattcgccctatagtag

SEQ ID NO: 83706 - DNA, 1037 bp, Oryza sativa
agtttctaacttcttttttactgagaaacagcgtgtcttgtgtttatagcattgatttccatgtccatatgttgctggtggttatgtagttattgtggcaactataacgcagatgccaactccgacttcgtataaaatgcctatatttatcctgattaatatcattggtcaatgtgagttgtactcaacgcagctgtagtttggtgtagtagctgcaacaattaagccatgttttcttcaacttcttttcacactatcttccatctttagtttaaagtctgatcgtttcgcatacaactgataaaccgtaaaatgcttatcagtaattaaagaataatttatgagtaaaacttttatatttgtgctaaaataaattataataaaaacccttaaaatcaactataaaattaaattttagccacagttgataagccaaaaggcgaagattgaagatttgatctttatgtgaactaaccaattaattgaagatttgatctttatgtgaactaaccaatttttaatgctcttaattttgttttgattttgctaaaagaagagtttgttattgttgatgctaacttatacttgttgccagaaaactttaggacagttggggcgattggttttgggtattggttatcggtttatggttggccatccgtatcagcttatcagaaaggctagtaatacagtcgacctgttagctataaggttctgtgtagtcttctcttagcttacccatataatagttagctctttacagttaatacagggcaaacttatctctctcacagagtttcttggttcttgtgtcaagtcggctgtaagtttacagcccgctctcctctcttctctcctccacctcagcatttagccggcttgtagcctactattatacttgctctcaggggattgtgatacgtctgctcatcttgaacaatatctagtcaaagtcacatcttttttgcgtaatgtcgcatctttgctgcgtaatggctaatttaatttaaatctgcgaaaaaggttcctgttcggtc

SEQ ID NO: 83707 - DNA, 632 bp, Oryza sativa
tgcttagaggtcattagtagggctttattttcgccgtttgtttcgcgtgtagtttcggagcccgaagacccgcagcgcgaggatttcgaggatcaagctccagatctcgagcaaggcaaccacctttgaacatcttgagcctatatttgaaatttaattatgttgtttgaaaatattatgcattgataggatcgcacttaacctgttgtcccgtctgcaaggcagattggcggacctacctaatttgttgcatttgatccttcctttattaattgtgataccatgtccccttgtaaccatctagttgcacctcaatattcgtgcactctgtgcgagtatcgacagtcgccttcaaacttaaaatctgaataacaacttgggtaaaacttgggttttacaaaagacttggaaaaccccacacctgagtcggtacttgcgaactaaatgaatttccgaaaccgcggaccggggaacgtaccgggcgtacggttttccgctcttgcacttaaggaccgtttccttagaatttcatcaaaacataagacaagtgcgaccacatgggtggaatgggacaccccttgctgaataactagcttataagggagcctcaatgcccaaaaacatgtggattc

SEQ ID NO: 83708 - DNA, 564 bp, Oryza sativa
ctatgggaagatatgtgttaaaagcatactgacaatatcttgcaccttatcaagaacactagttaatcccaagatatacctgtttcctatacatgacacatcatacatcagttcagacaaacatgtgctttttgaaaagcaacattgatcaactggctgaataagacgtatgatggatcagcaggaaacatagtaggaagtatgaaaatgttcttgttatagataagatgacaaatgaatctgcctcccaaccaaaacagaagaaaaaggatccaacacacagttacatggattaccttgagtggtgtacagggatgacaacttcccatcttttctcaacagactatgaagtggtttagacgtgcagttctcaagagccttaatccatatggtctcgagcacatctggatctcctaagttcatatctaaacaaccgattttgttctgatagcaaagatgagaactggtatctaagctttcgtctttcaagatagcagccccatcatctgcataataaatagctttcagtgagcatgagaaagtgactcagtcatcagagtttcg

SEQ ID NO: 83709 - DNA, 669 bp, Oryza sativa
  unsure (1)..(669): unsure at all n locations
atgtagtatcgactcttttataaggcgaattcnagctcggtaccctgtctatgactacgaggacaagatcaacttcgcagtgttcccgtcactgcaaggtggtcctcacaaccaccagattgcagcccttgcgggggctctgcagcaaaccatgacacctggattcaaggcctacgcaaagcaagtcaaggccaacgctgtcgccattggcaagtatcttatgagcaagggctacaaaatggtgactgatggaactgagaaccaccttgttctctgggatcttcgccctcttggcttgactggtatgcagactgtttttgcattcttcagtataattgctgttaatttttaattagtgctattaaacttgtcctaatgttggtttactcatgtaggcaacaaggttgagaaaatgtgtgacctttgcagcattacacttaacaanaatgntaacgggagggnnncaggggggagggaagaggaggggnnnnagggggtaggttagggacnccnnnnnnnnnagaannnaggnaatgaaggggagggaagttgctgccatnnccntnccctcnnnnctaagaggggnaagggnaaagagagaaaaaaaaaaaacaaaaaaacgatgtgtttcgattgtatacccnaaaaaaaaaagtcgtatgtgaaact

SEQ ID NO: 83710 - DNA, 1367 bp, Oryza sativa
aaaagcccatctcaaaattcgattccaattccagttcgtctcgctcgccgccaaatcgccccctcgctgcctccgtctcgcctcgccggcggcaatggagtggctggacgagtacgagaagctggtgatcaggatgaacacgccgagggtggtgatcgacaatgctgtgtgctcgacggcgacgctcgtccaggtatgtacggtggcgcggcgcggcgtggcgtggcgtgggtttggttcttgggtcaatctggtgcgtgttcttgcggcgagggttgctgatttggggatgtgcaggtggacagcgcgaggaagacgggggtgctgctcgaggcggtgcaggtgctcgccgacctcgacttgtccatcaacaaggcctacatctcgtcggatgggaggtggttcatggatgtcttccatgtgaccgaccgcctcggttgcaagctcaccgacgacagcgtcatcacctacatcgagcaggttggtgggtgttcttggtggtttctttgattctggcgcgggtgttcgacggagttggggggttttctgatggcgtagtacatggcttcgttgcagtctctggggacgtggaacgggccggcgcggccggcggcgctcgaggggttgacggcgctggagctgacgggggctgaccggacggggctcatctcggaggtgttcgccgtgctcgccgacatggactgcgccgtcgtggaggcccgctcgtggacgcaccgcggccgcctcggctgcctcgtcttcctccgcgacgaggaggccgacaccgagaggatggcgcgcatcgaggcccgcctcggtcacctcctccgcggcgactccaccggcgccggcggcgccgtggccgccgtccccgccgccgccgtcgcgcacgccgagcgccgcctccaccagctcatgtcggccgaccgcgaccaggaggagcgcgcggcggcggcggcggcggcgtccccgacccccgccgtgtccgtccagagctgggcggagcgcgggtactcggtggtcaccgtccagtgccgcgaccgccccaagctgctcttcgacgtcgtctgcacgctcaccgacatggactacgtcgtgttccacggcaccatcgacaccaccggcgaccaagcgcaccaggagttctacatccgccacgccgacgggagccccatcagctccgaggccgagcgccacagagtgagccaatgcctccaggacgccattgaacggagatcactagaggtatatcgaagccaaatcgacccaaatttccaacaccaagatgcaattcgttaattgatttggaagatgacgctaatgtgttcgatttcttgggtgtttcagggagtgagactgaagctgtg

SEQ ID NO: 83711 - DNA, 601 bp, Oryza sativa
agcaaaacccttcccattccatcctttgattcatcaatgctatccatgctcgtcgatgttgcacaccagtaaaagaccacagcgcattttgtacaatgtgctacagtgcccctctcatggatcttaggccctgtttagttacaagaaagtttttccaaaaaatatcacatcgaatctttgaacacatgtatagagtattaaatatagataaatttaaaaactaattgcgcagttaggggagaaatcacgagacgaatcttttgagtctaattagtctatgattagccataagtactacagtaacctatatgtgctaatgacagattaattaagctcaaaagattcgtctcgcggatttcaggtgagttatgaaattagtttttttattcgtgtccaaaaactcctttcaatattcggtcaaacgtccgatgtgatccccaaaatttccttttccttatgtatctgaacacattgatattagtagtagtactaacgtgaatccgcagacagacaaatggacatggcaagttggcaactgaaccacactagtcaattgacttgaatgtacgtttgactcttgcatgtaaacattgcggcaatg

SEQ ID NO: 83712 - DNA, 635 bp, Oryza sativa
accctgtgctggcttggcccgggagagagcagggaggagaggcccccgagccgaacggtggcccaaggcccccgacgaccggagcaggccctctgcccgcttgttagacggtgccaggtgcccccgacccccaggatggcccgagggccactgcgggaaggccgcacctatcgccctctgaccccgaggctaaccctgtgccgactcgacccgggagagagcagggagaagaggcccccgagccgaacggtggcctaaggcccctgacgaccggagttggccctttgcctgcttgtccgacgacgccaggagcccccgacccccaggacggccccgaggccactgtgggaaggccggccctgtcgtcctccgaccccgaggtcgtcggcacagaagacgagtgcaccccgcgaggccgcttggacaaagagcgccccagggatgtggcccctagcgaagaggatcggccccaccgaaaggtgcagcggcccgtctactttgttagtgaggcccttcgggacgccaagacccgatacccttaggcccagaagatgctttacgctattctgatggcttcgaggaaactgcgccattatttccaggcgcattgggtcacggtgggtacgtcttacccc

SEQ ID NO: 83713 - DNA, 630 bp, Oryza sativa
tagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaacccatggctcctttgccgacgctgagtagattttaggtgacgggtgtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgact

SEQ ID NO: 83714 - DNA, 512 bp, Oryza sativa
caatctatcatggctgcaactgcaagagaacatgcggcatgctgccgagatcaagtacatgatccggcacatttccctgacagacttgttcggatgtaggctcagtgatgactggggttgcataactgcataagcagatcttggatcgggaggttgtgttgcatgattgtgcagtgaattatgactttgaggttcttgctgaacaatttgttttcagtcaaagttcgattactgaagtaaagactgaggttggacaaaggaagtaaaacttccggtctttgcatcagctaaggatatatattaagatgaaatctaaattataagaacaacaacaacaacaaaatatcaggtgcaaccaaaaaaagaataaaacaatagagatgaaatataaattacaagagcaacaaaaaaaaagagcagatgcaacaaaagaaaaacagagatgaattctgaattgttggccaaagattcagcttaacaaaagagagagtgtcctaagatgaaatctagat

SEQ ID NO: 83715 - DNA, 824 bp, Oryza sativa
  unsure (1)..(824): unsure at all n locations
gggaatgagngtgcacgtagatcggctncttgcagnagtccatcagtcatactcgatcaaagtaaaagttatctccttagaagatcaggtcaagagagagagagcacgccattacatgacctagggtgtccggggtcagggttctctttgtgcccgtgcgctacatttctagttaataaaaagtcagaatgcagggtagatatataaaacgtagaataaaaaacgatccattgagttatgtagaaatcacgctgaccatgcccatatcacacatcgctgtttttacgagttgctcctgttggccgtagcataaaccgtgtgcccattgaactgtgtcagcgtgtaaccgagctctcgtgagacctctctatatataaacacgagacgccaatcttgtatcagccgcgaagagaaataagagtccgatatgggtaagatcgaagcgcccgcccgccgccggcctgaaaggaagaacccggggggccccccccccgcgtgctcgcgattaaaatggacaagacgacgatcatcgtgtccgcggagggtgggtccccttgggttgctcagcgccatcctgggattctccgccgagggtgcgaaacgcaccaaggcaagttcttgctaacactagctacatattatctagactctagtgggatatatatgtttaccgatttttttttttgaacttgatgactactgccttagagattatatatgtgtttaatttcccagcgtggcgaactcgacctgtaccactttgtactaactcgtcgaactcatcgtcagaaggggtcgggctgggtgtctgcggggccatcttg

SEQ ID NO: 83716 - DNA, 568 bp, Oryza sativa
ccaaagtttcccctttccactactaagttttttttctcattctttggtccataaccttccaatctttgttactcaacttcctaaaatgccttttaatcccccaagatttttaaaaaaaaaaaaccccccagcttacaccgaaaaatactagaatatcgatcataaccctcatttgcctggccaaaaccaaataactccaattttatgaaagttaattttcaagccagataaattttcaaaccccaataagatcaattttagattctttgcttgttgtaaatcttgctccaagaaaatgatagtatcatctgcatattgcaacatagacaaaccatcatatactaaatgagggattaccccattaagaaaatcactatctttagcccttttaattagcaaagctaacatatcagctactatgttaaagagaattggtgataaaggatccccttgtctaagacctttatgtgtttgaaagttgtcaccaatttgatccttagctttaataccagcatgtcccccttggataaaagaggatatccactcacaccatttgggagagaaaccc

SEQ ID NO: 83717 - DNA, 620 bp, Oryza sativa
caaaacgaatcggatttggttcctgtgcagttcttggtattactgcaacttaggcggtcatattgtggctgtaggatgcaaatccaaaggcccaaatttaataggacactgtttattcagacaatccagcacaaaattattataacaatcatagtggcaattaaagcgtgtaatgatgcatctaccaaatgctaaattgctaatggtgggatattccagataacactagaatgattcagacaggccaagcctcccaaggttttccatctcaccagcaggtgggacccaccccgttttgctcccagccaatggcgtcgcgaggcgcgagataaggctgcaaacctggagcacacactcgcctccttccatcgctgatgcagataagccgcgatcgcatccaccgttctagaaacgcagcgacattgcactcaccatctcagaaattgcatccaacagcagctgccatagttgcaagtgagctagagctcagagaagaggaggaagaagaaggcgtcaatggcgaccaccatagctgcgatggccatgcttaagccgtccaagatcgtggcgcggtcatcgccggcgccgtcggggagcggcagggtgcctagcatctcgct

SEQ ID NO: 83718 - DNA, 630 bp, Oryza sativa
ccgcaactacagaaatccatccaccgtagtgccaattctattaggccctgtttagttcaaaaataaaaaattttatgctaccatatcgaataaattggacacatgcatggattattaaatgtaggcaaaaaaaaccaattacacaaattacgtgtaaattgcgagatgaatcttttaagtcttattctgccatgatttgacaatatgattcaacagtaaacatttgctattgatggattaattaggcttaataaattcgtctcgcagtttcctaacggaatctctacgtttaatacttcaaatgtgtgtccgtatatccgatgtgacaaccaaacccaaaaattttccccagttaaacaaggccctactcccttcatctcaaaatatagctacctttaatatatataatttatcctacttcacatattccttcatctcaaccaactacaaccattttctatttaatttcatcatatacttctttatcttaatcaaccataaccttcacagtttctatcaaaaacaaaaataaaacacaaccctcccatttaattttattgccctctccttaatcccttcaaaaaaacataaaggtatgggtaccgagctcgaattcgccctatagtagtc

SEQ ID NO: 83719 - DNA, 625 bp, Oryza sativa
acaaaatccttatgaacagggaaggaattgtgtaacagttaacaacaaaacagaaggggacgagtttattacaacatggcactagaaacatatttcatacttcaaatatatacaatcgcaaaactgcatagctctttatgtatttctttaactaaatgttgtatttaataaaaacccatggtagcaatacatcaaccgatcataccaaaaaatctgcagaatatcaattaccacatctacgcagtcctgatttacataattaccagtatgaaacaaacaaatagcagggcacatttatccaatcatatggatacaatcatcgaccatacagatgaggatacagaatcataccgttaccccatctgcacaaagtacacttgttttccctaatgatattcacgcaaccatgatttccacaactgacatgaatgaatgcgtgatgcatggaaaccacatccaacccagtaacaaacataccggatgaaatacatcccaaaaagcttggaacagaatgcacctcgagctattgaccaagaaaacaaatccagatctagcaataaccgcagatctgaatccccatcaagaaaaggtagggggggtaccgagctcgaattcgccctatagt

SEQ ID NO: 83720 - DNA, 613 bp, Oryza sativa
agagggatcctgcacaccgggtgggtgcagcagcagcacatcctgcgccaccgcagcgtgggctgcttcgtcaaccactccgggctcagctccgtcgtggaggggctcgtcgccggctgccgcctcgtgctgctgccgatgaagggcgaccagtacctcaacgccgcgctgttcgcgcgcgagctccgcgtgggcaccgaggtcgcgcgccgcgcccgcgacgggtggttcgggcgtgaggacgtgcgcgacgcgctggcggcggcgttcgccggaggagaagacggcggcggcgaggagaagaaatggcgggagttcttgatggacgacgccgtgcagaggaggttcgtgcgggagttcgtggcggagctgagaaggctcaagggctgaaaacggaacgtcacgcgtcgttaatcagatcgacagctgtcacaactctgaagaaaatcggactctgttctgaagactgtgaagagaaggaatcaacggctgtgattgcttgatactgcatcgcgggtctcgctctagggagtactacatccgtcataaaataaaataagtgcagttttgcactggttatatccaacgtctgacttaacgtcttatttataaa

SEQ ID NO: 83721 - DNA, 1705 bp, Oryza sativa
attttcggcataaatagtactgttgttttgcccagaaaatatatatagagagagactttatacattcaaactttatatatagaaactttatagatggaaactttacataggaatatcttcgtaccaaaatttatgcagataaaattaaaacaaataaaaataaaacatccagatggacctggggcaaaccacatgcatggcatgcctgctcgatgggccttccgtggaaaacatgcaagcaaaaagagaaaacactaactagaaaaaataagtgagagcctgtgattaatcaaattgttgctcgtatttgccaaaaagagaaactaaacaatcccgtatgtagtttgttgtgccaaaaaaggaactttaaatctaatcttgcgtggtgagcacgagcgattcgctcattagctttttttgacaataaggtggtcaagattttatattttctcctaaaactagggtggcttggttctacgaatcttttacccataattcaccaactcactcttacacctacattactcattcatcaaatccgacggacgaaaatcatccggccaaatcaaatgatcgctgcggcgtagggataacccgggcgaaggaatcgcgtgatcttttccctttccttccgtgcggacgcgatctttccttccacgccaatctgcgcgatctcctcccctttccatttcccttcacctaccaatctgcgctcatccgcgcgcccagcactccctgccgtgcgccatcgacgttcctccaaacagtgaagatcacatccccttctccaccatcaggcgccgtcgcattctccgccacgaagatcatcgtcgtctcaagcgccgttgttgatcccctgccgccagagcgcagcagcgacgacgacggcaacagtagccaaccagtgcagggggagacggcactgcgtgatcctcgtcctgctacagatatattgcagtgtttttttttcagtttcttaagatctcttgttcaacaaattctaattcataaaagttaacaagttttttagctgatcaaccgttgctttctgactctttgtttctttgaacactgatgttttgattcctctcttggagttcatggagataaacgggcaggtaaggtattggatcagccatggtcaggaggtaatggagatcctgcgagctgattcgaagtctatttcttatcgattggagtgtcgacttcagctcctgaatgaacctgatctttctgcagcagtccatgaggtaactcctgttttcttccaggtttattagggatgcaggagtgcagcacgacgagaaggaccgctgcatacgagatgctcgtgacaatgcctcacagcaagatgatactcataactttctctgacttttcttcttttgatatattgctgggagataaaggaaacttttaatgttagacatacgctgccactgttgaagtgaaatgataccatccgtcgtacatatatgggatttctaatgttcgtttcctatgtaagcaaaggagtgaacaaaaagctggtgtatgattactctaccaatacctgatctagacagatagcactatatgtaagcagagatgcatgctctgatgcagttgattttttatatttataatgtggcaattaaggttttgccactcgatgtctatgatatgtggtctctcttgtgtctatgacatatgggtccagtgacaa

SEQ ID NO: 83722 - DNA, 569 bp, Oryza sativa
  unsure (1)..(569): unsure at all n locations
attgttgagtcgcacgatccactataggccgaattcgagctcggtacccttcgttactagaggtgtaatagcgtgttacatcgggtatattatatagggtattgttatgggatgtnnccccactaataaaaaaactggtggggaatctgccagtagtgcgcgagaaaaatttattaagcctaattaatccgtcattaataaatgttttactgtagcaccacattgtcaaatcatggagcaattaggcttaaaagatttgtctcacaaattagtcacaatctatacaattagttatttttcagcctgtatttaatacttcatacatgtgttcaaacgttcgatgtgatagggtaaaatattttagggtgggatttaaacaggcccataatctaacttttttattattatgaacaaaacaaggnnnntaattgaggtacaaaatgtgccttcttttctctttnanctttaggggtggagagggaggagggccccccncaaggtggatagtatagtgaaanctttttttnnnnnnnttttttaggtgtgagaacatgccaaaatcatttttg

SEQ ID NO: 83723 - DNA, 1908 bp, Oryza sativa
cacaaaaaaggaaaatcatctagattttttttacctttaaaattacatccaacaaataccaaaggatttgaccaaatccatatttattaatatataattttaatcaaaattacagtatacttacatgtcacatcaactgaatttacaaatgtaattttagttatataggcctataactttatatttcacgacgacgatgatgagagaggcggtatcgctcgccgaacagctttggccgtactgccggcggccagctcgatcagaggccaccctggcaccgtgcttctccaacatcgcgcgcgggcgtacgtaccagccggccggcgagcttcatgcaacgttcgatgccgttcacattgcaagctgcatggatgctaaaacgtatcaaatgccagaaaaaaaatcacacgagagatggatagcaaaaccgagttcgatgggagtagactcaacttcggctgtgtctcgtgtttttttagtaagtttacctgacgtctctcaattatccacagagcagcccaacaaatcaggaaagacattcaagaaaataacttcgtttttcagcctccttgatgatctcattttcttcctcttctcctcccctattgttgtcccctctctatcgttatttctatttcctaagaatgtcgcttcatatctccggtaacagttcacttgtaagctctatgtaacctactaatttcaccccctctaatgtattcggcaataatcttgccgctttcacctaaaaaaactatacgctgagtatatctgagatcccctaactgcaatatcaaaaatgtgcaccacggactatgtaaaacagttcaaaaaaggtcccagattatagatggccaaacgggccacccggcccgacacaacccagatacaaccggtacggcacgacctacatgtcgggtcgtgtcgtgtcagcccgcgagctgcacacacagcccaggcacgatccaataagacttgggccatgccaggccggtccgaaggcatgacaacccatcatgtttctctataaaataagtctatttttcctccctcgactctttgggttgtgtcttatatggctaaaaaataagtctattttgtattcctcttctctttgggccttgtcatatatggttaattaagtctattttagatccctctactattttcttccaccgtgccgggccgggccagcccaccgtgccaaggcatcagccttggcacgacccaactgtcgagccgtgcaagcacaggcccgacaaatagtcgggccatgcaatgcttgggctgggcgatcgggccttaggccttatggccatctatagtatagatacctggtttcgctgacgtggcatcctagtcagaaaaaaataaaaaaaatgtaaggcccacatgtaagtgagaaggaaaatgtgggccccacgtgtcagcatcatcttcttcctttcgctgacgtgacatcctagtcagaaaaaatttaaaaaaaagtaagtggggcccacatggaagtgacaaaaattataggcaaaatttgctacaggacactgaaatattgcggtctttgctgtgagacacccgaagatcgtgtatttgctggtggacattgtaaagaagtggtaattagctgctggacactcctcccattattttattatttccggtcaaaatggagagagaaagagttgtgtaagtactaaaatgcccctggacacgtactgttcttcctctctctctccttttcttttccaattcttcctcgcgacggcggccggcccgagccgggatggctcggccacggcggggcggcggcggcggcgcatcaccggggttcaccgccgacggcgatcacgcacggcggtggcccggcgcacaaatgaggtcggcaaagcttggttgtcgacgatggct

SEQ ID NO: 83724 - DNA, 1359 bp, Oryza sativa
ggtcagcagcccgctgctccagtgcggctctctcggcgcggacgcattcaagattgcggcgcgcctgctcctcctgcgccgcctcgcgaagtgacaggctgtccgccagccgtttggtcgtggcctcagcctcctcgagagctcgctcccgctcagcgagtgcgtcctcgcggagacggagcgcgcactcctcctcggcgtaggcggcctcgtgcgccgccagcgtcgcctcccggagagcagcggcggcctcgcggtccgtcaagcctttctccacggcgccggcgtgttcttccagcgccatagcacgggcctcaagggactcctcgcgccgccgggacgccgcctcagcctctgttacccgccgctctcgggcagcggcggagtcaaggactccctgggcggcgtcgagcttttctttcagctccgcctcccggctggcgttttgaaggcggagggcgtcttgcgcctcaatcatcgtggtggtagcgatgagggcggccgctcgctcctcctccacctcacgagcgatctccgtcagcgccgccttccgggcttcaagctccgagacgtgacggcggtgagctttacggcccacctccaccatggcgtccaccgagcgccgcccctcctcaacgcgtgcccatgcggcctcgagctccgctcgttccgcgcgcagggcctccacttgggcgctgaacccatctagcaccgcggtgtttgcggcggccaaggcctgcagaatgggctcggcgctcagcggggcgacggaagatgaggagaagagccgccttggagagaaggcgatgcggctcggccccccggagaacgtgctgggctcggggatgtcccccgaacccgtttgatcctgggcgtcgcccggggaggtgggcccaggcgatgtgcccgcggcctcgtcgcgagcctccccggaggctgtcgcctgagggttgcccgaaggagtgggcccagttgacgcgccagcagcagctgttgcctcagcctggcgagcccgggcggcctcctccttagcggcttcctcagcccgggcggcctcctcccgagcagcttcctccgcttggcgaatccgggcggcctcccgggcggcctcttcagcttcccgaaggcggtctgcggcttcacgccggtcagattctcgcctccgctcctctgcggccgcaggatcttcggcctcggactggccggacttggggtggcgggaggaatgcgacgggacatcgctgaagcagaagaaaaaaccagaaaacgaacaaaatgagtaagaaaaaacttctttttgggagaaagatggttgcaatgagagtgagacgaacctgcgaaggggtcggttgaatgacc

SEQ ID NO: 83725 - DNA, 557 bp, Oryza sativa
atgacacatttatcactgccagccgacatattcaacaaaatgcataaaggaagtgcacttttattaattctcctgtactattcttaaaccgaacagtacaccatttattcaatacatgaagaacaaattaaaatgattttgcaaatcctcacatatgtatactatttattacatggaattcaaacatataaataaaacctcaatatttatcaggataatgttgccacaagtgctccactaggtcttcacgtagctgatagtgagtttcgtcgtcccttatttttttgtgcatctggataaaattatcaagatcaggtatttcatcgtgggacactctgacattttctcctccctctgggaaccgttcttcccaatcaacttctccctcatcttcaataatcatgttatgcatgataacacaagctttcatgatgtatcccagagtcttttcatcccaatgtcgagctggccctcgaacaatggcaaatcgagcttgcagaaccccaaaagctcgttcgacatccttcattactgcttcctgtgctttggcaaaatat

SEQ ID NO: 83726 - DNA, 1740 bp, Oryza sativa
gagagtttgagtaagctgtatcctgacctctttaccaaagtggacaagagtagacttgtttgtgatgcttgtgagtttggcaaacatacacggtctacatatgctggaattggtcttcgtagttgtgaaccttttatattaatacattctgatgtttggggaccatgcccagttacttctgtgagtggattcaaatggtttgttacctttattgattgttatactcgtatgacttggatttacatgcttagacataagaatgaggtccttcgttgctttcaagacttccacaaattggttaccaatcagtttgatgcaagggttcggattattcgaactgacaatgggacggagtatattaatagtgagtttgtgtcatatgtctcagatcatggaattattcatcaaaccacttgtcctggagccccccctcaaaatggtgtagctgagaggaagaatcggcatttgctagaggtggctcggtcattaatgtttcaaatgaacgtacctaagtatctgtggagtgaggcagtgatgacagccgcataccttatcaaccgcatgccatccaggatacttggtatgaaatcaccagctgaacttttacttgggaagcgagaatttaaagttcccccaaaggtatttggttgtgtttgttttgtgagagatcatcgaccttttgttggcaagttggatcctcatgcagtaaaatgtgtctttgttggctatgcatctaaccagaaaggttataagtgttgggaccctattgggaagaggttatttgttagtatggatgtaacatttcgagagtttgaaccttattacaggagtcgaggagaccttgatcaatttctagaggagttctcaactgtcatcgagatcgacagtcgagagggggagatagttgaggttgatgcacataagcaaggtgatgaggatgtggttattgggtcaattccgagttttgttggtgatactattgagaaggttgtggacattggtgagaaggtagtagacattagttgtgacaaggatgagggggtagttgtcgggacaatcccatgtcctctggagcgtgtggaagtacaacaaactgaaatgagagtatatcaaagaaggaacaagaaccaagttgataaggtgacagggaaggagcaagtgcaccagaggagccaaattcagaatcagggggagagaagtggtgagcctatgcaagagcaagacaaggagtcacaacagctgcaacagtttgagtacgcagtcccagattcctcctctagcctctctccaacaagttcctccctccttgagacaagtggtaacatttctcctacctttgaacaagtagagttacctcttgcacaacgtagagaaactagatctaatgctggaagacctcctatacgccttggttttgaacaccttagttctagacatgacattgcaaactatatctcatactctcatatttcacctgcatataaagcattcattgcatcattgcaaatagtgcctattccaaaggactagagatgtgcaaaacaagatccaagatggaaggatgcaatgaaggaggagttgcgtgcccttgaaaagaataagacatgggaacttgtgaaactaccaatggggaaaagagcagtgggatgtaaatgggtatttacagtgaagcaaacccctgaagggaaagtggatagatataaagcaagattagttgcaaaaggttatagtcaaacatat

SEQ ID NO: 83727 - DNA, 660 bp, Oryza sativa
ccatgataaaaaaaataaatcatagaccaattcttgttaactaggcatttccataacagaatcagctgattacttactgtttcgccatccgtgaccattacagaagcgcttgcttgcctccctatgtggcctgtctccaccagtatctgggaaacaaaaaaaaaaacaatagtctaattacaactattctcatgccgtatcaaacacctgaaccacagaaccagataagaagtgtaaccaagtttcagtcaaataagcatgacaatcagcacattgtttttgaagttttacggcatcctgagaaaccacatttcgaattgcgcacacagcgttgcattacagttcactgcgcagaaatgttggagctcacgatgacgcatttcaaattccaagcacgcaggcagagcagtgcgcctcgattggaacaggagaaggtgggtgggattactcgtggagggctcacgtacgtggcggtcgccgacgggaatcttcgtggagaacttggtcgggccgccggaggtgctcgcctcctcggtcaccacggggggcgcctcctcgcccacggaagccctaaccctagcccccgccgctctccttcgcgcgccaccgcgacgcgaggtggaggcgctcgctgctacacggcgggggcgggggagcggg

SEQ ID NO: 83728 - DNA, 933 bp, Oryza sativa
atcgatccatccaaaacggacggccgagatcgagcggtccacggcggctcacagcagacagaccctgatgacgtcagcggtgacgtcatctccggcggcggctcggcggctcgggcgcgcaagctcgccggcgaacgacggcgcttcggcacgaacggagggcaccaggacgtagagaacgttgcggcgaactcaccggtgaccaaagaagcggcggaagagcagcggacggcgacggcggcgcggcactagggtttcgggcggcggccgatgcgaggaagacgacgactccgacaggtgggccccacctgtcagcgggcggacgcgcgcgcgagcggcggctgttgctggactgggccgactgggccgagggagagagggagagaggtttttgggccgtctttcggcccaaagccaaaagagacttttaaaaacctttttcaatttaaattattcattaaatgcaattctatttattaaaaatactttcttagctcaaataaatcccagaaaaatctaggaattatagaattaagcaaagtatttaatgaaattttatctggcccattttatattggaatttattaattaaaatttgatcttctcttctaggcttttaaaataaaatctaataattccatttaagcaacaatttatatatttaggatttttagggtgtgacaaacctacccccttaaacagaatctcgtcctcgagattcggaagaactggcaaacagatgcggatgagctgacttcaattcatcttctcgttcccaagttgattcttcttccgagtgattactccattggactttgcaaaaacggataactcgatttctgggtcttctctcatctatttccaaaaaaccgattggtttctcaacataaggcaaatcctcttggacttctatctgtttaaaaataacttctt

SEQ ID NO: 83729 - DNA, 619 bp, Oryza sativa
ctactatagggcgaattcgagctcggtacccctcacaatttattatgtaaaaaagaacatatgtaaaacaacatttagaatctcaccagatcctgatacataagtaaaagatgaggagatatatagtctgaaacgagaacatattatttcacaatgggtactgcacttccagtgggaatcatagatagtgagttttgccaatacttttgagatttatgcaaacaggggacaagagatgcacggctaacactcacctcgtcaacacggatattgtagagtagaatcgaagagtcatccgttccaatagctatgatgttattgtcatgcgggtggaatgcgaggaaagttgcagagggtggaggtgctatgaaagtagtcatggtctgtgagtgattccacaaaatcagttaagtaaaaaaaaggccatgatcgatgcaactatgaaataaaaaatattttccggaagtagtcatgacctgtgagagatcaatcatgaaattaccagattattgtgttacatgactgaagaagacatacctttgaatttaacatgttgaacaacgaaactttggcaccagatgcaaaaattagatagcagtcatttttggatagtagactg

SEQ ID NO: 83730 - DNA, 582 bp, Oryza sativa
tagaggatcccccttgatatgatactcaacgtaagcactggaagacatgagttcagctgttaaactctataagcacagcgtgtcaatccttcgtaccttggaaatagcatccaaagaggagcaatgtgattatgtcagtgcatggtacagtatgcttctgtcctgtgcccaagaattgcagcatggtgcgatgatttggcaggaatcttgtcatgcaaatgttggcgaaacagtaatttctcaaggtgggactctgaataatgagcagagctgtataatttgttttttcggtaatcatttgcttgcagaaagatgatcaactaacatgccttctgttggttgcacaggtgctcattactttattgctcttggggagatctacagagttgcacagatcttacatatatccatgctatctttcaagccttgggttcttgcagatcctggaatgttgagtaaaatgttggtttgttggaacagctgcgttaattcatggactagtggtttaggaatggctcttacaatggttgtcgacagcaagaacttacatgcagggtaccgagctcgaattcgccctatagt

SEQ ID NO: 83731 - DNA, 931 bp, Oryza sativa
  unsure (1)..(931): unsure at all n locations
tttaggtgacactatagaatactcaagcttnnnncacatggagatgggccattcagggttttggagaaaatcactgacaatgcttacaagatagatcttcccggtgattacacagttagtaacacattcaatgtggttgatttgtcaccattctttggcacggaagaaacagattcaggacgatttaaatatgaattttagaagttttgagctatttaaatgaatttctagaattattaccgatttattacgcaataattatttattttcttaaaggaaaaataaggttattgcgtcaacagtgggacggttgtggatcgagtccaccaaatgcgggccccacgcatcagccaaaggggaggggcggtccaccgtggactaagtccatggcggcgatcggccacgcgggcacgcacccgatggcccagatcggccgagggcggctgggcggcgcggccgggcaggcgcacacggaaagcggccagcctgccgccggctagcggcgacctggcccaatagcgccggcggcgagcagcggcggcatgagcggggccgagagaaggcggttgaggcggggagggaggaaggggacgcatcgagcggaggtggcggctgtgtggcaaaggagagcgtcggcgttgaggggttggaggcggcacccgtgggtcgacggcactggcggagttccagcagtgatttccaagggcggaggggtggacggggcgcggcacaacgttgctacgccaacggagcaagcggcgcggtccggggtggtcgcggtcaatggcaatcgtcgatcggaggcgacgaatgcggcggcagcctctggttggcggcggaatcggcactacagcggtgtttcgcggcgagcgagggacggccgaggtagccctcggtgcggcgaggccggaggttgtggcggcacagcacg

SEQ ID NO: 83732 - DNA, 549 bp, Oryza sativa
ggatccccatagtctagcctgaaaaaaaatatagggttgactttcatacataggtaacaagttaaaagtctaggagaggggccggggagactcaatcggtgaatagtaccctctccgtattcgtaaaggaagtcagttatgacaatgtttaagttaaaccttgggagataaatcataaataactctcaagttgttgagtttgaaaacgtaaaaattatatgaatagatttgtcttgaaaaatacttttataaaatcatacacatatcactttttaataaatatttttatagaaacaagaagttaaagttgtgttttgaagaccatgtcactgtccaaaacggcttcctttacaagtacggaaagagtatctaggttaaaaaaaatattagggtagattttcagacttctatataagtaaaaagctaaaaggtctaggggaggggagaggggagagtcaatgggtgaatagtatctagtttgaaagaaatagttagggctgattttcagacttccataagaaaataagtgtggtggtagactatttcctg

SEQ ID NO: 83733 - DNA, 7374 bp, Oryza sativa
aatgagatgtttacctcctctatagtaactgctactcgaccacagctcgcatttgaaatacccgggggcacattccagcttttcagcctaatgggaatagggttggtggacatgcagactttgtccaaaatcgtgcaggagtgaggatgttggaccaacagaggaacatttatctgggtcaggcaggagaagggaatcagtacgctgaggctgtcctcaaggggccaagattagaaatccctctgttcagtggagaagatccaatagattggcttaagcagtgtgagaagttttttgagattacgggtacccctctggatcaatgggtgaatttagcggtggctcatttgaatggcagggcattgaaatggttcggaggaattggtctgccatggcaagtgatagcttggccacaatggtgcagcatggtctgtactcgattttctgctgcgagtgaacatgaggcaattgagttgttccaaaatgtgaaacaatttggaacaacagtggagcaatatattgacaagtttgaggattatgtggatttagtaaagagagaccacccttatctccaggagcaatatctgaccagctgtttcattgggggattgagagcagatattaaatacgatgtgtgtggtcagaaacctcaaggcttgcttgaaacttactggtatgcaaaaaaattatgaaagggctgctaatgccagaaaaatggtgggaaatttcaaccgaaacaggaatcagaatccacttggaggtaatcaggggcggaatgctaaccataggggacaaaacagaggtgagggagataggagagaggaaaagaagtgctggttctgtaaagaaccttggtttccaaggcaccagtgtaagattaaacaagcaattcacgctttgttagaagaagatgatgggcaagaagataaagaaacaagtaatactgggggtgatgagaagagaagaaagaaactgaagaatctgcaacttcagaaaatgagtccccaaccgaagagttgatgtacatttctcaaactgcagtacagggtacatccaggccagatacattctcagtattaatcaaaatcaatggccggacagctgtagggttggttaatagtgggagtccccccacattcatggatcaggattatgcccttaggaattcttatcccttgaaaaatactgacacaaagaaagtagtagttgctggtggtggagaacttaagactgatgtcatggtgccagacatcagctatgagattcaaggagaatgctttactaaccaatttaagttgcttcctctcaagggatatgatattatctggggtgctgattggatctataattatagccccatttcgctggatttgaagcaaagaattttgggaattacaaagggaaacaaagtaatactcttacaagatttcactaaaccaaataagcactttcagatcagtggtaaaagattggagaaaatgttaaagaagggggctcttggtatggtgatacaagtcaatgtcatgtctgaaactgtggaggaagaagggcatgttatacctgaagacattagtgacattatacaacaatttccagctgtgcttaaagaaccaaaggggctaccacctaagcgagaatgtgaccatgtgattaatttacagagtggggctgtaccacctaacatcaggccatacagagtgccacattatcagaaggaagcgatggaaaatattatcaatgagctgattgaatctaaggagattcaaactagtgatagtccctattcatctcctgctgtgatggttcgcaagaaagatggatcttggaggatgtgtgtcgattaccgacaattgaatgcacagactgttaagaacaaattcccaatgccaatcattgaagacttgttagatgaattaaatggagcaaggatattctctaaactagaccttcggtcagggtatcaccaaattaggatggctgagaaggatgttcataaaacagcatttagaacacatcttgggcattatgaatatcaagtaatgccattcggtttgacaaatgaccctgccactttccagtcacttatgaatcatgtcctagcaccattcttaagaagatttgtgttggtgtttttcgatgacatattaatctatagcaaaacaagggcagagcatctggagcatgtgaagttagtaatgcaagctttgcaagacaaccatcttgtaatcaagcttaaaaagtgtgcttttggacttgcaagtgtgtcttacctaggacatgtaatctctcaggatggggtggctacagatcccaagaaggtggggaaaattaaaaattggcccacacccaaggatgtcactgatgtaaggaaattcctggggatgacaggatactaccgaaggttcattcaaggctatggtaccatttgtagacctattcatgacatgctgaaaaagaatgggtttcaatggggagcagatcagaccacagcttttgagactctaaagcataagctgagaaccagccctgtcttggctttgccagactttgatcaagcattcaccatagaagcagatgcttgtggagtcggcattggggcagtactaatgcagggagggcgacccattgcatttttcagtaaggctttgggacccaaggcagctgggcaatccatatatgagaaggaggctatggctattcttgaagctcttaaaaagtggaggcactatgtgttgggcagtaaattgatcattaagactgaccagcaaagtttgaaattcatgatgggtcagagattggtagaggggatacaacacaaattgttgctaaaattgatggagtatgattataccatagagtataaatctggaaaagaaaatttagtggctgatgctctgtccaggctaccacaaaaggaagctgttgcagacaggtgtcacccaatgactgtggtgatacctgagtggattgtggatattcagaggagctatgaaaatgatgtacaagcacacaaaattctcagtttgattggtactgcagcagatccagatagagaatataagcttgaagcaggattgctaaaatacaaagggaggatctatgtgggagaagccacggatatcagaaggcaattgatcacaacctatcattcatcttcttttgggggtcactcaggtatgagagcaacccaccaccgaatcaaaatgttgttttattggcatgggatgagaggggaagttgaaagattcataagagagtgtcctacttgccagatcactaagtctgaacatgttcacattcctgggttgctcaatccattagaaataccagatatggcatggactcatattactatggactttatagaggggctaccaaaatcacaagggaaagatgttattctggtagtggtggatcgtctgaccaaatatgctcatttcatagcattagcccatccatatgatgtggagcaggtggtagaggcgttcatgaacaatattcacaaactgcatggtatgccgatggtcatcatcactgacagggaccggatttttactagcagtctgtttcaggagattttcaaagcaatgaaggtcaagctgagatttagtactgcttatcacccacaaatggatggacaaactgaaagagtcaatcaatgcctggagtcctaccttagaaatatgacgttccaagaacctcacaaatggtattcatggctggcactagctgagtggtggtataacaccactttccacaccgcaattcagatgactccgttcaaagcaatgtatggttattctcccccacaaatcaatgaattttcagtgccatgtaacatatcagaagaagctagggtgactattgaagaaaaggaagcaatactgaacaaactcaagaatagtttggctgatgctcaacaccgaatgaagtattttgcagataaaaatagaactgaaagaaacttagaagttggggatatggtatatttaaaattgaaaccctatagacagtctgcatttgggatcagagggtctctcaagctaagatccaagttttatggaccattcaaggttcttcagaagattggccaattagcttataagcttcagttacctgatgatgctcagatccaccctgtgttccatgttagtcagctcaagaagcatctggggaagcatgctattcccatgtccaatttaccctcagtaggaccagatgggcagattaaaacagaaccactagcagttctacagaggagaatggtacccaggaaaggagttgctgtgactcaatggttgatattatggcagaatttgtctcctgctgaagccacatgggaagacgcatcagtcattcaagcaatgtttccatcgtttaatccttgaggacaaggattgtcttgaggggaaggtaatgtcaggattgagaggaattctgagatttcagaaatattctaagtctgaaaacctgaagatgcagtttgaagtctgaagatgatgtgcgaacgggaggaagcagagttatgaagatccaacggtctgcagtgattccgaagaggtatcgcaggatcctaaccattcacatgttgtcggggaccactgtagtggtaaattgttgttttctctgaattggtgtgtgtgtgttcagtggcaaagaccactttggaatccttatgtactcctattaaaactattggcttgtggccaggagggagataagaaaaacctcattatcatttgttcttaggagtagggtaaagtagatctgggagaaacgagttcttgcggcgaccacctattttcttcccgatttactctgtttcgagcgaacaaaggagagagagaggcgtccatttccaggtgttttcagctctgatcctgacatcccccttcctccaccatccctgccccatcctaactcaactcccccttcctgctgttgggccagatttgcccgacgacgacgaagaggcggccatggcgatgagctcagcgcgcggtgacctcggggtgccatgtgcttatgtgtggatatcaatcactatgtttataacataattaattttgatgctgatagagtgataatgctatggtgtaaacaatgtggtctaatctaggttggcaggattaattggttagatcctgcgccacgaatttctgagttatatttctgacctgtaagcaatgggaagttttatttctgatctatacgcaatgaagttctatttctggcttgctatggtgtaagcaatgagggcaagttttatggtagatgtgactaccacatctaattttatacatgatatacatcattaaattaagaggtgccatatataataggttgtctctaccacacaatccccaatatatctaacactctcacatttttttttagataaaggatttatataaaacccggcttctacatccccaagaatgtacacagccaatcaagtccatacaagagcactaaggctcctcccattacatgggttacaaaaacatacttaaaagtaacataagaagtaccaagttcaactaacatgccagctaacaagacaaccaagcaaactcaacaaacaagcttaaacaacagtgtaagcttcaattctccctctgaaattccagccataattagagaagaattctaagaccctcatctctaacaccttgcaataatttttcaacatgttgccatcctcttccttaagcaacaaagaccaaagtcttgcccagtgtgtccctctgaaaattacctgcataaaagagtaagcacatgatccattaaaaaccacatcattcctacttaaccacaccgcctagcacaacgccgctatgcccacaaaaacttgattttttagcctaatgttaacaccacttagccaactaccaagtaaatgagacatattgtgcggtgggcagatgccaaaagtgaaatgtactacgctccacacatatcttaccatggggcaatcaaagaagaggtgttgtattatctcatgagacctacaaaagcaacatctaaggctacctttccacctcctcttagctaaattatccttggttaaaatgaccccctcttttaaataccacaagaagatctttattttcaacagaagtcttagcttccaaataaaagattgccttggtatcacatttccaaacatgagttttttatacatcgagttgactgtgaaagttccatttttactagcatcccaagtaaacctatccttttgccctctaaggtttatatcaaccacgttagctacaatctcatgccatgctttcaaattatctcctattatggctctcctaaaggagacgttcaaaggaaccctctccaacaccttagccaccaccacattcttatttcttacaagattgtacaacgatgggtatcttttctctaaagattggtttccaagccaacagtcttcccaaaatctgatttgtaaaccatcctgaagtttaaacgagccaaaagagctaaaggtatgaaccagttttgcacccaaagaggagagcatactctctttcaacctctatggctttgccaaaacacaacaattcgctcttatgaaaattaatcttcaagccagataaccttttgaaagcacttagtacaagtttaagatttttagcatcctctaggtcatgctccataaaatgtatcgtgtcatctgcgtattgaagaatggaaagaccatcgtctactaaatgtggaatcactccatgaatcttaccatgctcgcttgttctctgaattaacactgccagcatgtctgccaccaagttgaaaagtaaaggggagaggggatccccctgcctcagtcccttttttgtttgaaagaagtttcctatctcatcattaactttcaccgctacactgccacctcttaccacttgatcaatccacttacaccacctaggctcaaagcccttcattcttaaagtttgttgtagaaacttccaatcaaccttatcataggctttctcaaaatcaagcttaagaataacaccatccttctttcttttatgcatctcatgtaaggtctcatgtaaaattatagctccttccataatgttcctaccctttaaaaaagctgtctgagaaggctttatgattttttgggctaccaacacaatcctatttgccaagacttttgtgaatattttgaaacttacattcaacagacagattggtctatactattgaattttctttaacttccttttggtttggaagaagagtaattatcccaaagttcaaactatgaaggggaagcctacccagatggaattcgctaaagatggccattaagtcatccttgattacctcccaaaacacttgataaaactccgctggaaa

SEQ ID NO: 83734 - DNA, 784 bp, Oryza sativa
gatgtgcaatggtgcatagtggcggtaaatggggcagctcaagaagaatataaggagtcttttcttacagaacttgtgaatgcttgtagtagggattctttacctatggtaataggaggggattttaatatcataagaaacccacaagaaaagaataacgatagatataacgacaaatggcccttcttgtttaatgctgtcatagacagtctaaatttgagagagattgaactctcggttcgcaagtttacttgggctaacaacctacaaattccaacttatgagaagttggacagggtgttagttagtactgaatgggagttgaagaatccactagctacagtcaaacactgagtagagaactctcagaccatacaccattgctgctagactcgggataaggaacacatataaataaacaacctctgttcaaatttgagcttgggtggttgttaagggaagatttttatgggttagtggagaacatttggaaaaaggaggacagaggggtaacaaagatggaaaaatggcaaaataagatccgtagtctttgtcaattcctaagaggatgggcgaagaacgtaagtgggtcatacaagaaagaaaaggtgaagttgttagccttgactggggatttagataaaattgcggaaactagacttttgattagtgaggagttggatcgtaaaaatgctatgaaggatagattggcaaaactgctaagagaagaggaattgaagtggtatcaaagggctaacactaatagagtattagaaggcgatcg

SEQ ID NO: 83735 - DNA, 3566 bp, Oryza sativa
ggctccggccacggttgggtcgccgttggggaagtggggatggtgcggtggagattgggggaggggacggcgacacgtagaggagggggtcgatgacggcggcgggcgaggtcggaggccgcgcggtcgacgcgctccgcctccgtcttcaccgtcagtcgctcgagctcgccgcctccaccgcgaccacctgagctcgctccaccgcctgctctgccgctgccggtggcttcccaagctcgctccgcctccaccgccgctcgagctcgctccgccttgccgcccgcacgaacgaggtccacctccgtcgccggctgggccagctgagagagaacttccgtcgccagccagagcgcgcgcgcgtgcaaggggacttggagggatacgtatgacatgtgggcccagagaatattttttattttctttgctgactgtattgccatgttggcaccacgtgtacaaattcaagtaaaccgctaacagtacttaggggggttatttgtccggtatgaatacttgagggtgtaaaatatctggttttgttgtttagggggtaatttgatcgactgcgatagttcgtaggggtaaaacgtactttttcctccccaaatcgccaaccgtgtgtgcaaacatttgctgcgcagcagcttgatttcagttatatatgaagttagcaaatctctgtgagcttatttcgatgatatatctgttcctgtactcgtttttttttaccctgatatatatagctaccataacaaaagagcaccgaattggagttgcaaacaaaatattgataatatacctgctcaaggcatgtataaccaataaaggaaacaattcataaggcaaaactctaccaactactcttgcactcaccaagagcgatgcgttatgagcatcctcagtcctcgccatatgaattgcgaaactaatgcaaatattcggaatagggtttaatgcaggatttatgaacagccgtaccttctattttttcgcttgaacgccaaagcaattttttttttgtggaaccaagtataagtgatttgaataattatacaatctttttactttgaagtagctaactttatatttgttgtactttagatcatccccgactattttcactagccatgtccatcatatattttgttaaacgtatggtctgttcgtaggtgaaggattttgccagtgtaccagagctgacatcctcaaagttgttgatgtgctaaagaatggacatatattccggtaaaggtttgcttggtccataatcgggcagaaccaccacacatctagaccaatctaacgaggacagaggatagaaaacgggcgataccagcaggggaccacctatacatttgtcgacaaattttctcctaaaaatttaacatatgtaattatagttatgtaattatagtttaatcgtagtgtaattacactctaacttatatgtaattatactgtaatgtaagtttcacttaattttgaatcgttatatctgttacaatattaacatatgtgaaagaatttgttctcacgatcttcattttaccgaaataatatgttacggggagtttttgaaagttacatacaagttatattatagttacagtgtaattacatgtaagttacagtgtaatcacactataattgtactgtaattacatctgtcgataaatatatagcaaaattgatatctaatccacgagagatcacttgttgggtgggaacaccgtgaagtatgtctgtgtagcggctagagcgatgacgaatgtggcgacggcaacggagatggccgaccacgggctgggaaaataattgcgccggagcccagccatgtggctgtgccaccatgtcccacagtagcgcgtcacgtcgtcgtacagtccggagaaggcctgcgagtcgtagcccgccgggtggcagtcgtcgaggcggttgaagaaccgggccgcctcctcgtcgttgtccaacaggttcaccacgacgccgcgccggcggagcagctccacgtcgcgtgctgtcacgatgagctggctcatcagtgccacgtagctgctcaggagcccctcctcctcgccgcgctggctctgctcgaacgcgagcaggttcgcgagcagcggccgcctcgcgtcgtcgatcaggactgtgggtatctccattacgccccagcgggcgtcgaacgccacgtcgtacctcgtcccccctgcggcggccgctgggctctgcgcggcgacgaactgtacccccgcctctctcatctcggttgcgcatggtatcacccgtggcgtcctggtgatcgtccgtcggtcagaccgtgggcctcggcggcttcgcggcggtgttcggttgggaatgaagctctggtagtacagatggaggaggtggtggacctcccagtcgccggaaggccatctcattggctcttcgtcctcactgccgaggtacttgacgaaaaggtgaaggagggactccctgccgtgctgggcgccgccgccggtgactgcgccatagagcctctcgaggacgaagaacgggatctggttctccatgaggagcaggtcggcggccgcggggacaagcgtgaggccccttccagcgtcgcagagcgcgtcgggctccttggcgtgccactttaagaggaactcgaggatgaagcagccatcgagcaggagcatcacgatgaagtcgtcggaggcgaggccggcggggcgctcgctgtagcaggcgcgcgcctgggcctccagggttctcatctctgcgaccaaagtggacgcgctgaccgccgcgacactgccgtcgccggcgtggcgggacagcaggccctgtaggtagtgccacttgtggtcctccatggtgcgcagtgcggcgccgccgtggtaataggggccgatggacaccacgcgcggctcgtacgaggtgcgattgctctcgcggacgttggcgggaacgcggaagatggtaaatggctgccgcgccctccattgatctcctctgagggcatccaacgttgcctccaccgaagattccaacgacgccacatccatgagatcgatagcaaaacgagagaagtgatggtaggaagaagacacgcatgcaacttgcaaatgctcccgtaataaactgataatacactacagtactacaacatcatgaatggtcatcatcgaagcgcgtcgtcgttgacatttttgttttaatccaacgagcagaaatgaacgaccgccaacgcgttgattcgttgacatttaggtgagcgtcgctttcctgtaacttcctgttaggtacgcgcgcgaacatcttatttatgttttataaatttaactaaagatatcataattaggttttataattccaaccgatccatcacatattcacatgctcggggcactgagagcaagtttaatagtatagccaactactagctccaattcatccatagccaatctaatagctcatatatataatagttacatactatattattaatatctggtcccacctgtcatatacacgttacatcttggagaccgtgctacagctggctacaaatctgtagcccgctg

SEQ ID NO: 83736 - DNA, 2672 bp, Oryza sativa
  unsure (1)..(2672): unsure at all n locations
cttccacatcttttgatcccaccgatgatggggaggatagcctcgcctctgatcccaccgaagccggggaggataacctggcctcgctctgggaggacgccggggacgccgatgacatcttcgccgccgatgctatggtcgacgaggtgctggtcgaacgcgtctgcgctgttgtggagtccacccccgaggatcagatccccttcgccctcgctttcaaggtcgtggacttacaacgagccactcctcgccgccattctcgtgtccaccgccaagagctgctccggtaaaaagctactcctccagttcaaatctattaacttattaaaggaatagaaaaagaaacctccacgttcactctcaaggcctagagattctcacattaatcgggataagaagaaaagtagagtccatacaaacatacaatttaaaagtaacaaaaaattcagaattaaaatagggaatatagaaagaggagactagagtccatacaggtatacaacttagaactaattgatattcggaattaaagaaagaaaactaaaactacaagtcagagtccctatagaaatacaatttaaaaataactaaaattggaattaaaaaaaataaatattggaagaagcccatattgaatataatttagaaaaactgaaattcgtaattagtagaaaacaaatattgaaagatgagtttagagtccatatagaaatacaattagaaacaacagaaattcggaattaaaaaaaacaggaatattgcaagaagagtctagagtccatatataggaatttagaataaattgaaagatgaaattaagaaaaaaagataaaagtagagtttagagtccatatagaaatacaatttagaaataactaaaattcaaaataaaaaaaaagcaatattgggagaagagtctagagtccatataagaatataatttattttggaattaaaaaataaggaatattgaaaaaacatagagttcacataggaatacaatttataataacggaaattcggaattaaaaagaagaatattggaagaagaatatatggttcatataggaatttagaactaactgaaagtcagaataaaaaaaattaaaaaaataaaagtagaattttgagtccatatagaaatacaatttataaataacaaaaattcaaattttaaaaaaataagcaagattgggagaagagtctagagtccatatagtaatacaatttagaaataagtaaatttcgaaattagaaaataattaataactatcaatacaatacaaaattcaaaattgtgttgctatttttaatatattataataataaaatatggaaatatttaagctattatatgaggaaaaatataatgacgttagccgcgtaatctgcgcgggccatcatgctagtttgtcaaaaagcaagtgaaaaattcatccaagttttgaaagtgagggagataaaaaacgaccccttaaagagagatttgataatttaactcttcttaaacgagcgtcacttcgattatttaatatcttgattcactttcattcactcggatagacccacgtatcatgcttataagtgttaattaaagtaaattgaccataaaaaaagttaaattattaaatttatcctcagagtcatcagaaacgaaactagaccaatttaacggaggcctaacttgggcccaaatcaagcccatagataatgagatgggcctgtggggcccactaagcactaggagcggaggcaagagactctccgcgcacatgacgccttcgtgtgctttggactcctttcccccgccgccgctgcctcttgccctctcgtctccggccaccagtccactgcgactgcttgacatggcctcggcgccgtcggccttcatcggcaaccacaaggtcagttacctacctccggtcaatggcattgaggtctccgtagagcaagcggtgccgtcctcttctcacatttcggctggcgctgaaacctaacataacctggatccatggcagcggcgtgggcgtggtgccctgtggaataggagcttgtgtgtttgtgctcccagcaaagtggggtgagggatgtgtggtgttttggatttcggggggggggggggggtggnagggggagccgtcgcccatcaggttctcctcgtgggcgtgagctttcattcacatgtggtgtaccggtgtggtgtagccacagtcggagtgggtgatctccgagatagggtctgtttggttgtctgcggattgagaatgtgcatactgcagctggttgaatccgtcagataccagagcgacatgcgtgtttcagtgtttgtcttgcctttagggtttagcggttgatactgatgaaatgagagtctgatcctagagatagcatggcctgcaggaggtcatttgtagcgggttggacaccacgggcagtggacgagctgttagctttttgcaaacgtgtagtacatccgttcacggtagagccagttaggccagttaggtttagtatatagagattcacagcagtccttgatgagggctaacttcatgagttgtgaaattctacagttataataactaataaacagtggtgtgtgatggattaagatggcgtattgactggcaaatacaattatacaacagtagattatatgcctttgctatgaa

SEQ ID NO: 83737 - DNA, 1172 bp, Oryza sativa
gatcactgcatagatgcgcattcagattgtgttgtgtgggtgaggattgctacaaatctacctgttaatgtttttttaaaggatccatgtatcttttatttctttgacatgtagcctgctggattcagtagacggtagaatcatataacctggaaatgagcagctcaatctgaatgtctttttgtgtcttacagttagggatgaaaacggagcggatatggacggataatgctcataccatattcgttttcatattttttaccggatacgaaaacgaatacggatagctcgaatacggaaacaaatacggattatctcgaatacgaataagaatcgaatatgatcggacacaaatatggatacaattttttctcggaacataaaaaccaactcaacttctaatggaaagaaatatcagcatatataattagctcattttatataaaatgaggtataatttataaatattttttaaaatttaaataatatattaatagtatggactagtgttaagagataaactactattaaaatctataaaggtatattgaaggtcatagagttagaaagaaatggggtatgtctcatgggtcctacggatatccgaatagcactgttcaccggatatccgaattattatccgtatccgacggaaaccctggtaccatattcgtattcgtatccgggagaaaatatccgtattcgtatccgtatccgaactattcgagaattatccgatccgaaaggtatccgtatccgtttttgtccggagcggacggaaactatccgctccgtttttatccctacttacagtatgtaactcaaacctggtgttcagtacaagagtccataatatgctccatggaaacgctgaaaattccatctaagatttggattcaacttatctcgaaaatgaagctgatgttcgtggaaatgaggctaaagcttccttcagtactacgctttcccacttctactcgctctaacttctactcgatcgtttttcacgcgctccttaagctaaatatatccgtactcacgcttttttaaactatttaacggtgtattgtttagaaaaaaagttataggaaagttaatactttattaatcatacgctcatctcttgctccgtttgggaaaaaaaagagaaaagtttcataggggcccaaaaa

SEQ ID NO: 83738 - DNA, 510 bp, Oryza sativa
gcactggatctgctactgttgagccagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgataaacaatgcatcgaaggagatgggtttgagacccatgtgagttatactatggtggtaacccagtctatgtgatcggagatcccgtgaattagatcctgggaagaacaaaccattagtaaactagaggagagtatcaatatatataccctctccaagtgaagatacatgtactctcgtgagctgcaaggcaggttggctatgccttaatgagttctgttggctttaat

SEQ ID NO: 83739 - DNA, 714 bp, Oryza sativa
cggcccgcctgcaaagatcaatcttcgcaggcagaccgccccctccaccctgggtactttttttgccggcggggttttggctccgaattacatgcccgcctgcgaaaatcgatcccctacgacgccgaaaatgagttttctagtagtggcaaggaatcaagtagagagtttataatgcacctcagcgtaagcatcgatgctatggagggaagagtcgatgcggacgatgctcccgacggcgaccccacgtatccacacgggcgtgcccacgcagatcccgcaggcctgggtgaactcgaagacggggcctggtacttgccgaagcgggagcgcagctggaacccacggatccacgccaccgcgagcgcgagcagcgccgcgccggtgaccatgaagagcccaacgccgccttcccacacgccacagcgccccgggcacctcgacgagcgccgcgagcgggttccagccaccggtcgtcggcgtcggcggcggagcacgcgacggagctagcttgggctcggtggggcctgggcgcgcgggcggagaggtgggttggggagggaggaggaatggcttggtggtggccatggatgattggtggaggaatctagcgagagatgcggatcagttcttgggggattggactggggggaagcggcagtgcgggacacaaagaatggttttgaggaaatttgttcggaaaccggagaaagg

SEQ ID NO: 83740 - DNA, 604 bp, Oryza sativa
agggaagctcctacatgaagcatgccaagaagcttggtgagctcgacccactgatgaagccgaagcaagaccggtacgcgctccggacatccccacagtggctcggccctcaaattgaggttatccgcgccgccaccaagtccatcgagcgtgagatcaactccgtgaacgacaacccgctcatcgacgtctcccgcggcaaggcgctgcacggtggcaacttccagggcacgcccatcggcgtgtccatggacaacacccgcctcgccatcgctgccatcggcaagctcatgttcgcgcagttctcggagctcgtgaacgacttctacaacaacggcctgccatccaacctgtctggcggtcgcaacccgagcttggactacgggttcaagggcgccgagatcgccatggcctcctactgctccgagctgcagttcttgggcaacccagtgaccaaccacgtccagagcgccgagcagcacaaccaggacgtcaactctcttggactcatctcctccaggaagaccgacgaggcaatcgacatcctgaagctcctgtcctccacgttcttgatcgccctctgccaggccgtcggggctgcagg

SEQ ID NO: 83741 - DNA, 640 bp, Oryza sativa
gaagaagtccatatcggcaaagccggagaagcggcggcgcaggccggagagccactcggtgtggccgaccaactcctcctccagcaccgcccagtccatccaggtgatggcgttgtcctgacaataggcattgttgttgccctgctggctgcgcccagcctcgtcgcctgcggtcagcatgatcgtgccgcgtgtggcaaacagggtcgaaagcatggcttcgatatcggcgcggcgctcgttcaggatagactgattgtctgtctttccctcaacgccattgttccaggagtaattctcattgtggccgtcgcgattgttctcgccattggcctcattgtgcttgttctcgtaggaaacgagatccatcagcgtgaagccgtcatgggccgcgaggaagttgacactgcggctctgtgtgcgtccgtcgcggccgaagatggaagaggagccggcaagaatcgttgcgagctcgccgatccctgcgtcgccacgccagaagcggcgcaagtcgtcgcgggcgcgatcgttccattcgaggaagggtgccgggaagctccccagctggtaaccgcccggaccgatatcccaaggctcggctatcaggatgcgatcccgaagcacctcgtccgccaacagg

SEQ ID NO: 83742 - DNA, 648 bp, Oryza sativa
atcattacagataatggcacccaatttactggtggagtgtttaaagacttctgcgaagattttggtatcaagatttgttacacatctatagcacatcctatgagcaatggacaggttgaacacgccaatggtatggtacttcaaggcatcaaagcatgagtttttgactgactgcgtccctatgccagcaaatgggctgatcagctgccataagttctttggtctcttcgcactacacccagtcggcctatgggccaatcaccgtttttcttagtctatggtgcagaagcaatgttgccaagtgaggtggaatttgaatctctgtgatttcgtaatttcaaagaggagcgctacgaagacgaccgagtaaatgatctcaaccgactggaagaagcccgagaagcagcattaattcagtcggctcggtatttacaaggattgcggcgctatcacaatcgcaatgtcagatcacgcacatttttagtcggagatatggttttgaggaagattcaatctacgcgagataggcataagttatctgtatttcagaaaactgcaactatagtgataaaactatcagtttgctgtaatggagtgtacaaaccatggggattcaatttcgattttgctttatgacccgtggttcgc

SEQ ID NO: 83743 - DNA, 1586 bp, Oryza sativa
cccttatattatgggacggagggagttgtcattttcggctttctttttgcatatgcagtgaaagtagctaaatgagatgcattcttctgtcaggtcgaatgaggtgtctagcagccttggcccgttgggaagatttaagtgcattatgcagggagcaatggactggctcagaaccatctgcccgactagaaatggctccgatggttgtggatatatcttgttatcaatttactgtgtatctttaacttgtagttctgctaatttaagttctaatttccttttcttttttttttctaggctgccaatgctgcttggcatatgggtgagtgggcccacagggctgaaatgtttctcgtctggatgatggggatgaaaacaagctccggatattgggtacacaacagctagtggtacggaaccagcaatggtgcttctttagggctgttctttcagttcgttgcaaaaaggtatgcttgcatatttgttgatttctttttccatttcttcttgaaaatttggtcatgcttttggttacttggcatttgttttgcagtatgaagaagctcgtgtatatgttgagagagctcggcggtgtttggctacagaacttgcagcattggtataacattatagtcaaatatattctttacataatctccattattcgaattttcatattatggagacatttgtttttgttcatgtttagggatttgccattggtttttgggtattgtggggtggggccctaaatactagtagctcttactgtcataggcagtgggctgagttgtccaggccctaggggtagggatctgttctagaaggaaatttcggtgatcttttctgagacctagaacaaatatttggaaaacagacataatagtattcacgggtcaggtgctggttgagaatgctgtagaatggacattgaattgttagctgataggatgtaaaggctaaaaagatgaacttctgatttttaacagactgtatagatcgtttcgatggttggatgaatcatacaaccactgatcaaggggataaatggtgacaaagtaaatttgaatgtgaagcaattaggtgtaaaccttggaactcaatatttataagataatataacagttgaaatatctctcatgtgactggtttgaataaattggttaagtaattttctttagttctttttttacttagaaagcaaaggtgaatgtttatagtactgatgactaatatcccctcttagagttcagtaattgtaacagaacatccttgttttccctttcgtgatcctattcttgtgaccaggtacttgagagttatgagcgtgcttataataatatggtgcgggttcaacagctttctgagctggaagaggtatatcctcatttcggttactttctaaagaaacttattgtcttgctaaccaaatatatgacctggacttcaggtgattgattactgcactcttccaatggaaagtaccaatagctgacagccggagggaacttatccgtaatatgtggaatgagcgtattaaaggaacaaaacggaatgttgaggtcatattatgcttcttttaactg

SEQ ID NO: 83744 - DNA, 726 bp, Oryza sativa
cctgtaagctatcatcaacaccttttgtcgtggatgcgcaagcaatagagtagaaatacccagttactgctgcaacaacatattttcctgcaatatctggtcgaccacgcaaagtatagcgggacatgacttcagtgttgaacaaggcccataagtgccatgccttgccccagtccttggcattaagtgtggcatttttgtaagagaccaatatttctggataaagaaaaaaagtatatttacatcaaaacgggcaggcagacaaaaagtaaaataactattttttcaagtctcaatactttggtaggcaatcttgcccacccacccctcaagagggaaataaactgaagttattcagaccttgaatagaatcatcgtctaacccaggtgataatgctctcttccagctagcaagtgtcaaatagacgcgagcaataagtggtactccagcatttgatgtggcaacctggcttgctaatgttccagaataactatttgttgcggtagcaagctgcacagacaaatcctataccacaaaaccaaaaaggaagtataaaaaaccacttaaatgcagaataattctgcaacttggggtcaaagacgaaggacaataacaagctcacctgtagcctgcaaaacgcgtcccttcgtttaagctcatctccaacagcatactggtacttcagggatgccatgactacttgaggatgtccatgatacagcgtc

SEQ ID NO: 83745 - DNA, 1102 bp, Oryza sativa
acaaccgtcccactgttgacgcaataaccttatttttcctttaagaaaataaataattattgcgtaataaatcggtaataattctagaaattcatttaaatagctcaaaacttctaaaattcatatttaaatcgtcctcgaatctgtttcttccgtgccaaagaatggtgacaaatcaaccacattgaatgtgttactaactgtgtaatcaccgggaagatctatcttgtaagcattgtcagtgattttctccaaaaccctgaatggcccatctccatgtggcataagcttggacttccgcttctccggaaaacgatccttacgaaggtgcacccaaactaattcaccgggttgaaatagcatcttctttctgtctttgtttgcctttgcagcataggactgaattatcctctcaatggtctccttcgtcttctcatgcattttcttcacataatctgcacgctttgttgcttccatattggcacgttcttgaagtggcaggggcagcaaatcaagtggtgtgattgggttgaagccatacacgacctcaaacggactgagttgagtagtagaatgtaccaccctgttatatgcaaactccacatgtggcaaacaatcttcccattctttcaagttcttcttaatcatcattctcagcaacatagaaagtgttcgattcaccacctccatttgtccgtcaatttgggagtgacaagtcgttgaaaacaacaacttagtcccaagcttagcccacaaagtcttccaaaaataactcatgaacttgacatcacgatctgatacaatagtgcgaggtactccatgcaagcgtacaacctccctgaaaaacaagtcagctacatgcgacgcgtcgtcgcttttgttacagggaataaagtgtgccatttttgaaaatctatcaacagctacaaatattgaatccctccccctccttgtcctaggcaatcctagaacaaagtccatactaatatcctcccaaggtgcattaggaacaggtaatggagtgtacaaaccatggggattcaatttcgattttgctttatgactagtgacacacctttgcacatacctctcaacgtcatgc

SEQ ID NO: 83746 - DNA, 528 bp, Oryza sativa
gcacatgatacttctcccagcctttcccatccaaacacttagaatatggatctgaaaattcactatccttagagtacaattctttcaaactctctaaacttgaaactttcacgtctaattgagtcaaaagcacactcttgcgagataaagcatcagcaaccacattctcttttcctttcttatatcgcacaatgtatggaaaggactcaataaactcaacccacttagcatgcctacggttcagattagcttggcctcttaaatatttcaaagcttcatgattagaatgaataacaaactccttcggccaaagataatgttgccaagtttccaaagcacgtacaagagcatagagttctttatcataaacagggtaattcaattgtgcactaccaagcttctcactaaaatatgcaatgggcttaccttcctgcatcaaaacaccaccaataccgattccacttgcatcacattcaatctcaaaagttttagtgaaatcaggtaaaataagcaatggtgcttcagtta

SEQ ID NO: 83747 - DNA, 1647 bp, Oryza sativa
aatcaattgtgttaacatctctatttttaagaattgggatgatgagttggcatttggagtccaccgttacatgtgccttccttgggcaacttagtgcacatcatgacctccagaaatgtggtactgattatcataacagatattatagctccataaatcactttccatgagatgttggtgtcacttaactcaataccaagaacaatgttaatggctgccaagaaaatacaaatcctacctaaccaatggtggtactggttccaacatttccgcacctgagaatccttattaggatgaaggaaaaatgcaataacctgtaacatgtagtacatccaatggcttcagacataacagaaatgaatcaaatgataggcattagcagtcaggatggcaaaattagttgcatgatcatactaacctgaagagaaccgagagcaagaactgaaatgccaaggcttctatgcgtagtaaaatttgaataggtcctgttgtacaatgcaatgccagaaacaacacccgcaaacccaatgatgtaaccaagaaattgcacgaggacatgaaggtaataccaaagtgggtccttatgtctgagataacgagcagcaattgctcccagtggtaccagaacaccccagccaaaaattgcaaatgcaccatggttcctcttcaattggtatggataataagtactaacagaatcacctgcgtagaaaaaagttaggttcaggtagtattgaaaaaacattttctaaaagaaaatttacattgcagtaaaaaatgatgtgaaaaacagataaggcttgcacttgtactatcttttatgttgaacttttgctgatgtatggtgctaatattttattacttctacaaaatcagttgaatgtagaaagtgttttttaaatgtttatgttatgatgtggtatcaccatatagttgatctggtaaacattcttcttttacgagttctaacaaacattggctgaaccttattatttaatgagattgtctttgtgacaatcaggtaactgattcagctagatcgatcgatttttttcactgtatgcattgcataatgtattagctgggatgttttttcatgttatccaatacaaatgtcaacaatttttagagacttggttttatatccaataatcaccctcttctcaactgctcaatacataccctattcctttgctgtctgctatcaaacaccccaggaatttagccatttatgtgaaggccccatttattgcatgtaaaaattactccactcctgtagaacaacggtttcctgtgatggagttcaaattcctgcattccagatggagttcaagttcctgcaaatttcttgtgacattccaagtggggctaaaattgtctctgctaatttttctacttctatttttctggcgttatcttcaggtatcactgatcagattctgttcagcggtctcaaaagtctaatgcatattccccttaatacaaagatgcgctccctgtgtattcccaaaaaaaaagtctaatgcatccttctgagatcagaatttaaatcgtatttacatatgtaggtaatattcagaaatgcaaatgcccggtttttggttaacttttctaatattttctgttttggggggcgccagatacaca

SEQ ID NO: 83748 - DNA, 564 bp, Oryza sativa
agatgtcaaactgacatgttccaacattgaattgcaggagatggtctggctggcatgaagcaaggggatctgataatttggtatgttgagcagcagaatgcccaaggagcctatagttctacagcagaggtgaaggaagaagtgaagtgcatcaaggccatcatagaggtaaaagccttcattgatcttatcatctatgtatcaatttgcctgcattgatcctatcagttcaacagtatggtatggaaattaacctaacaagactacatttaaggcatttagctgcatcaatttgcctgcactgcaagctcaacattgaccatttatattgagcattacctcagctttccatgttgctaaaagttatcaatcgatttgcaaatgcagaggttaatacagagggatggccatctcatagtgatagacgaaggagcagccccagcggctgacgacggtgctgcacgaagaacatcagagagcagaatcctggcagttaatccgaactatgtcatcgattaaccatctgaattatgatacgcagctaacacaatccaatcgatgtgg

SEQ ID NO: 83749 - DNA, 700 bp, Oryza sativa
gcaaacgagcgcccaatgtcaactcccactagatatagaagcagaaattaacagaaaaatataattgcatgatataataaggatgttgcagctttgggatttaatacagcaaaaaaaaacatgttgggttcaaaaacagacactttttaacatgtgcgtactgtttttccaagtaaagatccacaagtaaggaaaaccagaatatatcacatcataatcactacaataaatggaatggtttacaaagttcacacttacagctttgttgtcaaataacttcggcatactcctatctattatatcctttaacatccttggtgctaagggtacagtatcagagatcattctcaaactctcatgcaactgagaatagatttccttcttccttgcaagccatctcggttggccgatgaaagcagtaagtgatccaggtggagtgaagttgttcacaagcatctgcaaacactctcttaagaactgatctgccactgcagcctggatggtaaatcgattgatcagaagcttatatacagatcatccagggcaatgtgcatgtggttgtagaaaataataccaatctggtgattaatgacaaaagagcatcccttgtatcgctgttcaagtaccagatagacatcgtaaatatctgaaaaatagtgccttcagtaagatccagttgattcagcaaaagacataaagt

SEQ ID NO: 83750 - DNA, 864 bp, Oryza sativa
tgatttttgtgactgttctgagttttgttcgtcttcgtctgtttccagttccacctcctgaagcagaggcagctgttgaagcaacaacgggagcagcagctcgccgcggcaacagcggcgacgtggggcacgcaccgcgccggcgtcggcccgccgcttggtctgaactcgtccggctggccaccgctgcagaagtcccaccagcaggcgtcgtccgcggccggcatgcgcgccgtgttcctcagccctccaggaggcaaaccggaacgcacgggcaccggcgtgttcatcccccaccagggcggcgcccccactgagcccaagaaaaagctaagtgcgcacctcctctgaagcaacgcaatgctcaccacccagaagcgggtgcagccgctgccgacgcatgccgctgcacgccgtcctcctcccggacgtaggactgcagctcggcgaggaagtcgccggtccgtgttaaggcgagcagagcggcggcgccctggaagatggcgatgaggacggcgggagcaggagcagcggagtacgacgaggacagagggagcggccgccgcggcgcttgcggtggaggacggcgaggacatagaagccggaaccctcgtgcggacggcggcggtgagttcggtcccctccttgaaggggacgcggcgcgcacggcatgggcgtgcgagcgaggccaagatctgctgccgcacgaggcccacccggtcggcgacgacgacccgcagtttgcggacgccgaggaagggctggacggtgacggtgccgaggtcgacggtttggtcgccgtcgacgaagacgacgggcagcacggccgtgggcggcggcggtccgcgtgctggtggttgagct

SEQ ID NO: 83751 - DNA, 721 bp, Oryza sativa
ggatccccctatgactatcttacccctcatcgccaaagtagaagtatttcagcatgccctagaaaacagtgaaggaaatgaccttgcaaaggtactgtgctgtttttgtcatgccaaattggtgctttctgagacaatgtttaacattaatctacctgaacaaacttgtgtcaggttctctggcttaaaagccgaacctctgaagtatggcttgagcggcgcacaaattatacgagaagtctggctgttatgagcatggtatgatttactgtcatgttctgtttttgtttttgaattaaatgttcttttccatgttaagatgcttcaatgttgattttctaggttggctatttgcttggtttaggagatcggcatccaagtaatcttatgttagatcgttataggtacatctacaaaacttctcttcctgttcatcattgggcaattgttttcattgcgtcttctttttttgttgcttcagtggaaaaatattacatattgactttggcgattgctttgaggcttcaatgaatcgtgaaaagtttcccgaaaaggtaaggatgtgttctggacattatctctctccaattaataatttattctgtagctcgatgatgtatcattttatggtcttcctttgacatcaaattatttttcatgtgaggttgtcattatctcgtacgcattgatccataagagtatggcatttcattattgtatg

SEQ ID NO: 83752 - DNA, 691 bp, Oryza sativa
ctcctcttcttcctgctcttctccaccaccgcgctctactcctccacctcgtcgtcctcctcctccgccgtgctccgcgccacgacgacgacgacgaccaccaccacaaccaccacgaccaccaccaacaccttcaccctctccttccaagccaacccaaaccctcccccatctaacctctccaaccacactgccctggacgcggcgggggcggccgggcacacgcagagccacgtggtggtggggcggcatgggatacggatccggccatggccgcaccctgaccccgtcgaggtgatgcgggcgcaccggatcatggagcgcgtgcaggaggagcagcggaggtggtatggcgtcaaggagccgcgccatgtcctggtcgtgacgcccacctactcccgcgcgttccaggcgctccacctcaccggcctcctccactccctccgcaacgtgccctacccgctcacctggatcgtggtcgaggcaggcggcaccaccaacgccaccgcgtccctccttgcacgctccgaccttaccatcgttcacatccccttccctgaccgcatgcctcatgactgggctgaccgtcacgcaaccgagaatcgtatgcgcctccacgcactgcggtatgtgtgctttacttcaatactttccgctttctcatagttagtaattttctttgttgaattcc

SEQ ID NO: 83753 - DNA, 17116 bp, Oryza sativa
acccgccgccgcagccgtagtacgccgccgagtgctcgtgcggcaccgacctgcacttctccatcgtcacagcgaccacgccgccactgacgatttgattccggtgaggtcgcaggcttcttgatgagttcttgatcttgagagggatgaggagaagctgggtagtaatggagcttagctgagctgctagcttggaggagaggcagtgctataattgaggtgagggaggggaaagagatgggttttctgcttgatttattaggccataattatgcatgatgcaccttgggttgtatgggtattctaaagttgaccctgtctgttcttttttctgaccagaaaggatgaacccttgctttttgatcataccaatggcattatctaaaagagtgacataaaaaactgtcacacaacttaattaatttgagagtatcattaagtgtttgactgctcatgtgtatgttttcttagagaaaaaaggagcgtttctgggtactctcccgaatcataaacatttgatgtttaggataagatttactttaacttttaaaactttgactattaattttgtatttaatcaagtttgcaaagtctaataagcatttgagaaactattgccaataaaaaaattgtaaaggtttaaacaaatcttattataaacgttaaatatctattaacttattaaaggaatagaaaaatgagcctccacgttcgctctcacggcttagaaatttttatattaatcggggtaaaagaaaaaacagagtatatatagaaatacaatttaaaaacagctaaaattcggaattataaataaggaatatagaaaaagagacaggagtccataccggtttataatttagaactaattgaaattcggaattaaaaaaataagaaaactaaaactagaggtcaaagtccctatagaaatacaatttaaaaataattaaaattagaattaaaaataaggaatattgacagaagattctataacccatatagaatataatttagaaaagaatgaaatgcggaattaaaaaataaagaatattaaaagataagtttagagttgtcagggttatggataccacacatacctaactgtagttgactaaatctcggcaggacccaccacataccatgtcttatacggaaactaacttcggatatggagagagttccggataaggaaagacaaccagagttctacatagaaacgacaagggctcctcggattgtatctatattggtttccctaattctacttagacaaggggacacctatgggtataaatacaagctcccctatgaggagaggatcgacacccaacagaatcaacacccaacacaatcgacatagaagccacaacatagaagcctacatatgccaagatacgccgccggatatcaacttcaaggataagcacggctagtcccctacagtgtctccggatactgtcaggagagacgaaagcgctatctctgatctcgccgggcacggattcgaggaggaaggctaccctgttgtcgactacgagtcagctcgtcagaccgccatgtcgacaacagttagataggctaccccaaatattgtactggtgttattatcatgaataagagcaataccggtttcggccaacaggatgtagggttattacctgacaattcaggggaccgaacctgtataaaaatccctgtctccatctcttttaccccagtctcgcgtatatcctagtaccaacgatccccatgccatgcaaatactgtagtcgagacatcaaacgtcgacagtggcgcgccaggtaggggaattttggtgcttcaggatttcgacgagatgggttcaagagatggattctccaacaataagctactcaacgacttcggctatggggagatctaacctgaccggagcatgcccccgacaagatcggaatcaacgccgttaacttgtcgatccggcgagatcgaccaatctacgagatgtcgccgccggggataacgcgagatgtcgccgccggggataacgacggtttgatgtttcccaccgggaagcctcggccaggtcaaccaacgactacatcgaatccgattttcaacagcggacaatgatggacttcggagaaatcaactgctcgtcagctcggatcaatctcacaacacgcgacgtgatcaggcaaccgcgacgactacaaggcctgacatcgcgtggcatgagtcaaaaatactgtaccgtgaccaacacccataaatacagtacacgtacacgtctctatgagcacctgtacgtgtgcgaataaatatatgttggtatatacagagccatgatacgttggttaattaaggtaattagtaggttaattaattttattaacctattaatttcgtagatatgtccggcatatatctacacaggtatttaatattttatctgtaatttatcgtatctattcagatcatacagcattgtcagatccatgatttattatgtttacctagagcatattttttatacaatatctattgtgcaagtgtccccgatgttaaatcgactacgctttaacgttgggggctcgctctattttcttctgtatgaatcatgcttgcttacggtttacataatgcctgatatttacatctgctcgttatgtcctaataatactagaagattcatgcagttttttcagtgcatacccgatattctctgctatatatcttgtcttctagaaaatatttttcaggaacaattgagcactcgagtaggttatggtcgagtacaccgcattatcgagaacgatctcgacgaatgcagagtcgtcgcgcccaacctaccaacaaagatcgacgacctatctcatagcaccggccatggctggactactcgagaaaaggttgttaacggataattctcgtgaatgtcgtcggcttgatcacccgacatgattgcgaacggacatccggatatgctataagttgggtgcgtgagtcatgctggccacatgagacgcacttgtaataaaccaactctagcacctccattggtgttcgagagataattctacacgtttgctggtcctcgaaccagtgcgtagcaatctctcgcaccgcaacctccattggtgttcgagagataattctacacgttcgctggtcctcgaactagtccgtagcaatctctcgcaccgcaacctccattggtgttcgagagataattctacactttcgctggtcctcgaaccagtccgtagcaatctctcgcaccgcaacctcagatggttgaggtacgactacagcaataacgcagcggtcctcgtaccacgacttcaaatgatcgagggacacctactcactagttctcaaccagtcaatcgtagcgatctctcgtacaattacttttagtggttgagttacgactactacccggttcttgaccagaggtgtagcgattctcccattacctctacttcaacaagtgttttacccagagatcccttaccacaaagacacctagtgttgaaacctttcctaatgtccttttacgccatcttgacaaagcctctgaggaacctaagggaacttcggctggggacgcccagagcggataaggctatgtcggatccttcagagacgaaagatcttgtaagatctggtcgtgtaagagttctcgccgtgcgtattaaccaagccgtgtaatcggaaatggattttccaacttcacggctgggggctaggatcagtgcttgttcaaccgaggcaggtcaaaggtccaagagccttatcctccgagaacgattctccgatgacaaggctggggactagggaaagtgtataactcaacaaactgactgatcgaagtcggtaaaaaagtagacgctcatatacaaaacattggtatgtaaatttaattcattttcagttttctatacattctataacatgtcaccctttgagcattcgctcgggagctatttctatctaatatttttttctgagtattgattccaggaaaattctattcgacattgtcgaagacttcatggctctatggttctacaccaagatcgactaaggcgagtacgacaaatgttgacaaggctctgtcgcagactctgcgccttctcgagaacggttggtggatatcgacaaggaatacggaatgaagagatggtgtacccgccgagataaaatttattgacatcaatccaaattctcgattacagcaagacgggagacttagtcgcatgctctgtactttcttggttgacgtcggagattgactcagacaaaccctttaggtgcccgcacgaggctgataaaggaagtctaacgttatctctgaactcaccgagaacggtcacaagagctcgataacagttcctccaaggtctacggttgagaatatgaactcgctcatttgcattgaagtcggggggctactatcagggttatggataccacatacctaactgtagttgactaaatctcggcatgacccaccacataccatgtcttatacggaaactgacttcggatatggagggagttccggataaggaaagacaaccagagttctacatggaaacaacaaggactactcggattgtatccatattggtttccctagttctacttagacaaggggacacctatgggtataaatacaagctcccctaggaggagaggatcgacacccaacaggatcaacacccaacacaatcgacatagaagccacaacatagaagcctacatacgccaagacacaccgccggatatcgacttcagggataagcacggctagtcccctacggtgtttccggatactgtcaggagagacgaaagagctatctctgatctcgccgggcacggattcgaggagaaaggctaccctgttgtcgactacgagtcagatcgtcagaccgccatgtcgacaacagttagataggctaccccaaatattgtactagtgtgattatcatgaataagagcaataccagcttcggccaacaggatgtaggattattacctgacaattcaggagcccgaacctgtataaaaatccctgtctccatctcttttacctcagtctcgcgtatatcctagtaccaacgatccctatgccatgcaaatactatagtcgagacatcaaacgtcaacaagagtccatatagaaatacaattagaaaaacacaaaaattcggaattaaaaaataggaatattgaaagaagagtctagagttcatatagaaatttagaataaatttaaattcaaaattaagaaaaaaaaaagtacagtttagagtccatatagaaatataatttagaaataattaaaattaaaaattaaaaataagcaatattaaaataagagtcagactatataagaatataatttattttggaattaaaaaaaggaatattgaaaaaaacttaaagtctatataggaatataatttataaaaatagaaattcagaataaaaaaagaatattggaagaataatatagggttcatataggaatttaaactaattcaaagtcagaattaaaaaattaaaagtagaatttagagtccatatagaaatacaatttataaataactaaacttcaaatcaaattttaaataataagcatgattgggagagaagagtctagagtccatataagaatataatttagaaataagtaaattcgatattagaaaataataaattactattaatacaatacaaaattcaaaattgtgttgctatttttaatataccttaataataaaatataaaaatatttaagctattatatgagaaaaaataacgatactaactgcgtaattacgcgggcctccatgctagtttataataagagagtatattacaggttctgttcattgtgacgtaaaaataatagacacattgattcattgacaaagcgcgcaacctgtaactcatgtatatcttttatcgtagtgtccctcgtgtttagcctacatttaacattctatgaccaaggcaaaaacaaaaggtgaaaaaaaaaaaaccaacccaatgaccattacacaactacaaaagtgtttaaaagaaaatgacaaaataaggagagaataaaaatatccccccaaaaaaggggctccttttctgcttttgcaaaatttgaataaccaaaaacctagtgtgtctttatgtgaaatcactggagtttaataggctttttatcaaggaatgtggggaagggaatgatggaggcgctgtatggagtgggggctgcactcacccgtccgtgtgacccacgtgtgctgtttgttggacgcgacaattaagccatcttttcctcgtcgcccaaattttttcctctcctcctctaattgcgttgctttgcaaattaatctgcatttgtttttctgcatctccttcccctaggccagatcctctgctgccattatattgccatcgatccgtgggtgatccatctgttgctgctggaaatctgtgatgaacacatttctcagttgactcacagattggaaaccgtaggttgcacataattgggagatgcaatagtgaaatgtatcggttttagtgactcataagaagaaagttcagggttagtaaaaccggctataaccgttttggtgtgatccgatcgaatttgatatagctcgagcgataaccaacggttgtgggtcgaataccaattctccatcgtttttgtgaaccctaggaagaatcttgtactctacctatagaatcttaataataaagcatgttaaattgatcaggaagcaaaggtagcctcacagtgagtaagctttgctgcagtgtcttattccacagtacccaaagctaaaaatgagcatctatatggtcaatcagaaagcaagcaatgagatcatagctatctacaccgtcaactgggtgatcagacgatgatacatacgcacaccacggacaggttcaatgcacaggttgtatcagatcaaccagacaaaaaagaaggaagaaaaagaaggcgaatggccaaagccatgaatcgtgtaggtagtggcgctctagacacctcgcactctctgctccggccaaacggccccattgtctcgtttgtggggaataaaccaaacggcgtatttacaaacgaaaaataatttatatgtaaaacttttatatatgtattcttaacgatttaaaagtaagtgctaaaaaaataaacttcgataaaaaaaacctcaaaatcaacttcaaatttaatgttaaaaatttaaatcttagttgataaacaaaagtgtaagcgaaaagataagactgccaatggatcaaataatcctttcaatcgaccaaaccaatcaatctctgggcctttcgctttctcctagtagtacaaccctacttatcatcaccagcagcagcatgatgctaccgcatgatggcacgatgcccttggtcgtcacctacttggccttttctccgatccctcgtgccgctgaagtggaaagagagatacaatgggtagtagaatcatttatatagtaattacgcgacgttttatatagtaaatttgacttgcgctaagtagcattttgttcagactaaagtttgttttttttatgacactgaagattagcttttttttttacggaaggagtattgtgtaacaatagtcaattgctaaagataaatgtttggttttgatgagtttctggcagcgtaggttatatatattcttccaaaatcctcacctcttcaaacgttttaagattctcattcaggctatgagaatcggtagctacataaatcaaaatataagctaatagttaaaatttgatagatcttttttttatatatactcaccggttactcgttagtcaccagctcgccttagcttacatgtgagctgatctggttaatttcactggctaattaattacacgtagacgtaggagctcatcgaaaggaataatcagttcgctgttgctgcttggatggtactacgacgtcggcgtggttgggttgtcgcctccgttgagctttccacgtcgacggcggcttctcaatagatttgggagcatcccctgcactgcatttgatgagtggaataatactgtgctgtccggtcttattttaaatttaagatgatcgacatgtttctcatcatctagattatttactttgctttgcataagcatgtttggtttgatcaattgtgttgtgagatccatgaacatttcgcagagcatttgagcgtcatggagtatgtacggacttttagtaaagcagtgataaactgtagtacaattcggtagacatctagtactagtacagtaatcctacttcgcactctctctatcccgaaaaaacgaatctaaaattagatatagcatattatagtacaacaaatctgtacaaatattgatttttatgggagaaaggaagtatcagaggccatcgtttcatttatttatggaataaacgaaacggcatatttgcaaatgaaaaataatttataaataaatttttatatacgtgttcttagcgatctataatttaatattaaaaatttaaattttaacttataagaataagcataagttaaaagatgagactgatcactgagtgattatccagtgacagtgagcacaccacttccactgtcagtatatcgctggcacatcaaatgatcttccatcttatggccatccatccatatggacaggcaggaggacgcttgaggcacatcaacccggtctgcctctgcctgcaggtggatgtaaacgcacgggcccgatcgataccgacgaatagtagacagcagcacagtgagtctgttcgcgaatcgtacgtgattccccctaactgctagtggacgccacggcaaacagggcgtgcagctttcgtgtccccggagtcgccgtcaccggcctcgcgcctgtccgccggatgggtgtcatgtcccgtcccgtccacgccgcatatccaccattccattccaccgtgatcccccacgctcgaatcgctcgtcgcaataggcgacacccaccggtgcatgcagtccagtccaccacctaagctacactgcactttaccgccaccgcccatcacattctgatcggatcagctcccctttccgttaacatatttggcaccggcagatctggtctccgatggaaaaagaaggggcgaaacttcatggaaagctaggcaaaaagcacaaagcaggagaacatgagagttgggtctcctttgtgcggcttcgctgttgaggccgtgggcaataatactagtactactctgcagtctttggtccaacgatcgttcaattcggttcacagtatgtttctgtatgagcagtctggtttcatattgggaatggggatatcattattaccagaaatgcaccagattgaaacatttttatttgaccaaacagaaacacttccacataacttgttagtagatcgctttacatggttaagttcgagacatgaccatgtatgcaggatcgaaaattcagtaagttcagacttgcataatgtaagaaatttaggatgcggtaactgtataaaaacctcaccctctcttaacatgttaaggaatggcgtaaacactgaatcagatcagttcagaattctgtaacatgttaagcaactgctgaccgaaatggaagcacggcatatcagcttgcttgcatggaaacaggcagaatcagatcaatcaatcatatagcaaagaaactgcaagacttgagcgcaaacaagtggaattttcaccatgagttatgttatattatcatcatacgggaccagatgtatcatagctagcagaagagagcccgaaacatcttcggatcaagcaaccaactgcaacattgcttaatgcataacatgcttaaaggtagttttgttacatccgcacatagtgaagtaacacagacaggtagctggtttatcatttttcaggcattacagattggtatcagcctcatttcttcccgctcttcttcagaccagagcctcccagtgcacccttctgtcctgccttggccttaagctccttcagtgcctgtttgcaagaaatgcatgcaattgatgtcagcaaactaaaacaccagctacaatgaaaaaaaaaaacagaagactggtaagtttggtaaatggtctcaccttttcctcatctttcttcttctgcagatacgcgagatcactctacagaaagcaacaaaatcagaactacaagtctgcaactaaccattcaagttccttatatcatcattgcttcaatcaaatatgcactagttttccagataaagcgctacttacaataccacacattattaacaattcataaactacaattacatccatccaaatcactttgttaaaccaaatctatactggccacatcatctcaacttggacaaacagcaaattcaaaatgcttatctgattttgcgctgcttgattctaataaagccaggcagcgacatgttattcccaggaaaaaaaataaagcaccactatttttctttttctagcaatgcagttccccttcaagagatgtagattatgtttcacaagaaagctggtggaactggagtatcaagcaatagtaaatactagtagtacttgttatcaattatcaatagtcaaatcaagccaaaggctcatacactgaacacatgctcatttcttcaaagcctttaaggtcttagttcagttgaaaattaagatgaccataagcatagactaatgatccattcaagacaacttaaacccatagaagtatatcaagacaaattaagtttaattagatagaagaaatttaggacgagtgagatcatattctttgtattcccatcggacaagtaagaccatacgctcactgtgactggggacatcacccaaaaataacagctagcacaattttagaaggtgagataagttgatgctacactgctaccgaatgcaaattttccaaacatcatcaaccaggtcagttttgcaaggtgagaaaaggtgaaagcatcaagcacacaattccagaccatgaacaaatgatttccatacatgatagcatcaaacatattataaggttagcatcaaacatattataaggttgctcatttcatgttgacaaagtagttagaagaaagtaatttgccctagaaactaggacttcatgaacagaacaagcttttaacacaatcattatccaataataagttaataaccccctaacacaacatatccaaggaatgtaagtaaatatgatggcatatcagccaatccctccgccacggggatttaaggggattgattccacttccacacctactcaatcccccctccagtcccttcctcgtggggattaaccgaacggatccctaactgaggacaaggccacaagtcaatacgcagatttaaaggacaaacagcatcgcgcatgataattctacaaattcaccttcaactaaccaactaaaggataaaaccactatgaactaccccagacacgaaccgatctacaacacggtggcctgcacagtcaaaacacaagcgcggatcgctaacccctaacccgaaacgatcaatcggtagacggaaccacgaatcgggagcaaaggtcacacagcacagcagcatacctcgtcgtactccttcttctcggccttgggcgccttgaggggcttggccttccctcctgcaaatcaaacccacccccacaaaacaaatcatcagaaccccgcacgaatcgatcggcaacgagggtcagcgagatctcgcaggaaccaatcgcgattggaaggaactcaccttgcttcgacatggctgaccggatcggcgagggcgagtcgagaaaccctagctcgcgcgccgcgacgacgaggaggagatggaagaagggaaaggcgaggaaatgggagacgcgagaggcagaggcgtatatagctagcctagcctagtgtagtggttggtcgcggctgcgaatgggaatctcatgattgtggctgtattgggctgggccttggtttgttggcccattaagttctctagaccatcttgtattgggcctcctggtccgttggccacatgtgacgctgtacttctaatacatatctggctttcatcgatcaaacgaatacgtacatacagtaccaatcatcgtatacattcgtatggacgtaagtagtactaccttcatatcaggttataagacgttttgattttggtcaaagtcaaactactctaagtttaactaaatttataaaaaaaaagtagtaatatttttaacccaagactaatatataataaaaaattattcaattataaatttaatgaaactatgcaaatattactacttttttctatagagttagttaaactcatcttgtaacctgaaatggagagagagtactggataagtacatgtacgtccggtcgaatcatccatctatgatctatctataatccatctagagtttagataaggaaaaaaaaaagaaaaggttaaaaagaagcattggtagcttgccatccaaccgagtgatgcgagtgacacgcggagcagattgctgcacagcctgcaaaaatgggtgcagaaagcgagatggatggtatagggtggcgtggacggcggcggcgctgcatgagagtatagatcggttttgggagatagcgcttcttgtccgtagtacggcaggtggcacggacgacggacacggtgggcgccgcgcccctagcttgcttgcttgctgcacccgtcgccaaccgttttctcctcctcgctctctccatgtgatctccgatgcctcgttgcgccgcatcgatggatcgatcgcccgctgtgtatatatgtgcaggtccatccatgagaggttgatcagagagcttgagatctgtcaacatcaggagcgagctctcactgccattgccaattggcaattgaaaatcatcgtaaaccgccatctccatcatcatctcgcgcatggtgagattactgctgctactcctctgcctgcatatgtgttcaatctctgttgcaatgtagtgttgatatatgaatatgaatgttgcagtcgctgctgccgttgttgctgcggcccgtggtgcgcgccgcggcgagcgtggcgaggcggccggcgtctgcggtggcgacggtgctgcaccgcgccggcgcgctcccgaggaaccgggggctggagcgcctcgtcagggacgacatgctcgtcgggggtgaccacaacttcatcgcgcatttcgtcgtcggcttcatgcgctgcctgtgttagctggagtacatagctaggcggctaagctagattagatgcatagcaccggtattgatgaattgatatctgatctgcatttgcgatttgggctccatttttggggggatacgacgttctccgtggctttgataattaaaacagctagtgtagcatgcatttgcagcgatttgagcaccatttctttgcaccctgatatctgttcatgtccaacatatgtcgactgccaatcactcagtagtactccctctttccctaaatgtttgacgccattgacttttttaaacatgtttgactgttcgttttattcaaaaacttttgtgaaatgtgtaaaactatatgtataaataaaagtatattttacaataaatcaaatgataggaaaagaattaataattacttaaattttttgaataagacaaatatttaaacatttttaaaaaaattaacggcgtcaaatatttaaggatagaggaagtagtagaaaggagcagtttaacgatactgtcactgtgggcgcccactttacagcggcacgagctgctggttctgcatagtaagtcgtacaggataaacaaaacaaaacaatacttcttgtgagacgtaaataaaaagaaactgtggtgcattgtaatggtagtacatgtgtttaactagtagtaaagcaatagagaagcaacccttccccgcatatcaatgagttgggaagagccggatgtatccaggtctgtgcctgtacaagaattcagaatcatgaaaaagttagggaaaaggataaagagaattactgtaactttttttcagcaactctttcacagaaaatcatgcatataattctctggagcactcaattaatcaatgaattcaattcaatgttacaatgtagtaaatccctgttaattgaatttagtaacaaactgaaaacccctatcaactgtatcgtgctaatcctccaaccagtgtcctatctagacaaacacctggtacagagaaaatgttatataacaagaaaaacctacatatagattgaaaagaaaaagaaaaaggagaactcatgcacaaatcattccaatcacatatcaagaaagaacaaaggtagagtgacttgcaagttgcagcgaagaaactgtcagaacggcttaattctgaacttgtgcacaggctcaggacaatctagtgcaacctcaggccttcctcagagctctgactcgagcagcaagctcatcaaagtcaggcattttcgggtgcacatgtacagttttgggacagtccggctgcagtgaggtagaccgggcaggaaacttcacatcttcatcgcggcagacggattcccctggcagtgagattgctcttcctggaggatgcatggagcccttttgctcagattgttcttctgctttgttggttggagctggattgatttccgcatctaaacctttcttgctgtagtgcctcagaagcttatccatcattctctcctcctcatcaactccactgcgcgcatcagtattgcggcttttgtgtctcctatggccatttccagttctgggtaaaagattaccaaagtcaattgcagcctcatcctcttctgatttatggcgctgcatgaatccatcgtagtcctcggtgtacaaagctccatttctcctgcctgagtgccttggccggctactaggagttctctgaacattctctccattaacatcatccattcctttgcctccatgaggttgtctagacccatctctccgggcactgccatcattaacagcattctgcctgcttgtgtgtcttctgtgactactgggtgttcggcttgaaaccttttcattggcaggcgcctcatcatagacagcagcaggtgcaggtggcttggcatatttacttctaacagaaacaggtcgaagaggatctttgtcagacaggtgatctgtttgttcagggatagcacgtttgctgtagtcactagcagctcgctctgcaggatcatcattcactgtttccatgttgagttttggtttgatgtaaggaggtcgcacataagctgccctctctggcactggctgtctatcttgcactggattccccttatctgctaaatgatgtggtctagcattcaagcaaccagtgttctcttccttttcagaacatttcttgccggtagatccatccagcttagaataaggaggcatcctgtttttagtgttaccattcaaaggattcactgattgaagcccctgcttatctaggccaagggttctgagacctgaatctgcatgatcagcagcacaaggaatatgtgatctgtggtggtgaccaaggttgctctcgttctccttctcaagatcattgtctttcttaggcttgacatttagtgcaaatgtcttcttgctttctgcttcaggaactttcaatgaaccaaattccttcttaggcaggccattgaggtctagctccaccgcttccattagttccttttcgcaagggcgaacatcttttttgttagctttctgaacttctttttgaatgttccttcttttcatctctgaatcggacactggtttctccacatgccccttaccatcagatttatccgcatgctgtctcctggtgttttcacgtaaccggtcaatgccatcagcaacaggatgaacatccttttgttgttttaaggacgcttccaatttattcttgtggccaagagtagcagcttcagattttcttcctgatggagcagcatcatcccccttcttgctggacaaaggcactgccagttctacctgtttctttgagtcctttgcaggcaaatcctaagggaaaacaacccaagatgccaagtaagaaacatcaaccaatagattgtgtaaattcattcgaacaagtttgtgtaagcatatagtacatgtttggtttctggagtggcccatagtttgatcttaaatgctttgatatcaaaatcaaccaatagttcttcagacacactttgcatggcttgtatcttttcctcattagtgaacactttattgtccagcttctgaacaaactgcaagtactaggattatagatcatgttaagtggtacaccactaatcaattcaatgacagcaaattcgtggcagtagcacacctcaaggctaacaaaaggctcaagaaaatgtccatatctctctgtgaaaatatgcctaaggtcacacagttctggcaaatctggaaaccgagcagcagcaaaaattagagtcgacacagcttcccgagtttcctgggggcaatccctgtcaggaaaaggcaaagatataactgacaactgttgtcatcaagataaatggaaatccattttgtttattcctcttcctaacattatacaagtagtaatgtttaattgaccaagcaaagttctcaaacaatttttttaattctctttaaaagatgatgctttggttaacactaaactaaatcatccaaacaataataaaattgtatatgtttccggatgctattgttctgttggcttgattacttaaccaattaaacaatgtaggatgcattaatgactctatcgaggtatcaacaaacttgtggtttttaggtagacagtttcagcatcacaatgattgctagtggttgacaaaagaaataggaaatcaaagcagatcgttagttacccctgtttctgtaggctgttgagctgtttaccaatgtactcacagaactgctcgatcatatcatagcaagaagcatggttcatctcaattatcagcccatccatctgcattccaagagagaggaaagtagatacaaaatacaacatcagcaattcagtcaccgcatgtttcctctaccacaaaaatga

SEQ ID NO: 83754 - DNA, 4076 bp, Oryza sativa
ccattgtcccagtgcctaaagggcttaaacgtgctggtggaatcattatttggtgccacatttcatcaaattcctatgggggacggcgagtcatggcatccagatgtgatgaagttgtctctccatcatcctgatgaggtactattgtgttaagcttagtttattagttctatataaaaaaatagtaaactactgcatcttacccaatctaactctacaaaagcatgtaactacatgcttgaacttttgttattacggatacatttctaatacgctaacattagggggcatgacaatcactatgtttcctttctcgaaatgagcatgccagattatcaatcacactactttgtttttgttactaaaatcaaaatcagcaaacaccagaaataacttttgaatgatagccaagtagacaaagaacaaaattggcattccatggttactgattagtaatacataataatgatggagagttggccttgtccgattggtcatgtactcgtatcctattagcgcatagtgtaaataccgtaaacttgaacaactagaagtatgatgacaggaatctgttacgaaattatttatcaccaatgccatttaactatgtaagatatcataaaatgttatgctattcagagcaaaaaaaatatttcaaaactagtagacccaaaggtattttcttaataaaatgtatatttggattacaattatcagtccatctctttataacgcatatatgaccaattgaattcttctaaggggtagtctaatcaaggatcttggttgctactactatcacgcacccactgttgagagcatcttcttaatttatattttactggcagcaaagtaaccaaaggaaaacatgtttaatgagcagggcaatttaggatttatgtatcttgatctgtactccagaaagggtaaatatccagggtgtgctcactttgctatcagaggggggcgacgattgcaagactcaaattaccagcttccagtatgttctcttgtatatttttatttcatgaataacaagggaattggcatttccaaacattaatgttgaactactttttaggattgttttgtatttccgtagtactttggatgttttaaaaaatgtggaatgcagaattttgcagcctttttagcccaaatatttggaactaaacaaggcctaaggcttgtgtgccttatttagatttattctctttgttccacatagatgaagaacttttgacagcatttaaatgatccttacaaggataatatctaagattcacgccaccgattcacttcattctgatgcttttcagatcgttgctctagtttgcaatttttcaagttcgagcaaaataatggcaaggcttaaccattgggatgttgaaactctgtttcatgagtttggccatgcccttcattctctactctcaagaacggtattttgctgtccttttttataatatttaggtctctccaatgactccaggattgcttatctgccagcataatgatatttgcaggagtatcaacatttctctggtactagagttgctcttgatgtggctgaaatgccatcaaacctctttgagtacgtatgacttgttgctaaaaataaaactttatccattaacactcccgcagggtatctaattctggcttatctaaaatacagcagcatttgttatttaccttctttatcgtagttgagttcaattcacattgcaggttttatgcatgggattatcgtgtcttgaggaaatttgctgtagatgaaacaactggtgatccaataccagaaaagttggtaaaggcacttaatgcttctcggaacatgtttccagcaacggagctgcagcgtcaggtttgtttttctttgtacttcttatttctcacccttaacaattggatttgaccttgtatgtcccaatgtgctgtttcttcactttgtgttattgtgcctccgttccccagattttctattctataatggacttgactttgtttggggagcaaggatccaagccaatggacacaatttctactgtagctgatttgaggagaaagcatacaagttggaaatgtgtagaaggcacacactggcatactagatttactcatctgataaattatggcgctggtaagctttctatagttcaagaaaatttcaagcttcagttttcataaagtataactgctattctttatttcaacattattgcaggctactatagttatctttatgctagatgttttgccacaactatatggcaagaagtatgccaaggtgatccattatcccgcagcacgggtagtgcacttagggacaaatttttgaagcatggtggagctaaggatccttctgccctgttaaaggatttcgtaggtgattccattattataaactctggaggaggaataatccctgacattagctccttgtgtaaagaagtcggtttgtgaaataccattgggagtggagattgggatcattatttttgacattgagatgggttaaagggtcaaagactcatgatatcatgagtcaggagcttgatctgccacagggctgcaggatctagttgaaggtcaagctgaaaaaaataatagtagattcttgacaaagaactgatgaattggttctcaatacaggattgcaggttagattagttgggtggatcctgtttgaccattgctgaatcttcgattttaacttgctgctgctgctgctgcaagggtggtttagttccctgtcagatgatttttcgcatttactccgattgttcggaactgttgttccaaagctacaaagtggctgtgcctgtaatattgacccaggttaatcttcatagcccatcacatgtaatagttctctaaagtgattataagagtgagagatgtgcccatatgatcttttttgcattcttagttggtctcatggatagaaagcatgtttgaggatcatgctcattattgcaaatctcccttcatagcgtaatctaagccatctgaatttagattgaagctgaataggcgagcttctggccgccgaagacgtacaagccggcgatgatggacaagatgaatacaagccagcaattatcaggtaaagaatcagatggcactgccgccaatgcttccttcagggtccaggaaacaactgagcaacatcgtcaacgcctcctccagcacaatatcgaagtaattgaaatttcagtttgcacggttaagtagatgttattgcgataaccgctcgattttcatcgaattttgctaaaattcttacgaattccactgagaattttgactgtgccccggtcaataaattcaataacctgcacctcaagatcagcagctgcgaaacacatcacccagatagtgaccatcacagttaccgggtgaccaggattcgggatgggcagacaggaaagaatcaggtcagcatccatgtcggaatagatctcctcaacttgatttttgcgaaatgtgaatcatgcatactctctccgtcctaaaaaaacgaatctaggatgggacgtgacacattctaatacaataaatctggacaaaggtatgtccaaattcatagtattatgatatatcacatccagtattatgttggtttttttatgggacgaagggagtatgatattgcaactattaactggaggaatgagcagaaattgttcaggttttctatctgcttttgttgctgtaagtctgtaaccaaactaactagtacggagcactgcggtttcaactttacaactgagcatccactgaatttgcagagactgaaccttcagctcaataatcaccattttttttctattcggttcctggatgatctttaacctttctagtattctacagtccaagaatgttgaacatgaatcatcctcatatgagttattttcccctttttgttgattcttcaatttgtggtgcgaaataaaaaggctgaaagaaatatctaacagaaactatccaattatggcatggctagctttcaaccacagaagatatgaaagggaaaaaaaataaaaaaggagaacatgaaacagaaacagagg

SEQ ID NO: 83755 - DNA, 1910 bp, Oryza sativa
acttgagtatgctggttgtaagaacaagtctgaactgacccattttggataaacgtttctagaaccgttgccgagaaacctttgtttgcatctggttctgtcaggctttccaaacccttatcacatgaactcttcctcaacaactgcattactaaatgcagttttatgcttcatctgctgtacctacctccttacatatttggtgacatgttattatcaaacattcattaacttgtattattttttcaggcatttgtgcatgacccattaatcaattggcgtctgttcaatttcaatgaagtccctcaagttacaaactatggaaatgctcacagtcacacagttgtcaatagcgaagaagctgctaatcgggagctcatgcaaccaccccggggagctcgggagagagaactgctacaggtctgccttctctttctcaaccttgactgttcagctagtcattatagtattaacgacgtaccgaaatattaagcgttttttatgctcatgcaggcggtcaatcaactcggtgatgctaacgaggttttgaatgagcgtgccgtagctgtgatggcacgaatgagtcataagctcacagggcgcgatttctcttccggatcatcgttgtcgggggcgggaagctccacccaacatggtaacgagcatctggcttcaggagacactcgagaggtggaacctggtttatccgtgaaggttcaggttcagaggcttatacttcaagcgacttcgcatgaaaacttgtgccaaaactacgtcgggtatggttccgcaatttatttaccacgccccatgtttgtcgtactgccagaaaaaaaaatagttgaccactgattttgtcaagttactcacagtttgcttgtttctgctatgttccacaggtggtgcccgttttggtgagccttccgtaagcagtgccatgtacatattgtaaataacgtgtacatatagatagatatcttgtaaagagtgttgtatttgggcagtgtacatgtaccagaatttcatttgttaatgaaagccgtcattggcatcttcgtgttattggaattgccaattttttttggtgggttgcatgaggtcaaagctaagcaagagttccacactaatggccgctcggcacacctatgatttttatcgtgggtgtgcccactgcccacacaattctaaaacctaaaccaaaaatcttaagcgaaaaatacaattaagccttgatttataaaaaataatatgccttgtttttttaaaaaccctaactgatttctttcatttgtgtattctttctggctcaaaagaccacatattcgatggctactcaacaaggcagtgcatacacaaccatcaaatctttcagtttaattttgtacaggtctcggtatatataggttttagggtgtagtgttaccttcttaacttctcagtcgaagtgaaaggaactgttgattcgttgaagcctcagagtattagtataatactcgctccgtccaagaatataagaatttttagagttggatatggttattaagaaagtaggtagaagtgagtagtggagggttgtgattagttgggaggagaatataggtggagaagtagttatattttgggacaaatcctaacggctagaaattgttatattttgacacggagggagtagcagactattgattcgttgaagcctggacggtcagagtattagtataatagcatgatacaagccagttataaacacatatggatgagaggatcgagtattagtataatagcaggatacaagtcagctataaacacatatggatgagataagaaaagagagagaaagaaagcgggttatagattcgtagccacttgcaggactccaaaataatatgtttatatgagaggtgggaccatgt

SEQ ID NO: 83756 - DNA, 7488 bp, Oryza sativa
attgcccgttcggttcctcatccttgttgctagcttctcagccatttcttcgatttcaggtaaaaacttcaaggcatggtaattaactctgcatctgagccggttaatctccattggaacattatcatacctgaaattgcaggcttaggttacactcaatcacatcaattgatgtgaacgaaattgtaaggcatatacttaggggaggaaccgggagcaatattcactttacaacaaaagactctgatgtcaaggacagtaacagcgctaaaaagttatacaaccaatctcaagatgtatggatgaggtgcagtcatgatgataagacattaccccagcctatcaacaaatggcttgatagacattatctttttatctttgatcctcggaagtacattgtcaatgtagaactgcgccgatgcatactttggaatatttttcacagttcgcctgttataatcagcatcaaaaataaaataagttacattcatggaagactatgttccagtgttaatcaattatagatatagcacatatagtaactgctaactatgggtgaaaacacagcagatagtgatgaccaaaatagaaacatattataatcattcaacatcatgacaagaggggaaaaaaggaagaataaataaggaaaaaaatgcccataagcagtacctgtcctagtgatacaattttcctttgcccttgcacttttcggttgtataagactgttggcatcctatagtaaaataagctaattttgaccctataatacatgctaacccctacatggtttgaagtagatgcctctatagtggcatcacatatgtggacaatgcaatgtgtgaatgaaagacaactacaaaccgcaaacaagcagcggcaatcaccttgtttgcttgtctccagaattcatatgttctaggagtgtgtgcacacatcaatcttattgattgataaaagaaaagatagaaggaataagtgaaaaggaagcaactaactttatactggtgaaaagttcatctttttctgtgaaccattcaggaatatctcgaacaatgcgtacatcatccttcaagtaatttatgaaataatctacatcaaagatatcttcaaatttcctgcataaaaggacgaaagctctcaagtactaaaggacttgtacctaaaagacatgatagacacaaaagggtgtatgcaagcaggagttgatacagaaaaagaataccataattcatcacttacgtttgatctttccagatttgatcctgcttcagcacaggtaaaataagtgtggcattcattatcttagcaattgcaacagcattacatatctgcaaatacatcgagtatcgcagttaactactgattacacaacacagcttcagcaagctaataatgtgaggaaagaacatccgtacggctattcgctgctggtttaatccaccctcggcatgaataaaaatatacccagaggtttcattctctggtacaagatctgcacagcagaagagagaaaaatatctttattcatcaggatctaaccatggtttcaactttcaaaggaatgttgtaataattcctgtaagctacaaattgacaaacataaacaggcacaagcatacacagtgaaatgctgaagtgttaagcgcctcttataagagcagtcacaggacatcataaatgaaagcttaggtcttgtgggtacgagaggcttagtaaggattaaagtagtcattttttgcatcaacagagagaaatagataggtacattgcatgcaatcacagaacaggaggtacatcgttctgggtgcctaattcgcctgcgctcttataaacaatcttggtggatagttgctaaaatcatcagtttaacattagagaaataagttattcattgttcatttctccttacagacactggaaaatcatttgggccaactaaactacatctagcggtccaactagtacgtatattcagattatctttgagtaagtatttgcagggaggcagggacaaatgacaattagatgctgctcttgcctgagatctcatcactacggcgctcggcgcagggcttccaagatgccgctgcagcatgcggattctcccagagagattcccgctcgttcacctgcagagtagcaccaagccatccaaaacaatattgaaagcgaattgcgtacagatagatatccaagatacataaatacattatgagatcaacgtcactttaccctggggcagtggagccgaatcccgtccttgcggcacagatagggcgcgttctacgttccaacaacgacatgatagtaagcaaagaagttggatgagatcttgatcgaacagcaatagaaatgaagcaatcgaggaggaatcaagagctcacgatgcgtgaccagacggaaggagcggagacgagagcggcgacgaagaggcaggcgacgacggcgaccaggatccggtaggacgccgaggcggtcggcgacctgggatcctcgagcgcgaggagtgaccggagcggggaggggaggtggtacttctggtggtggagtggagcggacgagcggggcgccccgtccttgccgtccccgcctccgccgccgcgcggggaggaggaggaggccacgaagggggaggacgaggcggaggactccgcgtcgcgcttggccggcgagctcgacgcgcgcgtcgccgccgccgccgccgtggcgtgccgtagctccgccatgccgctgtcggcggtgacgggagtgtcgttggattggctccgctgcgcttcttgggccagattttctggttgcggccttacgggccaacatgccttttcgcaattccagtgaaatttggttcggatttcgcagaaacccgattttttttcttttttttttgaaccaggtcgaacctcaagcacaaaccactcgtgtttttttttgtcaactttaaaaaaactgaattttaattttttttaatcaaattcatctggatttcatgggttctgttgtgatgtgttcgctgagtcgttgggtacgcactcactcacaatagacttgtataatcggcattactaaatagcatttgataggaatttagggccaaaatcttgcttggatttggttcccgattttatgctaagactccttctccagctctgacgaccctaatgaactctggtgattagtagtggcccccaatttagggtttagggatgggggtgggggcaaggagagagaggagagttccctaggctaagaggaatgtccatgggaggcggcaaaccattggttggtgacaggacaagtgagcagtgaggccaacaaagccacgaggtcagcagcgaggcagtgggccaatgttggcgtcaatagcaaagcagagtgagtggctacaagccaggggcgtcccaacggcttgaggagaaggggaaaggaggtctagagggagagggagaaggcggaccgagggtgggtagtgacactgtggagcgatgaaggcaggagcatcgagcaagtcgcaatggggtattggggtgggaataagaagggagcagaggagggggttagggtttgagggttactacatgaatctcaaagcgatccaacagtttaaaattcatagagcatttgtagggtgtgttttttttgtcaaatggcaaatatacggtcacttcatcatttataatctttttgatgatctatacaatggtatggatgtgaaaggaacattttgattatatgctgctatggctaattttatattcaagcgagtgttgtatcacatggtttcgtgtgaaactccatattttgaatggctttcacattgtacttactgctaagcattgatcaccggtcgcttaatacacatgaggatcaggttatcacaatttagaaggggctggctaactaaggtcaaaacaggaactacgatttgcgtatttgctacaaggcctacaatgtctgattccagagttttttcctcacgatcaggactctttcatcaccggaccagagagcgtcttttttgggtttcacatcagatgaccagtcgtcccatcttaccgctggcaaaagcttcttgatgtggttgatgacagcaaccttgtctctgataatggcatacccctgaggcctcatgatgcggtccatctcaatcagcagatcctccacactgcacccttgtttctctatctcagaaaaaagaagccaggcgtgaacgagatcataggtgcgtgggtatgttgagaatgactcacaccttcaattaagaaaacagaaaataaagaaattatgccacaattgaggtagcaaatagtagttggtaccatcaaatactgcaatacaacaacaataagaaattgttttctgtgatcatggcaaagtcaatcaggcatatggaaggcattttagtagaaataggaagtaacaatagaaagtagacactgaaattaagcaatgctggagcactgggcccagatagaagataggccaaggttttaagttttatgcaatactagtaaatagagcatcttggtcacataagttaatgacaagagcaccacatgtcatttggagggatttctcatggcgagaacttcaggtgcaatcatgatgacttgataacatctctagcgacatgttttaatgtggtaactgaactataactactattaaaaccgtgtgataaatagctaccacccttcaattgttgcattactatggaaatccacaaaatcgtatgcaaattatgtctagataaaatgtaatcccctacatgaatggaagatacataatggcgctttgttaacaaagatatggtatttctaaggctggctgctaaagaacagcttgacaataggtttcatttgtcaacaataatcaaattactggtctctttcttcaatactcaacatacttcaatactttttgatattttgattgcattccaggcattaaaactattggatttgtctgccacagacaatgaaaacgtaataattttagctatgcaaagtcaacactgaaacaactggactgaactaaatctaaaggatttaggacaaaaggtttgcaaacatatcataccaattatggatggtccccaataaaccacgatcatagatgatcttcagttttccagattctgtggaaggaactacattcatcacccagacatcctttttcctcagggatgctgcaaatccaccaagatttgcattcatatccataacatttctaaatgaatccttttgtatctcagatttcatgagtttccagtactgaataactctaaaatgccaaatctcctgcaaggagtacttcaaagtcaggtactaaagaagctatcagaaaggatgtgagcacatattgcatgaaaaaatatcattggtttgttgcatagctcacactgtcatcagaaaaattgtttgaactgattccgagctcttcaagacgagggggtggtgctgtaagcctttgcggccagggaagcagattactgcccttaaccttgtggactcctggagaagtgcacacgacaagatcagaacaaggctaaattggctagaaaaacatatgtttgatagcagataaatcaaggatatgacaacgactggagttgacaattccttttaacagaaaataggtaactaacaattgcttgattaaatttccagcaccaagataacacacatatttgaaccaaacaaaattacaacagtagttctcaagctagacagcagaattctatacttcagtaaatgcaataacagacaattggttactggaaaagtactgagtgattctaggtaaagataacgaggtaaagcatttaatacatactataccaagctatactaaaaattacaaataacgagtttgaggtattctcgagagatgtccccaattaagcatgcacaattcagcttatcatctgctcttcaatcaccagtatatagccaactatgatctggtaccgccgctatgaccaggaacatgaaagagaagtgtaatctgttgaggccataaatggctggataagcaaagcctacagcgtatagcgattagcaagcatgatccaggtttaagcctattggttggcaactgggcagcccgcagcccaagtattaaaggttcggcagtggattattctcttgatataaatggttgaccgtggtacccttctaaattatcactaatgatttgaatctccaacattaagtgtgtcatgtgatgagcaaacttttgtggaaagccgatgatatagcattcaagcaaaattccataagaaagtaaggggtagtatagtagtacactatacttttcactattcattcaatcttgaggtaaatcagggaaataaacttactttccgagtaaggagttacacatgctttcatgggcacattccaagcagcatccggatcatcatcacggtcacacatatttggaagtgttcctggctctctcttcatatagcactcattagtcaatggtttgatccatatcactgtctgatcctccttagatgcaatctgccaacacattcttcgagcaagatcactcatctttctccatatgttccggttgatgggatccatagcataagcttctggcgatgaatatacgaaatacccgccaggcctcaaaaccctatcgacttccagcaacaagatcccatccctctgcagccagtcaatccgacaacgagagcagtgcgcaagctcaaatgagtggctggggtatggcagcctccttgtgcccagcacaccgagggttgacggaattcctctctcaagggcaaactgaatttggttctcgtgcacatcgttaggagcaagagacattgcaattatatcaagaggaagaaggtaggctccgaagcttgcaaccccacaaccaacatccagcacattcctgatgttccctccattgtttagcttaccattcggaaaattcagcatctgcaccacacatccacaccaaacaacaatgatgtcatcggattcaaaggtaacaaaacatggtaattagctgttagatcatcctgaacctgagcaaggtgcacaatgtacttgtcagcaccagtgtggaagtgggtacccccaccggggaagttgatcttgtcaccattcaccaccatccaccgctgatcggacttctcagaggcaaggtgggtgtgtggtatgttagccttccacacctcgtcccggctcctcggccacctgatgggcacctgaacattgaaacatcacaccaacatttaccaaataaacaacaaacaatgcacagcacaacaagtgatggattcatcgatcatatcatgtatggtctccatggtcggatcggatgtatgttgtctcacccggtagccggcgggtggcgggatgaggcagttgaggcggcggtgcgcgggtgggcagtggcgctcgtagtgctgcatgagggagaggttgagcctgaggcggagctggttgtggaggccacggtccaggc

SEQ ID NO: 83757 - DNA, 500 bp, Oryza sativa
ggctaaagcagcatttgacacaagcatagataatgggatgaccttatttgatacagcagaagtttatggtacagcggtaagaaactagaaaaacttcatgattcctcgctcatattttccttgcgtcaaaattgtgaaggttcatttaaccttagttgttctgtccttcagctgatgggagcagtaaattctgaaagtttactcggagggtatgccacgttttgctgttcagcactccattttttttattattttttattttcgcgaaagtcacatgtgcagcaatagtcacctgttgttgtctctcttgccgccagtttcatcaaggaaaggcaggagaaagaacagattgatgttgccgtcccaacaaagtttgctgcgcttccatggagatttggccgagaaagtgttctttccgcactgaaaaaatcgcttgaccgtcttgggttatcttcagttgagctctaccagcttcattggtgggattgtctgctctttct

SEQ ID NO: 83758 - DNA, 583 bp, Oryza sativa
cagaggaaaagtcagatatgcttattataatccaagattgtgcagtaagtttcttggtatcaataattatatgagtgttctgtattttcacctaatcttgtttagttaccttttcagctgtcccttatccatgtttctgcattttgtgccttgttgcaggttaaagtatagcttgctctgtactttacagccactgacccgctgtggtaacaagacgtcgtctcaagagaaaatctattaatcgtagaactgctagctggattgtgttctctctgtgggaaaaaaaaacatgaggacaattcacttatttcaaagctatcacgtatgcataagtttaaagagcagatttgttcatcctggtttgtctctgctagtgattaccctcttctatctgaacgggcaatttatggagaagttagtacgcttcaccttttgcgtttctattgctgttttttttaaagttaattcctatcttttatgtttgatccagttagcttctaatggatcctgatgttccaatgatatttcacgtgtctactcattatgggctacatgcattggtctttacatagccagttgtgga

SEQ ID NO: 83759 - DNA, 602 bp, Oryza sativa
  unsure (1)..(602): unsure at all n locations
cggaaggaaatgcaggtttcccccggagcagtactccatgacgaggcagtagaacctgtcggtttcaaagtgggtgtagagcgtgggaagcaaggggtggtcaagaaggcccaggatctcgcgctccgtctccgcgcgcgccatcttgttccggctcgcgatagacgccttgtccatcaccttcatggcgaagaaggccgacgtgccgcggagctccaccaggtacacgctcccgatgtcgccgtaccccagccgcttcagcagccggaagtgcgccaggctcagcggcgccggcgcgtcgcgcgcagtcgccgcctggaccgcctcccaccggctgtccccgccggtgtgccgcttcacgttctgccccgacgccgacaccgacgccgtcgacgcnnnnnnnnnnnnnnnnnnnnnnnncgccgcggcgccggtgctgctgctctccaggctgttgctccgtgtgctgccgctgctgatgctgtccaggctgccgttgctgacggcctcgccacggtttgttcctgctgttgctgctgctgcggtcgtcgtcaccagcgccgccgtcgtctcgggcctctgcggcggcgggttcgccgtct

SEQ ID NO: 83760 - DNA, 520 bp, Oryza sativa
agtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggcaggcggtggagctgggggggcccttgagtttgaaggtgccggaagaggagcttgcgggggagtaggtgtaggagcacgaggaggagtcggtgcaggatcctgaggaggagtcgatgctggagcttgaggtggagacggtgctggcggagcatgaggaggagacggtgcaggatcctgaggaggagatggcggagccagaggagatggtgcacgagacgccgcttatcgcccagggaggatgatgtaccgcctgcgccataaaataatggcatggcatgtgtctcgtagatgcgtctc

SEQ ID NO: 83761 - DNA, 1294 bp, Oryza sativa
aagtattttatcggagtacttaacccgtaaaggtagtattgaatcgatctactctcttggctatagaaaaaaaaaagggctcattttacatcctaacaacattttattcttttaaatttatgcttctctacaagtcatatttcactttgacacatcaagagacgaaggtaaatgataattaaacgaattcacttagttccacgctttgcacgtagaagcctataaggtgtcaatacaaaatcaatagcatatcttataacaatatgattagaagtttcctactaaattacgttgtaagactaatattgactaggtagttttcttaaaaatattgtagggtcctacgtataagaagcgctatctaatatatgtatatttagggaaaaaaatacatttatgagcaatacgagtttctcaagattttttttttaaaaaaacaatgaacaatcaattaaaaagggaaatacctaacattaatttaaacttattttggtagacctgtttttaaacaaaataacaagcatgcccgcgcattcacgcgggctacctttccagtttgctttctagtttgtagtaagtacttcttcccttgatgaaatttggtctgctttcttaaccggctggcgaaaaaaataatctatcaccataggccaagcaagtattgccatccagcctgccaaccgtattgagcaccctgtccacacatcatccgctgtcaccaaaacgcccctgctgaattgaattgctgatgatatcatcgggtgtgtccaacggctccagcacatgaactgcaccatcgctcatgccgactgcaaactggttaggcttccagggatgcgcagcgacaaccatgggatacacaatttcaccaccgctggagttgataagatgaaacaagagggcagcattaacaggtcaccagcattaaaattaccagactcgaaacaaaaacagaattaaactgttggagttggacactgcatatacctagaaactgaagatggtatataggcagaaggtgcaatcctgcactgtaacatgagagattccacttgaaatattccaattgcaccatcacagaatccagcgtagatcaataagccatccgatgagtatactgcactcgaaactggagcagagagtggatcacttgggaaccactgcacattgtcaatcaatgaaaggttaaatatcagtgatgattacaatatattgtgaaggttaggagcatcataaatatttatctcactgctagcatgatgtaacatgtttactcaagaccgaatcaagactg

SEQ ID NO: 83762 - DNA, 704 bp, Oryza sativa
aagaccagtgaaccattagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtcttccccttcagtatatacttctggtacagatctcccttgaagctctgaaactgttctgccattttcttcagagtccaccttttcactttgtcctctgtacccgcaggaagggtgaatgtctcgagcattgtggtccacaacatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgaatacggatctctttcacaaggtgacgggctgcaggaat

SEQ ID NO: 83763 - DNA, 2517 bp, Oryza sativa
cgtcgacacattcttggtgcacgacgatggccctgaccccaccgatccacacatgctcctgcgcctgcggaagaagttaggcaagctgttcaagaagagcaaggctcgccgtaagatctctaacctgatccaagacattaacaagaagttcgagcaggtgaaagcaaggcatgtcaagtacacagtcgacagcgttgtcctcaagtctctagcggcaacgaccatcgatcctcgtctccagaatctgtacaaaagggcaacagagcttgttggcattgacgggccaagggacgatctcataaacaagctatccctggggggtgatgttgatgtgtccgacaagaagatgaaagtcatctctgtcgttggatttggaggactcggcaagaccactcttgccaaagctgtctatgaccacttcaaaccgcatttcaagtgcagggcttctgttccagtcgaccagaatcctgacatgaataaagcattcgatgaccaggttgaaccgcatttcgaatgcggagcttttgttccagtgggtcggaatcctgacatgaagaaagtctttagagacattctcattgatcttgacaaggaaaagtacacgaatccgaatatgatggtgttggatgaaaagcagctcatggacgaactcaaggaattcgtcaaggagaagaggtatgagtgtaatcaccaatccaatgactcactgcttacgttgtgactttgaattccagtatctgtacaattccttccttatatctatttactttattaaataaaggatgaaaggagcacattttacatctcaagtctagaaaatagtacaacgctaatcgatgcagattgatttaatacagtcatgcataaaaatgtaaatgtgttttcagcaagcaaaaacagttgtataatattcagatatattttctcatacaaatgagtattattaatttattatctagccacgcaatcgcaagaaaatcatgctagtcatattattcaaacaaatttaaacatatcaagctcatttgctcccaagagttgcaaaaaacaaccacattaatgagaaaagagagacattcatcatgtcgattttggtaggcccaagctatataataaattaatgatgtaggttaactggttatttgttagagctactgcaaattatatttatataacaacatgcagttgtattttagcactaagcacaagacatacatcacatacaaacattggagatgtaagtacatgtcagttatcctgcaaaaatataagtgcatgattcaattcatgatgtacaaccagctaatatagccaagcccaattcaaaccgactccaatactaactgaattgtagtctgaacaaacttcaaagaacttagccaaatcagattcaaactctaaactcaattttaactgaatttgattctgacccctaactctgactgaaccaagattaactttgaactgcactggttttcctcctgctctgatacttctatccaatcatgacataggtgtttcattgttattgatgatatatgggacaaggagtcatggaaattaatcagatgtgctctgcaagaaagtgattgtggaagtagacttgtcataactactcgtatttctgaagttgccacacatgctggtgaagcttacaaaattcagccactttctcgtgataactctgaaaaattattgtatgcaagaatagttgatggtgaatggaagtatttcgataatccatcagctaaggcatgtgaaaaaattttgaagaaatgtggtggtgtaccattagctatcattacaatagctagtttgttggccagtaaaccaggggaggactggtctgaggtctacaactctgtcggttttgggcatgaagacaatgatgatgtaggtaatactagaaggatattgtcttttagctactatgatctgtcttcacatttaaaagattgcttattgtatctatgtgtatttcccgaagatcatgtgatagagaaaaatagtttgatatggaagtggatagctgaaggtttcatccatgaggaactagcagcagggttaggattatttgagctcggggagaggtgcttcaatgagttgataaatagaagcatgatccagccagtggagacaaaacatgaagggtatgtagatggttgctgcgttcatgatatggttcttgatatgatccactcattatcgagtgaagaaaattttgtcactgtattgaatggtgatgagcgacagaaacttccggggagcattgctcgcaggttagccctgcagcgtgttctagtgcacaaggatggtcagctagctaatatcactctgaagaatgtgagatcccttattgccagtcagtgcttcggttcattatgcctacacactccggttttacgtgtattagatgtgataaactgtgcagaaagtgagacgcctaatgttttggaagatagggacaaaactatgccaagccatcttgggagtttacttcacctgaggggctgcagg

SEQ ID NO: 83764 - DNA, 547 bp, Oryza sativa
attcctgcagcccatccgcgccgccgacgtgcgcgagctggccgcgctgatgaagcaatggcccggccgcgaatacaacatcgaaggcaacccgacgcagaacctgatggcgttcatccgcgaagtgcgtccgcagcaagccaccttcgtgcccgacagcgaagaccagttcaccagcgaccacggctgggacttggccgacgcagcggtgcgcgagcgccttcgcccgctgatcgaagaatgccgcgccctggcggtgcgcgtcagcctgttcatggacccggcgcccgagctgatggtctgggccaacgaggtgggcgccgaccgcgtggagctttacaccgagccgtacgccgccgcgtgggccgatccagctgcgcgccagccgccattgatcgcctacgccgttgccgcgcaggctgcgctcagcgtcggactaggcgtcaacgccggccacgacctgaatcgcgacaacctcaccgaattcctgcgcgccgtacccggcgtggccgaagtctccatcggtcatgcgctgatcgccgacgcg

SEQ ID NO: 83765 - DNA, 504 bp, Oryza sativa
gatctccctattgttgaaaaaccagtgccggctatccttatgaacagtgacaatcaaacggtaattgtcaaagtgaatagttctaaggataatatgaaatcgtctagacatgtgaaaaacgattgaagtctgtcaagaaattgataaactccggagttataacattgggttacatccaaacagctagaaacctggcagatcccttcacgaagggactatcatgaaatgtgatagacaatgcatcgaacgagatgggtttgacacccatgtgaattatactatggtggtaacccagtctatgtgatcgaagatcccgtgaattagaacctgggaagaacaaactattaataaactataagagactaccgagatataccctctctaagtgaaaatgcatgtactctcgtgagctgcaaagcacgttggctatgccttaatgagttctgttggctttaattagcgaacatgctttcctgcatagcattcttgaaagaactcaccttt

SEQ ID NO: 83766 - DNA, 594 bp, Oryza sativa
tacccatgatattttgatgcaatggataggatggctgttacggaatgtagcgaattcttgatgaaatgtactttctaatattaattgatcaaatttgagtatggaggccctttgcttgtcgactaagtgacaacgtcatggctagggatgcactggtgtttttatatttggatctcaagccctcgtatctggttctccagctgaatgtgttgatgcgatgactgcagcttaccaatggatgactctgtcatcttttcgctggcttgaagaactctgcagagaagcagaagtaggatatgttgacatcaggtgcttaactgaaacccgaatagaatccatttattttgacttcaaactgatgttcagatctgacatttggtgcacaacatgcagttgggggttttgacgtttcttaagtttttttcattgaacttgatcagccaaataagctattttagacgtgattcatgacctgttagtctgaagcgaaagcagaatcagattcaagaaatgcagatgtagaactatccaatcatatcgatcgagcacaatcttgtcatgccattgccagacatccattcttgcacaaagcaa

SEQ ID NO: 83767 - DNA, 1064 bp, Oryza sativa
acgattgaccctagcatcctcctatcaaatgaagacaccccttactcacgcagcgatcacaagaagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgtatatgttagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggtaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatacatgtggcatttacatatgttaattagagtttttagcatttaatttaatataattcctacgctaagtacatatgatgattacaatttttattaattttaaatcatgcagtatgtacattaatatcttaattagagtttttaccaatataataatatcattcatatatatgctaagaatatatatatattggaatttttattaattataagtcatatatttgcttattacgatttatccacttaatttattacagacaaaaataatttttcgaagtaattgtcatcaatctttgtactttaaataatgacaatgcattaacttctattttataaacacatatgtaagcgaaaatcatatgccctgctataatctttaatccccggtcttaaccctaaccgggtttaaaaagaatttcgaaataaccgggaaaagatatttactcc

SEQ ID NO: 83768 - DNA, 648 bp, Oryza sativa
cccatgtttaagaaagtattcttaactttcataagacctaacaaaaaataagaatcaccttgtttcctatcaacttgggtaatagactgattataaagatactttgtttttaataagtcttgccaaaccccttactcatttattaatttaaacaaccatttagtcaaaaggtatttattttgtatttctaaattatggacacccaaactaccctgatctttgggttggcaaataatatcccatcttgtaagtctgtactttttcttatgatcatccccttgccaaaagaatgttgatctataataatcaattttttgaagaaccccttttggaatctaaaaaaagatatcatattaaacataagctaacactttgaagggaaaaaccccaagaggaaaaattttttttttaatcaaaaccagtctacccctaacagacatatgttttcccttcaactactaagtttcttctcaattctttgttcaataactttccaatctttgttactaagctttctaaaatgcattagaataccaagatatctaactggaaaagtacctaacttacaacccaaagatagtagaatattattcataaaagtcctttgcctggccaaaacaaaataattcacttttattaaaaattatt

SEQ ID NO: 83769 - DNA, 553 bp, Oryza sativa
ataaacattgtaaatgtagttagaataacaaagtagtgcagagtagaagaaatgcagaaccagtaaaatactgggaaatgtttagtaattccaactacagaaaattacagaggaattgaatcattgcatgacagcatgttacacctatataatttattttcttaggaactgatacacaaatatgaactgttgttgccagcattttacatactacacgtgaaacaattatgtgtatgtactgtaagcataattgccttagtttcataaccgtttagcaggcaaagaattcctgaactttttcctaaacaagataaaacccagggcaccaaggaaaggccaagatgttacaaaagcaatgtaagtaagcaaccaaacagatctcccctgcgatcgaatgagctgattaatggatatctttacaggagcaatagcatcctggattttatctatgttttgttttggctgttcctgtgatcctacaggaccttgggctggcgtcacattctcttgtgacctattaccgtcacactcattctgtatttctgtggcgatt

SEQ ID NO: 83770 - DNA, 3703 bp, Oryza sativa
tgttttctgcttcccgattcctttggatttgcagcacctttccaacctagttgcgattcccaacctatcacacaaaaaccactattttcttggcccaatcggcaatcttgaccccaatgatttcatcattagtgaaaccaacagaatcctctttagactagccaaccctaacctgggtcactggaagaataccttcaagtcttggccatctctcgaaaagcctacccctgataagagttggaccacctggtaccaacgcatatcggctagtaagaaagtccactgggatgagattgggatcggccaagcgtttgctctcaccatagccaattctgctaaggatgaacctctgatggccgccgccacctatttctggtccaacaccatcaatgccttcttatttaactaagggccgatgactccaactttgatcgacatcatcatgattactgaattagatgtaacttcatcggctaaccctatgagtatgaacaccaagaaccaatttgacttcaagaccaaaagcataggagggtggtctggttatgtagcggcatacatgggcaaagggcctatcactcctcgggagcacatagctttcttgctaatgtggctagaaaagtttctcttctgtggattcagctgtggtcccacaaccaattggcaatttgtagccgaagccttaaaatcaaagaaacaattccccttgggcaaaatccttctcgactatctataccaaatgttgaacaatgcatcggctaagatagccgtcggctcaatagttgaagaaggtggaccatggtggctactgcagacctggctaaacctggtagtcataaaagttgtcaatcggccatctgtaacaaaagctgaattcccaaggttggagccaattgtagaagatgatggagaagaacgcacccatcacagatgcatgtcatatggagaatatgcatccacaccagcagatgctggggcaaaactatcggctgagctgctcaaagattggttctgcagcttttatgaaggcttctagaaagatgctcgtgtttggtttctttatgaagactcagcagaccttgagctcccatcagacttcagatttgaagacatcaatcatgaaagatatcaaacatccagggaaatctttatagccgcaatcagcccatgcatcctacctgtcggtattcaccaaggaagaaatatccaagtctcctacgaattctatcaccccacaagttcagctagacaacttggattaggccaactcccaatcgacttattctttgctaacaagatccaatgccgaggagaaatttcttcaactctaatgatggatcgactgcttaacctccaaggacctcccttaggcaatatcgacaatattgagttagcaggattcaggagcaggaactttgacagatggtggggtgaatggaagttgcatctatttcatcaatcggccacaatgtacatgacagatctattccccgacgtcataccccaggtaaactttgtcatcactaaatttcataacggttagccgattcattacttgactaatcttttgttcctgttttgcagacaactaagtcctcccctccacatcagagcaatagtggtaggaacattgaatatgccctaggtctgattcctaatggaggcggattgtctccccctgtcatcggctatcatgcctctaaggtctcaaccctcctccaaggcgccatcagggaaccaaccgatgtaaccaagaaaagaaaaactagatcatcggctgtgagcaccttgactctagctccaaagaaaaaggccaagtctaagaaaaccaagccaaccgacgacctgtctgctttggatccatccattgaacaagctctggatgaagaagatattgaggatgatgttgatcaggctgcagccgaagtaagtgatactaaaaaaacaccatcggcttcgcctaagcagatacctccaactccttctgcccccactcacttcttcagagtaaaacatctttccttgcaaacccttttataatcattattttcagccgactactcataggctttgtagttacagaagaagaaaactgctataaaaaagaaatcagcagcaccaattctcaaaccagctccaccagtaagacactcccaattttactagttgattccagccgattttgtctaacacttgtctttttacagcctcttcctcctccttcttcccctgtacaacaaccatcgagtgaccgaactccatcagccgtggggagtcatcatattgtggaagaagaacaaccagctgctcctgctatcccagtaagttttcctttgatgcaagaatttagatcggctatattgacttagctctcaaactttctgaacttatacctgcaggttctagccgatctcttctcttttgatatcaaagattatcttgttgaggcagaagaagatacttcaagcaaagctctagctcccttatctgacgatgcaaagaaaacacttgaagatatctcgcgtaggctagaagcctcttctctggatagcttagtggtcgactatggatcgattaggacaagattgcatgaagttcaagctctaattcctgaagaactggccgatgtcctaactccagccgcttatcatgagcaacatcaatttaaactagaaaaagccaagctaagactagccgaacgccgtgagcgcaaggagattgaagccacaatccaggtcaatcggtagcttgtgcatgaagaaaaaatcaaactcgatcagctatccgaaggtccgatcaaatccaatatcgatcggcttgaagcccgcaagatcgatctcttggcacagcttgaagaatgcaatgctgaattggatatggagcacaaaaagctagctgatctcccaaaatctgtcgaagagcaaaaagcaaggctcaaatcggctatcaagaatgttgctgacctaaccaagtccctgaaggtcatttctggaactgatgctcaagatgcccaagccattgaagaagtcgaacaaattaggcaaagagctatttcggctatccagcagtacttgtctcaataacttttgtgtaataggacttagaaattcttgtaatcggctaagataccttaataccctgctgttttaacaatcctttgtgccgattaacataacttctaattttcactttcattttttgtatatatgtgccccccaattttataatgtcaacagcattgataaaattagaaaaccaactaagggcgatataacaatatcggtcgttatatatcagcaaaccataaccgattacaactggaaaaacgactaagggcaatataacaatatcggccgttatatatcggcaaaccataaccgattacaattagaaaaacgactaagggcgatataacaatatcagtcatctcaagacgatgtaaacacatcggctgtcatgcatcagcaacactagccgatcatgcgtcaacccaaacacttgggtaatacttcttcaagtatttggcattgagcgcccgtccataaacttcatcatcaagcccttgcaacatatatgcccctttagacacaaccttattgatttgaaacggtccttcccaatttggtgaccacttgccgaacttgttatcccgagttccaatcggcaaaatcaacttccatacaagttcaccttccgaaaaaat

SEQ ID NO: 83771 - DNA, 513 bp, Oryza sativa
aaattcgagtagtacgttaaaaagtaggacctgcattttttaacccaaagggcattgtcgtataacaataggttcctatgggggtaatgaacgcagttttttcctcatcctccctagccatgggaatctgatggtaaccagagtatgcatctagaaaacacaaaaggtcgcaccccgcagtggagtcgacaatctgatctatgcgaggaagggggtaaggatccttaggacatgccttgttaaggtcggtgtagtcgatgcacatcaaaagcttgccgttcgccttgggaacgaccaccgggttcgccagccactccggatggatgacctcacggatgaatccggcttccagaagtcgtgccacctcctcgcggatgaaggcttgacgttccggggcctgccgccgcactttctgccagaccggccttgcgcccggccgcacggcgagacggtgctcaatcacctccctggggaccccgggcatatccgccggtctccatgcgaagacgtcag

SEQ ID NO: 83772 - DNA, 543 bp, Oryza sativa
ttctattggccgacagctcttaatgatgcggtcgacctggtccggcgatgtagagcgtgtcaattccacgccaagcaaatccatcagccggcccaggccctgcaaaccatactactttcgtggccatttgctgtctggggactcgatatcctgggaccgattacgcgggccccgggcgggtttgagtatctgtatgttgcgatcgacaggttcactaagtggcccgaggcttatccggtcgtcaagatcgataagcactccgcacttaaattcattaagggcatcacggcccggtttggagtgcctaaccgtattattacggataatggcacccaattcactagtgaactcttttgcgactactgccaagacatgggcatgaagctctggtttgactcacctggccaccccagaagcaatggccaagtggagcgcgccaatgcggaaatcctaaaggccttaaaaccaagaactttaacatacttaagaagcacggggattcatggatcgaggagttgccagcggtgctttggggaaaccgga

SEQ ID NO: 83773 - DNA, 533 bp, Oryza sativa
tccatactcctaatcttggcttgtggtatcctaagggttgtgactttgagcttttgggctattccgattcggattacgccgggtgtaaggttgatagaaaaagcacaaccgggacttgccaatttcttgggcggcccttgtttcttggtcctccaagaagcaaaattctattgctttatccaccgccgaagtcgaatatgtcgccaccggttcttgttgtgtccaactcctttggatgaaacaaaccctaaaagactttggctacaacttcaccaagatcccactcctatgtgacaatgagagtgccatcaaaatagccaataatcccgttcaacattctcgaaccaaacacatagatattcgccaccactttttgagagatcatgagaccaaaggagacatttgccttacacatgtgagaaccgagagcatattggccgacattttcaccaagcctttagatgagaaaagattttgcgagcttaggagtgagctcaatatcttagattctcgcaacattaggtgatgggtgg

SEQ ID NO: 83774 - DNA, 721 bp, Oryza sativa
attcctgcagcccgattaaaggacttgggagtgaggacatgacaaatcactttgttgtcaaaagacttctccgtacttttggtccaagaaatcccactcttgtatcaatgatacgggaaaggaaagacttcaagaggctcaccccaagtgacattcttggaagaattgtgtctcatgagatgcaagaagaggaagctcgtgaagtgagacaaatggtgaagaatgccgccatgatcaagaatcaagaagttgctttgaaggcaaaacaagaagaagagtcaagtggtgaagaaagtcaagatgaagaaatggcttttattgtcaagagattcaagcactttcttcgcaagagtggctatggaaaaggaaggaaggatgatgacaagggaaagaggcaatcaaagagagcgtgcttcaattgtggcgaatttggtcatttcattgccgattgtcccaagtcaaatgaagctaaggctaagggaggcaagaagaagacggagcgtgctcatgtggcggaggcacacatggcggaagtgtggtactctagagatgaagaagatcccgaagtcaagctcaagcccaagtcaaaagacaaggttgaaggagaaggtggtgttgctaccatcgcctttaagtcatcctcttcaagcaaggagcgtctcttcaacaacttgagtgatgacgacgacgactcctaccactactcttgcttcatggccca

SEQ ID NO: 83775 - DNA, 1124 bp, Oryza sativa
gaatagtacctctcaaccaaatgtggtttctaattcctctaatccttctactagcaatggttgtgctaagtgttacaatattgatttgaactcttatgctactaatattgatgctatgcaagctcttaagaaagagaatgaaaggttgggcacattggtgaaatatggatgcatgaagacataccattcaaaagatgccctttacaagaccatcaccgctcatcctaacaaggatggacacgggcacgggttttcgggtggaagtcctgtgtctaagcgtgtgatggtaaatgggaaagaatgcttgatgtttgtgagagaaggaaaagcaccacaagcaagtgagatcactaatcttgtgagcagccagggacccggaacatccggacaaaccggccaaaacctctgggtgggagtctccatctctcaaaaattcccaccaggaagttccggccggtttgccaggaagttccgggccaatggccgtgcacaagatatgaccggaagttccaggcataatgccaggaggttccgaccagatggtctttactatgattcatatgtaattttcaaaaattcagagggcaaagtggttgcttattttaatgggaattacaatgatgagtatcgcacttgtgtgtgggtgccaaaggctttgataactaacatcaagggacccaaacttagacaagtttgggttcctaaatcccaagcttgatttcttttgtaggcatactcctccggtggttcaagttgggttgtggacagtggttgcaccaatcatatgactggagagaggagtatgtttacaagtcttaatgatgagaacggaactcgtgagaatattgtgtttggagatgatggtaaaggaaaggtaattggtctaggtaaaattgccatctccaataatcaatctctctctaatgttcttcttgtcaattcattaagctacaatttactatccgtttctcaattatgtaagttgggttacaattgcttgtttaccgatgaggatgtgaccgtctttagaagggatgactcctccgtagcattcaaaggcaagataaagggtgatctctatcttgtcgatttcgatgtggatagagtgaatccagaagcttgtt

SEQ ID NO: 83776 - DNA, 559 bp, Oryza sativa
  unsure (1)..(559): unsure at all n locations
cttcaagttcggtgtgtctgaggcgaacatagaccaccattgtgctgcaaatgccaaacaatatgtcatttcactattatgaacacatagagcattgcattatgaaatttttttgctacattagcaaaaaaaataccaagggaagttttcccatccatggccatctttcttgctagtggcttcccaaattcgccactcttacactgatacatctcaacctccagcaaagcggcagctgccgtgtcaatgtccgtcatccactcgaaagcttaacgaaggtcttggaagacggtggaactacaagtgtaagcgtagtgcgtcctcgggttcaataccgcagctacaaaacatagcctaaattagttcaagagttatgggtttaggaattgaacattatgtaaagnnnnnnnnnnnnnnnnnnnnnnnagtgttttagtggtgaggtcgtgcatccttctgtccacaatatccatataagcgttgtacttatccctttcacaagcgaacagactatcatactccattctcaacagttgatatctcaaaagaacctcactca

SEQ ID NO: 83777 - DNA, 592 bp, Oryza sativa
cattctgtcaaacaggtcgattgcactcttggcaagtccaagatatgcaaaagaagaaaccattgatgaccatgtaactagatctgggttatggatcataccaaatgttcgttttgcttcttgaacaaaaccattcttaccataagccatgataagggcattgcccacttgtagaaagtcttgcaagcctcttctaacagtgtaagcatgaagctgagtagcctcattagcagccgccatgtcggcacaggaactaagtagactggcaagcgtaagctcgtcagggcaaaacccatgtctcatcatcgacacgaaaaggtcgaaggcttccttgcctctgtcatgcttaccatagcaaacaatgattgcattccaagatacggtatttctcagcaccatggcatcaaacacccggctagcctcaacaacttggccgcatttggcatacatatcaaggagcgcagtggctaccaccacattcaggtggagacccaacctgatcacaattccatgcaccgagctttccaggaccagcaacaggtttggcatggtcatagcacgaagaagaaaaagaagcacgcacactgagcaa

SEQ ID NO: 83778 - DNA, 550 bp, Oryza sativa
ctataatgacgccacttacatatgtctgtttttatctaagtttttcatatgaagttggatgaagataaactttatatcaaatttgtataactcgacgagatatacaaatttggagttgattacatttttcttcgaggtcaacaatttgtagttgtagatcatctaaatgagatcgataattttgtagttaataaaattttcagttgtagatctaaatatggattatatgtttcgaatgatagaagtatcaaaagaatagtatttgcttccaagacaataagtgttttccggtgagatggtaagaagtctttaggtggagagagaggtaaaatggtattaaaatcttgtgagttgtgggaaacgatacttgaccatggctgcctagtgaaatatgtcattcctccgtttcacagtgtgtaagacttttgtccatatttatatatatgctaatgaatctatatatataataatgtctagattcattagcatctatatgaacgtgggtaatgctagaaagtcttacattgtgaaacggagggagtaatactat

SEQ ID NO: 83779 - DNA, 726 bp, Oryza sativa
ccaaaaatgggttgattgtctcaagtagaagaccaacacatcctgtataacaaaaagggcaagaataacataaggcaaactcgccagctaaagtaaaggaaacagaggtgacaaaacaattgctgtccatacctacagaagttaaattctcctggttgaagggaccagcatttgctagcttctcaatgaatctcagcagctcgagttgaactttaggtgtaaatactagcaaagagcggatcaaaacaactacagcactagcattatatatacgctccttgtcaagccttgatagtccaaatgaggttgcagacaagaaacctgattcatcctctgggttttcagatgaaatgctctctacctgcaggttactagtgggaggaagaacaacctcaagtgcaagctcaagcaaaagcaagataacatgcttctcacaatccacacagagcaacccagattcagacagaagatcatagaaagtgttggaagacaggattgtatgcagtcttatcctattaacaggattgctgtatactgcagctgtcatagctcgcattagaaaaccaaagatcttcatatgagtaagcaaagatgattcagtctcctcgttttcactgtcattctggaaactgtgaagcgttgttagtagcagggaaaacccagtggcttctccaaaaattctttgagctgaactgtttgccccaagaatacgccacaaagcgccaa

SEQ ID NO: 83780 - DNA, 570 bp, Oryza sativa
tactatcgccatggtgggggtgagggagttattttgtgcttgtatgttgacgacatactgatatttgggacaaaccttgaggtgataaatgaggttaaatcattcttgtctcaaaattttgatatgaaagatttgggagtagctgatgttatcttaaacattaagctaattagaggtgagaatgggattactctcttgcagtcccattatgtggagaagatcttgaatcgctttggctatattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacttctaatccgggagatgatcactggcgtgcgcttgagcgagtaatgcgctatctgaaaggtactgtggaattgtggcttcactatactgggtatcctgcggtactggagggttatagtgattctaactggatctctgatgtggatgagatcaaagcc

SEQ ID NO: 83781 - DNA, 692 bp, Oryza sativa
ttcaacgaaattaccgtaaccacatcaccagtaggttcgagaattcgctgaatgagaggaaccacagctgggtcaccacaaacatgaagctcatctgaacaaagccccagaagtgcacgagtgaatgaaaaacccctcgatctacagccaaccatctactaaacagaagaagataacatgagaatgatgaggaatattacagtaaaaaatatgactggcttgatgatgtagtccaaaaaaatgggatgacaattctcttaattactgtttgtattatgaatatacatttaattagcatatctacagaaagaaggttgaagtacctgaatttcatcaataacggcacattgatactcagttgtcatgtcggccatctcaactgtcactgagctatgctttgcaccttcaatttcctccctttcttgtccagtaattaagttacaagggacattagctttgtttagtctttgagctacctcccgtgccaacaatctaagaggtccacagtatactcctacagaattcatcaatagctctgagaaatcatcataattgtatattaatttattatcactaagtagaacaaagtagtacctgaagaacttgcttctagtctcttgagagcattatgtgtcttcccactatttgtaggaccgacatgtaaaaatacattgcgcttcttttctcgggca

SEQ ID NO: 83782 - DNA, 559 bp, Oryza sativa
cttctttcatagtaggtctctctcctcctttagctttcaagcatgcttgtgcaattgaagcgatatcatcaatttcttcctgtccagcctcttccaaaacttgggaatccaagatttccatcagaactccctgctgaagtccttctaggaagcattgtgataagttttgttttgtacctacatcatttattaaaattggcttctttcttgtcagaagctcaacaagtatcactccaaaactatacacgtcacttttccccgttagttggctagtgttgtagtactctggatctaagtaaccaaatgtgccttgtaccattgttaccacatgagtttgatcgagtggtatggatctcgaagcaccaaagtcagaaacctttgcagtaaagttgtcatctaggagtatgttggaagattaacatctctatgaaaaattggtattgcagcagccgagtggagataagcaagagctcctgcagtttcgattgcaatcctaatacgatcatcccatgatagaaggcatttagcacttacatcattgtgaagaagttcacatagt

SEQ ID NO: 83783 - DNA, 722 bp, Oryza sativa
atgagctgcgagtgctgcgggctggaggaggagtgcacgggggagtacgtgggcggcgtgagggcgtacttcggggggaggtggctgtgcgggctgtgctcggaggcggtgaagtacgaggccgggaagagctcgccgcgggcgcccgtcgacgtggaggaggccgtgcgcgcgcacatggccttctgccgcatgctcaagcgcggcggccccgccgagcgcgtcgccgagggcatgtgccagatgctgcgcaccgcctcctggaagcagcggcggcgcgcctccggatcctcctcgtcgtcgtcgtcgccgtcgccgcgagccgcgcccgagcgccaccaccaccaccgcgcgccgtcgacgctctcggtccagctcatctgatcgggcgatcgatcatcgccatacatgtacagcgagcgcgcgcgcgcgcggtggcgtggcgtggcgtgcggttcttgtgacgaggtgcacgcagcgcacgacgcatgcaatctccatcgtcttcttcttcctctcgcatctagtagagagactagcagtagtaatatacataaggtttctatgtgaattttgaattttgatcaggtggtgttaaccacggtgaaagagggtgcacatatgtgtaatcaagttcaatatttttcacattcttttcaagtaatatttcacatgatcttgtactatactctcgtgcctttagctagcttcgcttctaggag

SEQ ID NO: 83784 - DNA, 1199 bp, Oryza sativa
tctctccctaaccgctccaatattttccctaggtcttgccggccatcggccgcggctccaccgtggtcgggcgtcgtcgaaacgccgttcccgtcgcctcccgtgccggtcgccgccatcttttccgccgccggccacctccccgtggtcgtctcgccgtcgccgtcctcggtgagaatccctatcgccccctctcctttttccccatccgccgctccccatgcccgccaccgcgacgcgctgccgtcgccggtggtcgtctggccgcgtgcgcgtagccgccgtgccatggccggccgggtcggtctcggccgcgcccgtgccccagccgcgcgcctgtgctgcggtggaccgagtccaccatgagccaccccctttgacccgctgacgtgtggggcccgcctgtcggcgctggttccccttgctgacgtcagcaaatgccatttcctttgtaaaaataaataataattgcgcaataaatcgagtttaattctagaaatccattaaaatggctcaaaacttctaaaattcatatctaactcattcgaactccgaattgagccattcaacttgcaaaattcatctaaaattgagctctacatgtttgtttactttttatgtactgtttccttggtttttattagagtttttcctcgttttgcgtgccagcgtgtagaatccgtcgtttcggaagtccgcggtcgcgaggaaaagagttcggaagatcaaagtgaagaagcaaggcaagtcacacattccccttgagcatgttgatcccaatttataaatgttttaccgtttgcaaataaacatgcatgtcttgctaattacatgggaatagggtttacctatctgctcgcttgtgccatgtttacttgatatctatcctttgtcaaccttgggtgataaattgactagctcgtgttacttatgtgacctagctagaactatatgcttagccatgcttaattaccactagctcagtcgatgggataattgcagtattagacattctagtatcttgttgagccgcgtgctcgagacatctggccatgttttgtgggtgtaattatccaactaaaatgcgactgaatggtgggctgtgggtgcatggttttgtgagtcgcacccatggcaattaaggaccgggttcacggaaaaccctgaaagattacagcgcttggcacaagcgggaatgg

SEQ ID NO: 83785 - DNA, 513 bp, Oryza sativa
ccacctccgcgtctcgtgccgcagcccacctcctgcccctgcgcgccgcctcgtgagagcgatagagagtgtgaagagagagagaggaagaggggaaaatgatgtatgacatgtgggtcccaccattttttaaaaaaaatgttgatgggattgtcatgcgtacaccacgtaggacaaaaccgctctggaatgggttgagggtgttaattcgtccggtattaaaggtttagggtaagcaatgtctggcgggttcagaggggtaattcgatcgaccgcgatagttcagggataattcatctttttttccaactagagattgtcctacaagacatgcctatagacttttgcacaggctcttctgatatcttccaagtacttcatccgttttatattataagactttctagcattgcccatattcatatatatgttaatgaatatttcatattataagaatttctagcattgcccacattcatatacttcctccgtttcacaatgtaagtcattcta

SEQ ID NO: 83786 - DNA, 551 bp, Oryza sativa
ccttttgtctgaaagcggtgtactccccggagcggggtgacacgaagatacacgtaatctccggcctcaaaagttagctcccttcgacggttatccgcgtagctcttctgtcgagactgagcaatcctcaatctctccctgatgattctgactttctcttctgcttccgctaatacttctgttccgaacagctgacgttcgcctgtctgatcccagaagagaggtgtgcggcacttccggccgtatagagcttcaaacggtgccatctgtagactggcctggtagctgttgttatacgagaattccgcatatggtaagcttttgtcccaagctccaccaaaatcaagagcgcaagctctcaacatatcttccaagatttgattgactcgctctgtctgaccatcagtttgcgggtgataggccgtgctgaaatttaaacgggtccccatttcttactgcagcttctgccagaactttgaggtgaactgactacctcggtcggagactatcttcttgggtaccccatgcaaacacatgatccttgcgaggta

SEQ ID NO: 83787 - DNA, 727 bp, Oryza sativa
tgtctcacttcctttcgtgatattttgtgctctcgtggaatgtaggtaacttcaccaggtggcaacactgtgtatacattgaaggggaagtctggtgacaaatttgaatttaaagctccaaggggtggaatgtacaagttctgcttccataatccatatggagcacctgaaaccgtttctttctacattcatgttgggcacatacccaacgagcacaatctggcaaaagatggttagtgttctggtcttttaccttgaccttttcgcttgtcacagtctcatatctgcttatcacgtcaatttatttgttttgagcattgaatcacaatcagtttaatatgcgatcataggtttatatttggtatgttcattttatatttgcgtacataagctatatttggttgcttttgcagagcacttggaccctatcaatgtgaaaatagcggagctgaaggaagcattagaatctgtcactgctgagcagaaataccttaaagcccgtgaagctcgtcaccgacacagtaagcttaacaatccttttgcaaatggtcactgaagctttggcagtttcctataatcctgcgtgtgatatgagaatgcataaatttgtatgaattttctgttggtccactcaccaccctttccacatgaagcaagaaaaaactgatccgttattacattttaaacactacaacattatcaccatcagaaagaagagcaaataggg

SEQ ID NO: 83788 - DNA, 676 bp, Oryza sativa
aattcaagattagattagtaatttgatactatgtgtacagatttggggggtttgatttatacttttaaaagagagggggtgtatcaatttagtatagtgacaagtgacaagtgagtgattggtgcagaaagggattggcacacgattttaatcccaggagctacctgatagtaccctccttacttttatagtgctaggagtaccattttcttagataggagtagatgtttgctgatagagagtaataggtgggctccatgtctaaacaagatgttaattaagcagcagtaatatttactccctccgtattttaatgtatgacgccgttgactttttaatcaacgtttgaccattcgtcttattcaaaaaatttatgtaattatcatttattttattgtgacttgatttattatcaaatattctttaagtataatataagtatttttatatttgcataaaaaatttgaataagacgaatggtcaaacattgttcgaaaaatcaacggtgtcatacattaaaatatggagggagtaatgtactagcaaatcacccacgcatgagatcaccgtattatcccaatctatatccatttctccggtgcagcaattttcctacccagaagcaagaaagtgattgctacttcaatacgtgttgcaatctcatgacagtggtcaa

SEQ ID NO: 83789 - DNA, 719 bp, Oryza sativa
atgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctcgcctggcatggcatggcatggcatggcatggcaggcggcgtgcgtgcacgacgtacgcgtcgaatggtccgaaaaattggctcctcacccttgcgcagatgcagcctccttttgcagttttgttttgctgcaaattcggattcgttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcaatatatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcacgcgactgctccctgttcgttcgcgacggctcgccttcctcttcgctcgcgtgtttcgtgccttcgtagacacctgcgaaatgttt

SEQ ID NO: 83790 - DNA, 504 bp, Oryza sativa
ggcggtggttctcattcggatgctataagagctatctcgtttagtgcaaacggtgctctgttcgcatccgctggtgatgacaagcttgttaaggtctggaagactgattcatggtgctgcattcggaccatgtaagtcaccctgtttgttttattgtgaaagcataatggattaaccaaattagtgtaccattttatttatcatgtattcagtgagtcaatctacaactattcttctgctacttatctacgtgtttatgagaatccacacataattgttggctgacacacttagcagcttggagtattgttagttatgttaaaaacttcatttttgtggttggtaatgtattaagtccttcatgcatgagtttgatttcttttgcaatgtctttacttttgcagaacttctgaaaagagggtcagtgcagttgctattagcaatgatggcacatatgtaacttttgcagataaatttggtgttatttggttagttaccatgggg

SEQ ID NO: 83791 - DNA, 697 bp, Oryza sativa
aaaacagaagaacaagatcaaaatatttcaacccacaatgaagaagagataaagaatgtaccaactgatgcttccttatatagtttgctgaagtcccattgtcattcgcaagaaggagaccaagaacctgctcagttaaggaataaatatattaggaacttacggtgtggcaggaagtcaggtatccacaaaaaatgttgcatcatatcaacttacctgcattgcgtggcgatgaagctgaattgtgtgaattggaacaagaccctccctaaattgagagaacacggtcagggaaccatttgcaaccatgtggaatagaacttgtagagcatcatcttcaattaggcttggtgcagcagatggatggctcgctagtgccttcattgtatgtactacacttgcctcgatctccatagagcaaaaaacaaggggaaaaaaatcaaaactcaaattaaccaggcaaagaaattaagaaggtttaacatatcacataatgcaggtttggcataaaacgaatgccttgtattagttcagatggatactccagcatggcactatgtgaagttcagcggataaagtattaacaagttgtgattttgcatcagaataagttaacaactcctccctctgtttttcagtagatgatgccattgacttttggcatgacattcaacctttcatcttattcaatgtcatt

SEQ ID NO: 83792 - DNA, 592 bp, Oryza sativa
cataatgtagaattgtcccccacataaatcacgtcgaatttctcgcctgcagcaccaagtttgagtacggcttttaaaatccaagcgtgtagtttatttcgctgctcgggcgtttgtactgattcatcattctcaatatcgtccaacaccaccaagtctggacggtatgcgccgtgacgacgtccacgcaatttttgtcccgcaccgactgcttctactttctgatttttgctagttaaaatagcccctgcacgccacaccttacccgcactcaactcggggaaatcaatatggaggcgtgggttgctttcgatttcgactttaatcgcttcgagcataccgtaggcttgctctttcgtatccattgcaataatgatgtatttttttagatcagctaccatacaccacagtgggaaaagctgagtacaaatggttgattttgcctcaccgcgaggtgcagcaattgcctgtcgaacagatttacttaattcgccaacattgactgaagccggcaaattctcgaaaaggtattcgtgcaattgagatttgtgctctgaacgcacataatgcggaaaataattttgcacaaaaa

SEQ ID NO: 83793 - DNA, 539 bp, Oryza sativa
tgctggagttgaacgggcggtgctggcggacgatcatggtggtaggtccaccctgctgtccgggagtgaagcgcggtcggtgctgactgccttggttggaccggaactgcgccgcctttcttttcctgtccattttgttgcgctgatcctcctggcggattgccttgtcaaccagcctctcaaagtcggcgtagtccccagatatcagttggttggtcagctcatcatccagacccgccatgaacttctcctgcttctcggcgtcggtgcggacatcctctggtgcatatcgcgcgaggcgattgaactcatggaggtactctgtcacagtcctgttgccctgatggagcgcacggaattccctcttcttttgtgccacgaccccatctggcacctgtgccttcctgaagctacggcagaactctgcccatgtgacctcagtacccggtgggcgggtggcatgtggttgtcccaccaagctgacgcaggaccctgaagctggtgtgtggcgaaagcgaccttctcctggtcattgcact

SEQ ID NO: 83794 - DNA, 616 bp, Oryza sativa
taattaggaatagttttttagtttccttttgtctttagaaaaatatgtgtttagtgtccgataaggactttatgttttccttttatctttacgaaagtttctttcttgtcctacaaagactaatatctccccatgggtataaatatgtacacccggagtcattgtaaactatctcttgatcaatacaactactctcggcgcatcgccaccctctttaccgaggtttttacttatcaaccagcggaatttggcacttgaagcggggctgcatcggctttcgatctccggcgaaggggtaagtcctacgtttcgccggccccagtgaatctatcggctacattggtgttgttcaaggctgcatcgcttcgatctcttggatcgctctgatttggttgatatatttgcctacctgatatctcaattctatctctagttgcatttgtttagagacacatcggtttagttgggactgtcttggttaggttcgatcttctgtcttagccgatatatctctacaatcacaatgttgttataaatagatttgttatatccatcacattagacagatctatcggctcatcgagtttaaattatcatatacaatctcgtgctgcat

SEQ ID NO: 83795 - DNA, 586 bp, Oryza sativa
aaaccatatagatataagctatgatattccattaaacaaagacagtcatgaaagaataaaaatatatctatctgagtcttgtttagatagctttatcgcacttaatttatttggagctagttctactaggtctttcaatgataataagatatatgaattgcttgaatatttgaagaaaaatacaaataaaccaattttattgttaacattccctgcaatagctagaaaattaaaaaaaattgcttgtcatttttcggaagtatttatctatgaacatacgaaaacagtgtttgatactatagaattaatacgttttgctgatttggttatttcacctgatacttctattgtgcatattgctgttggacttaataaaaaattaattgcattttatagtcttgatgaacaaaatttcattcactggcaaccaaataatttagttgaaacacatattttgcgttttgaacataacataaatgaaataaatatttcagaaattcaagcaaagtggttaaattaataatacgttttgaattatttaaatactgcccaaataggggcatgatcagagggtttttccatagct

SEQ ID NO: 83796 - DNA, 662 bp, Oryza sativa
ggaaattaaaattcacagtatttttcctaaaagtaaaaagttagtctttgggtaatcctctaagcacagcaacggatttaaatggtgctaccgatgttaaagctgctctattttcaaagtacataataaatggttttggtgacgtcactttttcattacgccataatgagcctaagccaactaattgaatatctttaggcaaagaggctaaccttttctgtaatacttcaatgctatttttacgagggtggccaattataattacatcaccgtgcttgcgtgcgtaatcaatagcggtattaaattgtgcggtaatatcagctaaattgtcactattatctaaaaataaatggcgttctaacgttcttatacccaattgacgtgctatcttcgctgctacactagggcctgttttactgtctaaaaaaagagttgttcttttaataatacctgcattaaattggtcattgttagccgatcagcggtcgcgccactccccatatggttgttcaagccaattgcataaggcacttgctacgcgcagtacgaattaattgattaatctcatcttgactatcattcaccattaatacgtccgcttcaataggtttagatttatctttaggctgcatgggtaagtgaattaaatatatcccgttttt

SEQ ID NO: 83797 - DNA, 814 bp, Oryza sativa
gaaaaaataaaacgtaacggtgaatcaaaagaaagcagtttttctttatctcgcataattaaatcgtaagtgtcttcgtccgcttttgaattccctttggtatccgtttctttgcctttattatcttgagaaaaataaccattgtgtacacctaccgcactttttcctgtttcacgctcatagatttcattgaaccagcgataaaatttaccgttatcacggtaatttgccaccttatcaataaaaaacagcgaaagcactttaatgcctttgctattcagccatttttctttggctaaatgctctttaatggtgcactccatctgctttttcataatttcatcacgcaagagatcatcatcttcactttgtgtaagcacttgcccattagataagtggatctctccaaatgggggaaatcggcagacgcataattcattgataataaacccgtgtcgataactctcatttttgcctgatttttcatagagatcatcacctgcttgaatggtaactacttttttcttcgtttctttctccgtttgaacgtgaatttcaattttggctttgagtttacctttgccaaccacaggctcttttagcaccacataagccccgttcacatcgttttctgccagcacaggttcgacttcgatttgttttaccaatttttggttataagcgtctaacggatttaagctataaattttatggtatggatttttatgcgtggcagaataacgcaatacaaatagcggattcagggcttctatcgcctgtttggctaaatctgtttccatattttgcggttcat

SEQ ID NO: 83798 - DNA, 2200 bp, Oryza sativa
agtttccgctagatctgagagtaacatttcctggttgcgcgtctttacaaccaagtcatcgacataagcctcaacattacgtcctaattggttacccaaagaaattcgagtagtacgttgaaaagtaggacctgcattctttaacccgaagggcattgtcgtataacaataagttcctatgggggtaatgaacgcagttttttcctcatcctccctagccatgcgaatctgatggtaaccagagtatgcatatagaaaacacaaaaggtcgcaccccgcagtggagtcgacaatctgatctatacgtgacagggggtaagggtccttaggacatgccttgttaaggtcggtgtagtcgatgcacatccgaagcttgccgttcgccttgggaacgaccaccgggttcgccagccactccggatggatgacctcacggatgaatccggcttccagaagtcgcgccacctcctcgcggatgaaggcttgacgttccggggcctgccgccgcactttctgccggaccggccttgcgcccggccgcacggcgagacggtgctcaatcaccttcctggggaccccgggcatatccgccggtctccatgcgaagacgtcagcgtttgcccgcaggaaggagacgagcgcgtggtcttggacgggccgtcgcccaaggcaacctccttgaccgggacctcgttgcctgtgatcatccgctgcctcggggtggcgggggcggaggcgccaagcctctcgtcgccaccctcgggctcggatgcagcggcgaggtggtccgtgcgctgctccagacaagcgagcgcgactttgaggtcgccatggacagagatggggccaccggggcccgacatcttcatctgtaggtaggcgtagtggaccgccggcatgaacttcaccaacgcgggccttcccaggaccgcgttgtagggcagactgaggtccgccacatcgaagttcacccgctccgtgcggaagttggcggatccaccgaaggtgaccggtaggtcgatgtgacctaacggccacgtgtgccccggcgtcacaccgatgatcggctgggacggccggagcaccatccccggggccttgattgcgtcaaaggctgcgggggaaaggatgttgagggctgcactcccgtctatgaggacacgcctcaatttcacattgcaaatggtgggggaaaccaccatcgcgatctgtcctccccgggcaacgcacggcgggtggtcggtctggtcgaaggtgagggccacctccgaccatcgcgcccgccgcgtcgcctcatgggtaggggccgcggccagaagctctcgcttcacggccttgaggctccggcgagaagcatgagcgcacgctcccccatcgacggtggcgacagtagcctgaggctcctggaaccccaggttatcgtcgccatcgtcgacgtcctcggcgggggccttctgcttggcctcacctcgctggttgccggcgggggccgccgggaccttgccctcacggcgcttctgcctactctactcctactacttcctcgtccgctcagccaaacttttgaccgcgcggcagtccgcgaggtcgtggaaggaggagttgtgcacggagcaccacttgccagtcgggcgctccctgctgggagcaccggcctccttatttctgtcgctcgcaggcctccccttttgggaggcccaggaagcgccctcgacggccaggacgtgcccctcgccgtcgaaataggccgacctcttcttcctactccagtcccgccgccctgaccgagcggcggacccgttggcggccggagctgccacaccggaaccagaaaagttccaggtccaggcctcctccttgcgagccacacggtccgcaagctgaaaaagctccacggaggtctagggctccttggaggcgatcttttcgagcatgcgattgtgccgcacgccccccctgaacgcgtagatcaccgcgtgtgcggggatacacggtatggtattgcggacttgacagaaccgctgaatttacgagcgaagagactcatcgacccctatttgtaccggatgcaaggtcgatacttcaccttggcgcggatatgtgccctggaagttcatggggaactgctgacacaaatactcccaagagtgtaccgacgcgggtggcaagctcctaacgggagacctcgcaagcccccctt

SEQ ID NO: 83799 - DNA, 645 bp, Oryza sativa
gatttcaatggcattggtttcaacttccttgagtaattgcaaccctttgagcactgcctcatactcagcttgattattagtcgcatacggtttaatagtataagcaaactcgaaacatgcccccctagggaaaattataactaggccgataccacaaccgtgagtacacaccgatccatcaaagaataaagtccatggcactatttcaaccgagccgattgaatcatcatgatgttccacaataaaatcagctatagcttgtcccttaatcgccttcggcgactcataccgaagatcaaactcggttaaggaaaatatccaatttccaacccttcctttcaatattggagccgatagcatgtacttgacaacatcggccttgcatacaacagtacactcgttggacagtagataatgcctcaaccttgtactcgaaaaatacaaacacaagcataacttctccacaggggaatatctagtttcagcatccaagagccgacgactgagatagaatacaactcgttccttcccttccaactcttgaatcaagaccgagccgattgacttctcaccggccgataaatataacctagacggtattcctttctgtggaggaatcaaaacaggaggagagctaagatattt

SEQ ID NO: 83800 - DNA, 1276 bp, Oryza sativa
tcatgcatcggcaatactagccgatcatgcgttaacccaaacacttgggtaatatttcttcaaatacttgccattgagtgctcgcccatagacttcactatcaagcccttgcaacatatatgctcccttggacacaaccttataaatttggaacggtccttcccaattcggcgaccacttgccgaatttactatcacgagtaccaatcggcaaaatcaatttccagacaagttctccttccgaaaaatccttaggtaccactttcttattataatgccaagcaatacgttcattatccttggtaacctttgcaagggctcgcaatcgtgtctgaaccagatcctccctctcatcggccataaggttgtaatactcatcagctgttaaatcgttttgtgattccattcttagagagccaattgtaacctcccatggcaaaacagcctcatgcccataaacaagtttgtaaggagggacttggatcgatccatgacaagccatcctataagaccacaatgcttcggccaacctagtatgccattgtcgaggataatcagaaattttccgcttaatcaatttgatcaaacttttattaaacgcctcggcttgcccattagcttgtgcataataaggtgaagaattcaataatttgatacccatgctatcggcaaactgaacaaactcgtcagacacgaagattgacccctgatcagttataatagtttgaggaataccaaatcggtagattatatgttcttgaacgaattgaattgcatccccagaatcaactttcttcaaaggaatcgcctccacccacttggtgaaataatcagttgccaccaatataaacttatgtcatttactcgatggtgggtttatcataccgatcatatcaattccccaacctcggaatggccatggcttaataataggattcatagccgatgccggatctcgctgaattgccccaaatttctgacaatcttgacaccccctataatatctgaaacaatcctccagcattgtcagccaaaaataccctgcacgccgaagtaaccacttcatcttatgagccgattgatgagtaccacaaattccttcatgaacttcgccggttgcaactttagcttgatcggcacccaaacacttaagtaacactccatcaatcgtccggtaataaagctcatcatccaacagagtatacttcaatgccttatatcgcaatttcttagaagccgattgagacggattatgcaaatactgatgcacatcatac

SEQ ID NO: 83801 - DNA, 1360 bp, Oryza sativa
ggtggactatctccccctttcatcggctaccatgccccccaagacttcaactctccttcaccggcctaactagagaaccagccgatgcaagcaagaaaaggaaaaccagatcatcaagcatgagtaccttaccctgggctccaaagaaaaagaccaaattcaagaaaactcaaccacaaccaactgatatgtcgactaatgatctgcccgccttggatccatctattgaacaagctttagatgacgaggaaattggtgaagatgttgatcaagctgtagccgaaatgagtgacacagaaagaacaccatcggcttcacccaagcaaacgcctccaactccttacgcccccgttcattttacaagagtaagtacctctctctgacttcttctgaaattacctcactcttcggctaattacccatagactttgtggttgcagaagaagaaaactgctgtgaagaaaaaaaacagcagcaattgttaaatcggctccaccagtaagatgtccttaattcttttacttaatcaatctcaactgattatatataacacttgtctatttcgtagcctcctcctacttctcctcctatacagcaatcgtcaagtgatcagactccatcggctgtggggagtcatcacatcgaataggaagaacaaccagctgctcctgctatcccagtaagtttccctttgtctcaacaattagatcagctataatttacccagctcttattctttccgaaattgtctctgcaggctctagccgatctcttctcttttgacatcagagattaccttgatgaagcagaagaagacacttcaagcaaagccctagctcccctatccgatgatgtgagaaaaacacttgaagacatctctcatcggctagcagcctcttctttagacagtttggtagttgaccgtgggtcaattaggacacggctgtatgaagttcaagctctgattcccgaagatctggccgatgtcctaactctagccgcttatctcgagcaacatcagttcaagctggaaaaagccaagctaagactagccgaacgccgtgatcgcaaagagattaaggccacaatccaaactaatcggcagcttgtgcatgaagaaaaaaccaaacttgatcagctatctgaaggtctgatcaaatccaatattgaccggctcgaagctcgcaaaattgagctcttggcgcaacttgaggaatgcaatgccgagctagatatagaacacaaaaagctagccgatctcccaaaatcaattgaagaacaaaaagcaaggctcaaatcggctatcaagaatgttgctgacttaaccaagtctctgaaagtcatctctggaactgatgct

SEQ ID NO: 83802 - DNA, 774 bp, Oryza sativa
caattcctttggatttgcagcacctttccaacctagtcacgattcccagcctttcacacaaaaactactattttcttggcccaatcggcaatctcgaatctcgaccccactgatttcatcatcggtgaaactaaccggatcccctttagactagccaaccctaacctgggtcactggaagaataccttcaagtcttggccatctctcgaaaaacctactcctgataagagctggaccacctggtaccaacgcgtatcggctagtaagaaagttcactgggatgaaattggaatcggccaagcactcactctcaccatagccaattctgctaaggatgaacctctgatggctgccgccacctacttctggtccaacaccatcaatgctttcttattcaaccaagggccgatgactccaactttaatcgacatcaccatgattactggattagatgtaacttcatcggctaaccctatgagcatgaacaccaagaaccaattcgacttcaagaccaaaagcataggtgactggtctggctatgtggcggcatatatgggccaagggtctgttacccctcgagagcatgtagctttcttgcttatgtggctggaaaaattcctcttctatggatccagttgtggccctacaaccaactggcaattcgtaactgaagccttagaatcaaagaaagaatttcctttgggcaaaatccttctcggctatctgtaccagatgttgaacaatgcatcggcttaaatatccggcggctcaata

SEQ ID NO: 83803 - DNA, 658 bp, Oryza sativa
attttcaatcttcgggaaattgacagtgagtgcacaaacatggagagataaaagtagttcgaaatttgaataattttgtgttcattataatgtggtttgttttgcagactatgatgagtatgaacgctcgatgcttatctcccagatgagctttgagaagtcgtttggactgtcatcagtgttcatagaatcaactcttatggagaatggaggcgttcctgagtccgcaaacccatctacactgatcaaagaggccattcatgtcattagctgtggatatgaagagaaaactgaatggggaaaagaggtgttaattctccccttattatctatacctttgttgaagttcattcctcctaaaactcaaagcgtgatttcttggttctgtcctgtcatagattggctggatctacggttcagtcacagaggatatcctgactgggtttaagatgcactgccgtggctggcgatccatctactgcatgccgataagacccgcgttcaagggatcagcgccaatcaacctttctgatcgtctccaccaggttctccggtgggctctcggttccgttgagatcttcctcagccggcactgcccactctggtacggctacggtggtggtcgtctgaaatggctccagagattgtcctacatcaa

SEQ ID NO: 83804 - DNA, 1016 bp, Oryza sativa
tcacgtacggctaaaagtcgccgggctcgccgggcggggcaccgaaattccggtgtcgcactgtcacacccgcccgccacgtctagcggaggtccggctgctcagcctatccgtgccggccgcctcgccgctggcgccggccgtcatctgcacgtccaccgtcacctacccggtgtcggcgtcggctgcgctggtggtgtactaggtggacgggttcagcccgtactcgctagttggctcgctgaactcgctgatcgtgtactcgctgacggtgcccgtaccggtggccgagcccaacgccatcttcctgagccgcttcatctggtccgtcgtgccgacgctcgtccgatgcatcgcgctctgcccgggcgtcacgccagcgttcaggtgctccgccgccagctcgccctccaggtaacgcacgatctgaccattcgagtgtccacattttcagtgtacaagctacggagttgctgaaaccagaagccgtgcggtgtgtgctgtgtgtttgtgtttgttcagtgaaggtgtgaggagttttggcaagaacctggctcatccgcgggcgagaccgcgcggtgtggcgcacggcggcggtcgcgcaggcgatcagccgccccatgtcgtacgcgtcgtagttgttctccagcctcgggtcaaccagctcctcgaagttctcctcctccacagctctcaccagcaggggtctcgcctgttggacacacacagagatgactactttcaccggccgtggcaaatggaaatctacgtgttcggttcaagactcggaagcccactcacccaagaaaccaatgtgtcaggctggtcaccgtgagacaccatgataggcttcttcccggtgatcagctccaggagcatcacgccgaatgagaagacgtcggaacggtcgttcactttgcccgtggcagcatactctggagctaaatatctggagatacaagttgttgacagcacaaagtttagtccgcgtggtgcgtgcactgaggaacttttga

SEQ ID NO: 83805 - DNA, 1642 bp, Oryza sativa
gtgccatgccagctgctaggatcagaacgcccttgaaacattttatgcatgataagaacgagacagagtatcaacatggagagatcttctcaaggcaaaatctgctcatagacaagctgaaaccttactttgccagttctattaactaaaatgagttgaggaagctaatgtgacggtggggaaaatctgaatgaacagccagccaaaccatgaaaaactctcatttctatggctatttacatttgttaatccttaaagccttacccagagttaattctaatggataaacgcatactgtgcactcattggagaaccatgctacattcacaggtaattcccttcttttctgatcactaaagtttccttgaagtaggaattacatatccatatttgtaccaacaacctgtcagaaagctactagatgccagtgcacaaatgacgcattggtaaaattctagcagattaaacagactgaagtttccacatcaacggtttgtcttctggttaaatagggcttgacttgagggcctatacatcgatagattagtaaagtcagtttattagaagtatgtagaggtagaaacctatgaattttaattgaataacgtaatactgcaagtaccttgttagaggatgtaacggcagtcctccattgtggatcctgtgtaggggatggtctatccctgaacaaaataacaactcttgattgtgtgggcctttctactgtctgccgatgaggaatatctttcatgacccatagaacaaatcctgacggtatggatgatcctgcaagagtatccgaagtaaaattaacaagtggttgtgccatctctctctctaaaaaaaaaagaggcttgccaagtgctttcttgagaatggaatattatgttcgcaataaacatgagaaaatatcaacagaaaaaactattatacaacatgcattctgattccagaattattttgattgattggatgcctagtaaagagttaatttttgtgactaggcaattccactgttgcagttcaatgtgtgccgtaaatacaccatgcaactaattatttttctaaaatcattcactagtttgatggtgttgctccctacagttgagttgcacaacattcactaagtatcaggtagggagaactaagaatccaatttcaaagtggattccataaatataagaccgaaaagaaatgtaagttctggcatgactgcaatatatcaactagcagagtttgagtatttcaatctggtactacacatagaatcattagatctagcctagcttcaccctgggggtatgagaaatgaaaggttggataaataatttatccacacctaccaccacacttactcatttcactaacttattgtattaattcccacatatggttccatgttggagcatgctcacatgcattcaccatcaggcttcgaagcatgtgcacataataagcctgatggcacaccacatcctaccatattttcccattgcaacatgaactacatttaataaaatgttatcgttcaatttaagaggagttatttctagccatagatggtggagagatacctatgaaatagtacataaacaatatgatagcattgttgatgatgtattcatctgctgagtaccaatac

SEQ ID NO: 83806 - DNA, 654 bp, Oryza sativa
ccctgcaaccagttgtcctcttagaataatgtagtcgtcccattgcccacctgacaacctatggatattgacacgaagcttcgcttcttcaggcctttcgcagtgcaacgacgtggcgagtgacctcgttgctgaacgttgatgtggaggagaaaaggaggtgggtcccgtgcccttgcaaggtttgcggctcctagctagggttcaggttcctcacgcccgaaaaagaaggtgcgagcacggtcccctttctgttgctgctcccaaatcttccccattcttctgcgccgccatgtcaagatccgagcaggcttggagcttgttggcgatgctgccgagtgctgacgaggaaggggagaagctggagtatgggaaaaagtggtggggggcaggtcgggtcgcggtgatggcgaaggaggagcggtcggagaggaatgagcgaaatgaagactagggcaaggaggttgatccactccgccagcttactcgattcctcactggggaaacttgatgtaccgacagccggagagctcgtcggctccacctcaggggagtgccgccttttgatccgtgccgccaagagcttgccgtccacgccacccctgatccgtaccggccggagcttgttggccacacgccccttgatctgcacta

SEQ ID NO: 83807 - DNA, 980 bp, Oryza sativa
cgattcatggatcgaggagttgccagcggtgctctgggcaaaccgaactacaccaagccgagcaaccggggaaatgcctttcttcctcgtctacggcgcggaagcggttctcccatccgagctcaccctgaggtctcctcgggctaccatgtattgcgaggctgatcaaaatcagcttcgcagagatgacctcgactacttggaagagcgaaggcggcgcgcggcccttcgagccgcgcgctaccagcagagcctgcggcgctaccatcagcgccacgtccgggcccgatcactctgcgtcgacgacctcgtcctacgccgcgtccaaacgcgtgctggattgagcaagctttcaccaatgtgggagggtccgtatcgagtggtcggcgtcccccggccgggctccatacggctggccacgggcgacggcactgagctgcctaacccgtggaacatcgaacaccttcgtcgcttctacccctgagggggggtcgggtgtcaggtttcgggctcgggccaaccccgcacccccccgggcgtgcagggttggccggggcctacaacatatgcataattcttatttttcttacatccgtatttcaataaaagcagtttcaatttcctaaaggctgtgtctgtaccattttttccttttgtagaatcttgacttgaaatagcacgctcgtgctcaatcctgcccttgggggctcgggtcggctaaaatcgccgaaaggggcccagaaccgagccgtgccccggggcgtgatgaactccggggggggaatcggcaaaaacccacaatcgggtcatccataaccctcggtcaccacgctcccggcctggccagtctcgacatgtggatctccccaggcactagctccggcccgcgccgtttgaggactgggacccgggcacgagcccttgttcaagccaagacacagaaggaccacggcacagaccatcctcgtctcatacacaca

SEQ ID NO: 83808 - DNA, 513 bp, Oryza sativa
cagcaccttcttacgggtttcaagctccgagacgggccggcggtgagccttacggcccacctccaccatgggctccaccgagcgtcgcccctcttcgacacgcgcccacgcggcgtcgagctccgcccgctctgcttgcaagacctccacctgggcgcttaacccatccaacaccgtggtgtttgcggcagccaaggcctgcagaaggggctctgcgttcagtggggcgatagaaggcgtgggccagagccgccttggagaggatgccacgcggttcgggccgccgatagaagtgccggactcggggatgtcccccggacccggttggtcctgagcgtcgcccgagggagtgggcccaagcgacgcgcccgcagcctcgtcgccagctgccccagaagttgtcgcctgagcgtcgcccgagggagtgggcccaagcgacgcgcccgcggcctcgtcgcgagctgcctcagaagtcgccatcgcctcgtcctggcgaaatccgacttcctcccg

SEQ ID NO: 83809 - DNA, 1339 bp, Oryza sativa
gcatacaataaaaggtcatgtagaaaagcagggaaaaaaacaaaaggacaacagcaaaggtatatatccagtaaaatatacccatgagtacaaatccacatccatggacccaacaaagccatctctcacaagtagcgatgatggtagacacgaaatacacaaggaatactgccataggattgggaaaataaaaatcagagttagtaaaatgttggtaatcataaaatatgcaaggaatactgtcaaaggaatgtataatgaaagtacacatgattgaactgattcactagtagagataatacaaatactttatttagaaactagtcaacctgagaagctgttagtgaagtaacaacatttttcttcttataaagttaaacatcagtatatttgattcattaattgtgcacaaattaagacaagtgatcagcagtcatgtcatttggtgtacattggacctatttaaggagagaactagcatgtccgtaatagaaaaattgcaaacaaaaatgagatctattttctatttcttaatcagagcttcaaaaccagaatataaatagttcaactattccttgtgcacatggttcctcaatgtcatagtggttgcattccagcatcataaaaaaggaagctcgctcaaaaacttgaattgtaacattttccaattgcccttagttaaaagtttaaaacatggatagcaggaaccattcagaacaattaagacagtcattaactactgactacattatgcagaaatttccagtgcacaaaaaataataaagaaacctcaagcaaaataaagggaaaaaggtattatcatagcaatacagatctcacctaagttgcataggccaatcataaaatggaatatctgcaagaacgtaggcatataacattaaaaatctggcagctgagctcacagcacagagggaaaaaaaaagtgaggcactaattagcattatttaatatcctactcttgagctctcattcgaaaaccctacagcccacgtattgaagtaaaatgtcccataccaaggaaacttgctacttctgtcaaatagatagactataaaacaaatggttgttttgataatcaatagttatgtttcattcatgagaaggtcacatgattacacatcattaaaggtatgcataaatgaaataacttttgggggttaacatttgtaaatataattatataaacaaagactatattgcaattcatccgaaccttggaatcagacaaactaaataaatgcatactgaacatgatataaagtggtatgccacaaatagtaccattagtaatctaaattactaaagtgtagaaagataa

SEQ ID NO: 83810 - DNA, 700 bp, Oryza sativa
agcattcaccatacataagaagcacacaaatattattaagacgagacaaatcgatcagcattagaaacgatgtcagagtatgtaccgatcgaagagtcatcttcagtgaagtaggagatgatcttcgcatgcccttcagtactgtagcgatccattggtttccatcaatgctcccttttgattcctacaaacaacaacaacaacaaaagacgctacttatgatttgcaggaaaaagttgattgccttgttataggacagtgaagactggtggtgattggtgagtgtactgtgtctagtttttccagaagctattggttgacgatgatatattttgggcataagatgaatactgtccacttattgttgtttagattattttgtagcatgaaaccaagatgaatattctatagtctgaggaactcaacacttttcaagcaagtaattgaaagaatccttacaaaagcttttatgatgtcctcgatagtctcagcagagaaacatttgttgatagttgggagcctatcgaagtaagattgtcattccagtgtcaatttatttcaataatagaataataaatgcatgcgcagcaagttacatttggaaaaggacatcagttcttaacttgtttaaaatactatcttcatcaggttgaacatcagttgagaactcttcaatagcagctcgaacagcagactcatc

SEQ ID NO: 83811 - DNA, 706 bp, Oryza sativa
tgactcttttgcccccctcccctccccttcccttcggatccatccacgaaaatctcctgcccctgcgattccaccgcgccgcaccgatggcacgaaccccacgcaagcgccgccgccgccgcggcggagggggccacgactacctcttcggcctccccgacgacgtcatcctcgccatcctcttccgcctcacgacccgccaggccgtcacgctcttcgccctctcccgccgcttccgggtcctcccgtcccagttcggccgcgtcgactccgcgctcgtcgccgacccggccctgccgctcccgtcgctccccgcgcggccgaccttcatacgccgccttttcttcgccccccagacccgccggttctcctcctccgcgttcggccgcctcctcgacgccggcgccgaccgcgggctctccgagctcgccgtccgcctgccccgcagcgcgttccttccccagaacctcctctccatccgctccctcaccgtggtctccctcgactcctgcgcgctcccgcgatggtgccccgccgcgtgccctggcctccgcacgctcaagctccaccacgttgccatcccgcagcggatgatcagcgtcatcctcaaggccgcgcccgtgctcgagacgctggagatggtgtactgcatgggattcgccggcagctgcagtatggagtcctccacggtgaggaacctcctgtt

SEQ ID NO: 83812 - DNA, 550 bp, Oryza sativa
tccttgggagctggatttgctcttcaggtttgcaaagagctcgctaagcaaggagtcttcgtggagtgtcatctgttcaatccaccttctgtttcacttgccatgggtgtaaggagtatgagtgagaaggccagctacctgtggaaaaaagttaaggctagtctaccactgactgaagaagcattacctgccagtaccaaaaaggagggaagtgcaaagaagaaattgcgtgctgacaagaaatgggtgccacatttatatgtaaccaacagtgactacatctgctgtcactacaatgcccctaattgctccaccaccaccaccactaccaccactgatggtgcttcagatgagcagcagcagcaacgaaaggcaagtgagatcgctggtgatgtggtcgcgaagctttttgtgacatcgaaaggcccacagaagtttcttgaagcgcatgggctggagcaatggtggtcggatggcatggagctgcagctagcagtgtatgacagcaagcttatatacaggcagttgaagtccctctacacagcaactg

SEQ ID NO: 83813 - DNA, 537 bp, Oryza sativa
ttcgagctcggtacccattatgggataaaatagctactggtccatgtgtaattggagcactcattgatatggtatctaatacacatttaaacacttaacatttctaattatgtctggataataaaaatctaagataaggaagaacttttgatcaatatctgttgatatcattttcatggacatatggtactctactagtgtaatgatatagaagagctagcacaaaagagcagggacaaaagagagtgatgaataaggttccttctgtttctaagatgataacagcagcccattttgtatttatagctaatcttaatcagtaatacagtaatcacctgggaagccacagctgagtgttcttttactgcacttctgcgaacgtccaacgaacgcgcataatagcttcttgctgagtggaggtccccatcataatagcaaagatctccaattttatttagtgaaactgagagagtatggaccaactgtagatgaatgcaaaagttaaattaacatgagaacttactatcatgctattat

SEQ ID NO: 83814 - DNA, 563 bp, Oryza sativa
cagatgatggagtgaaggatagtgaagaaaaagataaagataagggaaaaggtgtagacaaggaaaaatctaaagagaaggattttgacagaaaaactgaaagagagaaggagaaaataagagctgtggatggtgcaagtttagacaacctccttcagaggctgccaggatgtgttagccgtgatcttattgaccaattgacggtattaactcaaattgtattatcgatccacttcatgtttaacaccaattatcattcataacttacttttggttccaggttgagttttgctacctaaattctaaagcaagtcgaaagaaactcgtgcggacgttattcaatgttccaaggacttcactggaacttttgccttactattctcggttggtggctacactttcaacatgtatgaaagatgttccaagtatgcttctttctatgcttgaagaggagttcaacttcttaataaataagaaggtatgctgacattaactattttcttccctttgcattatttgtgctcatttcatgttccttctcaaaaagattcttcttttattat

SEQ ID NO: 83815 - DNA, 973 bp, Oryza sativa
cgtggggagcacgtcggccattacgccgacgctcgatactgatgcgggcatccggtttcccacgcagatcttcccgggtcggagccattgacgaaggagtggcggccgaatggcgaacagcggctggcgctcgccgcgcccttcgtcttgacgatgcggagccggtggcagcagcaccagaggccttggtggcggaggactgcccaccagcatctaggcgctggcgtgcagtcatgcccaatttggccacatcgtccagccaacgttgggctggagactccgggtcatgggcgacgggcgggtgacgtaggagcgcgcccgcagcttggagcgcgccctggggcgtgctgccgttgccgtagacgaggaggcgacgctcctcatctcgccgcccttctccacctcctgtggatgtcgaagtcgcggatccttcggccctctcaagtgccttctcccgcctaggactttggcgtggaggtggcggtggagtacgagctcgacgacgtgggtttggctccccgtcgtcaccgctcatactcggggagaggtcgtgcgcctttgctggctcggccattgggctgaacaggaaaagcttggcgcacacgaaagagtgcgagagctcagaaaatccctcgcagagtcccctacctggcgcgccagatgacggagcgtggggctcctcaccgggagaccgcacaggcccccctttgccggttcggccggggactcagggagagattctaagctctctgtatgtggaaggctcgcgagaccagaaacacacaagacacgggcgatgtatacaggttcgggccgctgagaagcgtaataccctactcctgtgttttgggagatctgtgtataaaggagctacaaagtatgagccagcctctcccttgttctgggtttctaatctggaaaaatccagttccacatctcagtgggcaaggtcctccttttatatcttaagggg

SEQ ID NO: 83816 - DNA, 618 bp, Oryza sativa
cccgttggaccaatatcttgaagtcctcaggagcccaatcccatctcactccctggtgggtcctcgtgaagtcttcggacccggtgtactcccaggcgccccgagcgcgtcgctggagcggcgcaatccgacgacggaggtagtcgccgtacaccatggcccctgtgagcccctgggatcgcaggcccgccaggcggtcgaggacggcgtcatagccatcccccagatctaccggcgcccgccagctggaggcctgcgccgggggctggctcggaagtcggaggcgcgcttcgtcggcgaggggagtgtagaaccagtcgctcttccagtcgtcccacttcttgcggagggcgcaggggatgtagcggttcagcaccggcccccgtggctggaagtagcagccaccgactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatggtggaaccagccctgccattgcag

SEQ ID NO: 83817 - DNA, 556 bp, Oryza sativa
ccaacttatcttatgaacaagctaccatgggaaatgagggtaatgcacgaatggtatatgaaggcatctaggaaaggtctcggtttcataagcgtcgccgtcccggaaggcgctttcatgagtggtcctaatgggatattttttatctctttccaagaccattacgccctctacaagctagataaaatggacgttaatctcgttgcggctttctgtctgtaagtctgaactctttattacatgttgcacgtttcattcgaaacaaataaaccaaatctcatttcttctttattcattgtacagtatgcaattccacgaagctgatagaactggagcaaaggttggatacgtcgatccaacaagaatatgcaaaacacaacacaccgtagagctgagagaggactgcgagcaattggttggcaagaccccggaagaaaaggaagaatatgtgaagacattgcacaagaggaagaagctagaagtagcaacatacttggcaatagcaatgttggcgcacgccgacaaagatgtcttaatggtcccctaccagttcacg

SEQ ID NO: 83818 - DNA, 520 bp, Oryza sativa
agctgatgagtattacaaccttatggccgatgagagggaggatctggttcagtcacgattgcgagcccttgcaaaggttaccaaggataaggaacgtgttgctcggtattacaataagaaagtggtacccaaagatttttcggaaggtgaacttgtatggaaattgattttgccgattgggactcgtgatagtaaattcggcaagtggtcgccgaattgggaaggaccgttccaaatttataaggttgtgtctaagggagcatatatgttgcaagggcttgatggtgaagtctatggacgagcgctcaatggcaagtacttgaagaaatattacccaagtgtttgggttaacgcatgatcggctagtgttgccgatgcatgacagccgatgtgtttacatcgccttgagatggccaatatggttatatcgcccttagttgttttttcatgttgtaatcggttgtggtttgccgatgtacaatggccgatattgttatatctcccttagttgtttttataa

SEQ ID NO: 83819 - DNA, 4516 bp, Oryza sativa
atggtggccagcgccgccgtggggcggtactacatggcggcgtcgccgtacgacagcgccatcccgcagggcccgccgttcagcgacaccaccgccacggccatcctgcagtacgccggccgcggcgcaagacggtgcggtggcggccgccggtgctcccgcggcggccgcccgtcaacgacacggccaccgcgcaccggttcttctccggcatgaccgcgctgctgcgccacggcaagccgtcggcggtgccgctcgccgtggacacccacatgtacgtcaccgtcgggctcggcgtctccctgtgccagccggagcagctgctctgcaaccggagcgcgccgccggtgttctcgtcgagcatgaacaacgcctccttcgtcgtccccaagaacacctcccttctcgaggcccacttcaggcgcgagccggccggcgtctacacccgcgacttcccggacacgccaccggtggtgttcgactacaccggcgacgagagcgacaacgcgacgatgcagttcacgaccaagtcgaccaaggtgaagacgctgcggtacaacgagacggtggagatggtgctgcagaacacgcggctgatcgcgaaagagagccacccgatgcatatccatggatttaacttcttcatcctcgcgcaagggttcggcaactacgacaagaggagggcggagaggaggttcaacctcgtcgaccctcaggaacgtaacaccatcgccgtgcccaccggcggctgggctgtcatccgcttcgtcgccgacaatcctggtaattactagtactactgttacatcaattttttaaaggtaaacaaattacgattacaaaattttgtctctgccggatggatgcctgcaggaagcatagaaccttcttccagtactgtgatgaaatgtgtttttggtgacattggaaaccagtgccccatgtaggagagtgacatgataaatacatttcctaaacacaactaaacaaaactccaaggtttcgtacattaatttgaacctagttgtataatcctgcagaattttaattttagattaaaattattggtatcaattaataacataagttgtactgagtttcaagtaaaaaaaatatttatttatttattcaacaatattgatgtttaggatcagcaaaaatatataagttgtataggaattctcaatttcggattttctaattataataatttgaacattacagatttaccagatatgaagttgtggacctaaattttaaatacgaactagtattcaccagtgcattcaaccatattgtattattgcagatagactaaactgatagactccataagggacaaattttctgttaaaattagtacaccttaatctatccattatggggccaaatattgacatccctagtccttctgtatttggcagcaagctaggacgcattatttggcattggtttagcgtgagagataattaattaagttgtggattataattatttaatttggctgcagggatgtggtacatgcactgccacttcgacgctcatattagccttgggctggccatggtgttggaggttttggacgggccgacgccggagacatccgtgccgccaccgccggcggaccttccacggtgttcatgagatcacgccggcggcgaattaaattttcgtatatttataagattgtgcatatatatagccaggtgtatatgtgcttgcatgagatcaatcagcgaagcagatgaattatatatttgttgattacaacatacaatttgcataaattgattacacggtatgatttgatgagtattatgtgtcctttaaaaaaagttaattattggaacggcatgcattcgtatggttggtggacaacctatattattaggttaggttcatttgtatattccaattcttttttgcagtcatattaataaaattttctgcaaggatctgtcattctaaatgttcagaactaattaaactagggctatatatatgtacaacccaacaatcttatttttataagaaggtattaagagtaagggttagctagcttccaaatagaactacatttatactacatacatactccctggcatacatgatcatagtaacgtgaataatcgaataatataagatcgattatatatatatagtaacgtgaataatcgcatggaagttccgtatgtacgtaagagcttccaaattatgtcaagctatgataacgccgattcgaatcattattttacgtacgccgattctatagtttaatttatgtacgtaatttcacaaaattaagttgtccttttataccagtttcggcccaggctatttaccaagcaggactattgtgttgcggttgatacatgtgtacaaattgacacggcctcctagcaacggttccatatgtttctgccgaatatagcagttatatatgtgcagtgtgtagatgaagtaacgacaatacaactatctagaaagaaaataccgtcatattgggcaatgagatttgacctgcaaacccatctttgggctaagccctaagctggccagcatatattgggccagatttaaaatactaatgagaatatattcaccaggttttaccgtggtcaacttgcccactaataaaaacagcttcccaaccgttgaaggaatcgatttgcatcggtttttaaagttggggaacatatgtcatacctagttttgaagttgatatgattcgatcaaggtaagtgaagggacacataatggacttattcatagagaattagtgcttgcaatcatcaggctatatggcctacaagtcccagagcctgtgaaaaatcttttctttctaggctgcgttcttttggaggcctctcccctccacacgcaaaacaaaacgatgaattaacgtatgattaattaattattagctaaaaaaactttaaaatgattaaaatgattttaaaacaactattttatataacgttttttttttgcaaaaaaaccacatcgtttaatagtttcgcatggaaaaagagggagattaaattgggcacgacccagttcttttttcttaactctaaactttaacttcatggttttctattagcatgctttttaaactgctaaatggtcgatttgacaaaaaattatatgtacaagttgttaaaaaatcatataaatccattttttttaatttataataaatagtacttaattaatcatgtgctaatgagttttcttgttttacgtgcgctgaaaatatctctcttaactgggccaagctaaggaacacaaccttattgttcttaccaacccttgcattttcttctttgcctctagcagccagttaggctatatttcaatggtgttatctgaagtatactttctagtatctttattgtgactcatacttcttactaactatatggaactccacgcgttgctgcagaagtttagtatgataatagtaaatataatgtgtaatatatttagattatgtaagcttatataatttgtatttttttcgatcattggaaaatgctataaaccatttaagttgatgtggtttatgataatttaaatatatactatatagattgataataaaaaaagtaaaagtaaggtgatgcggattcatgagagaagaaaaatgagggaaataatttggattatagattaatcatctaaatgactgaaacaattgaggtgatgtggtttaatgagagaagatagaaaacattaactaagtggcgatgatgtataatgtatataggatattgtagaaaatggtggagagatgtatgttgaaatattatataaattatgtgagataattataacaagcttgtaatttaaagctttaaaatataataaaatatagacgatatagcatgtttgtataaggactaaaatgtaataattgctaatggacgatgatgtgtcatctttacatggtgagtgttaggatgtagtgagttgtaactttatagtatagattgagcaacagcataacaatgtacgattggtttttaattgcttagttctcgcctaaatcatagagaaaattaccaatgtccctccaacaatatactcggcccaatccttacgcatccctaccctcaaagtttaatttggatcatttccatacatttcaattagacattagttgactgataaattcctattaaacattctagtttgccttctgcatgaagaatatagggtttattaattgttggagtgtaaaaatttgttatataagactattatatttatgagtttgtgtgatataatttatgaaggaatttatgttttgactaagaaattaatatttatttttaattattacaaaatatttatgtagcatattttttatacactcctagagaactaatctttgccagatggcgaaaatcacatttttcctagttcaaataggaaccaggactaaagaatatgtttagccccggttcaaaagcccaacggcactttatgatctttagtatatgatctttagtct

SEQ ID NO: 83820 - DNA, 586 bp, Oryza sativa
cgtgaatccaatcccttccaagcaacaagctgtaagaacccttcccatcgatgacaaaaaaacgtggtaggaatagtcttactgccgactgtcagctccacatttagaacacctttggtttccgatggattaccaccaaagtctatgagcaccatatttgtcttgatgagatcctcggcatttctacccaacttcttgaacgtagcaaaaggcatcaaatttaccgcggccccactatcaaccatcattttagacatcggcttcccattgacatagccgtttatatacaatggtttaagatgccgattctctgtcccctcaggtttctcgaacactgcctgttctggtgatagaaccaacttagctgattcctcttccacctcgtcgatatcggcttgatcgatcccgaattcggctggcaaggtaaagaccatgttaaccggtgccgtcacaacactcttcccctttgccaacctctttgcctcatcggctgcaacatcatcggctataggaacctgattcttaacacgccactcctgcctcggctttgctttcttcagccgatgattaatttcttgttcgacct

SEQ ID NO: 83821 - DNA, 4043 bp, Oryza sativa
ttcaaagaattccacgcctctattgctatgctttgattttagatcctcggctaaaattacatggcctggaagtggccttgaagatgttaggtgaagccttaaacattgattattcaagcactttcacacaaattgctgatgaatttcttgaagtcctttccatgtatgaagagaagtttggcagcacactccgtccaccaccatcaccgccctcttcactggtctttagattattcgctgctagactgaaggagttggagctgaaggagttggagcttcaaaaggattcctcgccctcttcatcagtacaccaacgaaaagccaaaaacgagttcaacaagaaatacatcgagactccatgctcgttgcgtcttaattctcgtggacctgatcccaatattatcatgtggtggaaggacaacaaactgtttcatgttgtgttagctcaactagcaagggatgtccttgcgtctcctgtgtcgacagtctcttctgcagatgcattcaacatcaacggaagagtagttgaagatcaaagatcatgtctagcaccggacattttagaggcaatcatgtgcctgaaagattttggaaatgctgctactcgagaacaggatagaatggtgaatgctgagtttgctagtgtggtatgccttgatatgtaatcaagcaatccaatgtgttttacctcctatggttccagtgttcagctcatctttgtttctatctatctgattagttaaatgaagacatcgttatgggctttagttacttgagaactgcatggtaaatgctgagtcttctactgatcttcgaggtgatagtaaatgcattctctgcatataactcaagttttctagcttcagtgacttcagttccaattttaggggcagtccaagtatcattgaggttaatttagtccccacaaaatcggagcagtttatcacattgaaagccatagatttccatggaaatccatctggttccatcactggtgctaggtaatacgagactgttagttggtttaacacagtggcatgcattacagaacaagggagcatgcatttcatgacagaaaattagatggctttttgtgaagtgcatgtacaccgttgaaaaacgcatagaacgtttggtaagtgaattgttgtgaatgcattgctgcgaatctacagagtacatactggtatgtatttgacaaacttgaatgaaccaagtacgttgatcaaaatcttgccacattaattaaaagattgcaattattcatgtcatggaagattctgggaaccaaataaataggagaccgggtttcatgttggtagaagctagaagcctagaacatgtaccatttcctttttgttttgcaatgctgtttcccttactactgacatctttccatgtcctactttaggttacggagacattagcaatttagacataccacataacctgtgtctgtcttatcctacaaggccagatggatagtaccttttccacctcagtttcgaggtttaagttctagttttgccactgaacatttgttgaacgtttggtacaatatcaagaattactcgtggtggacataaaaaatcatgaaataaatttcgaaactactatctataacatcagatccatcaccactgattggacacttcttaagaatgaggcaattgatttttgcgatcttacaatctagtgatctctagactctagtatagaaatgcaaaagcttctgagttttccatcgaggaacgaacgatcccttatacgaattgtcatcgaagttcttcaaaatatcagtacaagtgtccttgtccttttctgccacaaaccatatatttttcctccctttctcaaatcatatagatttaatattgtcaagttatagatttaatattatcaagtttgtgggaatggtgttgcatgctgtcgcctgagtttttgtagaaattgtgtgaagctccaatgattatcttacagccttcaacatgtagatcatgggttccgagatcagatcaggaggcaagagagtcataaccaggaattaggcataattctccagaggaatcaacaattaactcagtaggtacttatctactaaatgaacgatgttttcgctggtaatggcagtagatactggtaatggatattgctcaagaatgcatgatctgttttttttgtcaagaagcagagaaatttgtaatgattattttctactgctaaattttgttaaaatgaataataggttatggcacttgatttgtacctagaaaatgccatcttaagtgtttccccctttcttttgtccattgccgtttggttactcactagcccttaattttcatttaaaaattttcatttaaattggtgggtctaatattatacatagttaaataaaattgatcataaaacaaacaaaatactatgggtcccacctctcatctttctcccgtggtcacgtacgtacatgtgggtatgtagtacgtacggctccctccattttttttctttttttttcttttttccatttatacaattgatatatatatatatatatatatatatattaaataatcataattttacaaacaaagaatataccatcatataactctttataaacataggtaactaaattagctctacaatctttgaaaataaaatttacaccattatatgtttacccattaaatcaataatataagatagttttcacttaaaacagtgtactcattactttgtattattattctcaaataatgcactgttttaaaataaagtctacaccattatagtgtgcacccattaaattaacaatttaaaatctatattaactaatttacatttatactagaactggtggacccattatttaaatcatcggatctattgttaataaataaagtgtccaaagttttcttttttttggcatgctgcacaatgcacgtttgcacttttgcctttcgcactttgtgacaaagcatcgtgtctgaggcatctaaggtgatcatgactgctgcagcgctaccgctttgccacatatcaaatcgtatatggagatgattaattttgttaataacatgaaaagaaaattaaaggtgtgatgcagtgagagaagaattaagcaccgtgggttgagtttttctagcacttaactctatttaacctgaaaccaagagttgattacataattattataatgtattgtgttatatcgtatttggattttctattatttgatcttacagttgaaataaatcattatgttataaatataagcacaatattagtgaatatcaatagaactcttactaggaaaagagtgttataagggagtttaaggccgtatttttttcctattccatcttttggatttttgtttgcacgctccacgctccacgctttccagtataagggagtttaagggttttttgtttgcacgctacacgctttccaagatcctaaactttttaactttttagaagttaattgattagtttataatctcaaatagctatcacataaatcagataattcatcaattttagttgtcctaaatcctaagtagtacatatttctttcatgcaagtcttggtgatcagtaaattggtgatcaacacttaatcaagatcgtaagatatcaagatcgtaagatgaatctgtgagagctactatgaacaattgtaaataggtgtcaaaatatgtactacttctaatggctatcacataaatcagataattcatcaatgtcagttgtcctaaaccctaagttgtattttttttttcatgtgagtcttggtgatcagtaaattggtgatcaacgcataatcaagagcctaagatgaatctgtaagagctactatgaataattgtaaataggtgtcaaaatatgtactactattaattagacttctaatggcttgctagcattgtatataaacatggacgaagctagaacgaatattaacatatatcccatacatatatattacatggttaatattctaatcacatgtggtaagtccattaaatttttttaaaat

SEQ ID NO: 83822 - DNA, 791 bp, Oryza sativa
aaggcagggatatgcatacacttgcaaatcagatcagatcagatcagattgattattgcctgctcctttttggatgctactgtagcaaacctaccagcaaaaaacccaatacctccatttatggaagaggagtacacttgccttttcaagtatttggacttttgcactgttgctttgcctgcaatttgcaaaaaagcttttgtttgattatgggttgtggcacaggcactaaacatcctcaaatatagtgctactccttttgatttaaatctgtagataatactaggtcggcatggttcaaacttatggaatcatgatgccactgaaattttttttggatggaagttgtaaaagttgaaacctgccttggttgaataagcactgatcctagcccccagccgtgaagttggaaagctcagtttctgattacacggcttggttaatacgcacggcgagaactcttacacgaccagatcttacatggtcttttgtctctacaggatccgacaagcccttatcggctctgggcgtccccagccaaagttcccttaggttcctcggaggtcttgtcaagacggcgtaaagggacagtaggataggtttcaacgctaggtgtcgtcgtggtaagggatctctgggtaaaacacttggcgatattgtgtacctgctatcaactttgttgaaatagaggtagtaggagagtcgctacaccgctggtcgaggaccaggtagtagtcgtaactcgaccacttaaagtggaaatgggtaccgagctcgaatatcaatatcgc

SEQ ID NO: 83823 - DNA, 3505 bp, Oryza sativa
  unsure (1)..(3505): unsure at all n locations
ccagcgttaggattagcanatcncgaacccacaacaaggcgagatagattgaagagagccaattctgaagtatttggttcgtgaacaacttccagaaaaggaagaagaaacaagaagaatacggttaatgtcaaggaaatacaaagtgatagaagggtagttgtacaagagtggagtcactgcccctttgctaaaatgtgtaacaagagaagaaggaagagaaatcaccttggaaatgttagacgagataagagtggaagcattagacaaaatggcacaaagcacaaaaggaaccaaaagctattatgaaaaaagagtgaaaatcaggcaaatagaagaaggtgatttggtcctcaagaaaacactcaatgaagtggctattggaaagttggaatcgaaatgggaaggaccattcatagtaaaaaggaagttagaaacaggagcatacaagctggcacacctcgatggagaagagttaaagcacacttggaatgctatttccttgaagaaattctatgtgtaaaaaaaagaaaaaaaagagaaagaaagaaaaaaagaaaataaaagaaaataaaaggaaacatgctgcttgaagtgtacaataccgaccacctttgtaagattctcttttcttctcgatgttaacacatataaacaggacgtagggttgttatccataatgaaggcccgaacctgtataaaaagttgtcttgtgtgattgtgaatcgggaaaatcctccgcacgcttcggagaggaaaatcaaactcaatagcaaatcgagaaaatcctccgcatgcttcggagagagaaaaatcaaactcgatagcaaatcgagaaaatcctccgcgcgcttcggagaggaaaatcaaactcgatagcaaatcgagaaaaatcctctacacacttcggagaggaaaatcaaagtcgatagcaaatcgagaaaatcctccgcacgcttcggagaggaaaatccaactcgatagcaaatcgagaaaatcctccgcacgcttcggagaggaaaatccaactcgatagcaaatcgagaaaatcctccgcacgcttcggagaggaaaatccaactcgatagcaaatcgagaaaatcctccgcacgcttcggagaggaaaatccaactcgatagcaaatcgagaaaatcctccgcacgcttcggagaggaaaatccaactcgatagcaaatcgagaaaatcctccgcacgcttcggagaggagaggaaaatccaactcgataccaaatcgagaaaaccctccgcacgcttcggagaagaaaagccaacttgatgacatttttcgaataaatttttaccttagctattttgtatcagaaaagtattcggaaactgttttattaaagaccacacgacaaatttacatctgattgcttgttaaaaaaggaaaagaagaaggaaaaatgacattgagaggagaaggcattcccgtgtaagagacaattgagtagcgcattttccatattataagttgacgctcagatggtctaaaggtttgccaaaaattaatgctgctcgaagcattattcgaacgtcgttttctaaactcgacgacgaagtcacgcaaactgccatctcgatgttctctttgccatttaaaaaaaattaaaagaaaaaaatacaagtgtcatcgtaatgtatttccttctcttcatcatcacaattagttgcttgagaaaagagcaacttctcatgtgttcaaaatgcaatgtgcttcatgtttcgagttgaatgatacttgctacggcgaaccacaacttttcggttcaaataaacgcataatgattatcaagaataaccagcttcgaacttcaaaattttatatcctagtgttttttcaaccgaataggaggacggcggttctcccctagcttttgattcgaacacggtttcggtcgaaaacacacatcgcccttacccgtgaggggctttttgtagcagggggtgaccaccgtccctccatattcggcccaaaacactgtagagagagattgagtcattattctaagtatccgagtggaaatggccattcgaacagggaaacggtaaaacactattcgagtcagaaaataccgttcgagtaaattcttgtcactaagtcttattatccattttgaatgtttcctaagtcagtaacaggtcagctaccggataagtcgaaaagggtggtcgaactggaaaagactatttgccatggaaaagacccatggtggtggaaaagaccctcggtcgaggagaagacccatggtggtggaaaagactcttgatcatgaagaaggcgacttagacaacaaagatgccaagagaatattcctgaggaccactcaaccacttcatctagctggcaccaaaagactataatgacctccataatgtaccaaaatgcccttaggtttagctgatatagcaagggcataattgtaatttcatgtgggcccaacaaagggcgcaactgtaatctcacatgtaaagctgtgaactatataaagcagacaaaaagcctgtagcaggcaggatatcttggaatactaaaagtcttgtcacttagtgtgtgtgttcatttggtattcgcgctcatttctcaggataggcgggaaaagggggttttcccgtctatccccaatcttgtctgtgaccttgggtcacgacaatgttttctggacgcgactacgcgtcgctcgccggacagggagcgggtgaaatcgggtgctgacgtcagcgtccgatttatgtgcaaaactactgatttttctcttaaattacttatccaaatcatgatccgattgcaccattaaattcgttgcaattaaatcttcaaaacatgaccacacatggatatattccgacgaaaaaatttttagcttattattgaatttttttaaatgttgcacgatgttccaccaagtatatcggaattgtttcactaaatagatcgaaaatgtttcactcgtttaaatcggacgttgtttcaccttatataaaaacaatgtttcagcaaatagcgaaagaatgtttcagttcactgcaacattaaatctatatatagtgaaacattgtgaatacactaggtgaaacatttttcgatggaacaaaaaataaaccaaatttccttaataggggatttccaaaaggaaaaagtacaaattaccccccccccgaactatcgcggtcgttcgaattaccccccttaaccacaaaaccgaacattctttacccccatctatgcaaacccggctaattaccccctttctccaatccgcgttgtttttaattttgacatttcaatcctccatctattttttaaaaaaatgtcggacccaccttcataacctctatctctctctcccttatttatttattaatcctcttctcctagacacctccttaacttccaatatttctcatattcctaatcctcatgccatatttcacaaaactaccttttccactcgtttcctctttcaacctctatatatccct

SEQ ID NO: 83824 - DNA, 923 bp, Oryza sativa
ttagtagatgctacagctggttgcgagttgatgagtttcttagatgcatactccggttatcatcaagtctttatgatgaaggaagatgaagagaaaacatcgttcatcacttcgtttggaacttactgtttcatttgaatgccatttggtttaaagagtgcaggagcaacttttgcaaggttaataggcaaggtattggcaaagcagttaggccgcaatgtagaagcttatgtggatgacattgtggtgaaaagcaaacaggcgctcactcatggcaaagacctgcaggaaacattcgagaatttaagaaaatattcagttaagcttaacccggaaaagtgtgttttcggggtaagagtaggaaagttgcttggtttcttagtgtccaagagaggcatagaagcaaatcctgacaagatcgcagcgattcaccaaatggagccaccaaaaaacataagggaaatgcaaaggctaacagggagaatggcttctttgagcagatttctttctaaatctgcagagaaaggcttgtcgtttttcaaaaccctaagaggggcaaactcatttgaggggacagccgagtgccagaaagcttttgatgatttgaagacatacttacagaatatgccaactttagcaagtccacgaaaggtcaacctttgctagtgtatgtagcggcaacaccagtgacagtaagcgcagtcttagtgcaagagaaagaaaacaagcaaatgccagtttacttcgtatcagaagctttacaagggccaaagacaaggtacacagaagtggaaaagttgatttatgccattgtgatggcttcaagaaagttgagacattacttcttatcacatgacataacgataccgtcagcatacccgataggagaggtattcaaaaataaggagtcgccagaatgattg

SEQ ID NO: 83825 - DNA, 1542 bp, Oryza sativa
tttctattttggtgggcaaaataagaaaaaagatttggaacgagagacgttcctccaaacatttttaaaaagaaattataagtgtgtttggattgaatacgggatcttagagttgaaaccgcacacctcttaccattaccactttcatttgtgctgaccaaatttcatccgatggttgctggtaactcaaagggattcggtgacatgtacagtactacagtgtacacagccagcaggcatattactgaacaaagtcggacagatgattaagcatgttttatttggacagtacagaattaaacaactctgattcaaccgaggaactgatcgaccggcgaagaacagcaatctacagaagaaagaattttgccaatacaatcctatgtacttcctcatcatatagtagtgaccaactagcaaacttgaaactgctcttctggatcttaattactactgcgccatgatcgtccaccagatgaagctgaagcctaccaaggacgatgcactgatcaagctcaggcgatgcgttgcgcctccgctcgccgttggcttggccgctgcaagattcagcaaacaaaagagaggctcagttacaaattacagctacatgtctgtgaatcactggaaatttctaagcaagcttgaaatgatctcatacagagaggttttaatttggctgccagttcatactgtggaaaactgaaacataatctgaattgtgatgttctgagttgacagcgaaaattgttgttctaattaagcacaggtacctgtagatgcagcgtttccagtggaagctgaagaagcagcagtgctacctgcagtgccggcacctgcaggaattgaagagagttcagatcagcatccctctgtaaatgatcatatcagttttttgtgatctgattaaaatgccagagatcatgaattggaggccatgattaaattgtgatccatgattaatttgcgatctctcaattatcaggtgcctcggattcttgtgagaccggagagacaactgcatgctttagctggcactagctagctagagttggtgcatcaaacgacaaactctccagcgaggagaggagcactgttagtgttaaactaagcaataattcagaccattattactctagctaggagaaacaaacaaacaaacaaacaaacaaaagcagtagcagtcaaaccgcatcaaccactgtacgtatgtccactgcaattagtagcagcaatctagccgcatggatcacgccgtgatcgtcgacgagaggaattaattaacgagatcaaaacattgaggaaattgatggaattatgtgtgttaccggcggcggcggccgcggcggtggccgaagaagaagccgacttggcgcaagcggaggcgtctgtggtgacaccccaacgtttggcgaggaggaggccctgcttttgcgcgacgccgaacgcctggagcgcggccttgttggtgaggatggcgcacaagcacgccgtctcgtggcggcggcctccctgagcgggccgcagcacgacgccggcgggggg

SEQ ID NO: 83826 - DNA, 4407 bp, Oryza sativa
  unsure (1)..(4407): unsure at all n locations
tccagaacagaagaaacaccaacacacatatattagaccttactcaccttatgcacacgtgcagaaacaaaagcaataatacctaaaagaaacaacaataggaagtgtgtcgatagtattaaatgaaatttagccacggtactagtgtgcaggtgcattgcacaattctcttccagtgtcatgcacattttgttaagatgtaaagcaaacttgttgactggattgtcataccaaactgattgtgcattaactataatgtgcttgtgagataagtgaagactgaacttaattaacctcatgcacggggagcatttgtgagcatgtcaacttcaagtaagataaagatacattcacaataagcaggcatatgaactccatgaaccatatctaaatattggtcaccaggagagtggtaaatgattagtttgacaagaatttcaagattcccagctatcacaaactaccaaggaactgaccatgggaaatagcatcatacttgggttgcaacaaattatcataaaacaaaacagatatccagaacctacagacagcagaacaccatataaaataaaagctgagaacaggctagagagatattctgggttcaagtggcatcaatatagctgaatagatgtacttgcgttgacaagcaaaatgtcattcaagagacgcacaacaccatagaggtcaaaacagcgattccagtaacacctactctctgactgaccaatacatcactacttaaagaaaaacataggtaggaagggcatactttccagacgagtgctgcagggtagtattgtcaaattgagcaagatagtcctgtggacagaatacaatttgaatcagttaacattatagaaaccaatggagataacaccagcttatcgatgttgcacatacagcggtacttgtcatagcctgctgttcattccaagaatcatttctcgggttttcagccttaaatggtgtgaaattgctggtcagaaaaactccatctccattcacctgatgaatatcaattgcgaacagaataaatcagtaaaagaacccttatttcgagcaaacaaactgttggaaatggtgtggtgtacctcatccaacttttgccatactaaatcactttggctgaaaaaaccctgatcagtggctaagagatataggcttccattgtactgcaccaaaaaagaacttaagaacttaacttgggtggcttattaaagaaactggagactataacttaattaatcatcataccttgaacattgtgttgaaatgattattacggaagaagacgcacagctctctttcattaagaccctcttgtagacaaaataaactgtaatgtagaaatttcgcccaggcattagttaacaggataaataagaaatatacacgaggtttaaacctatatagtaagtacgcacccatagacagttagctggctagcagtgttctgaaggaaattatctattagttcccctgcaaacaaataagaaaatgtaatatcaaacattatgcactggatattcatgtgtgtttgatcttcaaacaaatacaaatacataatagatgacaggacaaacaaaattctcacattgatgttctgcaggcccatcttgcatgtcctcactacttttctcagtcttgtcagcttgttcagcaagaaccacctctccctcataaaccggctcctgattttcatatgccaaatttccagtgctaagtatgtgctcttctccttgatatattggctcactttcctgaaggtttaagatgataggctcaggactattgccatcttccccatccagctctttagtagcatgatttggggtatcttgactagctgcagttgttagctcagagctaatctcagtgtcagaagcctgaccatgaattttctcagtgtcagaagcctgaccatgaatttgcaagggagcttgttcttcacaggattctttatcaacttgcccaagggcaggagcagcttggttgggagcagaagactcatgagaggaacagtcaagcacagactctgaaggttgaatggttatatcagagtgctctggcaagatattccttttcccatcgtcttctagttcattagacgtcaaaacctgttgggattcctccatcccaacttcattaatattaggagcagcatttgtggtgtcctgtaacatagggccatcgctcaaagcatggctgttgccatgttcctccttatttgttgaatccatcgcctcgactgcctctaattggaagctctcagtgtgtgctgtctcctccatatttgaggatgaatgagactgtgaagtgtcaaaggaaccagatccatcaacagcattagcattttcagcttttgatagactaaggactctccttagttcctcttcttcctcacgatcgcctcgtcttatgtgcaactcaactgggtcagtgagtgtattttcatcaaatgatatacctcgagaaacactaggagaaggaacccctagtgctgcagtagttgcagcagcaaaatcaacagtttcttcctcctgtacatgtctattctcttttgttgattcccccgacttaaattcagcaagcccagatgcaagagcattgtaagactttgatccaatggaagtagcagtgtcagtatcctaaaaatatgaaacaatcagaattagcatgcaggtgagaattgcagacgtaagaggcaagcgaaatctcttatgcatccagcatgtagggaggtattgactatgctgttcgagcatccttctggctatcttaacaaattgtattgcacaagataaataaatcctatattaagttttggttgctacagaaacttatcatgtctagacacaagtatacgctttttgttggagcatcacatacaatactcaaatcaaaacgcaaccatagagccagtccgactgtcttgcttttactcctaaaagaaactactgatcagaagttgtagtttgaagaccatgtcaacatagaaaacagcatatatttgtgacacgaggaggttcaacactgtctggattgcaggttggagcatcttaactagtaaaaagttggaaaacaacgtagagtgattgtcttgcttttactcataaaagaaattagtgatcagaagttgtagtttgaagaccgcgtcaacatagaaaacaacatatatttgtgacgaggaagttccgcactgtctgaattgcaaattggaggatcttaactagtacatagttgggaaacaatgtagaaaactagcttaattaaatgtgatacatatttgcgaaaccaagcaatagctgtgagtgctaccagttatcaaatagaatcaccacgtagctacttgatagagctttcaaacgagttttcaaaacaatggtaaacattgcccgtataaggtatatatcggggggggggggacaagtacactggcatacatattacacttcctttttttattgagtgttgttgcagatggtaagcatgaacacatggtctctgttctaaataacagaaactgtgaatggtatacacatgaagttatctccaagcacaagaattattgtattccatgtcgaaagaagtacagtaaactctaacccgcacgccgatccagttgtctagatacagaagttcaacatggctaaaccaaacaaacatgccataaggagatgcatacctggggatctactatccacccatggtacagcgggatatccagaaggtcaaatatggcacgttctcgggtgaactcaaagtcatcgatcctgcaacgcccacagcccgaatcatatcagaacatatagagcaccataaacaacaaaccgctaaccgacaaaccgaaccatggactcacttcctgaacatcacattcacatcaatgccggtcgcgaggcgcggcaaaaggtcaatcgcatccgagatgttctgctcccggttgcgcacatactcctcgtccttaccctgcgaatcacaccccacaaccaattcacaaggcaacacaacaaacaacccccatctctaaccccacggggaccgatcgaacctgcacattgctgttggagtcgatgaggcgctcggcgacgagcgagagcagcttctgctgcgacacctcgcccgcgtccgggttcaagctgatcacattcttcagcagcatcacgttacctgcagcaaccaaaacaaaaccccacacatcacaacgccgcgcgcgcgggggcgaattgaaacccgaagggaatctagaaggtggggggattcttacagatggcgaggagagggcacggcccgttgtcgttctggtacacgattggggtgcggcggccgaggaagcnacggcccttgtttgtgcatcacctcggttgctcaagcggccgcgccgaagccgcccgtgggggactc

SEQ ID NO: 83827 - DNA, 2113 bp, Oryza sativa
actagaagtgatattggaagtacttacatgttgaggctgtaagcagtccatctcattgacataatgcttgtatgccacatcccggtgagcatgtgcagtggcagtactctcaaaaaggtaggccactctcttctccatgtctggctcattgtagggccaaggagtgaagctttgcctccacttaggccttccaaccggtaatcttaaccacatccacagctgaatcaatagcacacaaccactcatgttggatgatagtgcctgacgacaacaggcctcacagagttgtccatatgtccatgccaacactgctgagccccaactgaaacggcccagatcaccaaggttggcgaccaaaggaatccatatcgccgaagcaatgtcacccccagcattaggaaacagaacccctcccaacaagtgcaagatgtatgcacgagcataacactcaacacgccatggctcagcatcgtcgtcaagatgtgagaagttctaactcagccaagacaggggtattccattctgcttcttcttccccccttgcccctgctcaatgttcagtggaatgccaaacagctgctccacttgtgcacgccatccaggagtctctgtcctgcccgtcacggcatgcccccgtaatgggagggccaagatcatagccacatcctgtagagtgatagtcatctcaccactggggaggtggaagctatgtgtctcaggcctccatctgtccacaagtgctgtcaacgcaggagcgttgaacactggcattcctctgctcacgaccaaggccaccccgagcaacccggccgcccttaggtacgggatgtacctatcgtcgaacactggggggcatgagctctaactcggagcggttgaagtacctgcattagcaattgtaaatcaattagttaatataatgtcaaatacacgctaccgatacttatgtacaagtgaatcaatgccgattcataccctccccgcctcgatcgcagccccgcgatgacgggcctcgtagtacgcctccaaggctgggtaagtcggcggttgtccctcctcggccatcctacatgaaaagtaataaattcaccgttatttacctccctaacacttatattttttttggacttcttcttttttggacgcttaggacacttagttttcttgtgaccctcctggtgacacaacgagcatctattttgcaccggcgcagcatcaagttgaatgcatgaaggtggtttccttccagaaccacccagacccgagtccatttcgttcttgaatcgtttcgatctcctcttccctatttttttaatcttcaaatttgggtcagcaacaaattcttcaccatcgtacgatggccactgtgtggggtcgaggtatggctcaaagcgacttgcccatgtgttcacaacggctcttgaagagaactgatacggcattcggttgggagattcctcatcaattgcatgaattagataaacgtggataagatgtgagcaaggcatatggtagagcaatggcctttggcaagaacatgagttcacctcaccttcaactttgaaagctcttgcgccaaatctaacaccaccacgcgttataccacccctctctgtgacctcgtatgtctttttctgcttatcgaaacaccttgcagtgtgtttgttcaccttacttttttgcaccttcatcttactatcaaccttggtggaccaacgctgccctacctggactcgcttcaaagcttcatcatgtctgttcacaaagtagtcattgcacttcatgaacgtaaatgatactatggccgtcactggaagcttacgaacaccaactagcacgctattgaactgttcggccatgttggttgtcatgtaaccccaccggcggccatttctatcgtatgcacgggaccaattatctttatccaacaactcatcttcaagccatttacgaggaccttcgggaatacgctgccttagtgcctcaacgcatccctctcaaatatccacttctcgtcaatctgacatatccttaggagctcttttgtctgatgcttgtccgcaccggccttgtggaaattagcattgaagtgcctcatgcaccatcggtggtg

SEQ ID NO: 83828 - DNA, 1864 bp, Oryza sativa
gcgccccccctctgcgggccccaccaactttctccccccccccaaaaattttcgccaagtctgttctgtctccgggcaacggctggcgcccccccagaccgcggcgccacggtggctggcgccgccctcctcccccaatcgaagcccttctgcctccgggcctcggctggcgccgccctcatggaccacggcgccagggtagctggcgccgccctccccccagcccgaaacccttctgcctcgcggcactggctggcgccgccctcctcaaccgcggcgccagggtggttggcgccgccctctgcctccctgcaaattgaagatccatattgcacaaatgtaccaattcacagttcgcaattcaaatcacaattcacagattcgtacagactaaaactagttccaattgcacaaatcacaatgccaaaagtccatcacatagtcctcacatagtccatcacatattccacacatcaaacaatgccaaaagtccatcacatatcccacacatcaaacaatgccaaaagtccatcacatatcccacacatcaaacaatgccaaaagtccatcctatatttcacacatgaaacaatgtcaaaagtccatcacatagtcctcacatagtccatcacattttatatcacatagtgcaccacatatgtcatactaccaaccaatagattaacttcatacaaatcacttcttccgttggcgccgaattgcttgcgagcccggagtgtacctacatttgaaaatccaatgtttaaaacattttaaaaacaaaataagggaaatcaaataacatttgagaatggtaagctcattttacctctttttcgctgcccgagtggatcgcaagttgtattgcgtgggttgcgtcccctgaggcgcgtcgggaagctgcgacatgtctatctcctcggcgtctggtgcgacgtagtcctcatcctcctcgtcctcgtcgtcatcgtcgtcactaggtggagccggcgccttcccctttcccctcccttgcggaatgcgtgacgacgacgagccaccaactccttcacgctcttctattctgatggagtgtcgagcggtacttggacgcgcggattgaggtagtggtggtggtagtctccgcggttggtacacgtcgtctaatccaaccgacctgcaacctaatcttgctgcaagtttccggcacctttgacgaactttctgcatttcaaaaaaaaaagaagtttgttaggcataactcaagtaatgcaaagtgctaaataaattttacctctaaaacagtgcggagtgtgttctccgtgtcctcaccacccctcggagcttggaggcatgccccatttcattcacactcctgaggagctctctcgactgaaagcgtgagaagatatatgttagggtctagggtgcaaatggaaataactttgacaaatgcaagaaaatttacgactctgtctctaagtggggcgtgctccatttgatatccaactctagtccggacatcatagggattccgcccctcatcggagtcgcggtcatcctctatgtcggcttccgtccaagtagggcggaggaacaatctatatgtcctatgcagctaatgaaggtactctgagaaaagatgattttggtgtatagtctcgatgtacctgtcgttccttccggctgtcctccattcatcaatgtatctgttatgctctagcccctagtctttcaccttctttgttctcaccctgtcatacctagacaagtagaaggtgatgaaacaatagtgagcatcgacaagggttaaatggtacaaaattgaacattgacaatgaaagcacccaaagataagaaatatttacttgcgtaattcaactcc

SEQ ID NO: 83829 - DNA, 577 bp, Oryza sativa
cagcaggggcgccaggtccgatcgtgacaccgccaatggcgtccccgaacccggcacggcggccctcaccagggccttctggggtctccgagccttctcccccggcaacataatgagcaggcccggctccgatccctgcatgtcgacaacgtcggcgtcgtcggcggccccgtacgaccaccccccccccagcaccaagccatggcatagctagtaacccccccgccccccaggaatgaatagcgaatgattcatgcaagcaaatccaaccaaatttggttcgtgggctactcatcgatcgttcgccaagactgcctgataatgatggtcaggtcaagattatttcaaagctgggtaagtgagtggaatttacccagctctctttctttgaaggtcccaatgaaggttaaataattcatggtcctttgggaagggaagggctggtccaatcaaaaaaaaggaacctttccaaataaaaaccggtggttaagccaagccaaaaacaaaagttaattcttctccctccggtaataataaaatttttagccattctcagctcataaaggggctgcaggaa

SEQ ID NO: 83830 - DNA, 1022 bp, Oryza sativa
agcagcgattaggagaggcctttgaggtgaagaatcttggaccttttcgatactttcttgggattgagggtgctcgatcatcaaaggggatagttctttttcaaagaaagtatgttcttgatttggtaacagaaaccggaatgcttggatgtcgtacaagtgctactcccattgataggaatcaccaattgagtgcacagtcaggtgatccagttgatagggaaacttatcagaggttggttggacgtttgatatatctatgccacacgagaccagatatctcttatgcggtgagtgtggttagtaggtatatgcatgatcctagaacaactcatctagaggtggttcataggatcttgaggtacttgaaaggaactcctggtaaggggttgtggtttagaaagaaccaacacttggatgtggaaggatattgtgatgctgattgggcaagcagtgtggatgatagaagatctacatcaggatattgtgtatttgtgggtggcaatgttgtctgttggcgaagcaagaagcaggcggtagtggctcgatctaccacggaagctgagtatagagccatggcattgagtttaagtgagatgttgtgggtgaagaatctattgttggagctacggttgttcagaaataatactgtggtgcttcattgtgacaacaaatctgctatcaacattgcaaacaatccagttcaacatgaccgcaccaaacatatcgaaattgataggttcttcatcaaagagaagatcgataatggggctcttagactacaatacattaaatcttctgagcagctagctgattgtttaaccaagggattaggtcctagtgagagtgagtcaatgtgtaacaagatgggcatgattgatatcttttgcccatcttgagggggagtgctgatgtaatatgcacttgtattggggaccttcttgcatatgtagctaagtgaaatagtgtgtgtgtgtggctgtgaacaacacaccagaaaaaatccccaaaactgaacttta

SEQ ID NO: 83831 - DNA, 1246 bp, Oryza sativa
agtatatcaaagaaggaacaagaaccaagttgataaggtgacagggaaggagcaagtgcaccagaggagccaaattcagaatcagggggagagaagtggtgagcctatgcaagagcaagacaaggagtcacaacagctgcagcagtttgagtacccagtcccagattcctcctctagcctctctccaacaagttcctccctccttgagacaagtggtaacatttctcctacctttaaacaagtagagttacctcttgcacaacgtagagaaactagatctaatgctggaagacctcctatacgccttggttttgaacaccttagttctagacatgacattgcaaactatatctcatactctcatatttcacctgcatataaagcattcattgcatcattgcaaatagtgcctattccaaaggactggagatgtgcaaaacaagatccaagatggaaggatgcaatgaaggaggagttgcgtgcccttgaaaagaataagacatgggaacttgtgaaactaccaatggggaaaagagcagtgggatgtaaatgggtatttacagtgaagcaaacccctgaagggaaaagtggatagatataaagcaagattagttgcaaaaggttatagtcaaacatatggaattgactatgatgaaacatttgcacctgtggctaagatgagtacggtgaggattttgatatcatgtgcagttaactttggatggcctcttcatcagttagatgtcaagaatgcttttctacatggtgatttacaagaggaggtatatatggagattccccctggatttggaaatagccagactgttgggaaggtatgtaggctcaagaagtccttgtacggtttgaaacaatccccacgtgcatggtttgacaggtttaggcgtgcattgtgcaatatgggatattcacaatgtaatggagatcacacagttttctatagacataggggggcacacatcactatcttggctgtttatgttgatgatatagtgatcactagagatgatgtagaagagatcaaatgcttaaagcagcgattaggagaggcctttgaggtgaaggatcttggacctcttcgatactttcttgggattgaggttgctcgatcatcaaaggggatagttctctctcaaagaaagtatgtccttgatttgttaacagaaaccggaatgcttggatgtcgacaagtgctactcccattgataggaatcaccaattgagtgca

SEQ ID NO: 83832 - DNA, 619 bp, Oryza sativa
ccgccgcctcccccccacactttcggcgcactcgcgaaccttcgcaacgacggaaacgacaagctaacacacaaaacgaggaaaaagactaataaaaaccaaataaacagtacataaaaagtaaacaaacacgtagatcataattttagatgaattatgagacttgaacggcctcattctgacttcaaatgaatttattatgaattttacaagattaaatctaattaaagcccatttaaaaaaaattaaataaatttaattcaatttatggacaattttaatatgtagatctttattttatacaacttttgcaacttgaaccatattaaactgagttactatgaatttcagaagattcaatctattagaaaaactggaaaaggagaagatgatgatgtcatgatgacgtcatcaatggtggccggctcggatggcaacctcgccggagctagggtggtcggccgggattttggagggcatctacacgtagagaacgacgagacgaacgcgacggtacttaccaacacaccggacgaccaccgacgacgggcggcgacgaaagggcggcggcggcgactcggcttgcacggggcggcggagcttcggtgaccggcgaccg

SEQ ID NO: 83833 - DNA, 543 bp, Oryza sativa
caacgcgcatagccccagttgagttttgaagtaaacacgacgccgagttttatgcatgcgacgcgactcgccgccggtcacgaacttacgatggcgtccaccgccgccggcgacgacttccgggattggtccgggctgccggaggacctcctgctcaccgccatggaggcgatgcaactccccgacctagtccactccggcgccgtctgcagatcgtggcactcggcgttcgccacgttccgccgcctcgggctccggtcgccgccgcacccgccctgcctgctgtacgccgccgccgccgccgacgacaatgccgtccgcctatactcgccgtcgtccaccggcgcccacttccgcgtgcccctcctcgacgaggaggcggccagcggcgtcgtcggttcggcgcacgggtggctgttcacaagcgacagggacgccaacccttaccttcttaacccgtttaccggggcccgggccgcgcttccgccggccacggtgctcgggcgcgtcaggggcaggaggttcggtttctccccccgcgac

SEQ ID NO: 83834 - DNA, 680 bp, Oryza sativa
ggtcgactctagaggatccccatctaaattatttttggatttcactaagttacttttttgatatataaaagtaatttaataaagcctaaaagtaatttacatgtaatatagaagtaacttataaaaaaagaaagtaacttctaaaatatatgttaattactttaaaactttattgaatttacttttatatatttaagaagtaacttagtgaaatctaaaagtaatttagatatattataaaattaatttgtgattttttatcataatatttttatcataataaaaaaaactaattacacagattgcgtgtaaattgttagatgaatattttaaacctaattgtgccttgatttgacaatgtggtgttacagtaaacatttactaatgatggattaattaggcttaataaattcgtctcgcaatttacagacggaatctataatttgtaattgatttttttcacatttaatactctatacatatatccaaatatttgatgcgacgaaaaaattgagagtttgaagggaattaaatacagcctattacaatgtggaaattttctatttcaacacctcagccacgcctgtgatccaacatgtcatatcgaactggcaatacaggcccctcaaccgcacttcctgatctcactcaccactccctgcaaccgcattcaccactcc

SEQ ID NO: 83835 - DNA, 595 bp, Oryza sativa
tggccatgaaagtggtatgatctgcagggcctgggccggctgatggatttgcttggcgtggaattgacacgctctgcatcgccggaccaggtcgaccgcatcattgagagctgtcggccaatagaaaccttgtcgaaaggctttgccaaccaaggtgcgcgaggcggagtgggctccgcattcgccttcatggatatcggcaagaagctcgacgccttgttcccgaggaatgctcttcaggaggattccgttagccgcgcgccgatagagggtcccttctaccagcacgtaacgtttggagatgcgctggacgcattcactcccttcgcggtcctcgggtagagtcttatctgtgaggtatgcttggatctcagcgatccaagcaatcaatctaagggagctaggagcgctcccctcgggtcccgaggcctggactccgacgggcatcgggggcctgtcaggcgcgtccgtctcccctaaggggtcgggtcgcgccgacagtgggcaagcctttttcaaaggcgccccgtggggtctgggctcgcgaggaagcgagccgtgagaagtcgtcgcaaaccgtgtatcccgtctgggc

SEQ ID NO: 83836 - DNA, 600 bp, Oryza sativa
  unsure (1)..(600): unsure at all n locations
atctatataatatcctattgtactattaatttgtaccttcttaattcaatcatggttcctcactactgtacgtgtagtgtgtacgtacgttatgagaaatactccatatatgttgtgcagctagctagctatacgtggtgcatgtgtatcttggcaatcatatatgtatactactccctccgttacgaaatgtttgactctgttgactttttagcacatgtttgaccgttcgtcttattcaaaaacttttgtgaaatatgtaaaattatatgcctatataaaaatatatttaacaatgaatcaaatgataggaaaaaaattaataattacttaaatttttttaataagacgaacggtcaaacatgtttaaaaaagtcaacggtgtcaaacatttcgaaacggagggagtactacttaattacttctgtagtcgtacagcacattctattttgccaatctcaatattcttagagagagagagagagagaggttgggggcatcatcatcataaaatataaggaagcacttatacatggagagttaaatacatcttactacagcatgcatacatagcaggccactccctattnctgtttgaga

SEQ ID NO: 83837 - DNA, 595 bp, Oryza sativa
cgaggccgtggcgtacagcaccaccgtccaagtcgccgtgaagcccgagcgacgggaacaccaaacgtcatcgagccatctactgttgcatccatctactcaattgagagaagcacatggtgcacaggtgacaggagaatcaagcgtcaagacaccaagcaatccgcatcgatcatcttcgccaagctcctatgaacggccgcgacgcaagccacaactgcttcctcctctacatcagccatacatttgtcttctccgacacaacatcgccgatggtcttcatcaacataggaacaagcgcgccgccgccgactcgtccacatagatggacacctcgcgtcctctgacagattaatctgcaagacgcttcatcgacgacatcgaccgcgtcctctacgacggcaacgaccgcgtcaccgatgacggcatcgatcacgtcatctacaacgacaacgactgcatcaactcggcatcattattgtgatgaccgcttcacggcgcagaaggaccaactgaagtggtggcctcatcgccaacgacgtcctctgacatatgcaagacgttcccaatggcattctctcatcctctgacatct

SEQ ID NO: 83838 - DNA, 710 bp, Oryza sativa
tatttcaccaaagagtaataaaggaagtgcctccattgacaaccaaaaggtcaacattgttgaccgtggttctttgcaatggactgaaaagtatcggcccaaagttccaaatgacatagttgggaaccaatcaatggttagtgcttctgctttcggttaagctggtcacatacatctatgcacaattacttagtatgaacttatacatgcaggttaaacagcttcatgattggttgagaagttgggaggaccaattccttcattctggccagaagggtaagggaaagaagcaggctgatagtggagctaaaaaggctgtgttgttgagtggacctccaggtattggtaagaccacaactgctaaagttgtcagtcagatgcttggattgcaggctattgaggtaattctgctgttttgcatactttgcaaccttccaggcaactctttgtttcttactcaactattgaggcataaatgcaatgactaatgttcataacaggttaatgcaagtgatagccgtggtaaggcagactctaagattgagaaaggtgttgggggcagtacatcaaattctatcaaagagcttattagtaatgcaactctgaattatagtaacaaccggtcagtattacatgaagtttcatcaacctttttggacctttggttttatcttgtatataaatttggcaagaattttgacagattaaaa

SEQ ID NO: 83839 - DNA, 1084 bp, Oryza sativa
ttccaggtccatgcctcctccttacgagccactcggtccgcgagctgaaaaagctccgcggtagtctggggctctttggaggcgatcttttcgagcatgcggttgtgccgcacaccccccctgaacgcgtagatcaccgcgtgtgcagggatgcatggtatggtgttgcggacttgacagaaccgctgaatgtatgagcgaagtgactcgtcatcccttcgctgtactgcgtgcaggtccgcttcttcacctgggcgcggatatgtgccttgaaagttcatggtgaactgttggcacaaatcctcccaggagtggaccgacgcgggtggcaagttcattagccaaccccgcgcctgtcccttcacggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacgttccgaaggctcgccacaaaggctctacagccgacaccaccaaccgggggcacggagggctgatccccgcgtccgtgttgatgagacactccggacgaggaggcgccctccgttgcgtgggcagcacgtcggccattacgccggcgctcgatatcgatgcaggcatccggccccccacgcagatcttcctgggtcggaggcgctgacgaaggagtggcggccgaatggcgagcaacagccgccgctcgccgcgccctccgccttgacgacacggagccggtggtagcagcgccagaggtcttggtggcggaggaccgcccaccagcacctaggcgctgccgtgccgtcatgaccaagttggccacgtcgtccagccaacgttgggctggagactccgggtcagggacaatgggcgggtgacgtaggagcgcgcccgcagcttggagcgcgccctggggcgtgctgccgtcgccgtagacgaggaggcgacgctccccatctcggcgcccttctccatcacccgtggatgtcgaagtcgcggatccttcgaccctctcgagcacctcctccc

SEQ ID NO: 83840 - DNA, 610 bp, Oryza sativa
taacgttgtcaaaatatagtgatgacggatctatttttgtaaagctttttttttaaagcattatggtggaaacgggtcaaaaatattatatatgatgcgagagatacgattgtttaaagattagaatttcaaataatccacttgggtttagtttgctattatgtatcttttgtggtggtcactttcctccacgcccacctctttcgtattctcatctcggaggaattgcacagtaacaagacaaccatactgttctaacatatgattacttggtcgtagaacaacattcgtagtctgtagaagtatcgttactactacatacatgttccgtgttactacaatatctattatattattaaaacagccttgaaagaaagcaccacgttcactgtgggggctagaaattcccacattaatcagagaaaaagaaaaggagagtccaagtagaaatacaattcaaaaatagctgaaattctgaattaaaaataagaaatattgagagaagagttaatataagaactcaatacgattttagttaaatattccggagacaaattaaaattagaatttaaaataactaattttgagagaagagtcaatataagaaccc

SEQ ID NO: 83841 - DNA, 527 bp, Oryza sativa
aaaatcattaagttaaggtagatacacatcttgtcatatgatcaaatggtttcgccaaaaatcaataatcagacaacaaaatgtgcgaactcgatattttacacgactctctttaccaattctgccccgaattacacttaaaacgactcaacagcttaacgttggcttgccacgccttacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacggcttatggtattgcgagcttcagtcgcactacacggtcgttctgttactctttatgagaaagcgttcccgctttcagagcaatgttcaaagaaagctcatgaccaatttctagccgaccttgcgagcatt

SEQ ID NO: 83842 - DNA, 550 bp, Oryza sativa
ctcggtacccagatgctgagatggtagcacatcttggagactttggacttgcgaagattcttgttgagggcaactcattgctccaacagtctacaagctcaatgggatttagagggacaatcggctatgctcctccaggttagccttttatttttcctgtcctcctttcttatttagtcctgcctagtgcttttattaataaaatgtacagctagacaaactttttgggaagttgcaaaagaagtttgatttatgtgaagcagctatagttattatgaatctgttacattttggattacaagcgctataaaaatcgtaactttttttttggcaaactttgattaaacagagtatggtgctggaaatacggtatcaactttaggagatatttacagctatggaattcttgtgttagaaatggtaactgggaagaggcccatcgataacaaatccatacaaggattgagcctccgtgagtatgttgagctgggtctacatggtaaaatgatggatgttgttgacacccagctgttcttgggccttgagaatg

SEQ ID NO: 83843 - DNA, 1604 bp, Oryza sativa
acatggtagcccatgttggagactttggacttgcaagaattctagttaaggaaagctcattgatgcaacagtcaacaagctcgatgggattcagagggacaattggttacgcagcaccaggttaagcctaaactgttttttttttttttttgcctttctactctctagtgctgtatgaaataatgtttgatcctagagatattaatggagaattgaagtaattagttggaataaattgcacataagttaatgtaattttccatattatctatcaagttactaaatcaatttcgtagctacagacttttctagagttacacactcaaaccaacttgtggatttttttctaccccactaatggaggattttgaatcgtttagtttgagaaaaattttacaatattccctccttccacaaaagttacacctattacttttatcactaagacgaaggagaaattaactcatcattcatgtaacaaagatcaaggagtgtatgcacccatgcaaccaatgagtattaagataactccccggattctaatcaaatatttaatttacctctctattttagttttggatgcataaagaatacagataggaataacgcatttgaaaaaactaaaatatgtaataggtataactctcttggatggagaagtactacgctaacttttcataacatcaaagaactatatatttatgaattatttctttacggagaagttcatatccctcaaagaactatatattcaagaattatttcattgcttggtttaacctatagttcaattatagaaactttatttgaatatataattctacaaattagattattaaatatttaatttctttgttatttccaatatctcacatgtaatttaatgcagattattatatcagtttcagcgatgcaaccctatattatatcgttatactccctccattccaaaatataaggcacagctactcttaacccaaagactaagaaataattattatcatcttgtagtttaaatcatcctaataaatataatacatgcattcaataggattagataacataagagtggaagatttaaaaaagtaataatttaatggagaagatgtcatatttaattgcatgcttgcatgtatgccttgtattatggaacatctaagaaaagtggttgtgccttatattatagaatggagggagtagtaattaaatttcaaattgtacatgtttaaaagatacagtttttttcctactggaacagagtatggtgtcgggaacattgcgtccacacatggagatatttatagttacggaattctagtgttggaaacagtaagcggaaagcgaccaaccgatactacattcggacctggattgagcctccgtcagtatgttgaaccgggtctacatggtagactgatggatgttgttgacaggaagctcgttttggattctaagagttgggttcagactccagatatttctccatgcaaagaaatcaatgagtgccttgtttcactgcttagacttgggttgtcttgctctcaggaattgccatcgagtagaatgcataccggagatgtcatcagtgaactgcatgacatcaa

SEQ ID NO: 83844 - DNA, 614 bp, Oryza sativa
ctatagggcgaattcgagctcggtaccccgcatatttcgtagtgcttcacattcggcagtgaaactcttgagtgccttaggattttcaagctttagtaccttcactgcaacatgatcttggatattaagctttcctttgtatactgagccaaatgatccagaacccaacaaattagtcggcgcgaaaccatctgttgcttttaccaactgcgaataagagaccaatgggtggcctttcatggaagttcttgaaggggctccctttttagttctcttgtgccaggttataagcaagtagagtgatgagaggatggccagtgctgcgaccagagaaacagaaataggtagaactgggaaatgttttctattctctagtaatggacaacatcgaggcagatgtagatcaggtattccaccacagagtttggcattgccttggattgagatcccggatgcatctgcgaaagcaccaatggttggcacttcccccataaagctgttgaaagaaaggttcaaggaatgaagcatagtaatatctgctaaggatgtgggtatctggcctgacaaattgttgcttgagagatcaagagtttcgagacctttcagctgaccca

SEQ ID NO: 83845 - DNA, 1694 bp, Oryza sativa
aaggcaaaaaaaaaaaaaaaacagtttaggcttaacctggtgctgcgtaaccaattgtccctctgaatcccatcgagcttgttgactgttgcatcaatgagctttccttaactagaattcttgcaagtccaaagtctccaacatgggctaccatgtcagcatctaacaacacattacttgatttaatatcacaatgtacaacagattcaggtccaaggcagtgaagatagtccaatgcacaggcgacatcaagtagtatgttcactctttgatgcaaatttaagtgcctctgctctgcttgatcacaatttgtttcagggtgtagccaatcttctagactgccgttgggcatgaagtcatacacaattgctttgaaatcattccctttgttatcaatgcttgagcaaatagtaactatcttgacaagattccgatgacgcatatttcgtagtgcttcacattcggcagtgaaactcttgactgccttaggagtttcaagctttagtaccttgactgcaacagaacttgtactttcaccatgttggctatcaagttctcctttgtaaacagagccaaaggatccagaacccaacaaattggctggtgaaaaaccatctgttgcttttaccagctgcttgtaagtgatcattgggtggccttggatggatgtcatagcagggacttctttctttcttctcttatgacaggttagaagcatgtagagtaatgaaaagatcgcaagtgtcgaaacgagacagacagtaagagctatcagtagaatttgatgtttctttttctttgttgattttaaggaacactgcggaagacgtagttcaggtatgccaccgcaaatattggcattgccttggatataaatttcagaagcatttgcaaaaacaccattggttggcacttctccttgaaagctgttgaatgaaaggttcagcgagtggagcagaggcatgtcccctaaggacttgggtatctgacctgacaaattgttccctgagagatcaagtgtgtcaagacctgccaactgagtcagagcaattgggatgttgccatttaagaaattgttttgcagggagagatgctgtagaagttggcatccactaatggtgctggggatttcacccgataatttgttcgaatccgcatggaattcaacaatatttttaagttctcctatttcttttggtattgatccctccaatttattatgggacacatccaaagtttcagagagtgtgggaatgctaaatatttcagtgggaattgctcctataaagttattgtgggcaagatttagttcaaacaatctggtcatgtttccaagtgtgcttggtattgtgccactgaaggcattaccatagagctccaagttagttatttgtgtaagattaccgatggtcaattgcagataaccacttaatttgttgttgaatagaatgagacgatgcaaatttttaagcttgctgaaggaagatggaagagatcctgtcaaggagttgttaaagagaacaagggattctagattaatgagattaccaatatctctaggcaagcttcctgaaattttattggctccaatagagagatatactagtgatgaggaaagattggaaacagagtcaggaagaacaccaccaacttgcaggcacccatttctacgtgttggagattggagcaattcg

SEQ ID NO: 83846 - DNA, 750 bp, Oryza sativa
tgcagggccgtgtatttggccacctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaac

SEQ ID NO: 83847 - DNA, 744 bp, Oryza sativa
aacttgagcaaatactctgtttaataatttagtgaatagtttaaaaagaacatgacctctgcattttgggaattttttcaggcaagaaattaactgtaactggaagaaaagaagaatacccaatctgcagggaatggtcaccctgatctgggtgagggtggagaagaccctgatggtgatgaggctgatcagcaagaacagtgctagaaccgctgtgcccaccaccatcttgccaggacatatggagcacattctctgcactggtttcctgtaactgcacgaacaaacaaacgcttcagcggtatgagaagctgattaacttttaagccgtaccggggaaaaaggtttattccgtgcaaatactgtaactttcgtgaaacattttagcagccatgaaaagatcatggttgggactttagcaaggaaaaagatgtatgttgtccgaatactgatgcacgcaatgactttcagggtgatcgatggctgtgttacctttttcctcaagtctttgttgagatcttgcagctgttgctcctgcagaatcaattttagtgtttgtcatatgtgcacagatttaatttaggtgcagaggaaaaaagaaaagaaccagaatttattcagtaccttgctcttcagatcaaacagctgatcaagcagtgcttggttctgcagaaatattgagcctgtgttaaaagccatgcacataaacaaatccatacagttgaggggtaataagtaccgaat

SEQ ID NO: 83848 - DNA, 1473 bp, Oryza sativa
ttatagaaaaattcagcaccatttaaaatatcaaattagtttcattaaatctaggattgaatatatttagataatatgtttgttttgtgttgaaaatactattatatttttctataaacttggtcaaacttaaagaagtttgattagaaaaaaagttaaccgacttataatatgaaatggagggagtattttttatctgactctggcgtgtgtcttctacttaatgtaataatctactactcatacaagtatagtgctttttgatgctgttggttgtgaaagcaggtcactgatctaattgctatcttgttaaatgtacatagacgtcgaatttatcatttatcttttcttcttcctatttctgtagatcaagatattgatccatgccgcaaagggaaaaaactgcttgtcttagacattgattatactctattcgaccataggtccgctgctgagaaccctatcgaattgatgcgtccatgtaagggcatctcccatcaccactattatgttttccaatgagctgtcatgaggattgatgccatattcctcttcacagatctacacgagttcctctctgctgcatattcagaatatgatatcatgatatggtcagcaactaggtaagcgttttgtgatcctgatctatcagttaactggttatggttgtgctgtgaaacaagtaaagaaaaatacaattggcctttgaatgcagcatgaaatgggtggggatgaagatggaccaacttggagttcttggcaaccccaactacaaaattactgctcttatggatcacttggcgatgataactgtgcaatctgaaaacctgtcagaaaagaaaacttttgattgcaagcctcttggtgtcatttgggctcagttccccgaggttagtagtggcgtggtactgtgaatttgtgactgattctcattgaattatttgctcattgcttctgtttctttcatatgcagtacaatgaaacaaacacaatcatgtttgatgacctcagaaggaactttgtcatgaatccacagaatggtcttgtgatcaaaccatacaagaggacccattcaaacagaggcactgatcaagagctggtgaagcttacacaatacctgcttaccattgcagagctagaagatttgagcaagcttgaccatagtgcatgggaatccttcacagaagaaaatgccaagagacgcagacacaggtagttttttctcagtgtattgatcagcaggaaagaaaagttcgccctcctttttgatcactgctattaactgcatagactagaatatcttggattgaccatgacaaccacaatgctacttagaatactctacatatatccctgcgttcgatctgcacaaaaacatttccaaactgcaacagttattttttaaccttcctgtgtgcatttcaacgttaaacctagaagctttgcactatgctcatttttcatttacatatg

SEQ ID NO: 83849 - DNA, 721 bp, Oryza sativa
ccttcacaaaaggggcatactatattgggaagatggtgtggagtaaaggatacagggaacgtcttgacctgctgtccaaatatcagagcaagttggtgggtttggaagtagatttatatggtagcggagaagattccgacgaagttcgaaaatctgcagaacttctgagtttggccgtgaaggttcacccaggacgtgatcatgcagatcccctgttccatgagtgagttctcttattgttcaaaaacttccttccgtcttcttaattatttgaatgaacatgagcgtacaactagacaagtttaaccagctacttttttcattgttgttcaaaaatgagtttgagggttactatcattataattcattgcaacaatgcaaggttactgaactaaacaaaacgttgaacacaggctacataatgaggtaagacaagaaactgagagtgctaaatcacctaggaatgcaatataactcataatatattttgtcatctatattacattcagcatatggcaatggtttgtgtggatactgaaacacttcaatttcccaacagctataaagtattcatcaaccctagcacaacagatgtggtctgtacaacaactgccgaggcccttgcaatgggaaagattgtcatatgtgccaatcacccttcaaacgagttcttcaagcagttccctaattgccgcacctatgacagtggcgaggaatttgt

SEQ ID NO: 83850 - DNA, 1332 bp, Oryza sativa
aattgtggcaatagatacatattgccacaattttaaaatcgttgctagccgtggtaataaatagtgtagtaataggttattgcaataatttttatttagtggtaataaatttagatgttgccacggaatggatgtggcaaaaaatcatattgcaacacttcatatcgttgtaataaaaattattgccaccactccatatgtggcattagttctacgtaccaaattaaaagttcaaatattaatctatcatcctatctattaatttctttatacagtgtcttggctaggattcgaacccatgtatattgttccatttgagcctacctaactaagatttgaatatctaaaagatttcatatgaacaagttatcaactataaaattatagatctcgtcgagagctataatttccatataaaatttgtctcaatccgtatccatatgaaaaaaattaagttaaattatgagacgacaatttttttattgcaacgaatttgctgattgtggcaacaaaaagtagtgaaaagtaccattattatgtaaattgccacaaaaattaaaattgtggcgatagaacatattttttttgcaacagtaagattttttgtggcgatatctcattttctattgcaacaaaagtactaaataaaacaacaattgtagatcattgcaataaaatatatttttttaccacagaaaaattatcattgcaatagtacaatatattgctacaaattattttttgttgtaataatttggtggcaatagctcaattatcttgtaatgccggagggagtagcatttatacttagtgtttatatcgaagaaattaaacataattgtatccaattgtttataaaatatatgtaacacgtacgtattgatgtaataatttgtcgtaaatattgaaaaataatctttgactagttatttataaaaaataatgatgattacgttctataacacaaacaaaaggtagttcaaatatcaggaataatgtatgaaaatattaggattgttggtgtgaacaggaaacaccaaaactctttttttttactttcattttgttgaaacaaattaaccatcataactgctttagatattgtaaataaatatctagcataggctgcaggcatcagatataagatgcacacaggcattaatagttatatatgggtaactatgatataagtgttttttttcttgtgtttataaaattatttgggaatcaagatgaacgtactgcccagctcattgaattaaataaagatgtattttgtcaaaaaaaataaagatgtgtattggtcatgtgttttcaaaggaaaatgtgttt

SEQ ID NO: 83851 - DNA, 1833 bp, Oryza sativa
gtcatcccacgatcaccgattcactctcctagtcctagagtcctggtccatctttcttggcttcttgatatggcagaccgaccacccgccgcgcgcgcagccttacccggtccgccccggccgctgcgcggccaagcgcacacggacctcccgctccgccggcgcatccagcatcacgcgtacgactccgcgaggctcgtcggtttcctcgccctggctgtcaccctcgcggcgctccttgtcctcgcgggcgtcacgctcaccgtcgccttcgtcgcgcttgtcgtcctcagcccgctcttgctcctcaccagccctctctgggtgccgatggccgccgcggtcttcgtctccggggccgcctcgatcatcggctggtgcctccccgtgggcgcggtggcggccggcacgtgggcgtaccggtacttcacggggcggcatcgtcgacccgtgggcgcacaccgggtggactacgacgtcggcgcgggcaccgcgagcggctggatgggctactacgcgcgggagtacggcgcgcgcccccgcgtccacgtgaaggacgccgctcccggggcgtaggcggcacgcggctctccttgccgcgtgtggcgtctcgactctcgcggacgtactctcggtgtcgccgtgcgtgtctccatgccatatgttttgtagtgtcacgccttgagcgctatatatattgcaagtttgcaactataatgtggcgtgatgtggctggttagattggcgcggtctcgatcggttggggatgatccttttgacctgttcgggtctggttaattaccagcatatataattggtgtcccgtggcggctggtgaccgacacagtgctgccaacctgcattgccagactcgatgggttaactacatgctgggaaagcagcgagagtaacctgtgctcggtcgtcgcatctgtgtcctgtacactcgatcgatggacggtgctatttgttatgggcacctctgaatcgcaaacaagactgaaaaaacggagaaatagggaaaatatatgattctgataaaaatataagtataaaatagatgattgttaaatatataaaaaacataggaatgatagtttgattgagccatagaaaaaatacagaaatttgagtagagataaagactcaaataattctttctataaggttctaccttatgttaaattttctctaaaatttacgtggaaaagatattccataggaatttcgtacgattcatttcttcgattcagagggtaatatagaaaaatttttatagaaataacatcctttaaaattcgaacttcctttcaatcaaatggcctaacacttgacagcacgcagctgctgcctgctattttaaagcctggtgcagtttcggcccattaaggccagtgggctgtttttcggcctaagtttggaatatagacatggataagcctacctaagatatttactactctattttttttctcttagttaaacttttaaagtttaatcgagtttgtaaaataatatactaatatttttaataataaataaatatattattaaaatatattttatactaaatttaatgagactaatttggtgtcgtggatgttgctaatttttctaggtaaattttgctagaggacactgctaatatgtgattttagccttaacacactgcccaaacttacatttgcgggaaaacactccataaacatggtaatttaccaatggacaccgcgccgatcaaaataataatttccgattgaagaggagagagaaatcacgtgaaatgtcaagggaatgccctagggcccacatgtcagctctcttatctctctt

SEQ ID NO: 83852 - DNA, 5580 bp, Oryza sativa
gcctgcaggtcgactctagaggatccccatagaatgtattttacaatttttttggcatgatttttttctttgatcttctgaatgttctcattttgtttttgaaacttttcatgcatggccatattcaccatatttgggattagaatacatatcccaactttaggtacatccctatataacattttcaaaatggtatacaaataatcctgaaataattctggccaacatcctaccgggtgactcgtgacctcatcagcgtcatgttagaactgaagttcaacagtgccacaaccaaacagtacggcgacctgtgacggtacacaacgaacttgtagtcttgtacacatggtagtgatgggcaccgcgttaggacaacatggcgtgcaacaatggtaaaagtactatatgaacccgcgaattgcagtgagagattcttgctaacagctgtattgaacttgataaagcaactgtgctaaaagtactggataaattttgaaattgaataatcaaggaccttgattgctacatatcactaaacaggtagcgtaaatttagagacttcactaccatacacaactaattttctgctatttgatactcctaattgataccgagacctaaagagttaaacagcttcatgctcactattatcagactgggaaatagacaagattaatgagttaattcatgcatatgttgatacattggtatcactagttacatgatctaatcagtgactaagtctcctatgctcggctaagaataaagtatagggtgacagtgaaatccatcgactaaaatcaggagctgaagtcaaatatatcttagctcctcgaaaaaatcaggggagagatttcaacacaacatggatcccaacaaggagccgagaaaaactgtggctacttaaatatctaattcatttatctgcccttcttaagtttagactatatctacgtgctgctatatggattgatcacctgtacagtaagagatacttatgttttcaattgagcaatcttatgcggcaccccatcagctgcttcattcatatattctgacatagattcttcctgcatacatcagggaaaaaagctgaagttagaacatttgttaccgcatcaggggagaaattaagaaattaacacgagttataaatatgaaactccgaaggatttgaaagtgctgatggatgatggataaaagtgagtttatgacaattattcgagggcagaaatgaatgaattaaaaattaaaaggttgataagttgattttagaaaggtctcttaagaaatgttgataaagaaagtttttgcaaacatcatactgtttaggagtttgggaagccatgataatccggtggccataatcataaaagacacctaaacattcagtgaatctagaagcatttttctgaaagttaggagccactaggccattgggatggtaaattggctccactgaacaaacaatttgttctaagcaaggcagccaacaaaaactgtgcaaattcatgaaggaaagttttgatgtaatgagcatgggattctgtaagttttaacagagtcggctataaagttctacatgggtatctgcttttataaccttcaactgcacttcagacaggcacattccttttataaccttgtgatttaaaaagtggtacataatcaaaccttttgacttagtaactgacaatgtacataattatgcttacgattatttgctgcatgaaatcacttacatctttttctcgcttttcttttatgacaacacactgggaagcaccgatgctttcgctcttcaggaagttacgagcacttaagagtggcttgttcagtccatctgtcactgatgagtgccccggttgctcacctacatgcaactttatgcagtaatctgcagttggatcaggttcatcaccattcctaacaactctttccctgaaacgatatgtgaaacaaattagatcaagagaaaaaagactgaaagatggaaaaggccgggaatgtaaaccattttcactatctataaaaattgtattattgaaggcagtgaattttagttgatgtctcaacaagggaagcactcttaatactcccctttgttgccatagtgcttaatgacattaatatataacgtcaaaagtgtttgtgtttgatccacctcataggcatgcagactacgtcttgttcatatagaaaagtataaaccaatgaactgtggaatttcactttagtgaaatggggcacgataggttttttctacttcagaaaagaaaattgtcttcagtagaaatatgagacagaactattgccttggtaaagaaacatgctgccttagctgcgggctagtcttgtcaccctgagcaacaccttcttctagatgagcaaattgcctcttaaaacgatccaccccactgtcaacagcatagccatcagtttatttgcaacatgtccacaatcaatagtgtgtgtgaatgaaaaaatgaagtatgataagtcacgattgattgcagtgtgtatcactatgattaaaatgaataaatgaactgcatacagtttacaaagatagtggaaactgttggtaacattatatagtgcatccgacctggggtacaaaaagtttgactgatccccaccacgaagatatttctgcatcatctgaggatggtactctaatatctaaagatagagagagagagagacaccatgcataagaaaagactattaccaaaatcctcatggtagaaaagattagcagtacctctctgtaaattaattcccggacatcatcttttgctagcttccttctctcaaactcaaactcgagttttgagatgggttgtgctatgggttcacgttccgaatttgccaatccagtaaagtatggatctgttaaggccttgacacataactataatatcagtataatggataacgaatattagaataacatttttgagcaattgctctatgctggctagtagctacattcctacctctgcagcagttggccgatccttgggatcaaaagcaagtaaccgttcaagcaaatggagagccattgggtctgcaccaggaaatttctgagaaaaaggcactcgaggcttttttctcatgttgcccaaatatcgtcgagctttctcattccgaatctacaaatagtatcaaaatttgaagtataatttctaaaggtacttcttcaattgtaaaactgattgttggaagaaaacagtggacacataatgtgttctattgactttattcggtcaatgttttagaactttgaccatcaacagctctcaaaatatttagtttgaaaacataaaaatcatatgggtagatttttctttataagtacgtttaacaatattataattttgttagatattatcattacattctaatagagaaatagtggtcaaaggacctatagagggagcttttagcaaccgcagtttctccaagaattaagagctccctaaacagtctagattgccactcagattctaagaatctgtagttgtagaattcaaaaaatgaattagaagccttaagctgggtttagcagcttccccagattctcagaagctggctaccaaccagtaaattcttagaatcttaagctcccccaaacatggccttttgaacaccaaataccgaataaagtcaacaatgtcatatatttaaatatagaggttgtatccccatcatcgaactcatcctacaattaattgatagactgattaatattaaaaatcaaggctaatgtattcaaaatgtaaatgcaatataaatttcggatttgttcttccaagcttcatcttcaccatttgtgttcttgaaaatagatatgtagttttggagagcttaacatcaaccctgagccagttttctagtataatctccaaataaactgaagcagtggaaaaaggcttataagctaaagcctcaaatgaacttaagtattggagaagccaaccatggacaaacatgccttaaaatattgaagataattcattataaactaagtaaacgcttcacatcgaatttacagtggttggtttacatttatactttatataaaggtagatgtttcaccttatgagtatttcaatattgataggggtgcagatagtttgtgtataataacaccagtacaagaaaactccatcactacattatcctagagacaagagccaagccattctcagcatttttgaaactacttatgcagcctgagtataactaagttatttccaataaatatgtgatgagtgaactgtttgatgtgtctcacgaacctcatgtgttccatacagcgcgagtagaaagtttctaggaccacagacagattcacctatgaactaattggctaaaacattgttcagaattctctacacagcttgcattgaagtaatcatcttttaggctgtcatgatagaaagtaattttgctgatatttatataaattgtaggtttaaatataacagaaatgcccgcagcccgctaatttgaacctcctaaaaatgtccgggtataagaaatgataatgaccatcagtaggaaaaaggttaaatgaaattgcatagaagacaggctccaactaattgcagatttgcagggagactgggaaagtgaaccccaccctggaaatagtttctcctgaaggagagccaagtaagtcggtcatgagatccaattgatgtaccacattctttccaggaaaaagtggctttcccataagcatttcagcaaatatacaaccgacgctccaaatatcaattgcaggagtgtactgcaaaaaacacatttgagtttagtatggtgcaagtgcatttgaaattatccaaattggtatgctaagcatatgtatcgatagttcaagagcatggcattattttgtaacataaaggatttaatgtacggcattaactcaataatctcggatggggataaagtagctctgaaacgaaatgaccaggttgtgtaaaattgagcagaaaattcaggctttagcatgacgaaaatttgcagacctttgaaaagaaagagccgcacaactctggagcgcgataccatcttgttgccacgtaatcctacgacaaaaggaccacaaaacgaattaaaattcaaactatgatgggtgcttaagggctaacacaattctcaacatatctgactgtactagtactaggattgttcttttaccgtccagaatatcgcggacggagtgtcgtcgaaggacactcgagcaaggccgaagtcacaaatcttgaccttgcaatcagcattggcaagaatgttcttgggcttgaggtcccggtggaagacgctggcggcatgaatgtacttcatcccacgaagcagctggtagaggaagaactggtggtgctcgggggtgaggtcgtcgttggccttgatgacctggtggagatcggactccatgagttcgaagataatgtaaatgtcgcgaaactcgcggcgggagggtgggagcatgatgtgcttaatctccacgatgtccgggtggcgcaggaggcggagtagcttgatctcgcgaaggatgcgggtggcgtc

SEQ ID NO: 83853 - DNA, 4492 bp, Oryza sativa
tgcctgcaggtcgactctagaggatcccctactcctacatgagaaatcattgcctcctcacgcaacaaaacatacggactaggagtatacacgttaatcattgcaggaggcccaagcccatgcatagcatagagtacaccatttgcgggtccctgtaaattgcagctgtacgtgtgcaagaactcgtcgattctgtggaccaaatccacatccggagaaccatcaattatattactccatccgttgtttaaatacataatactattgatttttaaatacatatttgatcatttgtcttatttaaaaattttatataaatatataagatcagtggagccaaaaaaattttatgagccaggacaagtctattgatggatggattctctaaatttcaacaagagctagtttgctacaaataagcaaggggatccaaatccaatgcaaatcacttcattcagattatttcttacgttctgcttgtctgagtactctactcctgctagcatatcattttgcttctgcctgcataattaagtagccaagcacccaatgaagctaagctactgctgcactctgcctactgccgcgtgcgtcctgctaagcgcttgctaattaagctcattacacaaccatgtcccctgccacaagtggatgagcccgggcagttgcctagggtagccgggctgtaaatccgccccttataaaatataaatcatgcttaaagtaatatgagtgataaaaaaactcacaacaaaataaattataattacgtaaattttgttaatagtacgaatggtcaaatatatgattaaaaagtcaacgatatcatctattttaaaatagaggtaatatctttttgaaaaataaccatcaattagattgatctaaaccaacaattacagagatactccataggtttactgcagtccactatttctggccttcagccaaacgaaccttgtttcccttttaatcgtctaccgtctagctcattgcaaagccattttctctcagcaaacaaaattaaactgagaaataatgcatggtgataaaccatgctgggtatatagcagaaaaattaccgtacgtgagtaccttcgattattgatttgtaggaagaaatatgtacttctacacagttggcctcaaccctggccagcgaacactgaagtggatgaatgggtgatggcctctcgaggcttggagtgtaaaagaaactcgacacttcacgcgtgcgtgtgttctactgttctgcagagacctcaaagccgctttggtttgttttttcgtttcgtaatacatgtcccgtgccgtcttgctagtgggcatgcagctagtgcagatttcccgtttggtcaaaaaggatatgcgtgcatgtacacacgagcttacatgtaatccatgcaaaccttgatggtcgaggatcggccatgcatctacatggctcgttatgattcctgaccgtaccgcatcgatcgagtgcatgtgctcttaacactatgatgatcatgatcctttctttgcccgcattgcaagcatgcatgtgtgcttcgtggctcgtgcttgtaactacgcgttgcacgtgaacagtgccatcatctcgatccaccataggattttggtgaaattcaattcaggagccgaaactgttatgtttgtttattttctaattaggtacctctactttggtggtgtgcgttcgtttttactaaaggtgataaagttaggaaaaaaactcattagcacatgattaattaagttttaattattacaaattgaaatatggatttatttaatattttttaagcaacttatgtatagaaagttttcgcacaaaatataccattcactaatacagaaaagatttttctgtacaagagcccctgtagcttgcaagtggaccgtaagtctgtaactagtcacgcctacaaaaattggccagcattttcgtatacggctccttaaaaaacccgcatgtaccttaatcagaaaaatatgtatcttaatcactactacaaatatgtatcttaatcagaaaaaagggaccctccttgtttcggatagtattaccacggtgatatctattgctagtatttaactatcaatattattactagtatggtcattaatttataagttctacttccagtagatacatatatgcatatttgatttattgtattatcaggtatacattatgaacaatatgatccatgcattggagaaaaatatggaaggcctaaattcattttgggaattgctaaaagattgttgcaagatttttgaataaaaaacttttagatgtatctatagtatgttatagtgtaactagagcgtaattatattgtaactagtataattatagtgcaaatcgtaccataaacattgtaacttctatacaagttatatataaggtttcacataattttttaattcttatatacacgttgtataaaagttataacgtacttatagtataattacagtgtaattatatttgtcatggttattgtcacgcccagaaattcacgaaccagaatttctaagctgaatgtgtattaaacccctgtccaggaccagccagggtacacaaacgacaattgttgacatacagatccacgtcttacaaaaatataaaagattacaaatgcagcggaaaaggtaaagcgagctaagcctgaagacttgactcctgcagcgggcgattccattccacaggcaacccttgacggcagcgacgaaaccaacctcttcaagacatctccaactgagaagaacttcaactctggtgagggggaaaagagagcaagactgagtactacccactgtactcagcaagtcataccggaaaagggggggtatgatgcagggtatatccaagggaggctaaaggttcttttgcataaagccggcatttcaaagcagtagttgaaagcagtaaaacagtagtagtaattaatccatattaaccaatcactgtccaacgttacaccacgttgcaacaggcccaaaccaccacctgaactaaccagttccaaaagctaactagggtgaaactaatcacggtgaatctggtcgaccgcccataaccgcgggcacggctattcgaatagttttactctgatcagaggtgtacaactgtacccacaagacacatccccacgacacgttcccgtgcgccgacatgccaccacgacataccggaaagaggccgtgacaggacccttcgcataaccccctctaaccgatcgcaccacaccttagggttcgcccccgtccccagcaggcaacgggcagcccccctttcgtgccgcggtgaatccggaagccgatcaaccggacaccccggccgacccaactccatcacgcccaccctcgcctgggtacgtcggctagagaaaagctacactacaagcccagccgttgcccacgctggcttgtggtaagtacgataagttcttccagggcatcccgcgaaccggtccttagtcgccatgggcacgactagcaaaaccatgcacccacagcccaccatgtagtgtattttaattaaccaacaccattgcggtggcactaatctaaagctattgccaataatcaaagtctatgctttaatgtgatccccttttgtgcactagttgaactaagcatggctaagcatctcctaaaccaacatctagtcattttaatacccaagttatcaatggcgtaagggaaacaacatatagctgggtaataggaccaatcccacatgatattgtaaaacagtgcaatatttaatagaaatgcgggacatttgtaaattgggtacaatatgatcaattgcaatgtatgacttgccttgctctcgcactgatgaggccacagcaacgtcttcgagaaaccgcgaatcgacgaaacgggcgaaatctacgcgacaaacaaagcacacaagcaaaacatgctataagactactgaaacagataacaaagccatttttaatggattctacacatttttatgaatttactgagacttgaatggatttaatcggagctcggatgaattagttatgatttttagaagattatttgtgtttttactataaaagaaaaacccttaatcaatttattgcgcaataattcatcccagggctgacgtcagcacaaggaggggtggcgccgacacgcgggacccgcgggtcagtgactcaaggagagagaggggcggctggcaagcgggccccaccgagcggcggctcatggggacgaggagatgcccggtcggctcggctcggcctcaaaccggccgaccggttatggcgagggcggtggcgcgcacgcacggtcgccggcgacggcaaccggaggcgcggaaagcggcggcggatgacggcggcgcgaaggcggcggcacacagccgcagcggcggctcggcccggcacggcgctaggagggagagaaaggggaaaagagggggaggggcgcctcaccgcgagttggccggcgtggg

SEQ ID NO: 83854 - DNA, 996 bp, Oryza sativa
acccgcacccaggcgctgctgtgccgtcatgaccaagttggccacgtcttccagccatcgttgggctggagactccgggtcatggacgacaggcgggtgtcgtaggagcgcgccagcagcctgaagcgcaccctgaggtgtgctgccgtcgccgtagacgaggaggcgacgctccccatctcgccgttctcctgcatcacctgcgactggtgatgccacggatttgtcgaccctctcaagcgcctccccctgcttagggctttggcgcggaggaggtgggggagtacgagctcgacggcgcggattaggctccccgtcgtcgccgctcacactcgaagagaggtcgtgcgcttttccttgctcggccattaggctgaacaagaaaaacttggcgcacacggaagagtctgagagctcagaaaacacacgctgagccccttacctggcgcgccagatgacggagctcgtggctcctcaccgggagaccgcgcaggcccccctttgccggttcggccgggggcttagggtgaaatctcaagctctcgctctccctctgtatctggaaagatcgtctgcccgcaagacacacaagacacggcgatgtatacaggttcgggccgctgccaagcgtaataccctactcctgtgtttttgtggatttgtgtatgaatgagctacaaagtgtgagccaacttctcccccgttctaagctctaaatctggaaaagaatccaaaagaagaaccctctctctatgggcaaggtcctccttttatacttcaaggggataccacatgcaccctcccctttccaaactggacttttcttctctttatggacggagattggtatggttgctgtccgaatgacactccgatgggacagcccacacctacctccactcccggcgaagacaggcgcaacgtgggatcgtggctgcccgttgctgacgcgaccagtgccagaccggtcattcttgtccaccacgcgtcagttta

SEQ ID NO: 83855 - DNA, 5516 bp, Oryza sativa
aaatgggccgccatgtcctatccatccatatccctccatccaaacacaccttaaactatttacgtcggatattgtcgaaaatgttgtctgtcgcgcgtccgatgggaggagaggaaaatcggactgtctgcgtgccactgcatgcatggagagaatcttttcccttaaactatttatctaatatacgatctgattgcaccactaaattcgttataattaaatctttacaacaagaccacacatgattatatttcgacaaaaaaatattttagttttttattaatttttttaatgttgcatatggtttgttttgatgtttaaaccagtagttttacaatgtttcagctagtgtactcatgatgtttcactatatacggatcaaatgttgcagtgaattttgatattatggaacacgccgttgcaacaaatcacccacatattttggaaaccctttattaagggaatttggtttatttttttgttccacaaaaaatgtttcatctagtgcattcataatgtttcactatgtatagatctaatgttgcagtgaactgaaatactccattgcaacaaatcacccacatattttggaaaccctctattaagggaatttggtttattttttgttccaccaaaaatgtttcacctaatgtactcacaatgtttcactatgtatagatctaatgttgtagtgaactgaaacattatttcgctatttgctgaaacattatttttatataagatgaaacaacgcccgatttaaacgattgaaggggattttctatctacttactgaaacaatttcgatatatttggtggaacatcgtgcaacattttaaaaaaaatcaataataagctaaaaaaattttcgtcggaatatatccatgtggggtcttgttttgaagatttagttgcaacaaatttaatggtacaatcggattatgatttggataaataatttaaaagaaaaaatcaatttaaaatagttttgcacgtaaatcggacgctgacgttagcgcccgatttccccatctccccttcggacaaccgacgtagtcgcgtcccggatattgtactgtggattgaatggtgcacacgattaatacacctacgtactgtgcacaatccactatatccatcacagatcacagggttggttcccatcggtaaaaatggctcccattaaaaagtgtaaatttagctcatgcgcatcgcacacttgggttatatttgccataaccgtccaaattaactattcagttaatggacactacattattgcgtatatttgataactaatcaaagctgtatttatggtgcaattgcatggatctagactataattgtttcaaagtaaatttggatttaaatataaaatataattctcttaaatccattccgagcatatatacatttagttattattgtgctccaatatatactcaatcggtctacactgcatatcctaacctaaccacagagtgtgcaaaagttcgtgtgcgtgcaggacgttttggggtaggtgggggaaggccaaagtccgccgccttgacccacaaatattttctatttcgtacctttgtattttaatattgtacatatataagtttcctatacctgtatttaatttcgaccaaatatcgtacattacaatatgggagatttacaatatatatttagttttcagtgaaaagtatatctctatatgcgtgcaactgatatagaacaagagatagaaaaatgatattaagaagttcttttagtaatagtgaaataataaagtccggacaatgataataaaaatgattataattaaactatatcttgaaccttaggtaatgagtgggaattgatattgccgtattattttgaagtgtgtattattcttacatttatcaagtacaatgagtagcagccagtttttccacaaaaggatgcatggtatataatgcggtctcttgttgtacccaacacataatcccccacccacccgaaaaaaacaaatgtaaacaaactacagtagaatatctatatattcatgtatttattggtgagtcacatggacgtcctttttaaaatattgaaaaaaaaaccgtccagaaatatactcttagtcatagtgacaaccaagctctcctgtggtatatcgaagaacagaaccaacttgtgtcctcattcctcaaaaaaaaaagaaatcaggaactagatcaccgacggacgaacacaattccatacccatcacgagctcgtgacattgacttgacaatatgaaatgaactgctacagtacattctgctttgcaattaatttcttacaagtgactgtgaatgatctaaacacaggagagagtaaagagaaacaaagcaaaaaggaaaaaaaaacttgatatattggcagaagaactatacggatcatatgaccagagtactagagagtgcagatccctggaacgccggcgtgactccgtcgcgacgtaccggagatgtccgccaccttgcaattgctgccgatcgattaccataggaaccataggctcgcgaacgcagcacacgccgtgaacagacgtacggcgcggctcccgtgcgacgacggtgcgctcgacggcatgaacccggggtcctgcgggtacagaggccctctgccggactgcgcgcccccgccgaactggacgtacgccgctggcggcggcgggcagtatgacccggggtaatacgccggaggcggagggctgtagtagtagtacggcggtggtggggggagcgccggcgggggcggcgacgggtacagcaccgggcagtcagcgccgccgcacggcgagcacccaccgcacttgacctctccctcgatcgccgcggccgccgccgtcgacgccgcgacggcaaggatcgccagcacgagcaccggcgccggacgccgcatcatgtcgccggtgatcgactcgggtagctaggctagcacgctacgttatgttacgagaaagccggtctgcctacctagctaaggtaacaagaagagaagtgccctacggtatggccgggcgtgcagcctgctgccccttttatgatgcgcccacaactcaccaagtatatcttctagagtcatagtacgcattatttggaggaatattaggtgggggttcgttacaaaaaaacagcggccagtaagcagtagaacccaaaagggatatgcataattgtagtgctggtggcagtggccatcgaggggaggagtagctgggccgggacagtgtgtggcttcctgaggccggcaccaccaccacgcacggcacgttccagcgtggctcgaaagcgacgaccatgtggcggcgcctaaatcggtgggccacatgcgcgagctatgaggctatctactacgacgactactatctattacgacgactactatagtcgtgctgcattatgggcgggcaaaccgaccgatcggagctcggtttggtgcgcgcccgggccggtgaatgcgtccgggagggagcaccgacgcggctggtgcgggccgttacatgtgcgtgtgcgtgcctgtccgggccaagttgcggtaggagtattctttattccgcgcggcagcgcgacgcgtccaggggagggagtgggcaacgtgagttcatcattggggtggaggatcgtggagctgggagtagcttcaagctgggttcacctgcgtctgcgtgtgacgaagttttattaatgaagtgggaattcagaagcttccgatctggtctccgattcgtccttttgcgtgagccatgtgactgaatgcccctgatcctgccttgggaatggattgatttttcccgtgcatttcggtgtgtgcgaggtccccacatgcaactgaataagtcctacctccatattttaatgtataacgccgttaacttttcgtctaacgtttgaccattcgtcttatttaaaatatttataaaattattatttattttattatgacttgattcgtcatcaaatgttctttaagcataacataaatattttcatatttacataaaaaatttgaataaatcgaatggttaaacggtggttgaaaagtcaacagtattatacattataatacggagagattacatccgttcttttactatacacaggttagttgcacatactcgcgtgaatcctctgcgcactgcaggtgtccgtctgtatgatcactttttttttattttgaagtggtctgtatgatcactttgattacccgcactgactactggttatgtttgggtttgttaactacacgtttaccgcttaacatggaaaaaatatttgaccactactgccaagtgaccatctttgactctttatctccaacggttctttcattctttcttgtcaccttttccgcggtgttctgtacggagatgaattctaataactcgagtgcacatccacccgtttatccatccgtttattgtatgtcaattagatggttacaaaaaattttaaaaaaaattgacaagatcgatcaatatgtatctccacaaacatacaagttcaaattcaacttctataagttgtaataaaaataacaaatttaattataaatattcatatagtaatttcagttttgtttgttatttttgttacaatttgtagaagttgaattttaacttgcatgtttggggattgatatattaatattgatctatcttattcatattttttttattttttttcataactacttgcatgacatgcaataaacgggtagacgtccactcgagctgttaaaatagtttcccggctataccctttttcttcaaccaggagtagtaacatacgtaggggcaaaactagaataggaattaccctgtgtcccatttaatatcacacacttaatactccaattacgtgtgccatgaaaaaacatgctttggtgaaaattttatggacctgtgtggctgtgtcccatgcactacggaagcgtaatgtttttaggggaaaaaaatatcgcgcttccgtagtgcaatgtggcttcgctctggcagccacagacctacataattagtaatatatcattgtcggtgatatgggaccgggaatatcatgactagaggcttgaggcagacacaatcgcccacggggcctggcaccttcggggacgtcgggcccgagggtgaggtgtccgccctcctcctgattccccccaagggggggtcgggttgcgcttgccccggccccgagggccggggcaccccgaccccctttaggaagtctgcgccacatatatgggataagtgagcacagctgtgctcacctaacagcatttaatgcagtctggtcaggcgtgtcacgctgcatgcagcgcagtacggcgcgttcctttatccggtctgtgaccagtcacagaccggtcagatcacgggttaggtggcgacaggcggtcagacgcacgcttcgccccatcctgtcaagacgagagcttctaggcactcgtccccggctggagctagcgtgttacatcccagagatgacacgctagccccgatc

SEQ ID NO: 83856 - DNA, 5302 bp, Oryza sativa
  unsure (1)..(5302): unsure at all n locations
gccagccgagtcccgccgccgctttctcccgccaccgaagcagcagcaacaagcgcctccacctccctcctcttcatcctcagccgtagccagcaccgccacctcccttctctccctccccagcagccgccactgacgccctcctctctctccctccgcacggcaagatacggtgttcgtggtcaacgccggcggtcaggtggtcgtcggcaaccggggcaggcggccagcagaacgcacgggcatggcgggcggcggcggccgtggcaggcggcagcgtcctttctttctttttttttgataatttgttattcatctgagatgtataatttctttttttagaatttgcgatcaattgtatggatctgagatgtatttgatttgtgtgtaatttttttaggttttgtgatgtatttgatttgtgtgtataagtaacttaggatttgtgatgtgaataatttgggatgttactttgatttggggatttggggtttgatttgaggatatgcatggtacttgattggggagaaaatacagagctctgtcaattagcaaagaaacaatgaaaaaaaaagaaaaggggaccancggggcccgcccctaccctctctttagtcccggttggtaacactgaagattcaactttactctcggttattccactctagactaaagataggcatctttagtcccggattcgtagttccggtaaacaaagggttcccaaccgagagtaaaaacagttaccccggtagtgtttttacaaatattaattcatactaaacaatctataacgataactaatatgggggactgaggctgtaacatgtaacgtctgtacgcaacggaggcggcttgcttacttcacgttggtgcttgtacactacaaatgtgccacctctctgttggttgcagctagccttcgcggtggggccaacgttggctttttcatcagcgctgaactactggtccaggtcaaacagaggtgccattgtcgatgatacaggcatggcattttcttctagtaataatagtagtactacattaagattaaaatggtactctctccgttttagaatatttgacaccgttgattttttagcacatgtttgaccgttcgtcttattcaaaaaatttgtaaaatatgtaaaactatatgtgtacatgaaagtacatttaacaatgaatcaaatgatatgaaaagaataaataattacttaaatttttttaataagacgaatggtcaaacacgtactaaaaagtcaacggtgtcaaacattttaaaacgcagcgagtacccagctctttttcttactttcagtaccagcatgcctgtgaagaaaacagctgaacatcactagttttaggaactgtatgaccatcgctgctttacattagtgtgacgcaatcttgtgaagtcatcgatgctagctgctagtatagctggcttgggcgttcaattgtcgtgtaagctaatagcatgttctttccttcaattctagacttcaacgttagcatattttttaaaggttaattagtgcatcttttgtaaaaaaaaataatatataaacttttataaaaaatcaaataaatatatttttttaatttacaatagttaatatataattatttatgtgctaataagctttcttattttaagtatgctgaaaatgtctcccaaacctagcggaacaaacgtaaccaataccacgagcttaaaattgtttttttaataatgcatagtgcctttttgggtggcctcaattttgcatgctagctcttaataatttttgtttagttcctatatttttttttcaattcacgtggaaatcctaaatttacaccctaatatctcataagaactataaatttccttccccgccctattccccacacactctccttgtcttcggctctcccccgcatttgcgacaacgtcagcctctcctgatagtctcccctctcctttgcctatattggtgacgagcttcgctacatctatatttttacaataatttgattaaacgatatgctgttttataaaatagtaaagtccatcaccggtccctaaacttataccgttgtgtcatcccggtccataaactcgcaaatcgaccgttcaggtcctcaaacttgttcgactatgtcatcccggtccctaaacttacagaccactcgtttaggtcttctatcttgcccagttgtgtcactccggtccctaaacaggaaggcctaaaaactttatatcaaaaaataattcataactttttcatgtgaactctaatgaagacaaagtttatatcaaaattgtagccctcgacgtgacctacaactttgtagttgaaaagttttggaattaaaactgtttagggtcccaaaatattgttgcatgtttatagattttgaaattttaattttaaaattacattttgggacaaaaaatgacttagaataaaaaaaattcaactgcaaagttatagatcacgtcgagggctacaagcttgatataaagtttgtcttcattagaattcacatgaaaaagttatgaattatttttaaatataaagtctttagaccgtcttatttcacccagatgatattcaaatccaagtttagggactgaggtgacacaactgaacaagttggaggacctaaatgagtgatctacaagtttagggaccgggatgacacagtcgaacaagtttgaaaacctgaacggtcgatttgcgagtttagggaccgggatgacacagcggtacaagtttagagaccggtgatagactttactctttataaaatttactccctccatcccaaggcaaatttcagccgtctcacacatataaaataaaagtaaaaaaaaagaagacgatcatcactttacactgctagagaaaaggtttttaaccctggtttgtaacccctgtagtcccggttatacaactgggactacgaatttaggactaaatatacccatctttagtcctagttgaaataaccaggattaaaaatctatttttagtctcggttggtgttaccaatcaggactaaagatggagccaagccaggatggtaggttttttttcctttttcattgtttttaacattgaatattgatttcactatatccccaaatcgtgaaatctccaaatcgatcaacacagaacaaaaggatcatctccaaatccccaaatacatcacaaattctaataaaaaaatcacaaatacatcacatattcacatcacacacagatcaaatacatgacaaattctcaaaaacaaattcatcacaaatccttaaaaatacaaatcttcctccgatccggtcgccgccacccgtccgccgcggcctccctagaccaaccgccgaccccgcccgacggctgccgctgcatctcccgcagccaaccccgccagggagggcgcgcgcagtccgccgccgccacgcgcaggcagccacctcaccagcccggccgcgccgctgtttgccctgcaccgtgccgctgccggccttgtctcatgcgaggggagggggaggacgggtgtggtggtggagggggagaaggggatcgagctagcgctggtgggagagggaggcgaggagtcgtgggtggataagatgaggagatgataagaaggagagagagcatgaggagaggataagaaggaaagagtatgaataggaagatgaggcgcttggaggataagtcctatggataccgatgtttagtagagcatgaggagaggataagaaggagaaagcaagaataggaagatgaggcgtttgggaggataagtctggtggattatatatggtataccgatttttagttccagagttcccggccccttgacagcctctaagagtaaatgatctgggactacaccaaccaggactaaagatcatctaaggccaatagagtcttaaaccggaataaaaaagccatctttagtcccggtttctattcaaaccagaactattgtggtttttggccaactcagtaagaatgatttctccaatagtgtcatcaaatcctaatgcaattattgtatttttatttttatttacttaacttttacaaacttagatgtaataataactgaaaaataaaattattttaggataaaccggatggaggagtactgcaggaaacgcaactccactgcacctttttcttaaacctcagcatcatcgagtggcccaaggcttgcattgcacgcggacctacatggaccggccggaaagtcaggcctacggcggcgtagctgtggcactgctagtagttactgctagtgcatgcactgacctagcgcctgggcgagtggccgtggtcggctcccgccgggtgactgctggtgcgtgccccgctcccgcttgcatgtattctcgcgcgatgccgctgctgctgctgcagtacgtttgcgggtgcctttacggtttttctacgtacctggctgcccatggtggcctggccgggaagtggccactccgacccatggccatggccatggctgtttgctgcatgcatcccctcctgcgcgcgctgctgcgtgctgtgctgcagcggccttccatgctgcttgttgctttcgtcggccggccggtctgctacctgcatgaagtgctatctcactgcttgaacaataatgcacgcctgtctgcagtgcctcctcctcctgcttcagctgctgctgctgggcgagcgtacaccacagccacatccacatgcaggcatgcgcttgcctccccacttgattgaatgccccggcctgcatctgcatgcatatatcttctgatgtaaccggtcactcacgtccgtccttgtcgcccctcccgtccctcgttactctagctctctcccttcgtctttctctctctctttctatttcatcctgtccataattaataaggacttctgtcgtctatgcatgactgatgctgaacatgaccggtcttgctcttttccgttggactcttggtcaacaagcatgtttgcttgccccgcccaaaaaaaaaagaagaaaaaactaaaaaaaaactgttctttcttttttttgttcagaaaaggaagtggaagaaatgaaccatactggatggctcttttaggaaattttaacaaatgttggccaaaggaggtacatgctttgcttttttataatttatagaagatactattgatgattttggcgagatactgtacagaggacaaatcgtccgtactgtacactgtagtacagcttgttgtaaagaacagaatcagatgtacatttgcacaacggaatcaatacaaatccgatctat

SEQ ID NO: 83857 - DNA, 1361 bp, Oryza sativa
gtttgatgaattctgaaacagctggaaagcaagtttgctggcaaggtagtatagggatattccacccgggctagagcatcgcattcgcatatatcggcgctagacgccttcaccatcgtagcgtgacaccagcaaattccgcagccagcagccagcagccagcagatccgcagaagtccccaatccgtccaagctccaacaacgctggggagtgtggccccgcctggcccccaccagctccaccaaccgaggcacacgctgcggctgcgcgagcagggcccaggtgacggccgcccgcacgcacacgacacgacaccaacgacgcgacgcttcccctttcccccctcatcagccgtttgcctccaccccccacccactccacagtccccgctctccccccattgccgccgccgcctgcgacgaccgcgagctcatcccgagacgacgtctctagctagcatcgagcgttctttctctcctcgggctctcgttggtaagccctcgattccggtttcctcctgcttctcctcctacctgcccctcggattagtcgccagtgttgttcgctcgtctagttgcttgcagtaattatagtgctaagctccggttgtccgtcggcaatacgccggtagtccatgcaccagtctcgttttcatgggttttgttgtttgcagcaggcatacccctgtttcgctagctcaatcaatcatttcattgctactattttttttgttttactttgtatttaacgagtattgcatctatgaaacaaacttcacacaaatttgatgctcatcaggttcttagttccaccttcttttgtgttttttttgttcagttgagataaggcaaatcaagagagcaaaattttggtggtacatgtggtgattctatgtcgacaaggcgtcatcttgcagtatttaccactgcaagcctcccatggatgacaggaacggccatcaacccgttgttccgggcggcctatcttgcaaaggatggggatagggaggtcaccttggtaatcccctggctttctctgagggaccaagaattggtttacccgaataagattgtgttcggttcgcctttggagcatgaggcctatgttcgtcgctggattgaggagaggatcagtttcagaccttccttcagcatcaaattctaccctgcgaaggtacattgatatattaacgcaaagagttcattaaccatttaaccctggaattctctattctttgtgagattttcttttaggtggttctgtcacttgatatatcaagctctctatactttggggattttcttttaagtacattgatttatcaagttctctacaatactattggcttctattttacttg

SEQ ID NO: 83858 - DNA, 2110 bp, Oryza sativa
caggcgtctctgcctcaacggacaacagggtggtatgcacttttccaacccaggcgtccaaccgctcgcgcaacgccttcacctgtggaattccaagtactctaggctggacccatgacacgtgaactgtgctgtccacctcatcaattatcccctctataagatgaacctgcaaaatgggggaatcattaataattctctcatattccaatttacttttaaattgtatggcaattgatggcctcatggaaatacagcacccaggctccattagcaactaaatagaaaacatcagcatggagcttttgtaagaagctgatagcagtggcattctatcttggctacctatatattctgcctttcaggggcagcattattatatactataatgtactaactgatgtagaaaagaactgtaatggaagaaaaagatgagaacatcaactaggaatactagttgatacattgtgcaaacactgaagccgtataaggtaaaagcaatagtagcatgtaacaaggagagacacaggtttgctgtgatcaacaaacacaaatatatgaatcacatgtctagtttaactgacaacgcacacccataactcacaactaaagattcacaaaacaaaccatcagcaattaaaaaaaaagacaagttcacaaaggggaggaattgaaggcagtaattatcaaataatcactatccatatacagctgccacattaaaatgacagaagcattagaagcattctaatgtctaatcttaaaaaacaatttatgcacaacaaaactagatgtttatgaatggcattcatgcattgtctatcccaacaatgaattaacatgatattggcatattgcaaataatatcttatgaaagatcgaatgtaagaaatgcaattaccgagaggctcttcataagaagatattccacatcactgatagaaagcttagtgcgctcggctataacacttaatgggatagttctgtcttctgacgcccggctacaacatgaaaaagaacacagggcttagaaggaataaaggaaaaggggcaagacatttgtggtggcatagaaaagcaagtagcaaagttgtacctaaagattatctccatcagacatagaatgttgatcttctctagcagtttccgttcattctgcaccaaagctggctgagcactgagagcagcattgtggaccctacatagttcttggtagagagctaggttgccggtgttgaatgcttgtaacatatgatagacccactccaccttggttccaataagactgttgatctaaggatataaaaatataaacaacttcagacagagatgtaccaaatgacaaccatatatgccgatatatagatttaggggccattcaatatttcaatcccataaaggctaccttgtgtctggaatttttttgtttggtatccacaagtcaatattgatttttccatgcacaaaaaagatggtttgccattaattcatgcaaacttaagtttatgctatttcaattcaagaaaatacgaagtttacataattataatatagtggttcacaattacatcattcaacattcagcaaaaaaggatcaggcataggatatttcatcattttgatatgctttacacaatcggtagcattttattgtgtcaatgttaactgcatacattcaactcatgaaatttctgctaccgatttggcaatagatgtaagttactgtgtacaaaactccgaaacttaactaccataacatacacaggtaccttggacgccttgcagttctagcaagcatcagataaaaacaactaataaataattatcagaactggcagttgtgagtaccaagaaaagccacatgtaatgtttatataggcaagcagagttaattttaatcaagcaatcaagaaacacaaaaaagtatggataaaacaaaggtggtactactaactagtggcaacaaaagaaatcatgcgtaagcaaagtccaacttacaatcgggtgagctaacaattccccaaagttgtagatgttatcaccaagcaaggctgcaagggagagatcaaatgccaaatcctgacacaagacagcatcaaagggtaaacat

SEQ ID NO: 83859 - DNA, 685 bp, Oryza sativa
gtgctttggtccacttgtcttaacctacaagcaaagaataaatagctcatgtttcatcttgaacaaaaattccaaacagaataaccattcataaatacgcatgtaaaagtaccttgcatccaatgtacttagggcttgtagatgcaaaaaaacaccacttgcaaccctcttctgctcttttgcaaatggctctaaaccttttcttgtcattcttgacagtttcaaaagcatgatcattcaagatagcatgatgggtaactgctaacttgcattgatccacatctgggaacactacaccaacatcaatacaaggatcctgaacatcatatgcaaagacaggtacatcatcatccttatcaacaatttcttgatcaggatcaaactcagggtcagaacaatcagagtcggaagattcggccaaatcagaatcatagctgctatcactatgtgccacaagtgattcattgtcagagtatatgccctcatcatcaatgcctactgcatcctcatcatttgaccccttttttatggaattcttggctctcttttttttggctccctcattagtggctctctcattccttgcactcttttttttggctccctcatttgtggcaatctcacttatgcatgctctagaccttactgaaggatgaaacctacactttgtgggtgaaaattgcaa

SEQ ID NO: 83860 - DNA, 714 bp, Oryza sativa
ttctctggctggctacgaaagtacgaagggaggaataaaggtagagagataaaaatacagtactactggtactgtactgcgttttttttttctttcgaagttcaaaaagataatattttctttcaggagaaaaatatgatagtcttatccttagttgcgagaaaatgtgttcttctctacctcgattaatttatgaatcgatggtaatcacattcacatatcgttctcaccatcgaaaaaaaaacagcatacaacatactaggatgaaaacaaagctgatacaaacagatgatactcctaatgtatttgttttcgttttttttggtcggacaaaaaaataaatttgaatagctcgaatacaaaaaataaatattaattacctcaaatacaaataagaaccgaatatgctaaggcacaaatacataaacaaatatttttcagagcacgaaaaccgtcttaacttttaatagaaataagtatcatcacatataattagcttggtttatattaaggctgtatttgggaggatgggttcctccttcccagcacacaaaatgatgttcgcattaacgcgtgattaattaagtattaactgttttttttcaaaaatggattaatatgatttttttaagtaactttcgtatagaaacttttacaaaagacgcaccgtttagtagtttgaaaagcgtgcgtgcggaaaacgagggtagggaa

SEQ ID NO: 83861 - DNA, 700 bp, Oryza sativa
ataaggtagaaattcaatttgttttctgttgcaacgcacgggctctaggctagttatttactaactttcaccaaattttgctctcgattgctctcccgcgaatccctaaacacccataatttaatgtgaggtgttgaggttgttcggtaggttaaaactgttgtgtgcgacactatttgtgctggctacaatgcaactacaaattaagtagctgaattaccacatttctagtatttaattaattcccttcatcttaatctcttatagagtagaaaagatatactccctccatactcgtaaaggaagtcattttggacagcgacacggtctccaaaacataactttgacttcttgtttctataaaaatatttattgaaaagtgatatatgtatacttttatgaaaatatttttcaagacaaatctattcatataatttttacatttttaaactcaacaactcgagagttattcataatttatatttccaatgtttgacttaaacattgtcataaataattttttttacgagtacgaagggagtaagtgattatattttgaggcggagagtataactttagcatatatatatacacatatatccagctggggaaaaaatgaagtatatatatatgatgggacagatgaagacgaagatcgtgatccttaatttaatttcgtcctcgcaaaaacaaataaatg

SEQ ID NO: 83862 - DNA, 588 bp, Oryza sativa
ctttatcagatgaataaatgatcaaaataaaagttatagatcttgatgagttattcaactttgttgttgataactttttcagttgaaatcatttagtatttgaaaatgttgtttgaagttgtcatatttttaaattcaaattcaaacggttaaaaaattgttatatagaaaaatgaccaaaataaaagatatagatcttgatgagttattcaactttgttattgatgactttttcagttgaagtcgttcactaacaaaaaaattctatctgaatttctcaaactttgaatttaaaatatcaaattgtttaaatagagttagatggagaaatgaccaaaagaaaaattttgcacctcgatgagctctacaactttggtttcggtgacttttccatctgaaatcatttattaaccctaatttttcttcgaagttgtcaaattttgaaaattcaaaatttgaattgttcaaattaacttatttgtacaaaggaccgatacaatagttgtagatctcgatgagttatacaattttattctttatgatttttgatgggtgtgtatgtgaatgaatgtatatgaatgggggatg

SEQ ID NO: 83863 - DNA, 596 bp, Oryza sativa
ttttcacaatctaccatgatacctttgcttttacgacatttggggcaagaaagcccttcattgtttttcacaacatcttccatgtactcaacacgacctaaagcatctttcaatttcaacttattcaaattacatgttgagcaatccaaaacatcatgaggttgttttaactttttagcagaaatcatgttaaacatcaaactagcatgaaaagcaagttgatatttttgcaacaactttttagctaaaaataactcatccaaagtgcgtgtgtccaaagcaaaactacaagcaagagaagatctatttttcaaatcatgtgcagcattaacatctctaatttttgaaatctcgttcattaaaacctcacaattttcacaatcatcatcattaggaataacagattttaatctagcaatttcagatttaagagattcaatgataaattcctgttttctatacatcttctcacacttcttattcttttcactcaaaatattaatagcttcctcaaaagcacttacctcattatcttcatactctgtgtcagattcaccacgcgtcatgaagcaaacatcggagatgttctttccctt

SEQ ID NO: 83864 - DNA, 842 bp, Oryza sativa
ggttccaataatattatgtccagaaggtggttcaaccaaagtccaaactttgtttctctcaaaattttcaagttcttcatgcatggtgttaatccacgattcattagttaatgcatgtgacacatctttgggttcaaaagaagcaacaaatgcagaatttgcacaacatcatgagtcgttaccttagaccttgttgtccgctcacctatattaccaataatttgttccggcggatgtcgtcgttgaatgtgcaaaggagcagcaacttctgcagttgatccacgttctgtaccagtactggtcgaagtagtaatctccggaggaccatctcgaacagcatcaacagaaccctcagccgacgaccctggccggtctaaccgcacctcctgtgccggtctgaccggaggtgtgccagtggtctaaccggcctagcgcccggtctgaccagccgagccgacctcgtcgtcatcgttgttgtcgctctcgtcttcaaaaatacgaccatcctcccgctgaacctgtgacagtgtacctgcaatatcgggtctagtacctggactagcctcatcaaaagaaacttcgcaagtctcaacgattttgttagtctgcaaaataagtacacgatagccacgagtgtgtgcgtggtaaccaagaaacaatccatcggtagaacgtgcctcaaacttatccaaatttccagatttcaagacaaagcacttgcaaccaaaaacacacaaatgtgaaactttgagttgatgtccaaatcgaagttcataagaagtttttccaagttttgatctcaagaaaacccgatttgaaatataacaagcagtgttaatcgc

SEQ ID NO: 83865 - DNA, 624 bp, Oryza sativa
ccagttaagaacgactccctctactattaatacaggttctaatttacctgcacatgtgatttggacaatggttgttgtcttatgtgccggcacactaacctagtctttatcctacgggcacatctatctattatatatattattaaaggaatagaaaaatgagtctttacgtttgctctcatggtctagaaattttcacattaatcggagaaaaagaaaaaacagagttcatatagaaatacaatttagaaatagctgaaattcggaattaaaaaaaaggaatattagaataggagactagagtccatatagaaatacaattagaaaataactgaaattcgaaattaaaaataaggaatattagaagtaaagtataaagtccatatagaaatacaattagaaaataatagaaattcgaaattaaaaataagaaatattagaagtagagtatagagtctatatagaaatacaatttaagaaaaaaatagaaattcggaattaaaaaataaggaatattagaagtagagtacagagtctatatagaaatacaattaagaaaaaaatagaaattcggaattaaaataataaggaatattagaagaagagtatagagtgaatttaaaa

SEQ ID NO: 83866 - DNA, 688 bp, Oryza sativa
ccataagcatctttccactgtaaagttgaatattgtcctgtgtggtacttatgctgtaggcaagtaaagtttatgagttgcatctgtacacaatgggcaacaaggtttatgctactgagatggctaaggttcttgatcctactggaaccctgtttgctgggcgtgttatctcaagaggcgatgatggtgatccttttgacagtgatgagcgagtgccaaaaagtaaagatcttgatggggtgttggggatggaatctgcagtggtgatcattgatgactctgtgagagtctggccccacaacaaacacaatttaattgttgtagagaggtatgaatctgtctaatgtttcttgctacatgaggtaacagcagtacaacaggttcatcttactaggcccccttccatttttttcctctagatacacctatttcccctgcagcaggcgtcagtttgggcttcctgggccatcacttcttgaaattgatcgagatgaaagaccagaggatggtactcttgcttcttcactcgcggtatgatggttctgctacatctgaacttttaagtattgtaatacaacttgattatgatatacatacttgttgaattcttgaataggttattgagcgcattcacaagaacttcttttctcatcctaatctcaatgatgctgatgtgcggagcatacta

SEQ ID NO: 83867 - DNA, 607 bp, Oryza sativa
acgacttaaggcggccatgccaccggggacgcactgctcatgcctaatttagctgggggggcgcatccgctctatagctcgtatcttctcggggttggcctcgatgcctcgggctgagaccacaaacccgaaaagcttgcccgccggtacaccaaacacgcacttatggggggtcaaatgtatgcggtcggagcggaggttttcaaaagtctccgttagatctgagagtaaagtatattgggtgcgcgtctttacaaccaagaaatcaacataaccctgagaaatacgtcctatttggctacccctagaaatcttagtagttcactgaatagttggacctgcattctttaacgcgaagggcattgatgtataacaatagggtcctactgcggtaatgaacgcagttatttgatcatgctcgatagacatgcgaatctgatggtcaccagagtgtgcatatagaaaacacagaaggtcgcaccccgcagtggagtagactatctgatctatgcgaggcaaggggtaatggtccttaagacatgcgttgttaaagtcggcgtggacaatacacatccaaagcttgccgtttgcattgtgaacgaccagc

SEQ ID NO: 83868 - DNA, 914 bp, Oryza sativa
aagaactttcctgtggcaggaattcaggaccaccatacgtccctacaactgtcctcgcctcctcggcattcaagaggagcaaccagtggcaaaatcatgaaatagacaagaaaaggaagcaacatcacaactgcaccacattggcactcatgaagctaccaccaacacaacagaagcagccaaataatcatttacagggacgccttttattgacgacgaagaagagtgaacatttacatggacgagtttgatactactattgtacagcattggctagcgctatacagaaacctatatttcaataaatcttcagcatttacagggtcgtcagttcaaggctatctgagacgcagatgtgacgatggaccattcagaatttgtaatactggaacatatggtggccaggaattggctatttcatatgggatgttggcccctaagctgagaggaaggaagacattgctcttctgaaatccagagagttcagagcagatcctggtaaagggttaccttcgggaacccacaaaccacctctgtggggaagcataatctgtttgttggtactcttatcaccaccacttgactccgcagaaggatcttctttctttttctttacaaattcaaagaactccgcaacttgtcgggcatatcttcatggacaagatggaaatatcagacacagaaaatttgaactcaagggcaccacaggatgttcagctgaagctatagaaaagatccaaaagtatgtagcattctctaaagaaaatgggcatcgcaaaaatgcgggaatgaatagcataaatacataaactccatcataaggttcggcagaaaaataatactacaacagatgaaacagagcgtattggataccaaatcaggccgggaaatgcatggataccaaaactagggcc

SEQ ID NO: 83869 - DNA, 737 bp, Oryza sativa
aagcacaatataccagcactgaccgccatcggctcagttgggtgaaacagaattaccttcgtgcagaaacgctggtcagcgccaatgcccgcctggttgattttcagtccacactggagcttgctggtcgttgggaaggtggagaagtggcatcagctgacggcatgcgctttgtcacaccagtgaagaccatcaactcaggatctaacagaaaatattttggttctggacgaggcatcacctggtataacttcgtatctgatcagtactctgggttccatggcattgtggtacccggtacattacgggattcgatttttgtactggaaggacttcttgagcagcagacagggctgaatccagttgaaatcatgacagacactgcgggtagcagcgatattattttcggtctgttctggctactggggtatcagttttccccccggcttgccgatgcaggtgaggcggtgttctggcgggtgaataaatcggcaaactacggagtactggataagttggcccgaggatatgcagatctgtcaaaagcggagagtcagtgggatgagatgatgcgaaccgctggttcgctgaagttgggtacaattcatgcgtcagaactcattcgctctttactgaaaagctcgcgcccatcaggactggcacaggcaattatggaagtagggcgtgtaaacaaaacgctatatctcctcaattatattgatgatgaagattatcgt

SEQ ID NO: 83870 - DNA, 775 bp, Oryza sativa
attttaatttaaaatcggatttattgcgtcagccgaggggaggggcgcgcggaccgggtccacgggagtggggcccacgcggcagcctcacggtccacggtggaccgggtgcacgcggcttgcgccggccggcgccgtgggtcccacgcgtcagccgcacccgagggcgcgggcggctgacggccgggccccacatggcagccacggggcgcgcccgaaggcggcctcgccggcacggccgatgggaggcggcgcacccgcgccccgatggtcgccgccggcgaccaccggcgcggcggagcggcgcccgagagaggggagggaagggggaagtgaaacggcggtccacggctcaccccgggtcgacggcgacgacgggaacggcgaccggagcggaaaaaggcggcggcgcggctcgggtcgacgaggacggcggcgttccggcggtcggcgaccgaaacggaggggtggacgaggtcggcaaggacgcggcgaagccgaaggaggcggcgccgaagcgggagaaggtccggggcgacgacggcggcggaccggagctcggcggcgacggcggagagagagagcgacggcgcgagctcgattccggcggagagagagggcggcgagcggcggaaacggtggagagaggcacggggagcgtttatatagtgttgggagtgagagagggcgaccggaggggaaggaaaccggcgcggcgatctcaggctccatcaatggcgccgacgaggtttgcgggagcatttccaaacgaatc

SEQ ID NO: 83871 - DNA, 538 bp, Oryza sativa
gacaaaaatttaaataaatgtgttccagggctggagaaaaaaaaaatcatatgatcatctaaacagatgcggaaaaagcatttgacacaagtcaacattcttataaaaactttcaacaaattaggtatagcaggaatacttctcaatataataaaggttatatatgacaagaccacagcttacatcatacccaatgatgaaaagctgaaggctctttcctctaagaccaaaaacaagacagggatgctcactctcaccactgctattcatcttagtgctggaggtcccagccggagcaattagacaagaaaaagaaaatgcattcaaattggaaaggaagttatgaaactgtctctgttttcacatgacatatatcttatatacagaaaattgtaaagactttaaaaagactgttaaaactaacaaatgaattccggaaagttcccggatacaaaatcaacatgcaaaaattagttggttttctacacactaacaaggaactatccaaaaaagaaatttagaaaaccatactatttac

SEQ ID NO: 83872 - DNA, 941 bp, Oryza sativa
catttgatttgaacatacttatctaaaaaaaattgattttaatatccaatgagtagtcgaactgcgctaactagtttataaatgcaggtattgtacttgactctggtgatggtgtaagtcacactgttccaatatacgaaggatttacactcccgcatgctattcttcgactcgatcttgctgggcgtgaccttaccgacaaccttatgaagattctcacagagaggggttactccttcaccacaactgctgagcgggaaattgtcagagacataaaggagaagctcgcctatgttgctcttgattatgaacaggagcttgatactgccaggagtagctcctctattgagaagagctatgagctgcctgacggccaggtcatcaccatcggagcagaaaggttcaggtgcccggaggtgctcttccagccatcttttattggtatggaagctcctggcatccatgaagccacatacaactccatcatgaagtgcgatgttgatattagaaaggatttgtacggtaatgtggtccttagtgggggatctacaatgttccctggtattggtgatcgtatgagcaaggaaataactgcacttgcccctggcagtatgaagatcaaggtagttgcaccgccagagaggaaatacagtgtctggattggtggttccatcctggcttctctcagtacctttcagcaggtatccattgtctcaatgcatatacttttgtttcatctgcttaacgagattaccaaactatgtgtcttaatgcatttttagtacattgtctgcaagacactgcatccttgcaaacatttaacaaactttttggtgttgctttctttgacatgctccttgggccatgtgctgtcgactctgtcaaagggtggagatgtacttgatctttccattatcttaaaacacaaaggccaagacagg

SEQ ID NO: 83873 - DNA, 606 bp, Oryza sativa
tagatgtcccatcaaccgccaccactctgctcctctataggcctgttacttaattaaccgcgtcatgtgttttagatgatcttttttttcaatagtctttacttttttatcaccaatttcagaatttattttatttttcttattgtgttcttttgttctttttattttttattttcatcaactgtttcaaaattgtattcctactttaaatctctttttcatttgcctgattttagattttattttattttttattccgaatttaattcatctactattgggttcttgtactcttatttcaatactgattatatttaattttaaattgtattctactcaaatcttcttttcttttctttttttttataattttgctttttttattttttttattcctaacttttacatatcccgtattggatttttttatggactctttgttttttcccatcaatctttttttaggaatttttggaaaagcatcggtttttatggaattaggttttttttaacatttcacgaaaattttttcttccattaaccttttttctgactatttttttctttttttaaggaaaacgggtacatttgttcgtgcttgttttt

SEQ ID NO: 83874 - DNA, 675 bp, Oryza sativa
tttcggtggtaagtgagtcttagcgtgtcatggaggatgaggacgcagcggtggatccggtggtcaccgaggcggaacgcggcgtggaagaggaggaggcggcgccggtggtcggagaggcgaggcggggcgcggcatggagaaagtggggatagcgagcgcggacgccttcccttctctctctgctgcttgatatccccctctttctctcccacttctgtgttcgaaagcagaacacccgcggttgtgttgcgtggaagagggggattaataagggagggaagcgaggctgtgaggggcacagcacagctttcctttgggctttaggcaactgggctatgcaggcttggtgggctggaatgctactaccaaatcggctcttaatccgtgctttgaggtttttgccttgtacacgaggacatgttcctttagacggagccggcggcgacgttaagcccgagtgactaataaaatatttttttcaagatcgattaattaattcttataggcgttgatggcgaacaacggagcggtagacctcgagtggttgcccaacccgcccgtgaggagactctggcactgggtttttataggtcgattcttaacgcatggttttataagtgttcaataagacctttttaaataggtcctaaaatttcaactattaaaaccaat

SEQ ID NO: 83875 - DNA, 644 bp, Oryza sativa
ctttgctgtgttagggattaatatgattcttttcttatatatttaattttagaaaaacattttgcttagcagtttgaaaagtatgcgcacagaaaacagatgagtagaagttagaaatatgtactctccccatccaaaaaaaaaaatcaaatcctaactatgtatatgaacacacattgattatgtatttggacaacatgtatgtttgtccatatacacagccaagatttgttttttttttggaacgaaggaagtatagtatactccctccatacttataaaggaagtcgtttaggacaatatttaagtcaaaccttagtaatataaatcatgaataactctcaagtttttgagtttgaaaatataaaaattatatgaatagatttgtcttgaaaaatactttcataaaagtataagtttatatatataaaataaatatttttataaaaacaagaagtcaagttgtgttttggagactgcgttgctgtcctaaacgactttttttatgagtacggagggagtatatcacactcttaatggctatacatttttttttgaattgcatactatttttatttttattattttttggaaacgcatacccttattggattcttaaaaaaatacccattttggaattgctg

SEQ ID NO: 83876 - DNA, 545 bp, Oryza sativa
tttgaccttttatcttattcaaaaaatttgtgcaaatataaaaaatgaaaagttgtgtttaaagtactttgtataataaattaagtaaaaaactaaataataattctaaaattttttgacgaatggtcaaacagtgcaagcaaaatattaaaatcccttatattagaagacatagggagtatataccaataacacatgggacccacatcatggtgaaggaatcttaccttagaggttgtttggtttgctcctaaaatttgccaaacgttgacacacctcatgttagacaagtttgaccaagttaatttattgtttggttcatagccacacttgtggcaagattccttcttatctattataaccccacgtgccattaactcaataaggtgtggcgcaatcctatttcgctagttaaggtgtgatttacttattgtaagccacaacttaaataagtgtgacataaaaataccgtgaatggtggcaaacttagtataacattcaaacagtcaaatctggctaacttgagttggacaatagtcaagcaa

SEQ ID NO: 83877 - DNA, 1739 bp, Oryza sativa
tatgctttgaagaggcaggaagcacagtcacataacagacgggtaacacttgaggatcttgaagattcatgggatagaggtattcctggtatcaacactcttttccaaaaagaccgtcatactttggcatatgataaaggatggagagtgagaacagactttaagccgtaccaagtgctcaaacaaaatccattctggtggacacatcagagacatgatggaaaactatggaacctaaacaactataggactgatgtcatccaagctcttggtggtgttgagggtattttggaacacaccttgtttaaaggaacgtatttccctacttgggagggtctgttttgggagaaagcgtcaggttttgaggagtccatgaaatacaagaagctgacgaatgcacaacgttctggtctcaatcagatacccaaccgaagatttaccctgtggtggtcaccaaccatcaatcgtgcaaatgtgtatgttggtttccaggttcagctagatcttacgggcattttcatgcatgggaaaattccgaccctgaagatttctttaatccagatcttccgtgcgcatctgtggcagaagatccatgaaagtgttgttatggatctttgccaagttttggatcaagagctggatgcactggagattgagacagtgcagaaagagacaatacatccgaggaagagttacaagatgaacagctcctgtgcagatatcctcctttttgctgcacataggtggcagatgtctaaaccgagcttagtctctgagtcaaaggatgtctttgatcagaaagctagcaacaagtattggattgatgtgcaacttcgatggggagactatgattcacatgacattgagcgttatacaagggccaagttcatggactacactactgacaatatgtcgatatatccatctccaacaggtatgctttcaatatctatgaattgttttatcaactatctatttgtctgatttggttgtagctaattgatattttgttctacaggggtgatgattggaattgatctagcatataatttgcactctggttttggcaattggttccctgggtcaaagccccttcttcagcaagcaatgaacaagataatgaaggtaatataatcatgttaattgtaactactctatctttagcttgcataatgatctgtctgtatgttccagtatttccaatataactaacctgctggactgttttcatctataacagtcaaatcctgctctgtacgtgctgagggagagaataaggaagggtctacagctgtattcttcagaacccaatctgccgtatttgtcttcacagaactatggagagatattcagcaatcagatcatatggtttgtggatgacacaaatgtctatcgagttaccattcacaaaacatttgagggtaacttgaccactaaaccaatcaatggtgctatttttattttcaatccaagaactggtcaactatttctgaaggtatgttcattctcttctagctacagtcataattgtgacattactgtggagtgttgcaactttgaaggcttaaaatgaaaatggattgcaatatgcaggtcatccacacaagtgtatgggctggacaaaagcgtcttggacaactggccaagtggaaaacagctgaagaggttgctgcattagttcggtcgcttcctgtagaagagcagccaaagcaaatcattgtgacaaggaaaggtatgtt

SEQ ID NO: 83878 - DNA, 545 bp, Oryza sativa
caggatgtatgggacactagtgacggacagtgtgttgtgatcctccagacaaaatttgagaagttcttcgaaaaaattgatctgacactgttgaacaggcttctgcggttggtcttggaccataatattgctgattatgtcactgcaaagaacaatgttgtgttgtcttacaaggatatgagtcatactaattcttatggtctcattcggggtctacagtttgcatcatttgttgtgcaatactatggtcttgtgctggatctccttctgctcggtttaacacgtgcaagtgagatcgctgggccacctacaatgcctaatgagttcctcacatatgctgataccaaagttgagacaaggcatcctatccggttgtactctcggtatattgataaggtgcatataatgttccgctttactcatgaggaagcacgtgatttaattcagcgttatttgacagagcatcctgatcctaataatgagaacatggtcggttacaacaacaagaaatgttggcctagagacgcaagaatgaggctcatgaa

SEQ ID NO: 83879 - DNA, 657 bp, Oryza sativa
taccttttttgcagaattataatatcacatcatggttaagtactcaattagtcacttacctagtacatacctcctccgttccatattacaagtcatttttagttttctcctaagtcaaacttctttaacttgcccgagcttatagaaaaatgcatcaacatccacaatatcaaattagtttcattaaatacatcatgaaatatgtcttgatagtatacttatttgttattgtggatattggtgcatttttctataaatttgattaaatttagaaaagttttgacttgggacaaaattaaaacgacttacagtatgtgatggagggagtaccaattttatctcgatactcagatcttgtggtgttgtatgggcattcatttcttagcctgttctgatgttttctgcgcaactgaactacccaaatggctgtgaaactggtcaggctgtctgtttatgctaatatttcgtggtacttatcaagttatcggttattttatatcaattttgatccaaatcagcagtatctataagaatgtacacaccatgaaacctttctggtctcttgtacatttttttaatgtaatctgacctttcctgttttcagagaactttgttccggaagcatttagattttggcagcttggcactgaactggag

SEQ ID NO: 83880 - DNA, 1476 bp, Oryza sativa
ggtacggcccaggcacggccgggcctgggccgaggtcagttgggccggcacggcttgacgaacaagccgtgccgtgccgtaccagcccacgggctacaaccacggcctaggcacggcccaagtagcctcgggccgtgccgggctggcccgacggcccggctagcccattgtgcccgtgccggcctaggcacgccctggcaaaaaaaccccttcaaaggttcaattcaacacaacaaattgacataacacatcaaattcatgaaattcacatgtaattcatcaaataagtcaaagaatcacaaacaattcatcaagtcaccagttcatcaaatcatgcatacatcacgtcacagatttacaagcacagatttacaaacaaatgaacaattcttcaagtcaccaattcatcaagtgtaacgctccgcttttcgtgaggcgttaaaaactaattcggcaaaaatcctaattgcgaaaatttcgttctttgagtgttgagtctaagttgtgccaaggatctcaatttaatcccgttattccctctcatcgaaatcaaaaatcctcaacctcgaaattcctcttccgactcaagtctccaaatcaaactctgaaattctatccctctctttgaatcatcaccaaatacttccccagatccaaaatatccaaaaccccatcttgaatcctccgtctactccttcctctcatcgagatcccaatttcaaaatctaagtcaaattccaagttcaaattctcttcgaatcaatctcctccgaaaaagtctattttgcctccttctaaatttggatgggcctgatccccctcccctcggcccatctcctctctcagccgttcctcctctcccctctctccgcacgtgcgttgcgcgtgcgccgcgctcgagagaagagagcgcccactctcttctcacccacgctctctctctctccgtttctctctctctcccgtaaaagcttcccccaccggcgtcgatttcccgccgccgccgttcgaaatccgaccgcgccctcgcatccacgcgcgcgctcgtgcgtggccgaccgcccggtcgccgccgcgtcggccctgccgcgcctacgcctcccggccccgcctgcccgccgcccaaaacggaagggaagagttcccctttccaccgccctcttcgcctttttccccctcgggctcaaccgctcgctctctcgccctcgtccgcttgcgctcggaggcagagccgctgacggcagccgccagctcgccgcccccaccttgacccagcgccagctcgccccgagccagccggcgctgctcctcccgctcccgcggttcaaattccgccgcacgatccaccgccttcgccgcccaacacatccacgccgtcgccggcctccgtctcgccccctctccctttcctttatcccgaaacagcaagaacagagctcccttttcccccacctttttccttttgcccgacaccgc

SEQ ID NO: 83881 - DNA, 1348 bp, Oryza sativa
aagttgtttaaggatcgtcgttctgttattattgatcgtctcaattctgctagctctattgctttgacatctgatatatggtctggtcatgctaaggaagattatttgagtgttgtagctcactttgttagttcttattggcaattagaaaagagggtcttgggtcttaggcttattgatgagtcacatactggtgctaatattgctgagcgtgtgattgctgttgctgaagaatatggtattactgataaggttttctctattacattagacaatgcttctgctaattctaaagctatggacacccttactcctgctctgtctggttatattggtgatttatttttgcatcaacgctgtgcatgtcatatcatcaatttgattgttaaggctggacttgacaagttcaagcccatgctaaatgacattagagctgccatttcattcttgaatgcatctaatcagcgcattgctacatataaaaatgtttgcattgctgcgggttatcgtcctcgtatgtttggtttggacatggatgttagatggaattcaacttatctaatgcttaagcatctcataccacatagggaaccattcacagtatttattagtacacaacatccttttgttaatgaccatccattactcacagacttacattgggcatgtgctgaatctgttttgtgtttccttgaacaattttatgattcaactgttgttttgtctggtgtttattatccaacatctccattaatcatgcatcacattttagagattgctggacatctaaacacatatggcaatgttcaaaaccttgcaaatgttgttggtcccatgaaaactaagtttatgaactactggtctaaaattccaattctttattcatttgcatttatcttggaccctagggccaagattagggggtttagtaaagtgcttcagattatggctcaactcattagtgatgattactctgcttatttaacaactgttagagcttcattgtctgatacttttgctaagtatgaaagaaagtttggttctgttagattgcatagttccactattccaggcccttccactggtaagaaaaggactgcatgggggaagatttttggttctgttgttgctgctgggcttggtgctggtaatgcaggtgccagtccaggtgctggtaatgctggtgccagtccaggtgctgggcttggtgctggtaatgctgatgccagtccaggtgctgggcttggtgctggttcattatccaggatgacatctgctactgctttgcttcaggcagcttcttcaactgctaatctcaatccttctgaactgtctgcatatcttgaca

SEQ ID NO: 83882 - DNA, 4024 bp, Oryza sativa
ggagccgaatccacgccgtcgagctcgtactccaccgccccctcctcgccaaagtcctaagcagggggaggcgctcgaaagggtcgaaagatccgcggtttcaccgatcgcgggcgatggaggagaacggcgagatggggagcgtcgcctcctcgtctacggcgacggcagcacgccccagggtgcgctccaagctgcgggcgcgctcttacgccacccacctgtcgtccctgacccggaatctccagcccaacgatggctggacgacgtggccaaattggtcatgacggcgcggcagcgcctagatgttggtgggcggtcctccgccaccaagacctctggtgctgctaccactggctccgcgtcgtcaagacgaagggcacgacgagcggcggccgctgttcgccgttcggtagccactccctcatcgactccttcgacccgagaagatctgcgtagggagcaggacgcccgcgccagcctcgagcgccggcgtaatgaccgaagtgctgcccacgcgatggaaggcgcttcctcgtccagagtgtcacctcgacacggacgcgggaatcagccctccgtgcccccggttggtggtgttggctgtagagccttcgtggcgagtcttcggaatgtccgttggcccccaaggttccggcccaccatcgccgaaaaatatgatggcagcgtcaaccccgccgagtttctccaggtctacacgaccgggattgaggccgccgggggtgacgacagggtcatggcgaatttctttcccatggccctgaaggggcaagcacggggttggctaatgaacttgccacccgcgtctgtccactcctgggaggatttgtgccagcagttcaccatgaacttccaaggcacgtatccgcgccccggtgaggaagcggacttgcacgctgtacagcgaagggacgatgagtcgcttcgatcgtacattcagcggttttgtcaagtccgcaataccataccatgcatccctgcacacgcagtaatctacgcgttcagggggggtgtgcggcacaaccgcatgctcgaaaagatcgcctcaaaagagccccagaccaccgcagagctttttcagctcgcggaccgagtggctcgcaaggaggaggcctggacttggaacccctccggttccggagtggcagcctcggccgcccccggatccgccgctcagccaggacggcgtgacaggaggaggaagaagaggtcagtccgttccgacgacgagggtcatgtcctcgccgtcgagggcacttcacgggccacccgaaaggggaggcctgcgagcgacaaaaagaaggaggccagcgtccccagcagggagcgccctaccggcaagtggtgcaccgtccacaatacctccctccatgaccttgcggactgtcgcgcagtcaaaagcttggctgagcgaacaaggaagtgggaggaggagaggaggcaggagcgccgggaaggcaagtccccggcggttccttccggccgtcggcgaagtgaggccaagcagaaggcccccgccgaggacatcgatgatgacgatgatgacctaggtttccaagaacctggggccaccattgccactgtcgatgggggagcgtgtgctcacgtctctcgccggagcctcaaggccatgaagcgagagcttctggccgcggcccctactcatgaggcgacgcgccgggcgcggtggtcggaggttgccctcactttcgaccagaccgaccacccaccgtgcgtcgcccggggagggcagattgcgatggtggtttcccccaccatctgcaacgtgaagttggggcgtgtcctcatagatgggggagcggccctcaacatcatttcccccgcggcttttgatgccatcaaggccccggggatggtgctccagccgtcccaaccgattatcggtgtgacgccggggcacacttggccgctaggtcatatcgacctcccggtcacctttggtggacccaccaatttccgcacggagcgggtaaacttcgatgtggcggacctcagtctgccctacaacgcggtcctggggaggcccgcgttggtgaagttcatggcggctgtccactacgcctacctccagatgaagatgccgggccccggtggccccatctctgtccatggcgacctgaaagtcgcgcttgcttgcatggagcagcgcgcggaccacctcgctgctgcgtctaagcccgagggtggtgacgagaggcttggcacctccgcccccactgccccgaggcagcggattgtcacatgcgccgaggtccccgtcaaggaggtcacactgggcgacggcccgtccaagaccacgcgaatcggtggtcttttggacggcaaataggaagacgcgctcgtctccttcctgcgggcaaacgctgacgtcttcgcatggagaccggcggatatgcccggggtccccagggaggtgattgagcaccgtctcgccgtgcggccgggcgcaaggccggtccggcagaaagtgcggcgccaggccccggaacgtcaagccttcatccgcgaggaggtggcgcgacttctggaggccggattcatccgcgaggtcatccaccgggagtggctggcgaacccggtggtcgttcccaaggcgaacggcaagcttcggatgtgcatcgactacaccgaccttaacaaggcatgtcctaaggatccttatcccttgcctcgcatagatcagattgtcgactccacagcggggtgcgaccttttgtgttttctagatgcatattctggttaccatcagattcgcatggctagggaagatgaggaaaaaactgcgttcattactcccataggaacttattgttatacgacaatgccctttgggttaaagaatgcaggtcctacttttcaacgtactactcgaatttctttgggtagccaattaggacgtaatgttgaggcttatgtcgatgacttggttgtaaaaacgcgcaaccaggaaacgttgctttcagatttagcggaaacttttgagagcctctgctccgcccgtataaaattgaaccccgataagtgtgtgtttggtgtacctgcgggcaagcttctcgggttcttggtctctgcccgaggcatcgaggccaaccccgagaagatacgagctatagagcgaatgcgcccccccagtaaacttagggatgtacaatgtgtcaccggttgcatggccgccctaagtcggttcatatcgaagctgggagagaaggcgttacccttatttaagctcctcaagcgctccgggccgtttacttggacggaggaagctgaacgcgccctcactcagttgaaagcatatctcagctctcctccggttctagtcgccccggagccaaacgagcctctgctactctacctagcggcgacccccaagtagttagtgcagcgttggttgtggagcgcgatgagggcaatcctcactccacgcacccccaccctgtgctgacttggcccgggagcgagcagggaggagaggcccccgagccgaacggtggcctaaggcccctggcgaccggagtcggccctctccccgctcgtcagatggtgctgggcgcccccgaccctcaggaaggccccgaggccactgcgggaaggctgcacctatcgccctctgaccccgaggctaaccctgtaccgattcgacccgggagggagcagggagaagaggcccccgagccgaacggtggcctaaggcccctgacgaccagagttggccctttgcccgcttgtccgacgacgccaggagcccccgacacccaggacggccgcgaggccactgtgggaaggccgcccctgttgtcctccgaccccgaggtcatcagcacagaagacgagtgcgccccgaggggccacttggacgaggagcgccccgggtatatggcccatagcgagggggatcggccccaccgaaaggtgcagcggcctgtctactttgttagtgaggccctccgggacgccaagacccgataccctcaggctagaa

SEQ ID NO: 83883 - DNA, 524 bp, Oryza sativa
tcaaatggacgttaagacagcttttcttaatggagagttggatgaggagatctatatggatcaacctgatgggtttgtagttgaaggtcaagaaggcaaagtgtgcaaattgttgaagtctttgtatggtctgaaacaggctcctaagcaatggcatgagaaatttgacaaaacattgacatctacaggctttgcagtcaatgaggcagataaatgtgtgtactatcgccatggtgggggagagggagttattctgtgcttgtatgttgatgacatactgatatttgggacaaaccttgaggtgataaatgaggttaaatcattcttgtctcaaaattttgatatgaaggatttgggagtagctgatgttatcttaaacattaagctaattagaggtgagaatgggattacactgttgtagttctattatgtggagaagatcttgaatcgctttggctacattgatagtaagccttctccaacaccttatgatcctagcttgttgcttcgcaagaacaagagaa

SEQ ID NO: 83884 - DNA, 542 bp, Oryza sativa
atgagcagaattagctctgaaaaagttttgcaaattgcaaacacaccatggaaatcagcatcaggaagccccggggcttctcctcggccacggcagccggccgtccaccgccggcgagtcgtcggaggcgagcaccggcagcttccccttgccttgccgcggccactgccaaatcttggacaccgagaagctgtcgcccttgctgccggcgccgatcttcttcccgtcggcggcggcggcggcgtcgttgccggccgggttggcgccggcgagccctctcagcctcgccctgccattgccgtcgccgtgcctccggtgtacggacacctgcaagctcgcctcggcgaggacgtactggtaggagcccatggagaagcaccgcctggcgtccaagctgctgctgctcgactcgccttcctctcgcgtgataatgccaccgccgacgccgacgccggcggcggcggcggcggcgtcttcccggtcgtggacggggccgaccgccctggagaggttcttgaacttgccgaggcggacggggaaca

SEQ ID NO: 83885 - DNA, 540 bp, Oryza sativa
gggtagaaattaatgtgtgcgattcatttgccactctctggaaggagcaactggttttagcatgggtaccctgctcatctcaaagatcagggaggagtacccagacaggatgatgctgacattctctgagaagttttcccctcaccagaggtttctgatacactatggtggagcagcacactatctgtccatcagcttgttgagacttgagaacgctattgagtgcatggtcataatgagtatgtctggcacttgcattcagctacactgacgatactgctgaataaatgatctatctatacgtttgtctgtaaaatacatgtatggtctacagtacgtgttgatatggatacggtgttcttcatgaatcatgctgttctacctcgtttcatgtatgtgtttctatatgcatgattctgactctactttgtttctttccttctgcagttggtgatctgaaccatcttatttctgcaaccatgagtggtgtcacctgctgccagctcttcccggccggaacagcttaactctggcctccgg

SEQ ID NO: 83886 - DNA, 591 bp, Oryza sativa
actgcttgttggttcctccccatcaaaatgcttggctcacttatgtcttactcaccttcagtggtatgttttagattcatatgcagtgatatatagttaaatctcttatgtagaacaagtatccaggtggaggtattattagtcatgtaaagataatcaaagagctgcgacttttcctttgtgcttagctgtgtcattcgctgatattcttatacttgagttttacttttttggtttaggattcaaagacggagaacactgatgagttaattgcgactggtgttcttgctagtctgcagaatttcatccgcaaatgcattgtagctgtcctctcgtatggcccaatgcctaagcatattgcatttattatggatggtaaccgtagatatgctaaattcaggagtatccaggaaggctctggtcacagggtgggcttctctgctctcattgccagcctgctctactgctatgaaatgggcgtgaagtatatcacggtgtatgcatttagcatcgataattataagcgagattcgactgaggggaaatccttgatggagttaatggaagaaaagatcaatgaactgctagaaa

SEQ ID NO: 83887 - DNA, 877 bp, Oryza sativa
  unsure (1)..(877): unsure at all n locations
tggcctattatgccgccgttgttgggcgtctgcgtttttccccgccgggcttgctttcgcccccgccgtctggtgtttccgcctgccggcctggcctattatccccccgttgtggggcgtctaggtcttcaccgaccgggtttgctttggcttgcctttccgctgcggctggtgtttccgcctgcacggctggcctattatgccgccgttgttgggcgtctacgtcttcactgaccggcttgccttcgccgccgccgactggtgtttccgcctgcacggctggcctattatgccgccgttgttgggcgtctacgtcttcaccgaccggcttgcctttgccgccgccgactggtgtttccgcctgcacggctggcctttatgccgccgttgttgggcgtctacgtcttcaccgaccggcttgccttcgccgctgccgactggtgtttccgcctgcacggctggcctttatgccgccgttgttgggcgtctacgtcttcaccgaccggcttgccttctccgccgccgactggtgtttccgcctgcacggctggcctttatgccgccgttgttgggcgtctacgtcttcaccgaccggcttgcctttgccgccgccgactggtgtttccgcctgcacggctggcctttatgccgccgttgttgggcgtctacgtcttcaccgaccggcttgccttcgtcgccgccgactggtgtcctcgcctgcacggctggcctttatgccgccggttgttgggcgcctacgtctttcaccgaccggccttgcctttgtcgttcgccgaccacttgtccttcgcctgcacggctggcctttatgccgccgttgntgggcgtttacgtcttcaccgaccggcttgccttc

SEQ ID NO: 83888 - DNA, 598 bp, Oryza sativa
gagcaagcaaacgcgagtagcaaatcaagaaccccgaggaggagcaagcggagcgcacagagaatgagagagagagagatccacacctgcgtggctcaggaggcggcggcggctggtgtggtgagtagcagcggtagaggtaggagatcggggtggcgctgtttctttcttccccctttatagccgccgctccgcactcacgcagccaaacaccccagtccacccccagcgagcgcgacggaagaggaggactcggaggaggggggaaagggaaagaccgcgacgcgccgcgccacgaccacgaggcgcctcgcctcgcatccccgtcgcgaagattctctttgtttgggtcttgacgtctcctttttttatgtcgacttgtgtgcctcctggtggctgctggcggtggtggtgctcgccccgcgggcgcgccaccggcacttccttggctcgcgcccgcgcccgggcgcgcgccagtgaaaagtactagtaaaaaatactagtggcgaaaccggcggttgtgcggaaagccccccgcgggtgtggaacaagatgggtgggtgcgttttcgtgacggcggcgccaagcttggttcgtt

SEQ ID NO: 83889 - DNA, 696 bp, Oryza sativa
gccctccaatgacagaatagtactcttcctctttctgccattagctatgccatgaaagaaagcagtgttggcatcaccttctagaagccatttctcaccacttcttccttgccagtagatttcttcctctaaatagatcttactcaattcatcttctaattgatatctttgagcccactcatctgaattcagttgtctcatatcagcttcagtatcaattttctgtatctgactcaaaagcttctcttttgttctccttagattgcttatgttattcatgctccatcctctcattttcctccttagaacagtcccctgacacttccaatgatccaaaatcttgtcttttcttctttcaggcccgtgtttgattacccattccttaaagccatcctgggtcaaccaagctcggtcaaacctaaaaaccctctgtgtttgtatatgtccttgtctctccaataagaccatgattgggttatgatctgagcccactctagttaaagttttaaccacagcatatgggaacaaagaatcccaattaggagacaccaggaccctatctaagacctcacagatgggattcacctgtttatttgtccacgtaaacttgcatcccactctatgtaactctctcaactctgcatctgcaatgaacctattgaattttccatccatctcctgttaacatgaccatta

SEQ ID NO: 83890 - DNA, 512 bp, Oryza sativa
ctggtttcctctaaagtattaaactttttgaagatgtcctctcctgtccagtaacttgttagctcatttttacttattttgtgtcctccaggaaacaagctacacaacaagaacaaagattttttctcatccccttcaagatggttgtaactggattccaagggcatgtatatcttttgcaacacttcggccttctcaagagggtaggaactctcaagctctgacaatgcacactcccagtacctcttgtcctttccacacaggactgtcccgattacatctagtgcaagaggtaaacggccacatcttttcgctatttttccttccacggtttctgttccagatatgtcaggaactcctgctttgaatttgcaaagttcccatgattctttctcagttaagaagttcaccgaaatctctacttgtgcttccatgtactagcaaacttcgattttttgtgtagtgacaattactttgcattcctcgactggtatgcccatcttccagaggtc

SEQ ID NO: 83891 - DNA, 649 bp, Oryza sativa
gcactgagagatcccctcataatttccccaaaacgtaaccatgtgtgaatagattttgagtaagcagggttgcagccacgagtgagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaatccatggctcctttgccgacgctgagtagattttaggtgacgggtggtgacaatgagtccgtgtcgagcgctgattttttcggcctttagagcgagatttatacaatagaatttggcatgagattggattgtttttagtcagcctcttatagcctaaagtctttgagtgatagatgacatatcatgtaagttgctgataggtttccagttttccgctcct

SEQ ID NO: 83892 - DNA, 1012 bp, Oryza sativa
attcctggttcttctctcacttgtttccaagatacggatcggtttctccacataggtcaaatcctcttggacttctatctgctcaatattagcttcttcggtaggtacccttaaacactttttcaattgcgacacatggaacacattatgtactcctgccaaagattgaggtaactccaactgataagcgacctctcctcttctactgacaatcttataaggtcccacaaaacgcggtgccaattttcccttggtatgaaaacgatgaactcctcgtaaaggcgtgacacgaagatacacataatctccctcttcaaaactcaaatctctgcggcgattgtcggcataactcttatgacgagactgagccacacgcaatctttcttgaatgatctttaccttttcttccgcttcccttaggatatccgtcccgaaaacctgacgttctcccgtttgatcccacaaaagcggagtgcggcacttccgaccatacagtgcttcgtaaggagccatctgaagactagcttgataactgttgttgtacgaaaattctgcataaggtagattcttatcccaacttccaccgaaatctagagcacaagctctcaacatgtcttccaaaatttgattcaccctttcggtttgtccgtctgtctgcggatgataagcagtactaaagttcagcttagaacccatctcttcctgaagtttcttccaaaagtttgaagtaaactgactgcctcgatcagacactattttcttagggacgccatgcaaacacacaatccttgccatatacaattctgctaagcgacttccggaataagttgtctttaccggaataaaatgagccactttggtaagtctgtcgactatcacccaaatagagtcatggcctgatgatgttctgggtaaaccagtaataaaatccataccaatttcttcccatttccattcaggaatcttcaaaggttgcaacaaaccggcgggtttctgatgttctgccttgact

SEQ ID NO: 83893 - DNA, 609 bp, Oryza sativa
gtagagccaaacactaagtatcatgctacttttactgtgtctgtagatattaatgaatgtgatgttaacaatccacctccatgccctggccgttgcaagaacatacctggcagttttacttgttcaagcccctcacaatccagaacggtgatactagctgttagtaagttgtcgttccctaatcttatagattttttggcacacaactgagtttgcaataacaaaaaattgataaattaatatgcaggcctaagtgttggaattgttgccatggcaatgatcgtcacctgctcatacttggtccgtgaacggaagaaactggccaatatcaagaagaagtatttccaacagcacgggggccatgcttctgctgcaggagataggcttaaagcaagggcagagcactgccttcacaatcttcactgaagcagaactcatagaagcgacgaacaagttcgaggacaagaacgtgcttggccgcggtggccatggcactgtctacaggggcatgcttaaggacagccgtctgattgccatcaaacgatgcatgtcgatgattgacgacagggcaaaaaaggagtttgggaaggagatgctcatcctgtccca

SEQ ID NO: 83894 - DNA, 680 bp, Oryza sativa
ttcctgcagccttgctagctgtatgatatgacatatgattcatcatccatacatttgcagaagtttttttctacagcaaaaggtgtacatgaatcaaactcggcacaacgtgaagggaatccaagtagactctttgccatccgggagctagccaacaactcgtggccggcccaaacactttttttttctttgaaaccgtagccaggctaagttggagttatattaaggagaatagaaagtatttaatatcaccaaggaaggtgaaagagagaaaaaaaaagaaacatgaagaaaaatagaaaagaaacacacactaaatgaaataaaaatctaagcggatattctcgcaatattttttgccccacacatgctccatagcttgagatttcgtctttaaattattttttttggagccccgcaaaggagttgcggtatggtcttatcttgattttggaacacccttctatttcgttcacaacatattttccataccaccaacaagtggattgacttgagtgctttagccttagttttcccaccttgagatgttcttctgatccacgaatccaacaatgctttattttcgtcacgtgggtgttctacgtcgctgcagttcagtttacttatttaggaatggaataagtttacttatgtccctcaatttgatgcagtgtctgaaa

SEQ ID NO: 83895 - DNA, 2372 bp, Oryza sativa
aaagaagaaaggatttttcctgggattaaaaattgcactttggtgatttttaattggttaaaattatttccaaggctctgaaaattccactaaaaatcctgttaatatattgtgacatgtagaatccaagaaaaattccacatgccgattccgattattatttgcatttattaattagggaattagctctaggttaattaagataatttcttcggacgatttatttagccaatttttttaaagcaagcaaaagggggaaaacttcagggcgtgacaaacctaccccccttaaacggaatctcgaccccgagattcggaagagctggcgaagaggtgcgggtgggtggccttcaactcatcttctctttcccaagtggcctcttcctctgagtggtggctccactgaaccttgcagaatcttattactttgtttctggtctttctctcgctggtttcgaggatacgagttggcttctccacatacgtcaagtcttcctggatttcgatttgatccggacttgcctgttcctcaggaactctcaaacatttcttcaactgggagacgtggaacacattatggatgccaagcatgttggagggaagctcgagctggtaagcaacttcacctctacgttccaaaatccgatatggtcccacaaagcgtggtgccaactttcctttggtttggaagcgatgtactcccctgagcggagtgacacggagatacacataatcccctgtttcgaaagcgagctcccttcggcggttgtctgcatagcttttctgccgagactgcgcgattctcaatctttccctaacagctctgactttctcttctgcctcatttaaaacttctgtaccaaacaactggcgttcccctgtctgatcccagaagagtggagtacgacaccttcgtccatacagtgcttcaaacggtgccatctgcagactagcttggtaactgttgttgtacgagaactcagcatacggcaagcttttgtcccatgccccaccaaagtcaagcgcacaggctctcaacatatcctctagtatttgattgactcgctcggtctggccatctgtttgtggatggtaagcggtgctgaaattcaaccgggttcccaattcttcttgtaatttctgccagaactttgaagtgaattggcttcctcgatcagacacgatcttcttaggtacaccatgtaaacacataattcttgccagatagagttctgctaatttcttccctgagtaggtagtgtgcaccggaatgaagtgggccactttggtgagtcggtcaacgactacccaaatagaatcatgccccgatgatgtcctgggcaaaccggtgatgaaatccattccgatttcttcccacttccattctggaatctgaagtggctgtagcaaacctgctggcctttggtgttctgcctttactcgttgacagacgtcacagagtgctacgaactcagctatttcccttctcatgctgacccaccaaaacttctctttgaggtcttggtacatcttagtactaccgggataatggaatattgagtttgatgagcctcggttagtatcaggtcttttaattccttgttttcgggtacacacaatctttctccatccagattgttccttgttcatcctcaacaaaacctcgggcttttccgaccctcatgttctttttgagctctgctatttcaggatcacttgcttgagctatgcgaacctgctccaccagtgtgggctgtgcctctagggcagccacgaatccgtgctcaactataccaaggttcagatgttccaaatcgcgttgaacctcacaacatagttgctctacccatgcaacattgcagtagctcttcctgctcaaggcatctgcaaccacattagccttgccgggatgataatgtattcccatatcataatccttgatcagctccaaccatcttcgctgtctgagattcaaatcaggttgagtaaagatgtactttagacttttgtgatctgtatatacctcacaacggttaccgatgagatagtgccgccaaatctttaaagcatgaacaactgcggctaattccagatcatgcgtcgggtagttgccttcatgaggacgcaactgccgtgaagcataagaaaccactttgccatcctgcatcaacacacatcctagcccctggcgagatgcatcacaatagacctggaaatctttcgtctgatcaggcaggattaagactggtgcagacaccaaccgtcgtttgagttctacaaaactcctattgcattcagcagaccagataaacttttcttccttcttcaatagctgtgtcatggcttagcaattttagagaagttctcaatga

SEQ ID NO: 83896 - DNA, 1871 bp, Oryza sativa
aaagagatcatgattgaagcagccaacatatgaattagtaaaagtgagcaggtccagattattacacttaagttccatggctgcctgccccagatctgatatctcacgatatgagatactgctcattcgaaaccatggccctacaagaaattttaggtgtttataagtatgtgaactacctaaggaacacaggcattaaaagtctagaggcaattgtggatcattacgaattaaatgagaagatcaacagatgcatcaatttatacagaaatgtagcaaacccaaggtaattattgtagtatagtaatacacaatataaaatccctagaactcatagattaatcatgtaagacttaatcactttcaagaggtaagaaagctgcgcagagaacatttcaaagttaatgagtggatagtctaggcaatcaagtagcacagctagccccttctgaaaatagtgctcccaaattcatgctgcacatctgctatttatgtaaaaataaatatgtaatcaagaatgaagtaaaatgagcatctcagttattacttgatgccgatatagcaaccttttcgagtgtagatcctaacaaagagcctttgtccatcatctggtaacaactgaaaagagtctgttgaggataagaacagagtcctcgatgagtactttctaattcacaaatataagatatatatagtggggaggaaataagaaacaacctaaaaatgacttttccttgtcactaaaaaggtgtgaatggtttgccatcacatctgttatcatcgaactaaaatttgtctggtatctcgtactgctaggttgcagcaaatttccatttccaacagcacatatgaaattttcccataagaactgtggatgcttcagatcatcatatgtctcattttcatctgtatatttctggcacttaagctggatgggaacatgatcaagttgttgttcaggcacgccaaccacacatccctaacaaaaaaagaataattagaagttgaatggttattaacttggtagtacagagtcacagaaaaagaaacattacatccttcctaaagtaaataaagtgaatagttatttccaccaaaattaatacaactgataaagtgaccaccaaataatttcaagaagaaatagaaatgcgggggttaggtgaaataacatcgtcccaacgctccgactggaatgagtcgcttaaagagaaggacaagctagagagcatgacagtagcatataaagtaatatctgattatgaagctgtcatatctaatgcatgcattaacatcagggaccattagcgaagatggcatggggtgagatactgagatttcaaagataatctaatgcacaggtcaatgttggttcccttaccacctataggatagtaaagtagaacttgaagggaaacatagcaatagctgcagtttcatcagtgtaatgcattctacataaatacaacacttatatccaacagaatatgttaattcaacaaggtaacctaatgacagcggttctgctgcgatatacaaagaagtaagctcacctcgcattcaatgtagtgtctgtccagtagaggagccaaaactttagccagctctcgaggtaagtatccaagcatctgttcacattcatagcctgcataaagcacctatgcatggtgttaagaaaaaaatgtccacagaagaggcatatcacaggaatttatttagacaaaatggaaaaccttgatagcgtcagggtcctttgcattctgaggatctcggagaagagtaatgctcgcaccttcttgcaattctatgttttcatggaacctcctgcccactatgacagtgtcaactactaccgaattgctagaatctgt

SEQ ID NO: 83897 - DNA, 583 bp, Oryza sativa
aatgattgctcaataaaagctgtagttttccaagttgttccatggtatgttaaggtttattatcacagcttacaaattttcattgatgggaacagtaaggctatttcagaagtagttgagaagattcatgtcactccttcagaagacaaacatttacctggtactctagagatgctactaagattaccttgcagtatggaatcagctaccctgtcgctggactttgacaaggtttgttctgctacttaaatttacttgtttcccctttgtgttttatttagtgatatatagaactaaatgttgaccttggtcttatatttacatgaatgcatatttcaggggtttctgcatatcgatgaatatcctcctgatgctaatcaaagatttgacatcccatcagctttggtaacattttctgagttcaattctagccgaagttatcctgaaagtgatacattatttgtgtcacctttgctacaaacgttcaaagtatatcttgtgacttgacttatagtataggaaccaaagccaaaagacttccatgtgaactgaaatgacatgcttcaatacttactgattgcga

SEQ ID NO: 83898 - DNA, 617 bp, Oryza sativa
atcacggagtgtattcattgccgccgctctgttaggtacatcgttccagccacgtagggtggagcatctgaaacgatggggtatccattgtacaatgggttctgtgtaaggaaatacatgtcggagctgtcaatcctgaagttatgtagaactaatgcacaatgtatgatcttggtatggtcgtcactcctaaggaaataaggtatttccctcaggattctcactggcttttgataactccaaatgtcctttccactatgttacgctacgaactgtgcatttagttaaaagtatcttcctttccatggggcaaggctgctcccttattacccgcaaattcatccaagtggtaccaaacatgtgggtaaagtggtaggaatctataccggctagcatatcccgagtccacaaggaaatatttccctgcaccaacaaattagcgaagtgattatttctggaaaatggacactaacatttgcaatgtttgaacctaaaattcaaaacataccccatggtagcctttgggaaacaaaacggatagccccgtactggttttggtaagttgatcatgcacagaccctatccacccaacatcttgaaaaatgacacggtcgtcc

SEQ ID NO: 83899 - DNA, 668 bp, Oryza sativa
  unsure (1)..(668): unsure at all n locations
tgccgggaagcagaaatggttcgttttaatgaaactgttctatgctgtccgcctgtccgtgcttgctcacggtagagtccccaaacaaatatgtaccgagaaacaacaaaaagtagtgcagcagcagagtagaagagaatgcgggtgggggaccttccagacgagcgggcggacggcggcgccgccgtccggcacgccgaggcaggcgagcctccgcagctcccccatgttcaccaccttcttcgacagctgcaaaccccaacaacacacgatcagaaaatggaaattccaaacaccccccaattcgtacttcaccgcgaaattccaatcccctcatccaaaccaaaacccccccttccctcgtcaccacccacccacccaccgtgagcttgaagtcggcgagcaggtgcgcccggagcgcgggcccacccccgaccttcccatccttcttctcctcctcctcccaccccgcttgcttctcgcccttcttgacgaccccaccgnctgctcgtacgacgggggcgggacggtcggcggcggcttgggcggaggaggcgggggcggggagaggtcagcgccgtaagggtcggggggcacgggcggcgacggcgacaaagactaaggcggcggggccgaccaagagcggcttgtgagccacttcggcaccg

SEQ ID NO: 83900 - DNA, 1395 bp, Oryza sativa
tgtcctaccgggcagctatatcaactattctcagtaacctctttttggtcttgatggtttataccaactttgcagaaggatatcatcagctttgggtgtttgcacgactcagtatgatatatgcaacatcaaatcaattatgacaaaatgaaagcctacgagaaggaaatagaagcaagcaagcatagtctttacttcatcagccttttataacttctattagttaggcattagacttacatgataaaaggtcacactagaaaaagaaaaaaatattaaacacgacatatgaaacaaaaactgcacggagaatacctgaatatttaagtaatggagacctgcaactagggtaggaaaaacaaggcccgaagaaccatgtggaaactcggtcaagttatgaaaccacagaataccaccctgtataattgtcaaaaaaaatgaaaacaaaaggttaaacctgaagaaggtcaaaataaaataaataaattaaaatggagtagacagtataagaatgtgaatatatctattgtattaagaaccagaaaccttgaacatttgcaattgtgcatctgattcatagaaatgggaaagaaaattaaacttctcttatggcaacaaaaaaaaaacaaatttaccaagtttaatggccatttacttaccatgctctgttcacaaggtttcctttatttaaacatgaaaacaactcatttgctgcttttataaaaatggtgaaatgtacttctgactcacaatgtcaccagtacctatttgtatcacaacttaaatagatattatgtgctctagctcttttgaaagaatagtctaagtcaccttggacaatatagtacaaataacgttctttgcaattccacatcgcattttaatttttcagggctaaatgacccaatgcatgtgtgacagcatttgttaactgtattccatttgatccggcaaacatgccaaaggcatagccaaaaaaatattacaaagtttttattctattaaaattctaaaaagacgcatcataattttaattaatagaaatgtttttttagcatatgaaattataaaggaccttcggcaatggaatttaaagcatcaaaacaatactaaaaatgagcgtagctcatgaatggttataaaacaggggggaacactacatataataaagtatagctgctagtacaaatgtgtaatataataaaaaaaataccttgtacatacattatctagtccagggtgattgctcaaacacatagtccttattgttgacatccacagtataaagcacgggaactgcgtatacaacaaacaataatgaacaattcggaaaacaaattatgatgccaatgtaagattcgtagctattattagacaatatcaaggatagaagac

SEQ ID NO: 83901 - DNA, 522 bp, Oryza sativa
cgggcgggctaatgcgcccaaacatgatttcttcttggtttaaaaaggcgagctcctccccaagttcaggaggcctttaaacccttttaattagtcatcatcatcatgcattccatgaggaatgatctctataatttacatttgggaaggaaataaaatgaatcacatacaattgactttgcttttcatattcgtttcgaacttcatgaacatgcaccatgacttccaaatcttgctctagccatttttgcaatgatttctcagtcatctgcattacaaaaaaaagtattctcaaggatatttccaaataagcaactgatctttttctttaagtatggaaaataacttacatgagagccaggagaagtaccattcatgcctgatgtgtttggaagaaagcaaaaaaaaaaaaaaagaaaaagaaggaagagctgttagattgggagtattaattataatgcgaaaaatggtcgcaatgcggagagagatacctgagttgtcacgtcctgatgatttccgagc

SEQ ID NO: 83902 - DNA, 508 bp, Oryza sativa
ttccaaatcttgctctagccatttttgcaatgatttcgcagtcatctgcattacaaaaaaaagtattctcaaggatatttccaaataagcaactgatctttttctttaagtatggaaaataacttacatgagagccaggagaagtaccattcatgcctgatgtgtttggaagaaagcaaaaaaaaaaaaaaagaaaaagaaggaagagctgttagattgggagtattaattataatgcgaaaaatggtcgcaatgcggagagagatacctgagttgtcacgtcctgatgatttccgagcctctagtaactctttcagccttttggtagccatcgcagcttcttcagtcttcctctgcaaaacctgcataaagatgcaaaactttgatatttaatattttataaatagacatgataatatgagggaaaaacttacacgtaattatatagctaagtaagatatgaactttgacgaaaactatgtcagggcagctagttacacataaagtg

SEQ ID NO: 83903 - DNA, 637 bp, Oryza sativa
tatttgagaaatcaattgctttaaaggtagttagcattctattgaatgtcatatcaaaccctttgtatgtgatagtgatgatgtctcgatagataaatccttgtgaaaagtttgtttggtgctccaaaacttgtccatcatcgacatttgccatcattgatttcagtttctcaaaccattttgggggcaactgaccagatagagtgttattggctaaatcaagtatttgcaagcttgagaagtgatcccttgttagatcactattatggagacccttaattgtgccatataattggtttgatctcagtacaagaactcgaagcttgggaagattccccagccacaaagggaacagatcgaggatgtgattgttactaacatcgaggagttccagacttttgcagtttgatagtgttctgggcagcctcccttcaatttggttgctgttcaaatctatagtctcaagcttacatccttctttaatgcccttaggcaacatcccgttgaatttattccccctcaaattcagtacccttaagcttctgccttctaccagacaagatggaacgaaaccactaaagttgttatcagataagtacaggaattggagtttcttcatactacaaatggaaatggg

SEQ ID NO: 83904 - DNA, 657 bp, Oryza sativa
atatttatgcttgtattgctgcattttgtttctcagggcaaatactttgtcaccaaatgcaagacaagctaggatagcatcacttgaaagcatggtgacaatatcttcaaatactctcgttgctatggcttctcaactctcagaagctgaagaaagagagcgtgcattctctgggcgtggtcggtggaatcagttgcgttcaatggcagaggcaaagagtttactgcagtatatatttaacgttgctgcagatgcaaggttggtatttattcttttggcttcattatttaatagtatggtagcatccatccttgtaggacttctcaatttgcagaacctggaaacaaattatttttactaaagagctaaaaatctcactttttctttctaaatagttgaaaatctgtaagtgttattttgctaagaatatggcactgattcgaataaaaaagtgtggtactgatttgaaaataggaataacaaaaaaaaaattctgaactcaagggcaacttttattctttctgaaagcatgacaaccatgtgaatggaagaacaatgcaaagcggtttttttgtaactttgaaaaaatgatcattttgacaaaagtatggaactaacctcaacttgtgaattatcaatgccaagtaagggagaaag

SEQ ID NO: 83905 - DNA, 997 bp, Oryza sativa
ttgtattcgattcaccctggaagcactaagatgtatcaagatctaaagcaacaattttggtgggccagtatgcgacgtgagatagcagaatatgtggctctatgtgatgtatgtcagcgggtcaaagccgaacatcagaagccagctggtctgttacaaccgttgaagattccagagtggaagtgggaagaaataggaatggattttataaccggtctacccagaacgtcggcaggacatgattctatttgggtagtggttgatcggttgacaaaagtcgctcacttcataccggtcaagacaacttatacggggcataagcttgcagagttatatatggctagagtggtatgtttgcatggggttcctaagaagatagtgtcggatagaggtagtcagtttacttcgaagttttggcagaaattacaatcagaattgggtacccgtttgaatttcagtaccgcttaccaccctcaaacagatggtcagacggaaagagtaaaccaaatattagaagatatgttgagagcttgtgttctagattttggtggaagttgggataagaatttgccgtatgcggaattctcatataacaatagttatcaagctagtttgcaaatgtctccgaatgaagcattatatggtcgaaagtgccgtacgccgcttctttgggatcaaaccggagagcgtcaagtttttgggacagacatattgcgagaggcggaagaaaaagtgaagattatccaagaaaggttgcgcgttgctcagtcgcgtcagaagagctatgctgacaatcgtcgcagggatttggttttcgaagaaggagattatgtgtatcttcgggttacgccgttacgaggagttcatcgtttccaaaccaaagggaaattggcaccgcgttttgtgggaccttttaagatcgtgagtcgaaaaggtgaagtagcttatcagttagagttgtctccgtcaatggccggaatacatgatgtgtttcatg

SEQ ID NO: 83906 - DNA, 2258 bp, Oryza sativa
cagactgagaagtggcgagaagtccatgggggtcgctggggagtccatgccttgtttataagggggtgattatgatccaggaacggtgcactgttttgagttgtgttgtgcaaagggtattgtcacgatttccccctttgcaatgccgtggtggtatttcggggcatggcaacatgtgtggaatcgtgtcttgtgggtacagtggtacacctgtggccagagtaaaactattcgaatagccgtgcccgcggttatgggcgagttgagcaatgtttttcgtgattagtctcacacctttcacaatgattattgatgattaactggtaataatttgcttagctcctggtttggagttagatctgttcagccgggtatggttgttcaggatggttgggcctgtacagcatgggtgtgctgttcagtgttgtttaaaatttcggattaattaatctactgttttactattcttaactctttgctaaatgctgctttcgcaaatgagcctatattatgccatcctttggaatccttgtgcacttgcatatttgctgtgtggcttgttgagtatgtcatatgctcattcttgcaataatcatcaaacctcagttgaagataaaggatccagaaggagaagacgtttggcttataccccagttgagctgcctgtgggagtggagccggagcttcgctagattttattttccgctgcagttttcttcatggtgaggactaagtgcctcttaagtaagtatttatcgttttagttaatttgatgaatctgtatattaaattgtcagtttgtgtaccttggctgattcctggacgagaattttatgcacaaataagttcggaaattactagtgaatttccgggcgtgacaaaggtgacaatgttgggaaagctggcagcaaagaggtgattggaaaacagccaagacaggctaacccgaagaagaaaacatccagtcgtccaataccaaaaatcagaaaatcgaccaggtatgaatcagcttgtcatttctcctgtgttgccttgacatgcatcatcaatataacacatctcgaatcctcaggaaaccatcagacatcgatccagctggaaaagaccctgagtcgaccgacaaggagactggttctgcggctgccagggaatccgagccgactgaagaaaaccgctcaactggcagtcagtcggcgaccgttaatgtagaagctgggaacaagcccctgactggaaatcagtcggcagaagctgaaactgacgctcaccaaaagcccccgattggagaccagctggaggttgaaccaaataaagacatcccggaaacagaggaacaaacgagcatccctccctttacaacaccaatgctggtccaaaggtcagtacttttgacaaaatacaagggacagctcgccctcctccgaaggttataacaggtaactgagcctctgaatccatttatattgaaaaagttctcttcaatcgctttatcactcttttcgtaaatgcataggcccaataattggcgacgaagaagaaattcttcggatacgatcagctgaagactcttgcccacccatcttagtcaaatggtgagatgacgaaatgcagccgcaagaaattgtaataaataagcagaaagaagacgaagaagtgtctctactcacaaagacacttaatcaagccactcgtcttgtaaatgtacgtcttctgcttatagcttgactcatcctgttggtcagtcctgtgaactgaataaacttgtaatgctgagaattcatcttaggaatgaagcaaagactgcaacccttgaaaaactggtcccacatcttggaaccctggaagcagggaccagagcccaactccacgaaaccagggagcttgccaggaagactgaacatgatctcagggactggattgccgagcttcaagattccaatttcgagctgagtggttcatctaaaggtaacccctattcctgaataacttattccaaactgtcatccgtgttccaccaaccgctgggatgtattgcagtataagctgccaagatcaccgagctagaaaaagataagggtgaatgtcacacccgaaaataccccaacgggcgttccttagtgcgtgtattattccttgtcccaggaggcaaggtacaccaaaagttgatacatttcagagtttatcaagcggaagcgtaaataattaatttattacatgggcggcaaaggcccagcacacacaaagacaaacgggaaaca

SEQ ID NO: 83907 - DNA, 2390 bp, Oryza sativa
aggtaaaagagatggagacaacgatttttatacaggttcgggccccttatctgacaggtaatagccctactcctgttggccgaagccgttgttgttcttattcatctgaatctcacaagtacaataattatgataatctatctagctgtcatcgacttggcggctagataaccaactcgtagtcgacgacaacatagtcttccttcttgaatatgaactcgtcgggatcagagatgacgctagatccctcttgccagcctccgtagacaccggatagggtatgtctaggcttatctctaacatcgatctctggcggcgtattggcttgtgtgtatgttgtgtcttgtggcttcgtagactgtggtggatgtctctcctctcctctagagggacttgtatttataccatagatgcccccttgtccaagtaaactagggagaccagtatggatataatctgattagttcttatcgtttccatatagaactttactcgtccttcattatccggaactccttcaatatacgaggattgtttccgtataagacttggtatgtggtgggccccgccgagtttagtcgattactattaggtatgtggtatccataaccctgacatatatatcttgttagttgtaggatcaaactaactaacatgccctgaaccctgattgacagaacatgtactacagctaaccaaatctctcaggcctctatgtgtacgataaattttgtgtcaataaatttgtatatgaatacagactgtttgagaaactgaaaattctgttgaaaaatacaactgctagctagaaacttcccccagcataaacttttattctgttccagttaatgcgcaacgtaatgccgatgctgacagccggacaccgaagcgctcatgtcgatcaccaacgcatatcgcagcacaccgaagcccgccgcctcgccgccggtgcccagccgccgcccagtcatcggcatgcatgaacaagctagctttggtcgtaaaccagctgtgccaaattgatcaatcaagcacgaacgctcaatgatcgatcgattgctcgatcttggacggactgtccctaatttttttttcacgaacgtataaaagaattgcaagttaatatatcaggaactgcccctaatttaatcatgctaatgaaattatttgatcccggtcaattaatctgtagttaattttcagatcgatcatccgtcattttacttctccttccgtgcagtcaaatcctacgggggtatttggtacttgtaactgtcaagctaaccaagtagagatggaattgaatttggtgatcattaaagttgatggagcaactaattgcatgtatgcttgtcggttaaactttccattcctcttgcgacgggagctttcgacgcgtgcatatgactggaaggatggcggcgccggcgccgccgctccccggcggctctcctgctataggctaggttgtaacgagttaattattgaggaactgtactttttccggattatctttttgattatataagaataaattagatactataataaataaagttaataaataatctaacagaagtggctaagcaatacaataggacttaacaagaaagtttattgggaaaatatattttctgaagcatatgaagcaataatctacctatctatctatctatctatctatctatctatctatctatctatctatctattatatattaaaagtccatgaaacatcctaaaaaagcttctacgtcgacacatgacacttctagaaacgttcccaagctatcaagtgatactctaataaattggataagcatgtaactattgattttcacttaattcggtggacccatcaattttgaccattagattaaattctcatctctccaccctaatatatgatggttaaatgctttggtcccaccaaaataattaactacgagtaaacatatgtagagaatcagttgttttctctcccgaaaaaaataccgcagaattaattcttggaaagaaaaccgacgttgtggatttatcatttaatgcaggagcctgggtgtgtgcttccatcatccaaaaataaataaaacaacgaacactttttaagtgaatatcacctttgcgtcaaaaaagtgaatatcactaactgttctaaactatttacagatttaggttccgattcatgaatattgccctcggtagttagtttctgaatttttcctgtatctgtttgattacaaaagtgaatatcactgactgttctaaactatttatacagatttagggtcagattcatgaatattgccctcagggcctgatgaatttctcactaaaataaattatcttctctcctccctaatatatgatggttgcatgctttggtccca

SEQ ID NO: 83908 - DNA, 2068 bp, Oryza sativa
cgaaggcgagctttggacctgcactggagttaagcagatctcccaggccatgtgttttctgtcaacacgcttttggcacgccctgtgggacctgattagaagtcagacgtcagttcttcctcatggcttagaaacaaccaccaccaccatcaagcccaggttccgttaaaggcaaggcgtcgaagccgggattaactgacatcattgatgacaacgtcatgccaatcgatccagagaaattcacgcctgagcagaagcaggagtttgaagcgacgctgcagcaagcacgagatcagttcctgaactcgttcatgcaaacccgcaaggggacacttgttcagaagtataaaataaaattggttgctgataatcttgggaccggttcttctaaatatggagaggtgaaaaaagctccagaaggctcggctcagccgagcaacaaaggtgctactgatggttctctaggaaatcaaggcgacaaccctcaaggggtccatggagtacaaggtgatagagtgcatggagctcaaggtggtggtgctcaagggccgcaaggaggaaatcttaatcagagtaacgagctagcacaagattttttcaataacttccaagatcgggttgattacgctgtgcatcatgctctgatcaatcagtccggggtattagtcaatacattgtcaaacatgatgaagacaatagccgatggttcgatagtcgagcatcaggctacaggcccagtttacttgcaaggaggtgtcttcccgaattatcgatctttgatcacgaatgttcagccatctgttcaagcggttcgctccgttgcacccacaattcagccgacggcgccagcatcaactcccctgcatggtacatcagctatggcgccaggccagccaatgaaccttcggttgttaatgagggagcatccatagcctattgggcagattgcgaatcagccgacccaagatcaagttgctgccatgtttttgccacctccacctattgttgatccagtgcagcagcagccgattcagcagacaccaccaatccagccagttgtacagccaatccaacaacaggtcgtacaaccagctcagcaaacaccaccaaggcagcagcctctgcaaccaattcagcaaacgccaccaaggcagcagcttcagccgatccaacagactctggtgagacagcagatcattcagccaattcagcacccggggtcggcaaatgcatcgccggagtttgcaccacctggtgggcaacttgcgcagcaatttgtaaaccaagtcgtcctagaacatttggttcaccatgcacagccggcgggcatagtgatgcctcagatggttcctgagcacttggtgcgcaacatccagccgaatctccataattatcaagggggtaacttgaactatcaatatcagcctccttccccacaagcccaatatcagccagggggattggctcagcccagttcgcatctcagtttggtcaattcgagcccatgcagcaacagccgcaacgagcagctcagcaacgaccatgggccgatgtgattgctgatgtaatgaggaacaatttggactcaaaccaaaagaaactggaagtttgtatcggcaaccttaccctgagtggtttgaaagagttcctcttcccaatcagtttaaggttccaaatttctccaaatttttagggcaagagggcgtgtcaacttatgagcacatcagccgattccttgctcagtgtggtgaagcatcggctatagacactctgaaagttaggttgtttcggttatctctatctggatcagcttttacttggttttcctctttcccatatgggtcaatcaacagctgggccgatttggaaaagcaattccacagctacttctacagtggggttcatgagatgaagttgtctgacttgacagcgattaagcagtggcatgatgaacccgtgcacaagtatattcagaggttcagagagatgaggaacaagtgctttagcttgagtttgaccgatgctcagttagccgatttggcccttcaagggtatgattcctcaatca

SEQ ID NO: 83909 - DNA, 598 bp, Oryza sativa
atccataactaactcccccctctggcggcatgttactcttttaagactgaaaattaatatgagacttcttcaaaatgggcttaatgaacgcacccgacgagaccttgaagaatttggtaattggatcctagatctcggtgatggcatgctacctacaaccaaaaaaaacgatgaatctgaaccaacatggatagatattcctaatgatttactaataaagacacccggcgacaaagtaaaggcaattatagatgaggtctttccagatttcccctccagctacacagatcattcctatctagcatgtcgtgctattgtttgcccaaataactcaacagtcgatgaaataaatgattgtgttgttaagatgatacctaccgaagctaaagaatatcttagctgtgatacaatttcaaaagcatgtgaccatatgcctgactttgatatactctacccaactgagttcttagattctattaatgttaacaattttccatcacatcgtcttactcttaaaaagggtgtcacagttatgttgttgcgaaatttaaatcaatctatgggtctttataatggcacaagactattggttgtttct

SEQ ID NO: 83910 - DNA, 594 bp, Oryza sativa
aaagttatcatctacgttaagagttcttcaatttgtgttttctcgggttcggcggtctaaccagcaagtcgtcggcggttagaccggcgacaccacggcggttagaccggcgaagaagcggtggtcagaccggcgacggcatcaggcgacttcaggcgacaggagttgatctcagcggttcgaccggtgttattacctcggtcagaccaactgcttccaggcggtcagaccggtgcaactactttggtcagaccgcgatccgtcgaatttgagggtaacttctaattctgcaaaaagtttgggtttttgagtataccaaccattcaactctctctggttggcttagttcttgtgtttcgatcctacaatcacctcctcgattgaatcacatatatgcatgcaaacaatataattagaaaacttaatggtacaggaattaaaataaatatttaatatatgcatacatacaggccttatattataagacatgagaaaaaaaatggttgtgccttatattttggcatgtagggagtaatgatttttaaaagatgacacatgtatcagtgagagaggtttactgtagagatttattta

SEQ ID NO: 83911 - DNA, 921 bp, Oryza sativa
agattgaaggatctgatcgagggttgcatagatggaattcacaagaccatgatctataatggtttggagagatatttcttcatggttgtatgtgggtaggttccggaatctttggagatttatctcagctttgagaaccaggaatctataggatgggtcagagattgcctgatcatctagccttaagagagggagcatatatatgattactcgtatggctgggtttctttctcttccttctaagagatcaaagaaataatcttggagtccaaggaatattttcatttgtctctctttaaacttttgccaaacaagatcgaggatgtcttgcccaaagcaagataaagtttgctccgtcttgaagcttaatctaggttggagattttcgtatgtggtactcatgggattttggcttttaagtttcttttggcaagaatctttgtaggcacaagatctacatggtgcttttggctgggtccggagtatatattgtggaaggaatgaattgggatgattatgcagtatgtatggtgtttggggaatggtatcatgcctttttgtggatgatgatggtttattatgtggaaaagattgcaataggttattgatatttatgtggaaagcaaccatgctcgaagcaggatctgttgagatcaaaatcttatctgagaataccttggtattcttatctgttgccatagattgttcaacttccatgggaagtttatcttggccatcacgggatttctcctcgcgataatctagtaatctctcctcatgatgagggatatcttgtagtttagcccttttttctgttatcttttgatctgagggcacgaaatttttgaaataatatgccaggccatttaaggcatgagctttttcttttttgttttttgcctgccacaagtggtttaataa

SEQ ID NO: 83912 - DNA, 1579 bp, Oryza sativa
ataggtagtacaattctccgctcgctgggctcacatagtacatcctacctatcttttcgcatggtgttctaggatgccagctacatgagctgttatcccatgtccattcctttgggaaatcgcagtatgtcagtgttcttgcagcactatgttttttattggcctcaaaccattctgtcagcatcattttttgggctgcaggacttgtaagcagcgaattcaggtcagcaccttttttgtatcgaacaaagttctggtatggaagatgcacagttaggcgctcaaccgaaggcaccctatagtggatatcaaactcaaaagcatgccaaagggactcacaagtagaaaggaaccttgcatcaatgtactcttgtatctcattccgtggtgtgctgttactgtttggtgttttctttgatgtgtcattttgtggtgcactattattttcagataactgactcggtaacttactattaacctcatagtacgctttagatctgtcggttccttttgtgacatacttaaagaggtacttaatcatgttagatttattgcaccattcgacatttatatgtgcttggtattttttaagaagttccatgttgtaaggcacaacccattgattatcgatcttcactccatttttaagaacatatcggtcgttatctctacgtttgtaaatagtaaaaccaaactcgtccattattgtctcgtcctgaaaagacttagggaagtgcttagaacactccccttttttcatgcatgggcatgatttgttctggttgccacaagggccatgcatcatgaactcatcaaccaaagcataccccaatggatcagtgaaaatgtcagggatttcagcagaaatgaacccatcaacaataggagcactgaagtcaatagtggatgcaggcagccaaataaggcaatgtatatgagggggcccacgcttttgaaattctactgtgtagagcactatatgataagcacaaaatatcagaaccaaccaagggagcgcagaacaaactaaatagagcaaaaccaaaaagcctaccagcaaggactgggccaaatgtctttccttccttaatgtccgagataaactcgtctactttcatgttgaaaactctaacaatcatatcagaacggtcgcttggtacctggcctggttcaaacaacaatgcatcgtatatttcttgccacttagaattgcaagtaaaagtcacaaataggtcaggtgctccaaatacacggcatatggccattgcatcttggtaattctgtaccatataacgtctgccaccagtaaaactggtgggcagtacatacttctttcctacagaatccccagatgcaagaccatgatcaatggcatcacttatcccttgtacagattctgagcggagttcatgttggttgtcagcaatgtattttagtctagacccttctacagttgagtatgagtcaacacatattgcatcatttagatgaccacatcaagtatagggatttagtttattcaaccggtaatggagtcggtagcggtagtaatcaagcattgtaacatagcgtcgtgaat

SEQ ID NO: 83913 - DNA, 1652 bp, Oryza sativa
cgaattcgagctcggtacccccttgagggccatggggaaataattcgccatgacccggtcatcgccccttgccgctacgatgatcgtggtgtagatctggaggaactcggagggattgatgctgccatcatacttctccgtaaggttggggcgaaacttcgggggccaccggacgttccgcagactcgccacgaaggccctacaacccgtccctccaggggtgagcgtggggggagggccgcctcgtgaggaggaacgtggcactccagatgaggaggcgccttcccccatgcgggcagctcagcgctcgtcccggcgtcgctcgatatggattcgagcatcctgctccctgtagagaccgtcgtgatgcctccggcttcccgaggcccccgacgatgttggagccgtggaccgcctcgagaccatggccgaccaacaggccctcctccttgctgacgaggagagggtaatgggggtatgcaacgtaccggtgacggcgggtcggccgcccgcggccaactgccgctgggcagtggtgaccaagttggccacgtcgtccaaccagcgctggacaggggtctctggctccgagttcacggggggatgccgcagaagggcacccgccgcctaaagcgcgcctcggggcgagccgccgtcaccgtaaggaggcggcgccgtgccccgatgcgtcgtggcctcccttcacctgggggcggggagagggccaaaccacccgaacgggtggggtcctccctccgcgagggttcacggcgggggggagttggagagttgcggcggcggtgacgagggccgcagctctcgctagcatcctcactcccagacggagtgggggtgaataccacctcctcctcctccaggacctcgaccatgatcgtcgagggcccagggaaacttgggacggaaggaaacgacttctctttaaagcgcgtgccctccccctacctggcgcgccagctgtcgagggatgatcctctctagcgggaggtcgtgagacccccctttcgtgagttcggccgggggaagaagctcgcttctagaaaccacgtatccgtccctaaggcccctagctagctcgcacacaatcaaattatacaaattcgggccgctgagaagcgtaataccctactcctgtgtttgggatttagattgagagttacaaaggttcctaaactcgggagaacactcttctcctagagcccaagttagttgagaatcgtccctttgctcggtgggcaaggtcctccttttatatctcaaggggataccacatgcaccgcctctacctactcttctttcgggtggggtcccaccctatcttgaccggaactcgacccgtgccttcgcctggaacctgaaccacagcttgtccttgaatggggcccagtgccgtccctcgcctgacacgggagacagccctgtcattccctcattaatgggtgaagacttgtggtggccgccgtccgaatgaccctccgatgggacgggtcatacctacctccactccgccggaagcaaatgcgacgtgggagcacggtcggtgtcaggccggtcacagaccggtcattcttgactatggcacgtcagtttagcacgccgcacgtctgtctcactgcattaaatgcgacaggggg

SEQ ID NO: 83914 - DNA, 554 bp, Oryza sativa
aaagagtaaacatacttagggaaatcttctagcacatcattgcattcttccagtgtggaccactttgtgaaagaaattgactgcatattgctcactggcctatactggctggtgcactgccttacacgatagaatgtcagatcatacaccttcccttcagtgatctgaggctggaaaagctcatctaatggtgggaaaatctgggctgcaatactggctccctgtttacacagtagtacaaagggaaaatatgtgtatgaactgtaagcaaagattccaaagaactaaccgtgcgatcaagcagaaccagcccaagatggtgcaaattactttcatcattttggtcacgaaaagcccagaaccttgacacacgaacacgaattgttgggttcccaagactaggttcaagcctattaattagcgtagcctccatttgtacagaaagtttgaaacggatagttcataacggaaattcctaggatatcataggtacggcaaatagtaaaggcatagataagagggatggggtaccgagctcgaattcgccctatagt

SEQ ID NO: 83915 - DNA, 551 bp, Oryza sativa
ccgagctcggtacccggtttcttgggttttgtttagatgaaagtttagccattgctacttccttgcagcgcgcgtgatcagcaaccgccgagaagatgcaaagccgatatgcttgaacctgttaaggctgagattcaacgcttatatgatgctggttttattcgtcttgccgatatgcttagtggatttctagtatagttcctgttaccaagaaaaacggcaaggttagggtatgcattgattttagagatttgaataaagctaccccaaaggacgaatatccaatgccagtagtcgatcaactggttgatgctgcatcagggcataagattttgagttttatggatggaaatgctggatacaatcaaatttttatgactgaagaagacattcataagacagcttttaggtgtcccggtgcaatcggattgtttgagtgggttgtaatgactttcggcttgaaaagtgctggagcaatgtatcaaagagctatgaattatatataccatgattaatcggctggttggttgaggtctacattgatgatgtgg

SEQ ID NO: 83916 - DNA, 661 bp, Oryza sativa
cttcttggccacctctgcatacttttggctcctttgaatttcttctggggagttcttcaaggtcagaaagtcgtcccactgattgggggttatgttggcatacgtcgaaaatggtgtgcgtccagtcttcacaaatttcttgttcaaggtggttttccaaccacgccaagacttggccattgtttgcagtgcacaatttcttactgctgcctttgatccatccgggaactggaagattttcttcaactctttccataggacttccttatccccattcgatacataatcccagtacttgaccgtgatggggatcttttcccttactattatgccacactgtgaactgaatttcgcacgtgccgtcttaggggcgagcggctctcctttaggcgaaacatgggtaacaacatggaacccttcatcctttctattcacgcttctctcgcccttccttttcttcgtgattgctaaccgttcgattttctttgtgccggttgagttagctggtacgtcgtcgtctttggacggaacttttttcttcggctgccgttttgatcgccgtggcgccggttcctacgagaaggtatacatggaagtttcgaattagctcgggctaatagttatcacggtgaacattttacatattaagtttacttacccc

SEQ ID NO: 83917 - DNA, 2169 bp, Oryza sativa
aggggtggactgatgacagcgatgctcttgctttgggtattcatggggttgctcgctggctactcttcttcaagtctttacaagttgttcaagggcgcagaatggaagaacattgcattgaggacagccttcactttccctggcagtgtatttgctattttcttcttcctgaattctcttatttgggggcagaagtcctcaggcgcagttccattcaccacaatgtttgcccttgtcctcctttggttcggtatctcagtgcccctagtatttgttgggagtttccttggcttcaagaagcctgcaattgaggatcccgtgaaaacaaacaagatacccaggcagattcctgagcaggcctggtacatgaacccgatcttctcaattctaattggaggaatccttccatttggtgctgtattcattgagctctttatcctgacctccatctggctgcaccagttctactacatctttgggttctgatcctggtcataacttgtgctgagatctcgatcgtgctctgctacttccagctgtgcagcgaggactatctgtggtggtggaggtcatacttgacatcagggtcttctgctatctacctgttcttgtatgcaaccttctacttcttcacaaagctggagatcacaaagtttgtgtcagctgttctgtacttcggttacatgcttaccgcctcatatgccttctttgccttgactggtacgatcggattctacgcatgcttcctgttcactaggctgatgtactcttctgtcaagatcgagtaaagaggctgtcttgcctaattctttattgccacggcaagtactgatcctgcggagtgcggacagtgaatatggtctccaagcttagttgcctgtggcatcagttttgagttttcaaagctggtagttaagatgaactggtgatttgttatcccatgattcaggtatcatagctagctcagtggttttttgttttcattttcttttaccttttcttctttttatggatttagcccttggatcacggcctattaagtggttgttgcagagttaattgtatacgaatgctgagtaatccatttctctccctatcagaatgttatgtacttgttgacctataatgcgactaccattaaagatattactgcagttgaaatattcatcttcctatttcctttttggtcattcagattttgatatatgaaagcatgaggttgggtattattcagactactgtgtattctgtcgcctgaaatgtttcacggggaaaagaagccagacagtctctcgtaagacctgttcttttttatgttttatagctgatgcagctataaaatattggtaaaatttgttacaaaacatcaaaagattactccaaactcaacctaggagtttttgtctagtacaatgaatcccctcctaatacaacgaatctagaccattcccttctaatacaacgtatctagatctctcctaggttgagtttttttaatggagggagtacaatctttgcatagacaataaaataatatatagtacatctaagtgagaatccgtgtcaaatgtcagttttgctcttttcttctttcaccatcttcatttcttgtgggcattccagtcacctaggcgaccataggtgcacgctgctctacttcgctggtgtcgagttcttctccaaggcccacctcgttacgcctgtcattgactgctgccccgagaacgcagctgcgcagttgggattggatatttggatggaaaaagtacaccgaaggtctctcaatttgtcattgagttacaaaatcgttcctcaacggcaaaaccaaatattggacatcccttaactaatcagatccttcggtggttttgatccggttttatcctacatgatggctgagtcagcttgggatccacgtggatcccacatgtcaggctcccacgtcatctctctcccttcctcctctctctctctcactcttctcctgttgcaagccggccggcagcgaaaacggtggcgccgccacgccaccggagagggtggtgctgcggggggcacgcgacagaggtgggcggcgccagtgctgaagaggaggaggaggtcgtggcgctgtcgtcgtcgtcgtcctctgcgctggggaacaaggtgggcgcggcggcggagggtgct

SEQ ID NO: 83918 - DNA, 536 bp, Oryza sativa
ttagccaaaaaaggttcatattatctgtatggcactatcttcatttacttaaagaagtatgttgcctaggattgcagggaaaaacattttaagttatctgatagcacaatttatttcatgttgaatgggatttctaaccaaatgccacttgcagatacaaaggatcgccaggcagcaaaggccattaaatgcatgctacttatgtactataagaatagcagaggtagcaactaccgtaagcaggtgacattactttctaaatgtcataaattcattttgagattttatcatcatgtttatagcatcttgcctttaaatgttggatctacctaacttctaatgataatcaatgcagtgattactatgctggttagagattgtagagatctaaccaaactagtgaagtgatcgcagccatcaaaattcaaaaaaaccaacacttagtatatgtgggtgcttttgtgacagcaccctttctgccacactgaaataattttatttccacatatccaatactgagtatatattgactagaa

SEQ ID NO: 83919 - DNA, 530 bp, Oryza sativa
caaccatcgacttcaccatgtttgacaaagtgttgactaacattccagattgattaatcaaagcatgttgtagggcatagtcaatccgatattggaagttgttaaactgtagctgtgtcgtgttgccatcttggttaagattctcaccatgaaatccctgagaaccatcaccttgagccccttgagaaccaccacctttgtcacctgagccatctgcagcgcctttatcgcctgattgagttgtaccatctgagacctgttgtacttctccatccttggaagaatttgtcctaggaacatcagcaactaatttcatcttgtacctctgaacaattgttcctttacgggtctccatgaatgaattcaagaattggtgttgtgtttgctgcatcatcagattgagctcattcttctactcaggtgttagcttgtctatagtgacgggggcaatgtttccttcgtgaacctcaaatgcaccagactttagattcttggtaggggtctctttgccagccgaagatggcgatgct

SEQ ID NO: 83920 - DNA, 748 bp, Oryza sativa
atcgataattacatgcatttctcggctacatgcatttcctcgcttaattactgcaacgctgcaataagtgagcgtatatatgtattttttaagttcaatttagtgatgaaataagtgagcgtacgtgtatataactaacctagcctccaccggcaaaaaaaaaaaaaaaaaccgggtcacatcatatacagacacacatttgaagtaataacaaaacaaattacataatcagcatagaaaccgtgagacgaatttattaagcctaattaatccatcatcaacaaatgtttactgtagcaccacattgtcaaatcatggcacaattaggtctaaaagattcgtctcgcaatttacacgcaaactatgtaattgttttttttcaatatttaatatttcgtacatgtgttcaaacgttcgatgtgatggagaaaaaatttgccggcggaactatttattgctccttccgtcctaaaatataagtatttctagtacagtgacaagttaaacatttttagctttaactattagtagcaaaagaaaaaaaatcaatcatatgtataaaattgatgttactagatttatcattaaacaaattatcataatatgcaattctttatatttaaaacattttatttttattgatattgttggtcaaagtagaatctcggagactgtgtcagaatttaaaaatgcttatattttaagacggagggagtagtacatatctacatccgatcgatatttgttg

SEQ ID NO: 83921 - DNA, 1711 bp, Oryza sativa
cttccacctcacatcatatcgattgtactccaggcctcggacgcgtctcccccgcctccgcgatggcagcggcttgtgacgctcagcgagaagtaagtgaatgaatttgaggtttcgtgatttcgtcgaactctgtctcaatcgcagcctttcgcagggcggcgcgggcgaaggcagcgcaagatgggtctgggggacctccaacgcgtctcctgccgtggcctcaacggatgtcgttgtcgtgcccaggagccatgaggcgacggatgtctgggggatcttgtggctgattgtggttcgccggctgccgtcctcacctgggaggagctccaggttgagatggggcgcctcctcgaggctggtgctcgcggtgttagccacgaaatcgcggaggcgagggcggcggctgcgtcgtcggcgaacaagcacgccgatcggctagcgcgcgacctggcggaggttcgcgaggacctccagaagatgagggaactggtggccggcaacgagcgacaacggcaggggctcgagcatcgcatgtcggagcttgagaacaacttgtcggaaatccatggctcattgcgggtcacctatactggtctgcaccagctcgccggggagtgcggtatcaagtccaccatcccggcgaatcccgatgagttctcgctgacgtcttctcttgcggagctggtgacggtgatggaggagatcccctccaagcatgcggccaggatcggagaggagacgtctaatgggatctacaccggggtgtgccacgtccttgcatgtgtgaggctggcgcaccctgaactcgatctgtggaagatcttggatcagggggcggttagcgacgcgcgcaaggatgtgatggaggaggtcggcgatctgggggagtccgtcctctcgctttttgaagagtagggtcttagctctcttgtactctttagtcatgctttgtaaaacttttattggtctcaaccgccctagtgtgtgcggtcattgccttagctttatttagcattttgatcttgagtactttgttgtcctttgttaccatttcctttgcccttccgtctggatcgacttgatttgttgtgttctcgggagagaagagcagcttgacttagtcgtttccatgctgagcagatctcgagagtgcgcttgctgaccaggatcgtcgcatccagtattggaggacgaagtttgaggtcgcggaactcgagaggactatgctggaggtgagaaaggaccaggccgtagagacactccggggtcgtgaggtgtggttcaactcgtatctgaagagttgctgcacatccatgtcgagagtctgtagagagctccgaataccccgtggggatcccgaggaatcggctgccggatacatctcatggctgaatggggcctatgcccagctcgaaggcatcggtcaacatatcgacgaggccttgaagcaggagtgtcgtcgctcaagccgatatgccggggggcacgtgttggcctgcatagagatcatcgttcgcagctgcatctcgagttcctccgcgaagggttttctcgttcccagagaactcctacggagatagatggcctggcaaagtcgatggcgccgctggcggagaaggttttccagtcgatggactagcgttgtccttcctggtagtctccgtatcctgtgacaaatgtctttggaaaaagtgtaatatagttttga

SEQ ID NO: 83922 - DNA, 1057 bp, Oryza sativa
aacccgctgctgctcggcaactacgcgaggttcctcaaggaggtggagggcgacgcggcgagggcgcaggagtactgcgagcgcgccatcgtcgccaaccccggcgacggcgacgccctcgcgctctacgcgggcctcgtctgggagaccacccgcgacgccgaccgcgccgacgcctacttcacccgcgccgtccacgccgcccccgacgactggtgagcccacgcgccgccgccaccttctcaggcaattccttcttgatgatgtctcgcttctcctgcagctacgtcctcggctcctacgccggcttcctctgggacgccgaggaagacgatgacgaccacggcggcgagcagccgccgccgccgttcatgggggcagctcagcctccttccatcacagcggcgtcttgagtgaacagatgctcttgatctctcgccgcctgtaaagaagacgaagcaacgaacacccgaggaggaatcacggcggcctctctccggcgaggcaccggccgtcgtcgacgtcgccggctcgccggcccggcgaccctcgccgtggctcgcagctgaatccggccacctgtaaaaatgaatctggagaagagcaccacgcagctaaggtgtagtcgatcttgtaaaatgagcctgcaaagcctacatgatgatcttgtttacttcttgtacatgtgtatcactgtatcagcaacgcttgtgaaataaataagccacagccaagtatgttctagctagatcagcaactgcaaggctctcatctcccttccagaacagaaatcatttaagccaaagttccacaccaacttaacaagatagaatgcacaaagtttattgcttatttgctaaagagaaaaaggcagggtaattcatatggaaataataagttcttctagcctaggaaataggatatggtcatatgcaattgttaccaactacaaataacaacagtaggttcctcctctcttgtatcaagaacaaaaattgacaagataaacattacaggggctacttgcgttcttcgaaactcctggtgatgaggacta

SEQ ID NO: 83923 - DNA, 642 bp, Oryza sativa
gttgatctggatgatgtacaggctgtttttgacaatattgaggtttgtgtatgccattggtatattgccaattgtctgtcacctatttgcttctatagttatatttatacaacttttctggcttcaggacaagtacgtttctgagcaagtgactcataatgatggtggccctcttgtgatgaatgccttcgagatgattacattatctcaaggtttggatctttcagcattatttgatagacagcaggtaatttcatagttccactcttccttttagttggtaacactcttggtatggttgaccattttgctgttggagaaccattagcgcaatgaaatttgaaacgctgatgggtttatagtgtacggagatctggcatgtcagcttatttcatttacttacaaggctgtgaggcactgggtttagtgacggttggtcgctcaggggtttctatcttgtttataataaatgacttaaacgaacatccatttcaattggcgttagtattatgtggaactatattctagccactgtatatggattaaccgactgtagatcgatcccattgtctattctcttttcttatcgcttagtgtactggttggtggcagacggcttctgttttttgccaaatttgaatg

SEQ ID NO: 83924 - DNA, 2219 bp, Oryza sativa
gaagaatgtgagcagagttttcaagagttgaagaatcgtttagtatcggctcctatcttgattttgcctgatccaaagaagggtttccaagtgtattgtgatgcatccaaacttgggttaggttgtgttctgatgcaagatgggaaggtggttgcctatgcatctcgtcagttacgtccgcatgagaagaactaccctactcatgatcttgagttagctgcagtagttcatgcgttgaaaatttggcatcattaccttttcggtactcgaacggaggtatataccgatcacaagagtttaaagtatatctttacccagccggatctgaacatgagacaaaggagatggttggaattaattaaggactacgacatgggaattcattatcacccgggaaaggctaatgttgtagcagacgctcttagtaggaaaggctattgcaatgctacggaaggacaacggttgccattggaattatgcaaggaatttgaaagattaaatttgggaattgtcagtagaggtttcgttgcagccttagaagcgaagcccactctaattgatcaagttagagaagcccaaattaatgatcctgatattcaagagatcaagaagaatatgagaagaggaaaagctatcggtttcttggaggatgagcaaggaactgtatggttgggtgagagaatttgtgtccccgacaacaaagatttaaaggatgcaattctgaaagaagctcatgatactttatattccattcaccctggtgtaccaaaatgtaccaggatctcaaggaaagattttggtgggcaagtatgaagcgtgaaatcgcagaatacgtagcagtatgtgatgtttgtcagcgaatcaaggcagaacatcagaaacctgccggtttgctgcaacctttgaagattcctgaatggaaatgggaagaaatcggtatggattttatcactggtttacccagaacgtcatcaggccatgactctatttgggtgatagtcgacagacttaccaaagtagctcatttcatcccggtaaagacaacctattctggaagtcggttggcggaattgtacatggcaaggattgtgtgtttgcatggcgtccctaagaaaatagtgtctgatcgaggcagtcagtttacttcaaatttttggaagaaacttcaggaagagatgggttctaagttgaactttagtactgcttatcatccgcagacagacggacagaccgaaagggtgaatcagattctggaagacatgttgagagcttgtgctttagatttcggtggaagttgggataagaatctaccctatgtagaattttcgtacaacaacagttatcaagctagtattcagatggctccttacgaagcactgtatggtcgaaagtgccgcactccgcttttgtgggatcaaacgggagaacgtcaggttttcgggacggatatcttaagggaagcagaagaaaaggtgaaaatcattcaagaaagattgcgtgtggctcagtctctacataagagttatgctgacaatcgccgcagagatttgagttttgaagaaggagattatgtgtatcttcgtgtcacgcctcttcgaggggttcatcgttttcacaccaaaggaaaattggcaccgcgttttgtgggaccttataagatagtcagcagaagaggagaggttgcttatcagttggagttacctcaatctttggcaggagtccataatgtgtttcatgtgtcgcaattgaaaaagtgtttaagggtacctaccgaagaagctaatcttgaacagatagaagtccaagaggatctgacctatgttgagaaaccaatccgtattttggaaactgatgagagaagaaccaggaatcgagttatccgtttttgcaaagtccaatggagtaatcactcggaagaagaatcaacttgggaacgagaagatgaattgaagtcagctcatccgtatctgttcgccagttcttccgaatctcgaggacgagattctgtttaagggggtaggtttgtcacaccctgaaaattcaaaatttataaattgttgtttaaaaggaatttttagaatttatttttaaaagtcttgaaaataagatctaattttaataataaattccaatataaaatggggccagataaaatttcattaaatactttgcttaattctataattcctagatttttctgggatttatttgagctaagg

SEQ ID NO: 83925 - DNA, 1442 bp, Oryza sativa
cagggttgtcaatggcaaggcccttcagaatgcaccttgcaaaggccggatccccaaggataatatcaggagacccctacaaacaccataagaagcaacccccattgcaaacacaaacacacacacacacacacacacacacacacacacacacactacccacgataccgcaagccgcacaagacctgaactggaacaaacatacgcacccgaagagatcgcgaacacctggacactgaagaactggagcagccaagtttctacgaacggtgttgatgtccgcgactaacaagaattaccggaaaagaagaacacgctttgacaatatttgagctccgaacacgacgcaatggaaaaaaaacagcatgatgtaatgactgtaatcaacaaggaccaaggttgggatagaggggcaggggtgccacgctaatggcagccgaaggctcaaggaacaggcactatcccaagaggatacctgcaaaaaacgagcactcggctaaaaatgccccccggaaaacaaccggctctaagacgaaggaagtccaccatgactcaaagacaggacccaagaaaccaactctgctgctgcgaagcttgactgaagtaggagtactaccgctacggtcgtatatttgcatctggagatggatgacccagcacctccagcaactagttgttgttcctctaagcaaggatgtcgcaccaccagagctgcttctccagcgatgcaatgttgtggttgccacatgaagttgaactggagattgaggccctccaacgatgcagacatgctgcctaagaaaggaacactcttctgggtaaccttcaaacaaccagaaagtgagaggacacgaagtttgagctgcctcgctgacgccaacactgcaacaccgtagtcgctgaccatgcagtttgagagatcaagttcggcgagatcggtacagccctcagaaatggcaaacaggcttgcatcagtgatcctgctgcaaccttcgagactgaggcgtgcaagcgaactaccatgtgccttcaccaaggcagaaacagtagcatctgtgagattctcgcagccgttcaagtcgacatggaccagcccactttcggaactcttgatcaatggaaggagcccgttgtctgtaactgcaccgagaccactcaagtcgacattctccaactgagggcagatcatgccgaccacggccaagctggcatcggtgaaacctgggcaatccttgatggtgagggatcggagagacttgcacaggggaagctgcgcgggagcagagcagatgtccttgatcccgttgcacttgaccagtgagagggccttaaacttcgggctgcagttgaggaggaaggccagaatgcccatgagagtaaccttgttgcattcctcaatctgcaaactctccaagacctttgccgattccgcgaaatccttg

SEQ ID NO: 83926 - DNA, 604 bp, Oryza sativa
aaccatttatacatgctgcatagactgcaattccagtattacaaatgctccagtttaaaatgattttgtttggattggacataactcataagtttattctactattattactaaaccgcaagacttttttcattacttttctgtttatgaatatcaatattccaaccaaaagcagttagcttcatcatatagaatttccgatgatgctgccaaactgaactgaatgctgttatggatgaactaatccactacacaattactatcttgaaggtcagctgttctgaaagcttttcaaaggatgtatggcgtgcagcttgatgatgatttgcataccctgccactaatgcctaatgatggagacacttggtctgtgatgcaaagctgggttttgcctacgagatcattcctggaatttgtaatgttctcaaggtgcacattatctcttttggaattcaatagtcaacatagcagtattaagtggaagatgtcactagctaactgttggtgtatacatttcaaagcacaagtacccaacactgctactaatatttgctcaaaatagctaaatgcctgttatctttctactagagaaaaatgaatcgta

SEQ ID NO: 83927 - DNA, 554 bp, Oryza sativa
aagaagatgaagtggaagacgacaatattccggactttgctcagtacgctggatttgaaggaaatcaaacgggcgaggaggaaagggatgctgatggtaacaatgttgcggatgatcttggtcagatgttgcaggacgccaaggaggattgcgaaagtgaaaagggggcccataaattggacaagatgttagaggaccacataacatcgttgtacccaggttgcgagcaggggcacaaaaagttggataccactctggagttcttgcaatggaaagcaaaaaatggtgttagtgacaaggcatttggtaatttattgaaactcgtcaagaacattcttccggagggaaacaagttgcccaagacaacgtacgaggctaagaagatagtctgtcctctagcactggaagttcagaagattcacgcatgtccaaatgattgtatcctatatcgtggtgaggagtacgagaacctagaagcatgccctgtttgcaaagcactacgatacaagattagacgagatgatccaggagaagttgacgggcagctaacgaag

SEQ ID NO: 83928 - DNA, 826 bp, Oryza sativa
ttctttaaggttcaattcccaggagggaggaaaaatatctgtggagaagtacacatttgatccacaaatagctaggagagagcttgctgccatgattgtactacatgagtatcctttatctattgttgatcatattggatttcaaaggtttgtgactgcacttcagccattatttaagatggtgactcgaaacactattaggtaataatgatatctattagtttcagttgtctattaaaaatatctgcaattaagaagaaaaaattaacatttatgcatttttaggaaggacattatggactattacatggaagaaaataagaaagccctagcctacatggctggaactaagtcaagagtggctattactacagacttgtggacatctgataaccaaaaaagagggtacatggctgtcacagcccatttcattgatgattcttggacacttagaagcattatcatgaggtacttgatgaacaattaatttcatttcctactgctacatatttaattcagcatgacattagatttcatttttgcatcaatctgaatttaatctaggtttaactttgattgtataggttcatatatgtgcctgctccacacacaactgaagttatatgtgaacaactttatgaagcattggtggaatggaatcttgatgagaagatctcaaccttgactcttgataattgtaccacgaatgacaaggtaatcactgaacttgggaagaagattggcaagtctaagttgatgttggagggaaaattgttgcatattgttaacgcccaaatttggttatttaggtatcggagatgaagat

SEQ ID NO: 83929 - DNA, 1325 bp, Oryza sativa
cgtgtgaggccacctaccttttctagcactaccaacccagtggaagcaggtgattggttgcatgccatagagaagaagttggatttgcttcaatgcactgatcaggagaaggtctcatttgcatcgcatcagttgcatggccctgcctctgaatggtgggatcatttccgccttaacagaactactgctgaacctatcacttggcttgaatttaccgctgctttccggaagacgcatataccatcgggagtggtgtctctcaagaagaaggaattcaggtcgctcacccagggatcacgctctgttacggagtatctgcacgagttcaatcgtcttgctcgttatgctccggaagatgtgcgcaatgacgaagagcgtcaggagaagttcttagaaggacttaatgatgagctttcttattcactcatgattggagattatcctgatttccagaagctagtggataaggctattcgccaggagaacaagtacaattgcatggagcagaagaaagccggattgctcaattcaagacacaacaggggaataatcagaagccgcgtcttactttaggaccccagtccataccacatggaagttcttcgtccgttgttcgtccgcagcgtcagttcttcaacaacaatgctggcaacaacatacgtaatcaagttccgcgtcctgttgcagctccaacacagcaacaacctatcaagagggagcaaggcatctaagcccgcggtgtgtttcaactgtggagatccaggacattatgctgacaagtgtccgaagccccgacgcgtgaaggttgtccctctcagaacaactctactgtaccagtatcaaaggcccgtgcaatcatgttgctgctgcagaagctcaagatgctccagatgtgattttgggtacgttccttgttaacttagttcctgcaacagtgctttttgattctggtgctacacattcatttttatctatgagttttgctggaaatcatgggatggaagtagaagatcttagacgtcctttgatggttagtaccccaagtaatcaagcactctctttgcaacgtagcccctctgtcagaatagaaattcaaggagtaccatttctggccaatcttatcttgttagaatccaaagacctagatgtcatcctagggatggactggttagccagacataaaggtgtgatagactgtgctaacaaaaaagtaactctcaccagcaatgatggtcgagttgtaactgttcatgcattgtcttctgaatctttaaggtcgagactgaaccaaataactttggaagaaattcctatagtccgggagt

SEQ ID NO: 83930 - DNA, 575 bp, Oryza sativa
aaatacaagtaaataagaagcagataagccctatggatataatggcagggtttccatgtatgaagttggtgctgtaaaccttcataagccataaaaagctcaaggcgtatcaactaacgcaccgcgaaagcacgagaggttcctgtaaaatgcctgaccgaaccaaacattggtttggaggcaccaaaatgcctcaatctgtaaacaccagcagcagcgtcttcaggaactgtccactctagagttgcaaaacttcttgaactcaatcttgcgggccttgaccacttgaaacgcaatgaccaatcatcatcatcgtagacaggaacccaattattgttaccatctagcttctcgacgagtgcaaaggtaccatccgtaagaaggtcattccttgggcatgctgaataaaatgtagcattcacagtactacccttgttgaatgttgagttaccaggaacatccgagttgacatccccaaacttgacaccaagaggagttgagtcaaaaacaacaccaggaagtagtccaatttgcttgtccaacatatcaagaggttggaaatttgttgagacctc

SEQ ID NO: 83931 - DNA, 666 bp, Oryza sativa
agggggagctggcccagaacctaccttaggagcactcctcccgatgctagtggctgtcgcccttccactcctgctgtagtcgccaagctgtcgcatccggttctacgccaccttcatccgcatgtcctccttcctcatctccggcaagtcaacaataatctcgtgcgcgtagctagccagcatcgtcggtctgattcgagagttacattttgttttgattcaatgttctgatttgagtgtttcattttgttttgttttcatgtttcatccattgatttcttggtgttgcaattagtatggatgttgtatctgactgaaatactttcgatcaagcgatgaaatattttttcctacttgatgaaacatctgaaatttttttgttgaaacatttttttatcgagtagtgcaacatgtgaaacaatatagtgcaataccatgtgatgttctatgaaatatcctacatccaattttgtagtgcttcccttatttatactccctccatctatttttgatagtcaaaatctgaaaaatttatttttgatagacatatttcaatccaacaacctatcatcttaatgactttctcggattttatgcgtgactctccattcttccacacaatattggctatatgggcatcgagaaatgtaaatattaatgaatcgc

SEQ ID NO: 83932 - DNA, 1103 bp, Oryza sativa
tacctaaataatcctgccgaagagagaagcaagtacgagtataatgttgataaagaaatgaccctcatcaagtttgtagacgatgaactgggtccagttggaagtttcaattggtttgcaactcatggaacatcaatgagccgtacaaattctttgataagtggtgataacaagggagccgctgcacgcttcatggaagactgggctgaacaaatgggcttgcccaaacagtcagctcatgcaaattctgatgatttgagatctttgcacaagacatctgtacttcctcggagagtttctactataattcctgaaccaaatgagataagtatgaacctgaaccatatgccccttgatctgtacacatatatcggtgaaacatgttgggtcatgcctgaacttttattttcttcaattgctgttcagctgatgacttgatacaattggcatcatcctatgaggcctcaggtggcaggcggttggcaggttcaagtatcactaggcgcattagaagtactcaacaaaacaaacctaaatttgtttctgcattttgtcagtccaattgtggagatgttagtccaaatgtccttggaacattttgcatagacaccaatcttccctgtgacttcaatcacagcacatgtaatgggaaaaatgaactttgctatggacgaggcccagggtatccaccatgcctgaaaagtttaataaccttcctgtacatctgctagaaactgttataaatgaggttcttctttgctgctttgcagataccctgatgagtttgaaagtacccgtgttattgggaataggcaatttctaaaggctagagatctctttgattcagcttctgaagaaatacaaggcaaaattgactataggcacacttatttagatttctcaaaacttgaagttaaagtttctacaagtgcaggcggtcagcagaccgtgaaaacatgcccagcagcaatgggctttgcttttgctgctggaaccacagatggccctggagcttttgatttcagacaaggagatgtcaaggtttagcatgtcaatacatagtagcttcaaaatttgggtaacatgctactcactggtttata

SEQ ID NO: 83933 - DNA, 662 bp, Oryza sativa
tagtagcattcggtgttacagcaacagatagtcctctgtacaaatgagcaagggctgcagatccccaggcatattcacgtatctttctaaaatcagccagaagaggtaaatatcttggtgatacaaatcccctcatcgtgtcaggaaataaggtggagccaacaaggtaaagaaggtatgcccgggtgctgtaagcaatctcgttgatagttggattttctggcaattgatgaaatttcctgtacaaccatgtcaatctgattaagccacacagttgctctccatttccagggctctctcctaagaaatgcaaacacatccgcctcacagcttcatcaccaattggctcagcagtcaccacatgaccagtcactggaattccaagaatatatgaaacatcacggagtgatggggccatttcaaatcccatgaaatgtgcagtatttgtttcattgttccatctctcacaaaaggctgtaagcaaagaacgatcaatagtaaatcctgtggtgagggcaagatgtccaagaccactagcattaactagttgttgctgttcgtcagttagaacccattcttttagcttccgtgtctgctggctgggaagcagaacaccatatcgctgtggaaaattgagtgtctgcatgtaattttggtcacga

SEQ ID NO: 83934 - DNA, 1251 bp, Oryza sativa
taacaaacagctactctcagtacattacaacttttgaagaataccagatccaaagatatgaggtgtgtataaacttggccatctggtctatacattgacaacagtattgaatcaggcaaaatagactcatctcatagaccaattcatttatagctatctatgtgcatgtggtgtgtttattaatttagcttctttgctacgttaagtttgtacttaatctgccatgcttacatatgtccctgctcaactagaagccttagaacaactagctgggtggcccgcgcaattgcgcggctggcacccatacaaaattatctatttttaatatgattttacttataatttattcaatagatatttcattgtctttaagactttgaaagaccaaaccatatcatccccgtatttctaatgttgtaacttttataaaagtcacatcagttgttaccccttactttttttgtcaccctttctttatttgcttgttcgatctaccatggcttatattcattctccttttaacctttaaaaattggatcttatagtttttttgagtttattgtctcattgggtttcatttttttattttaagaagtcccgttaaaagctgccaatatacttctctacggcccatctgctgcttcctctctttattgtcattgggattttaaaaatcgaacataattatcgtttgagttcaatttttactttctagagtcccaccaaaccgtttgtactcctctacggctcgcccgcttcctcccactctttattatatttgagattttaaaatcgaatgtgattatcattgaggtttattttttaattttttggaaatcccgccaaccgtcgtgaccattctgcttaacggcatgtccgtcgtcactccttttaattgtcattgggattctatatggggttttgttaatagttcttagatgtctcatcaactgtcaccactctactcctttacaaccctgtaacttcttcgatatttattatcatttatcatcgttgtgttctagatgatttttttttgaaatttccatatttttcgttccgatagattttatttataaattatattcctagttgttttactctattttcagaatttattttattaattatttggaattttaattaatctcgttatgtattctagatggtgtattctttaaatagtctttattttttattacgaatttcagttacttttaaattgcattccaagttgactcttcttttatt

SEQ ID NO: 83935 - DNA, 676 bp, Oryza sativa
ccctccacagttttctttcgatacactagtcaagcctagactttcaattctcctggcgatcactttgtgggttctaatcacgatcatctatatcattcttaaaggaactttttgtggatatatgttcatacttctctgcttcaactgttcttatattttttgggcccttgtacaatgaccttttcattttccttttgctggcaccaagggtgactaacagtctaacacacacgggagatcaccttgtggattcatcacgagggttcaaatcctacgatttgaagaccttcaactgggctgctgaatcaggcgaggttaagctgcatgcgtttgatgggcttcatgaacgggttcacttttggttttcggctcatatctcgaacagtttttgtttcggctcttttgaacagaaaagattttatactgcttaaagatgtccaattcagagaaaaaaaattcaaaattccttacctaggcacaacgacgcaattatgagggagctcattgtgtggggctgcaggcctcccaaaagaaggtatgctataccaaaaacgagaaaaactctatccctttccttttgatatccccatctgccacaccgcacacaccacacaggagggtgtggggccattaaaaaggagatcctatcaatatcaactagtaattgttccgatat

SEQ ID NO: 83936 - DNA, 878 bp, Oryza sativa
aagacctacaccatgcgtccactgcctctcaaggcctcccaagacattctgagattgatgcatcatacatatcgcaatcaaggctatcagttattcgtgagcttctttgaaatatatggtgggaaattatttgatcttctcaatgaaaggaggtaagtagcccccaatcaattatgcttatagacagtatatattcaggaagcctgttacatcttcttgttcgaaacatttttgacttcatgcagtaaactttgcatgagggaggatgggaaacagaaagtttgcattgttggtttacaagagtatcgggtgtctgatgttgaaaccataaaggagttgattgagaaaggcaatgccaccagaagtaccggtactactggtgcaaatgaagagtcatcaagatcccatgccattcttcagcttgctattaaaaagcgtgttgatggcaatgactcaaaaccacccagattggctggcaagttgtcgtttattgaccttgctggcagtgagcgtggtgctgatacaacggacaacgacaaacaaacaaggttatctcacaacttttctcttctatcttgttataggaatgccatgaatattatgaaactgcctattatgttgaggtctgctgtactgaactgcctattatgaaacttgatgcagaattgaaggagctgagatcaataaaagtttgcttgctttaaaggaatgcatcagagcactagataatgaccagacccacattccatttcgaggaagcaaattaactgaagttttgcgggattccttcattggggactcacgcactgtcatgatatcatgcatttctcccagctctggttcttgtgaacatactctgaacacattgagatatgctg

SEQ ID NO: 83937 - DNA, 551 bp, Oryza sativa
  unsure (1)..(551): unsure at all n locations
acaataagttataattaagtaattttcctagtttaattacatgtttaaaattttgctattcttaacttacaggtcgttccagacaatgagtatgaaaagaagatccgaccaacggttataccagccaatgaaataggagtgacatttgatgacattggagcactggctgatatcaaagaatgccttcacgagcttgtcatgcttcctcttcaacgacctgatttcttcaaaggtggtctcttgaagccatgcaagggcgttctgnnnnnnnnnnnnnnnnnnnnnnnnnnnnnnnnnnnnnnnnaggccctagcaaacgcagcaggagctagcttcttgaacatctctatggctagtatgacatcaaaatggtacggggagtctgagaagtgcatccaagccttattcagccttgctgctaaacttgcaccagcaatcattttcatcgatgaggtagacagcatgctagggaaacgagataaccatagcgaaaatgaggcatcccgcagagtaaaaaatgagttcatggggtaccgagctcgaattcgccc

SEQ ID NO: 83938 - DNA, 3599 bp, Oryza sativa
agcgcgcaccaatgcggaagcggaaaatcaagcgactacactggcccagcacatcagagccgtcaacgcaatactgagggaaaccccctacgatcccattctgaacgacgatctcgcacgatggacagaacgactacgggaatcagtgaccaacctcagcaacgcgttcaaagaagccgctgctgcagtgcacccagaacagccaccaactggcgatgctaatggtgaagatcctgaacaccgggaattgcctcatcgagccaccccttcacctcgcggcaccggcgatctccgcgatcacctgaatggccgccgagaggcgcgacgcacaagtgacaacgagaaccgttctcaacatcgcatctcttcacgacgtcacgataacgaagatcgaggaggccgttcaagcgaagaccgaggccatgataaccgccacaaccgctgcgatcatgacgatcacgaacggcgggtgctgggcgatactggtcgaggacgtcgccataatgacgacgatgatggagatcggcgccgagacaacaacgggcgacgacaacaaggttctcgagaacccggccgacgtcctcgtaaccgcacgccggaaccgagcgacccatcgtcatcgtcatcatcttcctcatcttcatcatcagatagacatccacgaagggcgtatgatcgccgacaacccaccgcccccagcgctgggtgtagagctttcgatcgttcacttcgggatgtccgatagcctgaaagattccgacctggagcaatagagaaatacgatgggacaccaacccagaagagttccttctggtttactccacggtactctacgctgccggagcggacgacaatgcgttggtgaattacttgccaaccacattgaaaggctctgcacgttcatggctgatgcatctcccccctactcgatctcttcgtgggcagacttgtggcagcagttcgtagccaacttccaaggaacttacaagcgccacgcgatcgaagacgacctacatgcgttgacacagaacccgggtgaatccttgagggattatgttcggcgctttaacgagtgcagaaacacaatccccgagatcaccgacgcttctgtaattcgcgctttcaaatccagtgtcagagatcgctatactactcaagagttggcaacgaggcgcgtcacgactactcggagattattcgaaattgtcgatcgatgcgctcatgcggatgacgcactgagacgcaagaacgacaaaccgaagactggaggagagaagaaaccagccaaggatgcacctgagtcaagcaagaagaaaattcgcaagagtaggaaaaggaaagctcaatcggaagttctcgcaacagaatacgcggaccctcccaagcgcccagacccacaaggcagcgatacgaagaaagcatggtgccctatacacaagtcggacagacactctctagaagattgcctcgtcttcaaaaagtcgctcgcaaaacacatgacatcggaaaaaggcaagcgagtacacgtggttgagaaggatgctgaggcgcctactcaggaatcggactcagcatacccagattccgatcttcatgtctcacacatctttggaggttccacggcatactcctcaaagcgagaatacaagaaagtggaacgtgaagtctgttcgacgtggcagggggctgcgcccaagatgaagtggtccgagcagaagatagaattctcagaagaggaccaccccaagattgctgtcatcccagggcaatatctgatcgtagtcgaacccactattcataatatcaaggtcgcacgagtcctgatcgacggcggtagctcaatcaaccttctcttcgccagcgccttggacgcgatggggatcccacgaaacgagttgacacccaccgatcaacccttccatggaattactcctcagtcatcgtccaaaccattgggcaaaattacgttgcctgtgactttcggccaagcaaactacttccgaacggaacagatcacctttgatgtcgctgaatttgatacagcatacaatgccatcattgggagaacttcactcgcgaagttcatggccgcatctcactacgcgtatcaagtgctcaagatgccaggaccgaagggaacaatcactattcaagggaacgctaagctggcagtacaatgcgacaagtggagcctcgacatggtcgagcacacgcccagcctacccgccacagctgagccacccaagaaagtgagcaaaacaaacaagacgccgaagccggacggcgcaatcaagatcgttccactctccagtgccaaccccgacaagaccgtcaagatcggggcatcactaggcgagaaataggaactcgcgctcatcaccttcctccgcgacaatgctaacgtgttcgcttggcagccgtccgacatgccgggggtacccagggaggtgattgagcacaaactcatggtgcgacccgatgccaagccaataaagcaaaaactgcggagatttgcaccatatcgaaaacaagccatacgagaagagctcgacaagcttctcaaagccggtttcatcagagaggtactccatccagagtggctagccaacccagtcatggtacggaaggccaacgggaagtggagaatgtgtgtcgatttcaccacctcaacaaggcgtgtcccaaggatcactttcctcttcctcgaatagaccaactggtggactcaacagccggttgcgagttgttgagcttcctcgacgcttactccggttaccaccaaataagcatggcaaaagaggacgaggataagacagcattcatcacgccgttcggggtattctgctacgttaagatgccattcggactaataaccacaggaaacactttccagcgcacggtccaaggtgcacttagtgaccagctcggaaacaatgtcgaggcttacgtcgatgacattgcttgtcaagaccaagacaagcgactcattgattgacgatctgcgggaaacgttcgacaacctccgacgatatcgccttatgctcaatccagagaagtgcacgttcggagtaccatcgggcaagtgtcacaccttgaaaattcaaaatttataaattgttgtttaaaaggaatttttagaatttatttttaaaagtcttgaaaagaagatctaattttaaaaataaattccaatataaaatggggccagataaaatttcattaaatactttgcttaattctataattcctagatttttctgagatttatttgagctaaggaagtatttttaataaatggaattgcatttaaaaaataatttaaattgaaaaaggttttaaaaatcttcttttggctttgggccgaaagtcggctcaaaaacctctcttttctctctcctcggcccagccggcccagtccgcagccgcgcgcgcgcgttcggtcgctgacaggtgggtcccacctgtcaggtcgtcgtcttcctggcgtcggcctccgcccgaaaccctagccgccgccgccgccgccgttcctttccaaatccggccgcccctttccgtttccggccgaatcaatagaggggaaatgatctccgggatct

SEQ ID NO: 83939 - DNA, 505 bp, Oryza sativa
gtcgaagatcttaaactgttgtggaagaaggaaggtgtccctgtgtgggatgaggacaaacaggaggagtttaacctacgagcgctgctgttcataaccatcaacgattggcctgcacttagcaacctatccgggcagtccaacaaggggtacaaagcttgcactcactgtatggatgaaacagaaagtacgtatcttaagcactgtaggaaggttgtgtacatgggttatcgtcgattccttgcagcaaaccacccggtacggaagaaaggcaagcactttgaacataaggaggaccactgtacaaagcctaaacatcgcagcgggaaaacagtgtttgctatggttaaagatcttaaagtagtgtttggaaaggggcctggtagccagcctatagagagcgaagatggtcacgcggcgatgtggaaaaagaactctatattttgggagttaccctattgggaattcttggacgtccgccacgcaatcgacgtgattcacctca

SEQ ID NO: 83940 - DNA, 682 bp, Oryza sativa
cttccataagattgacaagtgttattaccctcaaatacaagtaaataagaagcagataagccctatggatataatggcagggtttccatgtatgaagttggtgctgtaaaccttcataagccataaaaagctcaaggcgtatcaactaacgcaccgcgaaagcacgagaggttcctgtaaaatgcctgaccgaaccaaacattggtttggaggcaccaaaatgcctcaatctgtaaacaccagcagcagcgtcttcaggaactgtccactctagagttgcaaaacttcttgaactcaatcttgcgggccttgaccacttgaaacgcaatgaccaatcatcatcatcgtagacaggaacccaattattgttaccatctagcttctcgacgagtgcaaaggtaccatccgtaagaaggtcattccttgggcatgctgaataaaatgtagcattcacagtactacccttgttgaatgttgagttaccaggaacatccgagttgacatccccaaacttgacaccaagaggagttgagtcaaaaacaacaccaggaagtagtccaatttgcttgtccaacatatcaggaggttggaaatttgttgggacctctttgtttgcaatcatggccatagcaagtttctgaaattcttggatataggcactcaaggtgtggggaccatacaa

SEQ ID NO: 83941 - DNA, 612 bp, Oryza sativa
acataaattattaaaaaaatggtggggtccacatgggccccacatgtcattctcagcatctccccctcttcaactagagcccctcttcttcctcctctctctctcccttctcccatccccgaggcggcgggcggtgttcgggtgagggatggcagctcgcggcggccgggagaggagggaggcggcgcgcggccgggcgaggagaggcgacgtgcggtggcctggcaaggaaggaggaggcgctcggcggcccgacgaggagaggtgacgcgcggcggcctggcgaagagggaggcggcgctcggcggcccagcgaggagaggcggcgcgcggctgccggacgaggagaggcgacgcgcggcggccgggcgaggagggaggcggcgctcagcggcccggcgaggagggaggcggcgcgtgcggctaccgagcgaggaggggcggtgccgtccggctgggcatcgcgggcggagcggccgacggagtgtagctgtcgcgctcgccggcgacctcctcctctgcatcttcctcctccggcaacctccgccgcccgcggcctgccgccgctccgcccgcccctccgccgctccgtccgccggcatgctcctgccg

SEQ ID NO: 83942 - DNA, 667 bp, Oryza sativa
tgcagcagccgccccaccacctgcttccgccaccggggtacgccgccccgcttcacgtgctccaccaccgccgtggtcgtcgtatctgtctttttctcgccggcggcggctttctggctgtcccacgtagccttgccgttgtcctcgaacttgatggagatgaaggaatctgttggttttaattaattggcagcagcaatagtagagtacgtacaagaacacaattagcttgcttgcgagcgacagagaattgaaggcgaggcgaggtgaggtgtaccatcgaggctagcgatggaggcggtgtcggcgtcggagttggcgtcggagtcgtggggggcggggcgaaggtggtgaggaaggaggagccgagcgcgaacaccttggggagagagatgctgctgttcttgcggtggagcggtcggtcggcgaggaggtgggcagcggcaggcgaggtcttggaggcgaggaggaggaggaggcgctcccggaggcattgcgagcacacgcccaccacctcctcccgcgggtggaagtagcacatgcatggcctctcgcctcctcctcctgctactccatccttcatggctcacttcttcttcttcttcttcttctcctccttgagttgagttgatatatactctagatagcaagctgctaggtcggtatc

SEQ ID NO: 83943 - DNA, 3529 bp, Oryza sativa
  unsure (1)..(3529): unsure at all n locations
ctcggccagttcggcgctcgtcgctctgtatgcgatgtgtcggaaggagagctcgccgccgccgagctcgccgtcgacggctgcctcctctccgcctttccctccgccgccatgacgctgccggcgcccgtaagtaagcatgcactgacgatttgttcaccaccaggagcgtcagcgtttgctcgccggagaagaagctggtggtgccggagagcgtgtgcgggcggccgttggggctgcagttccaccacgcctctggcgacctgtacgtggccgacgcgtatctgggcctcctgagggtgccggcgcgcggcgggctggccaaggtggtgacgacggaggccatcgatgtgccgttcaacttcctcaaccggaaagtattttactagctaatttactagtccatttattctaacatcgtggacgcacacacttattcttacacagattttgcactacacgattgcacacaacaagagcaaacacacgcaggctttgcggcaccacacaaaagaaccttttctgttcttcctcaacggcttcgacgtcgaccagaggaccggcgacgtctacttgaccgatagcagcagcacgtaccggagaaggtaccccaaattaaatcaatcggtcatgttcatactacacagtgtgcatgcatcatgcagttaatcgtgtgccatgctcgccctccgccgccgcgctcaccctccgcttctttgcctgccgccgcgctcgcgcccgccgccgctccgctgccgcgatcgccctacgctgcgccacccacatccgcacgctaagagaaagaaagaagagagagaagagaagagaaggagaagaaaagagaagaaaaaaaaagtgcggctgacatgtaggccccacatacttttaaaaaaaattgctgactaggatgccacgtcagcgaaaccactcatatatactgctataggaccttgagtgaacggttttagtaatttaggggtaaacatttctgattttgtggttaagggatctcaaataatctcgctgttaagttgaggaacctccggtgaacttactcctttcgtcctacatgcatcccttgtacgaccaattggcgttttcaagtaggcccgttaaggcccacattttcatactagccatattaagcccattttgttcacgtaacgccgtaacttttggtaagtacacttcaggtcccttaatttgtcgccgagtctgaaatacgttcctaaatcaaaatataggtcactcaatttataaaaccggatcacccgaggtccattaattggagcgaactgatattttaactagtcaccttaaaaatggttcaaccggtttcttatatgccaagaaaagtttaccattttttttatgtgccactaaattaaccatttcagaaaagatatatatatctttaaggggattttgagtttccaaatatagctgttagcctgtcagataaacacatccactgaactttttttgaaataaaaaagaaggattgcattctaccaactccaaagtgtgcgagtccaataatcatatatagtcttcctaacgctgcagctgcacgaggacaacatggccactcactttataaattcagccacatgtaatataatatagcggtactagctgggaagtgggaaaacagtgattaaattgaaactatagcctagctcgatgcatccacttgactaatagagtatcgatcgtttatgggactttgaagcgttcaaacgccaagcacaaggtctcggcgcacgcgctacctatcatataacaacaacaagtggatgttagggtatgcatgcatgtttggttactagtcatactttatcaataaatattgatacacttatctaatttgaggtgatcaaattcttagccataatttaataagcctaaaaaaatcttaccacactttttcaagttaataacatatggacctaatttataggaagaaaatattgccacaatagtggctacaaccaaacagccatcaatgtgatcaaacctgcctaagcgtagcaaattacgacaaagtatgattggcaaccaaacaccccggtagtacatatatacaatcttatgcatcgcgtgcgtggcgttaganaactactctccccagccgttttataataaatattgcaagccattttaacttttaactacggagtagttgtttgagaagttttctgtttttaattaagctgttattttataagttgtaattttcgacccacaacatctgtaataatttctacttcccccatttcacaatataagtcattttagcatttcccacattcatattaatgttaatgaatctagatatgtaacatcaatatgaatatgagaaatgttagaatgacttacattgtgaaatatctagattcattaacatcaatatgaatgtgaaaaatgctagaatgacttacattgtgaaacggagggagtagtaatcttatactctctccatccctaaatatttgacgccgttgacttttttaagcatgtttgaccgttcatcttatttaaaaccatatgtacatataatagtatatttaacaatgaatcaaatgataagaaaagaattaataattatttaaataagatgaatggttaaatatgtttaaaaaagttaacggctttaaatattcagagacggaggaagtataagctatgtaattgtccacacctagtaccaacatatgcgtctgcctcacaagggttaaagaaaacaagatctttttcctgatggatccaccaccgtacctgtaattcatcagccctcgataaggtcgactcacgcgcgcacagtacacgtacgacaagatgcatgaagagttgttggcgacgatcgacgagatgcacgttgaggttcagggaacgatggtgtatcaattaaagttggcaactgatcgaccggacgaagcggccaacaagtatcatgtgggggttcatcgcacgccgcatgatcgacacatgcatgcatgcatgccccacgtgatatattgtacatcgatcggtgtcatcatgaatctcgatgtggtatacacgcacgcaccagtccaaataagtactcctatctaaagtactagtagtactacaattatctaaagtagcacgtacataaagaacttaaaagcagcaagtatattattttcttaatgggttcttaatagtagaatttattccgggcatttgctttaaaaaactacagttagatcgagcattgcggcttataaaataacaacttaattaaaaacaagaaaactacttgaataccaagaaaaacaacttccatccatagttagagagaggggggttgttgttgttaaaaatagacaagaggaggtaggatgcatgggatcttttgggagatgttttggggttcttgttaattcggatagcacatatccataagtaggttgtctatccgttgggagcagacacatttaaaaatgggtggccttcgaagcacatgtggtttaaaacttacgaggatattaaactacttaccact

SEQ ID NO: 83944 - DNA, 1332 bp, Oryza sativa
cagcccagatataagttcatttttatttcagcttttgcactaatatgtcaccatgttttaattgcacgtttcctcatcgcaggacctcgtctgcttcgagcgcgttcgcaggcacgaccggcgcttccgcgagctccgcaggggcgttcgccacctcttcgggcgcgttcgccagctcttcctctcacggagcgtcgatccctcgcccacacggtactttactttttattactactgttaaatacttgtacgaaactgatggtccttgtccagcaggatttgcagccgggatcttcggtactggggcctcttcgtctcacgccggtaggactggtcctactagccagttctacgacgacgacttgcacggtgcacaccaccacgacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggataggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgcttcacggtagtgtcagatccagtagcgcgcacagtccacaacagcacacatgaaaagcggcagctcgagttatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacaccacacacgaaaatggaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttgggactaacaaaatatttgtacggtaacaatccaaatataccctaaaaaataataaaattgtattttaccagtcttggagattttaatcttgtatagttttcaatataaaaagatttgatagctattgatatttatacaaaaatatagagcacagtataaaatcgccctccccca

SEQ ID NO: 83945 - DNA, 680 bp, Oryza sativa
tgatctaaacaggcccttgggatttgtggagacttggggaaggacgggtcctagtcagcctcgctatgcacatcaatggatctacatccaccgattgattgtatagtagtactccgtatgtgctggtctggtagtttgcaacaatcattggcatatgtatactgacgactgtacacaaggggaaatctcgaaagataagcatactcagctctgtgtatttcattttctgccacctgatcgatcgatctcatcaatctgcaacgaattgatcgtttggtataataacgaatctgactgggaaatacagtacatacatatttatggctgttgttggatccgcaaaaaggaaaaaagaaaaggaagaatgcacagatcagatcgtagagagaaaggaagaaagaagcagcaggaatggaggtgatccgaggagcaggtgataataatgaatgaatatgatggattcagaggtaaatgcaggacttgtcgagggagatgggcttgttgagcttggcggggttcatgaggaccttgcactcgatggcgcgtgtgaacttgggcttcaccagcgcccccagcacgtacgccctcgagtgcaccgtcgtcctcaggatcatcggcaccggagccatgctgccgctgcccttccccgccgtcagcgtcggccctccgccgtacagcgg

SEQ ID NO: 83946 - DNA, 1666 bp, Oryza sativa
cgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaagtaatacaaattggacgtactgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacctagtcgtcaacgtactgctgtacacgtggaacccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaacaaaaaaaaagaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctaagcatccgcgatggaccgtgcgtagtggaccagccggaagtccacagcgtgcccgtgggtgctagtgaacatcacccacccgaaaaaccacaacaggtacgcctcaagggagcgtcggaccgagtaatcatcagcgtcagggtgcagaaggtccgcctacaattaagaatgaaatgttagtacaaaacactcatccggtcgcaaataagcatgtatgataataacaacttatttacttacagtgaactggagcaaccaagccttgctaggcccgactgtagagtacggaggaagggtgttggccggtcctaggtgtggaaggcgcatcacctgctcgaagcgcgcagtgatatcctccttccacccaaaaacaccgtccacgggaccaactggtgctcccgccagcggtagcccgagcaggtacgacacgtcctgcagtgtcgg

SEQ ID NO: 83947 - DNA, 705 bp, Oryza sativa
attatatctcttatgattatacacccccgttgctgtagaagcggggtttaaaaattcccattatctaaaaaaatctcttatgattataatatggtactcctatattttgctggttatctgaatcttttgttttcaaacaaagcagagtatcatttaataaaaaggacttcagtattttatgattaacaatatggttcattttactggtgatctgagctttttggtttcaaaacattgcagagtatggcatgggcagtcaaatctcaactgagggtgatgtctatagttatggcattattcttctggaaatgctaacaggaagacaccctaccaatgaaatatttactgatggcttcacactccgcatgtatgtcaatgcatcactttcacagatcaaagacatacttgaccccaggcttattcctgaaatgacagaacaaccttctaatcataccctgcaattgcatgaacacaagacaggtataatggatatctgtgctctacaactccttaaacttggcctggaatgctctgaagagtcgccaaaagatcggccattgatacatgatgtatatagtgaggtaatgtcaataaaggaagcatttttcgccacgagcatttgacgttaggtaataaaatggtgtcaatagaagtggaacactgaggaatgaagcatgaacgttaggtaataagggctgcaggaat

SEQ ID NO: 83948 - DNA, 511 bp, Oryza sativa
gattgtggggtatcagacacatcctccatcggcattcaaacatgttttattaatgccactaaagatgatgctgttataactaaatcagttttgcgtattgagcgatctgcttcttctaaacctctggaaaagaaacttgagttctctgatgagaacaaggaaaatttggacaacacaattgaacaggcaaaagatggacagagtgcaggaaattacaaacacattgacgagcaggcaaggggggaacggcgtactgcaacaaatataactactacttatgatgatctgccaggcaatttagtaagtacttccagtttttgatgatatttagccagttagtatgtgtatcatatttcgttgaggataaaaggtagcacctgtatagtttgtgaggtgaaccaatcagagtgggtccagtaacacaattaaatttagcattaggccagtcccattgggtgccacataagcaacaaggtatttaatggatgattgaaatatctcttacaatgca

SEQ ID NO: 83949 - DNA, 574 bp, Oryza sativa
gcatggcccagccgcccttgagcacgcagataaagcagctggagcgggagctgggggtacggctgttcgaccggacgagccggggcgtgaggctcacggaggcgggggagcttctgctggaggaggcacggcggttgttcgtgcagctggatcagacgacccgcctgatccagcgggttgggcacggcgaggtgggtcgtctggcgctggggttcgtgccgtcggccacgaacgaggtgcttccgccgatcctgcgggagttcacgaaccgcttcccgggggtggagctgtttctgcgggagatgcgcccggacatggtggtgcagcggctgcacgagcagcagatcgacgcgggcttcctgttcctgccactggaggacgcggcgctccaggtggagcgcatctcgcgggagccgctggtgctcgcgctcccggagtcgcatcctctggcctcccgccggcaagtgcggctgcaggaggtctccgaagagccgttcatcctccccgcccgctacccgatgcccgggctctacggccaggtgacggaagcgtgccgggcagcgggcttcgagcc

SEQ ID NO: 83950 - DNA, 2901 bp, Oryza sativa
gagttaaatttaggagttggagctataccaaacaggccctatgttttgcaatggacacgaattgaatcggcactgttacttctgtaccggaagaacgaatcaatcccaatttaattatcagattgattccgttattactccagtaacagacggattgatttctctccctctcgcgcactatataatcccaccaccgggacagacagaggatgcacttctctgctctcttctcttcttctctcctgcactgattctcctcggcacatcctgattcttctgttcatgcgctaagattctgcttccccagtaacgaacacttgcgcgcatgagtgattgggacgagcaggccttcgaaactccgtccgcttaagtacatgcacgggtaggcggcaatcaagtttttgggagcgcgactgctctgcatcggttctccacggtattgtcttcttcctctacatcgactccctactctgcttcgtctacttccactacttcaacatatctattggtggaggcgctggtggaggtggcggcaaggacactggagaaggtgagaacgtcaacatcaacggaggcaacaacaccaataatgcctcatctagtaccaaagcgttctccgggtatgtttccttcttcactatagcgttaaaacatgtttctcgatgatgcttttctagttattagcatgtacatgtttagcacttttagtagatcaattcctattacacatgtcatgtttattatcttatttttctggattaaaatatgttgaattatgatcaaattttcaacaacggccatatttctttttagaaaatggattaaaaccggcctctacatccaaaacacatgtatacggtcatgaaacatataaacccaaactcgtcacaataaggtttcaacaaagtaccatagacaacacccaacaaaagagacaacaagactatgcttccaatctccttctaaagtcccaccccaaacctttgcataaatctctctgacccttgcttccaacatttttcagcactccttttcaactggtgaccatccttttctttaagcaacgatcaccactagcgtgcccagtatgtcttcttgaagatcacctgtaaaaataaattagttttggagccattaaagaccacactatctctagttaaccatactgcccaacataaagccgcaacgtccacaaaaatttggtattctagcctagttccaactaccaaaaagattaacaacaatagcaagcaattgatcaatcccacaggctataaggacaatattccatacacattttaccaaacgataataaaaaaatagaggtgttgtattatttcattagaattacaaaagcaatatttaatgctacccttctactttctttttgctagattatgtttggtcaaaatgaccctctctttaggtaccaatggaagatcttgattttcaacgaaattctaagcttccaaatgaactatatgtcattgtagtcacatataataaaggtgaatggagaattggcagagtctatgatcccctctagatgtttaatgcagggagatcctctctttccatacctattcttgatatatgcatatggtttttatccttgctaattgttggtgaaaagggagggtacaatacaccaagttgtttgtttgcaaccttaagtcacacatctgctatgttgacttattttgctgaagttgaatgcacataatttagaacatatccttgaggtgtatgagaaatgttcaggccaagcaataaacaaggaaacacagccattatgttcagcaagaacttaagtcagaccggtaaatctcaagtaatggtactataatgctagatctgataagtacttgggacttccactatacacttatcaataaagaaaacgagaacctttgcttatatcaaagaaagaatttagcaaagcgtaaaggggtggaaaaaggagatgcatgccaccaaaggaggggaaggagataaggattaaagctataacattttaccaactgagggaaatgtctatcgtgcactacatgtgatgtgtaggcaaaagtgacatcttctaaccaaacggtagtgtgaagaaattaatatcatgattagacgatattgaaggagctagaaaataaatagaacaagatgcactaggtgtcatggggctgggcagaatgaggaaacagatgagtggagatggtttgtacggcttcaacctcagcatgcttgccagacaaggttggaaattactgcagcaaccggattcactatgtgctaatgccaagaattttattcagtgctggaggctagacaagtgtgaggtatgtcttattcatggaggagcattcgtaaagaaaagtgttaaagcaagagattatttggatgatcaggaatgtaaaaacactttgaatttggaaagatccatggttactagtaggtatcactaggaggccgacatcagcccagggcaaccactaggtaggcggtaggcaccggtgctggtagcaacaagcacgtgagagaggtgctactgaactcctattgcctaatccactttacacgtgaggtagttggtacaagtgaaacacaagtcggggctaaacaaaacaaagatagggttggtaggcacgggaaaaaaaacattgaagccaacaacacttacgtagctagtttcatgccttattgcttagcgttgctgtcaaaaaatatgatccaaaatcgagaaaagaacaagtatccatccaagttttcttactaattaaaatgaacttccatttatcttgaacctaattatactttttatccaacacattttttcaacaaaataataatatattcatgaggatatgacaacgcagataggggaaagtcattagtagagcatgttttctt

SEQ ID NO: 83951 - DNA, 559 bp, Oryza sativa
aacctaactgttcttctagtttgttcaaagcacgccttattccttgctttccaaatcgaccacgtcacagcaactacccccactaacaggacggagttgttttgtatctttgtcacagtgttgtccatataccaaaagtatgttgaatatttctcacaggtttcaaatcgaaagcacaagccaccacatttcaagtaaagtcatggggcagtaaaaaaacagatgttgtattgtctcttttttatcacagaactggaaagtttcagtcccttttttctatcctcttttcttaaaattatctttagttaacacgttgtttctcagtagtaaccacacaaagatcctaattttaagaggtactttgatattccgaattttttttatgcatccccccaccgtgccgggaaagggatcctctgacttaaccgccatgtagttaagtcactgacatgtgggccatagcaaagtaggacccacatgtcagtgactcaactgcatgtgcagttaagtcagaggatctgctccccccccctccccaaccattgaggctgtctcttgc

SEQ ID NO: 83952 - DNA, 3464 bp, Oryza sativa
gcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcattattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattttgaagggcttctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttatgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattctcaatatggtaactcccaaaatatagagttctttttccacatcgccgcgtgacaatcttcgctctctatatgctggcttccaggcccctttccgaacactactttaagatctttaaccatagcaaacactgttttcccgctgcgatgtttaggattcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcttccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcaccttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgcacacaaataattattcttacaataatgacagtcatacaataattataagatatctttattcatacaaaaatcataaaatatcacaccaaataattcttaaaaactatttgtaaagttttaaactaattttaatgtgttttacttcttttaatttttattttagtttgttttctattatttaatattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccgggatctttagccccggttggtgctaccaaccgggactaaagtcccacccctatatatatgtcggcttccccctccagctgcccgagcaagcttcacaatttcctcattaaaagaggggaggtcatgccataatttctattgaatttattttggtgattacatacaagt

SEQ ID NO: 83953 - DNA, 955 bp, Oryza sativa
cgcttacatatgtgtttataaaacagaagttaatgcattaacattatttaaagtacaaagattgatgacaattacttcgaaaaattatttttgtctgtaataaattaagtggataaatcgtaataagcaaatatatgacttataattaataaaaattccaatatatatatattcttagcatatatatgaatgatattattatattggtaaaactctaattaagatattaatgtacatactgcatgatttaaaattaataaaaattgtaatcatcatatgtacttagcgtaggaattatattaaattaaatgctaacaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatgtaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactaacatatacatgatttaaacttgttgaaacctctaataatcgtgcgtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgct

SEQ ID NO: 83954 - DNA, 2411 bp, Oryza sativa
tgtgatagacttaacacaagggatatgcttgacagaaggcttggtgcaaaagaagatgatgatctcacatgtgctttatgcaatacacaccaccagacttcatctcttcttcacatgtcctttcagtatggcttgttggcaatagctaggcattcattgggattgtaatttggaattctttcagatgattgttttggcaagaatcaggtttgcacaaaggggtttccttgaggttttctttctggcaacatggcatatttggaagcaaagaaatgggctaatttttcagaatattcagccttcattccaatcatggaagtctttgcttatgaaagaagttcttctgcatatgtacagaatgaaagatcctctcaagcaatctctttttgattggttgcaaactttataggattgctgtttttgcagtttttatttatccctttgtaactttgtacatattttttgatctataaaatttaaaactgctgggcatagtcctggcagtacttccagtcaaaaaaaaatatcattgtggttatagacccatgcactttgcaagtttgcatgtcatctaaatataaataaaatacttaaaaattttgacaacgtgttgtgtttttataggtcaacctttaaacgtgtcaccgttggttccaatgacaggggcacatacgtttcatgtgtttgcttacaccgtggtctcgggctcaccatctggaaaataaagaactaactcaaatattaatagcacaaaccacaacataaaaaaaatatctggtgtctttacgggtggtttcaagtttgaagcacacgtaagatagcagcctctcgcgtcgtccctcccccacgaaagacccaggaggcgacgccctcaccggtgctcgtctccccttacctcctcctctacctggccgccacccgagcggccgtgcggccacaaggacagcggcggcggggcttcgtcctcgcgctcgggcgggggggggggagggggggctgctcggggcaggggaaccgcccggccagatctagcggtgggtcagccagcggcggggctgagcgatgcggtggcagtgacgtctggtggtggtggcggcggcgtttcgagcctagatctggcaggatggcgactgcggcgggggtggcgaggggatggcaacggtgaggcgaacccggccgcgctggctgcggagttctggacaccctgtggtggctcggagttcgtggcgatggcggcctagagctcgcggcgacgacggcaggtcgactgcgccgtgtgccgtcggagctcatcgacggcgagaagatgcaggagttgcccaccacgtggagtgcgttgatgcgtggctctctagaaccacttgcccgctctgcccaaggcgagggctccgatggcagcgcagtcgtcgttggtgacaccgcctggcggcagcggcggctggaagtgtggctgcagcggcggcgactgggacgcaaggaggcacggaggtgcggcacggctggtggctgcgtaggctggcgaggcacggacaaaggcggcatgtggtgacatgcggcgggcggcggtggcgtgcggaggcaggccggcggggggcgccggtgcagtggtgcccacgcgctagcagaggttaagttggtggtggagcatcggtgtgtcaacggtggatggcgggtgaaaactgtaacgccccgatttttgttcgggattaaaaatcattaaataaagcatttccataaattaaataaaagttaaagcaatttaatcaagtgaattatggaggaaattaaaatttcctttaaaaatcattggtcgagaattttttgtaatattctttgtgccctaatgaactctctgaaatttcccgagaattttcggagctcgagaaataattttaatagcacaacatcatttaactaattaaataaaaagaaaacaaattaaaaccctctctttgtctttgggccgccccggcctaatcccccttcccctccccgtggcctcttcctccctcctcttctctcggcctagcccgcaacccggcctgctcctctcctttcttgcaaaagtctattcccccccagctcctctctctccctggctgacatatgggaaccaaggctccacatgtcagaacctcctcctacctccagccgcccgcgggcaactgccatgccgcccacaccgctgccaaaaccgccgcctcccgcctcctgcctcccgcacgcacgtccaaccgtgtggacgtggttgccacccactcctcctcattttcccccacttttccccaaaaattacgccggtttgacctccctcgagctccacgtcgccaccccacatcgccggccggttgccgcccgattctgcccctctcggccacgatttcccctcccgtagctataaaaacaccccc

SEQ ID NO: 83955 - DNA, 6780 bp, Oryza sativa
tttaagttgttttgtctaatacttaattaacaatgcgctaatccatctcatgcgctaattccctactggcggctcgccttcctcttgctcgctgctgccggtgccatggtcggcgtgcccatccactcgtttgccgccaggaggaaggcgaatggcgtgctgcatgtcccatcgttccagatcatggtcgtgtaggggctgacaggcttgttcccttagtcggcgctgtcctgcagggccacgccatatgcgtcaccaaccccctcccatcatgcccgcgctcctcggcatgacggagagatggggaaggaagaagataaaggaggatctaaggaagaagatgaatctgacgggtgggttacacgtgtagataacaaagaagatagaaaacgtggcggcgatggcatggtttcaatttagtaaatttgagtggcatggttacaaatagatgaattataatggtatttatctgaatagtcatatttgcaatgacacatatcaaattaacccttaaaaagtagggaacatatcctatgcacacaaactttccatgcacaccaactggcaactagcaaacattacgaaaaaaattggacatttactcgaaatagtattacacatatctgcaaagtctcatattcaaattcattatattttagccgtaagaaaaatgtaacatatttaagggtaaaaatctgtcaaaattttatcttttttgtgttacggctgaaatataatgaatttaaagataagatttcgcatgtattggaattatttgttcactttcttctataattttttgtgacatttgctagtaaacttatcagtatagaatacgttccaagaaaaaaatgttggattggatatcggtccatgagacgacgagtgctttgttagtgagtagtgacagccaggatagtcaagagttattgaattgcaatacgggagatttggagttaagccttgaagtttttgttgcatatgccaaatagccctgcaatcaattcaccgcgcgcacgttaagtaattaaacactctaacagctggttggttcttatgtctattagattagtttgtatacccattaggttgtgttattttgtacatgttactaactttcttgtttttcactcgtatgcttcccaactactaaatagtgtgcattttttaaaaaaattctatagaaaattgctttaaaaaatcatgctaattctttttaagttgttttagctaatacttaattaactatatgctaatccatcctatgttgcatatcgggggtatgtgttcccaactcatacttctgagcttacatatgttaagagcttggcatcttctttccagcacaaaggtgaaaccttagccattccaatcttgaaacaatttagtccctcaactggaaaaagcctatttgccaccctgcaaaagaaattcaagccaccacagcttgttctccatcctcacagccacccaagcgcgctctatgtctccaatacacatgaagatggcggcagcggggctatcttcttcattttctcctccacccccttccctctcaatgacttaggggtccttggatctgaagtcttaggcgccagccacaatttcaatccaatgatgaggaggacggttgcgaattaggcattggtacggtaagtagcctcggtcatggttttggcattattgacaactctgactttggccatggctctagcattcccagtgatgatggggcattctgatatggcaccgtagagatatcctctccctgtcatttgctgcatcgtcgtctgagcacggcaacaataggtttcaggggcattgccaagcgtcttgtgcgatagacagaggatatgggggcacccagagctcaccgagagcggtatgacttcgccaactaaagttgcgctcacagcttcatgctggctaatggtggtggcaacgagggcgtcatgccttgatcgccttgactgccatcaccttgcagctaatcctcatgacaacattttcatcaatagttaagggcttccacaccatcttgaatagtagtgtcattttatcttcaatttatggtattatctactcccacatctcattgattcttcagatggaccctacggattatggaaatgtgtcttttggcttgactgcaacacgatcattttatggtagcaggtctatagaaggttgcgatcattttatggtagcaggtctataaaagggttgcagattgcagtatttgtggcattataattgtgctaagactaggaggcatgacagcaatggctcagaacaaaggaaggtaataccggggcacttcgttttagtgttgctcgtcgaataccagtttctcaaattcagagttaaataactatgtttggccttacatggttgtttttttatcatagttcaattgttagtttgatggactatgagcaacactgaattattttcttttttatatgaagcgagggaagctcgtccccacgagaaggccggaaaggctaattagcgcgtacgtgccagatatgtttctggcgcagacgtccacgtgtcaatgtcatcaggaagatgattagcgccgcgctgtgccgtgattagttccgacttttccgtttttgcaattaagacgtatcagaatatattattaccgatgtgatcgtaattagcatcttgattagttcctttttgggaacatattagggtctagttgtttttttgcttttgaaatataatttaatttaagactttatattctaaattaaaaactttcaacactaattttaaaactttcaacccaaatttgaaactttcgagtcaaaatttgaaaaaaaaaatcaactcaaaatttgaaaactttcaactcaaaatttaaaaactttcaattcaaatttgaaaactttcatctcaaattttgaaaactttcaactcaaaattttgaaaactttctattcaaatttgaaaactttcaaatcaaatttgaaaactctcatcccaaattttgaaatctttcatttcaaaattcaaaaacattcaattcaaaattcaaaaactttcaactcaaatttaaaattttcaattattttaaaacttttaactaaatatttatgttttttaatatttaatcctaattaccgtaattagcactaattactataaataagactgattaggcaattagcggtaacaacatgggtggatgggcctgaactggaatgttccgcgtgctgcttctgtagccagcgcacacgcgccgagtaggaacccccgaaaaggctggggcatgacctaatatggctttcaatattaacatggcttctgatattaggtcattagtagtaaaaatgttctaaaataatatggtaaattagtagtaaaacttttctttaatagtgcaacttattagtagtaaaaatgttctaaaataatttggtaatttagtagtaaaaattttctttaatagtgcaacttattagtagtaaaaatgttctaaaataatttggtaaattaacacaacacacttgatttactgaattactatataaccacaatttcatttatattactaattttttatgtgatttgttttgccaaaacgtattcccaaccgtaatttcttattttctaaacttttctctgatataattttgaaaacaaataatctaaactgttattttaaaatcaaaacccaatgctagaagaggggcatccaaacaaaacgatgttcctatgcaaagagagctaccttgtgtgcctcacaaacatttacatgccatgccatttcggatgatgcggtaaaaaaagctttatttttctataccatcttaaaagcggagtggttttacttccatgtcctcctcccaccatatgcagtgcatccgtacatataatatacgtaaccaccagatccaacattttattttcaatcatcatcctagctcatccatgcttatatgggacttttccgttttatccgttataacgtaacgacatacgactttattttaaattttaaattgaagaggttaaaaaatagtactccatctttcccaaaatatgggacggaggttataagaaactaaccacacatcggttgtcttcttcatgcgcctgcggtttggctattttctgcttttcctcgtatccatctgggagtctgggaccctacccaccacgcacggccgcggcgcgccagtggccgtccagggtactgggtttcagcggctacagcctatggggaggttctgggtgccggccgcggccgccggaccggtggtctcccgcggcacccgacgcgcttccacaaggtctgggttcagcatgattgttgcagttgatgtttcacccatttgtttttaattttctcaaaaaattgattgcctgcgggaatgcgtcaggtagggtagaatttgcagtgaaatatgtgggtatcgatttagtgccgaataaattactcttgtacaactagaatcttgcatttggttaatttggtgcgtacgtctcatctacttaggggatttagagggtcagtctattgggattgtggggatttatttatttttttggctggcttgggatgaatcgaggtgtgaattatgttgtgaatcttggtggatttgtttgagagtgtcctcttaagagagcccaacaatgccccttaggctgaaaaaggcttttctttgttttgtgcagagcgcatctattcaagttaatgttggtagcgtagtttattttcttttcttcgaaaaggcagtgtagctttgaagatgtaaaatagtggtaagaacatatgtataatgctactaagattatgtgacgcccattgccacaaccatgtactgctagagcgtagaagggtgatattaggtggtagcaaaagattttgctcttttcgattgtccagaataggaggatgtttgactcaaacaggtttacttcatgatagttgatgacatgtaacatgttacaagtattgcaaataaaagttcttttgcaagtaaaagtactgaacctctttccaattaagagtaccaagcgagttctgatttagtttacaaactgtaacaaatgtcattgtcgttcctcaggtttggatttaaaatttagatacgcgttccagtacaaaaaaaacacagatctttatcccttaacatggaagaagtctttgactggtcatactagataaaataacgatgctgcaaaatttacttcatgatagttgatgacatccaatagaagtgtagaagcatcatgatatgcatgtaaaagtattatgcttaaaattagagccattttacggtccttcaggaggtaacaggaggtaccacattttgtagtataaaatttggtacatcttggtacctctggtactaggaggaattttcaccacaaattttggaatttcttgtacctcctaaggattgtataatttctcctaaaattaacatgaagaaattatggcgagaactggcgaaccgatgtttgcactggtaacccaagcatataatttattatataatgcttgggtttaaattctatgacatgttcagggctaaatatgcgcctgagaacaaagttaattgttgttaattatataactttccacaccataaatgttgatgttagtttatacatgcattaattattcaatatctaggcagtacattatggaaacgagttgaccacagaagatgaatctggaggagttgggattgcatccgctccatcaagcatttgagttaccttcaggatgctgggtcgcatagttggctcctcctggagacaccacaatgccactgctacaaacctttcaaccttcttgatgtttaacttcgcctcatcatcaccatctaccagcaggtcgaccctgccacacctataacagtcatttgcccagtaagtaagaatactttgctcttcttctgcagcctccatttccacattttgccggcaacagatgagttccagaagaatgaccccaaagctgtacacatccaccttggcagtgatcccgacgttcttgaaccactcaggggcaacatatccgcgggaccacggatacccgtatatgtctgtgtttggttggttcggagtagtttcgctaagccaaagtctgaaatctttgctatgaaattatcatcaagaaggatattttggggctttatgtcacagtggatgatctgtgtgctgcattcctcatgtaagtatagcagcccccttgcgacaccgagagcaagttgaactcgaagactccacagaggcctgacaccactaaacaggaatctgttgagcgatccattaaccatgaattcatacaccaacagtctctcagttccttcattgcagaatcctagcatccggaccaggttcttatggtacgtccgtccaatggtttggacctccacagcaaactccttttcagtctcatgctgaatcttatcaattttcttgacagcaatgtaagttcctaactcatcttgcagctggcctttgtacacaataccagatgcacctgtgcccaacacctccttgaatccgtccgttgccttctcaagctctgcataactgaaagctttgaggggtaatcctgggtctcgtgatggttgcaatggctggacatcctttctggtgattgtacagtaagtaccgaaaagaagaacagaactcaaggcaaattcgctatcacagagcctccgagaagcaacgaacttcctagatccagagcttcttgtcactcttccattttctagactttctgagctctggctgcgaactgttgct

SEQ ID NO: 83956 - DNA, 697 bp, Oryza sativa
  unsure (1)..(697): unsure at all n locations
ttgcaggcaaaaataaacgcttgtaatcataaattaccgctatatcattatcaattgtcttgggaacaccagcaacagcaacttttagaccacgtctacgaattttctgccaattgaaaaagggaaaaatcaaattaaaaatcagttctgaaaaacaaaactccaacaatattttccctcagtttctaatgatatgcacactgcacatacaacaatttttaagccaaatgcacaccactcaacaaattcctgctgccagagtgcacatgaacagatgaagaagtttgacaatgtctggaggtctctacaagatatggaagttactcatgatagtgattaccttatagagnncangggggnagttgtgagttccannaagagaggtgatggttacctggatctngttccccncccttttttacccaaaattcaaaatanggattattttacctanaaaaatattttccacacctaccttattaattccccgatacttgaaatgtgttggtttccataagagcccgcggaaaaaaggagccccccggcgtcatgaccaccccgtgatgttcccagaactgtgccacctcttttgtggatatcatngacacttttaggtgtcataggaagataattactccaatagaatcccttgtatccattctacagaattacttatagcatgttagaaataagagga

SEQ ID NO: 83957 - DNA, 911 bp, Oryza sativa
  unsure (1)..(911): unsure at all n locations
cttcctctccaggcatgttttcaagaaagctgctccacaagccggccagaatatgtaaaaacaanatttatatttcctcctcccgcacccctttttctcctcgtggtgtactctatcgtgnaagatatttttcttcttgtactttcagaaggagggaggtaaatcttaaggtgctcaaggtgccggaaatcgaccagaaggtcaaaatttctttcgatttccccgtcaagagtcaaaatttggaattttgggtggtcagatggtttgctatttacctggattttgtgattggcgattgaagttttttccccgatctcgtatgcaggttcttgatgccaccagcgacgagccgtgggggccgcatggttccgatttggcagatatcgccagggccaccaagagctagtgagtagctcaaagctaaaaaaaaaaatcagaacttatttcccatttgtttatgagaatctagcgtgtttcagtttacgacttgggggcgttgcacattttgattgttcgcataatcccattgctttcttgtttcttttccagcggtgatagcgaaattataatgaatgtgttatggcaacgcctggggaacacacttgcgaattggcgtcacgtgtataaggtaataagataggattgattgtgcagtgatgtgctgtttggattgattccttaataacaggatgttttttttccaaaatcaattttaaccaaggggcccgggttttttggggggggaccccttttttgggggttttcgggggatcgagaccttctagcaatggcaccgaacgtgcagctgatggcattggtgacaatagctcacnaattgcnnnnnngnnncnccgctnnnnnnnnnnnncctctgntnncctgggcaattatagnnnnnnnnnnnnnatgct

SEQ ID NO: 83958 - DNA, 592 bp, Oryza sativa
aatgaaaaatttcattgtagtatttacaaacagaatcgatgtctccttgaacaagacgactctctgtatatggcagagaacgaaatcctcttacatccgtgacaggctaatatgcttgtcaacaaaatcctcaacgaaaaaagaacagagatgaaaccctgaccccccaaaaaaaaaacatttcgatactggtcctactgatgatatccgcttttgtttacaggaattgggggaggcctatagagcatgcttttggggttattcctggccatcagatttgcgcaagaacttccagacttcttggctattgatgggctggttgcgccaggtatatgacaagcttcctggttcccatccagggctacatagcttttggatgatttgatcttcttgtatggattctccctcttgcgtagattctctaggcatgtcacctcagacatacatgccaaagattgagactttccgtcggagtatttggaatatccttttctgcaaagaacaacaaaacacttgccctgtgagaaaaatttccctttgctagtccatctattgatactaaaatgcaactcttctttcccaggaacttact

SEQ ID NO: 83959 - DNA, 3503 bp, Oryza sativa
tcgatttcaccgccgctagcccgtctcgatacacattgccgctgacctacgatccatgctactgtggccctcgatccgcgtcgtcgccggtttgatttgcgttgccaccagcacatgccgagctcgttgtcgccggctcgattcacacaagcgctggctcgattcacacaatcgccagcacccgattaacgcttgtcccgagctcgtctgcgatggctcgatttgcgccgcggctagctcgattcatgccctagagcttgtccacagttggccttttgcaaccttgattcacgcctctaccgagtctcggtttgcgctgtcggccaccgagatcctctcgcacccccagccacccttgctgccacccaccgtcagtgccaacttgtctcattgcactcaagttttggccctacatgcagaggtaaagaacgagaggaggaagagaaggaaaaaaaaagaaagagcgaccgacatgtggatcccatcggtcgggttattatacaagagagagaaactgttggtagttttgcaggtggtcccatttttaattataggggaggatattttatgaccctaaatcggtaaatcctggttagcaagttttgaaaaatcatctatggagtggatatattgggtatcttttggtgatgctcttgtaacaaatagacaaatagcttttctgaaaatcaaaaggacatgttcttttaatctatttttctataattaacaaaacttgctttgttacttcaacagtttcttaatctatgtcaacaatctgtttacataatttatttgatatggtctactacagcttgggcattgaatttgcgtctggaagttaaaagagataagcacacgatcgagtacatctcactggaagagagcagatcaataattgttgacttcttgatgcatctctcgagctcccctgaaactagtatcaacagaagactgaagtggatccgtttgacgttttaccatcagatccgaaatctatctattatattattaaaggaatagaaaaaggagtctccacgttcgctctcatggcctagaaattctcacgttaatcggagaaaaagaaaaatcagagtccatatagaaatacaacttagaaatagctgaaattcagaattaaaaaataagggatattagaagaggaggctagagtccatatagaaacacaatttagaaatagttgaaattcggaattaaaaataaggaatattagaagaggagactagaagaggagactagagtccatatagaaatacaatttagaaatagttaaaattcgaaatttaaaataaggaatattagaagtagagtatagagtctatatagaaatacaattagaaaataactgaaattcggaattaaaaataaggaatattagaagtagagtatagagtccatatagaaatacaattaggaaataactgaaattcggaattaaaaataaggaatattagaagtagattatagagtctatatagaaatacaattaagaaaaaaaatagaaattcggaattaaaaaataaggaatattagaagtagagtatagagtccatataggaatttaaaagtaaataaaatttggaataaacataataaaattaaaagtagagtttagagtccgtataaaaatacaatttacaaataactaaaattaaaaattaagaaaaatatgggaagaagagtttaaagtcaatatagaaatacaatttagaagtaactgaaattcgaaattaaaaattaaagaatattgaaagatgagtttagagtccatatagaaatacaattagaaataataaagattcagaaataaaaataaataatattggaagaagagcatagagtctatatagaaatacaatgtacagaaaattcggatttaaaaaaagaaatattaaaagacgagtctagagtccatataggaatatatataatttacaaataactaaaatttgatattaaaaataattaataactaacacgtatataatatataatatgaatattacacattagtagttttgtaaagttattgcaaaatttaaaattatattgtcgttttaatatatttgaataaatgtaatgagaaaacatatatgctattatacgagataaaatataatgatgctagccgcacaatctgcgcgggctaccatgctagttaattaattactcctataacctactgtaacttgttagagctccatggcacgtaaattaatttagccgcccctacctagctagaaacgtctacaaaacaatacctcaaagatttccactaaccttctaatctcgaggtaggagagactaggagagccatggcccatcatcggtggcacactgccaaagctacgtacgccttgtgtcatgtgtcccgacaaccgttggctccaccatcgttggctatgaactatccattggcgcatgcagttctcgttctagaggctaccatgcaaagaggtccttttcgccaaataattttctcatctagcacattcccgcggtttccatcatcagttaatacagcatttttttgagatggatcaagtcgttagatttaaccgctatctttaaatgacagcagcgttgcttgcttcccgtctccttgctttgccgtttgcgttgcgcctctcaaattcttttccctccattctccgtttgcttcccgaccacgtcttccgcttcctctcctcaaccaaaagcagaggattccaagttaatttctaaactcgcgcagtccatagcttagctaggtagagacaaacaatctacgcgaaaaccttcgcttctgcaatggcggactcggctccggcgccggaggccagagtaagcggtggcgacgttccggcgaggctgcagcaggctctcgcgctgctgttccctaccaacctcgccgcgaaggccgtgctgttcgccgtcgtcgtggcgctgctgccgctcctgccgacgagccaggcgcccaggatctgggagctgcctcacatcctcctcctcggcctcatcatctcttacggcgtgttcggccagaggaacgccgactccgaggtggccgccgtggccgccaccaagaccgtcgacgacgagtcggtggagtcctacgtcacccagatgatgcacggcccgctggtctttgaggagaacgatggcggcggtgaagctgacgccgccggcaagaagggcgtccaggcgtggagctctcagtacttcccagacgatcccctcgtcgtcgttgccgatgccggtgcagggagcaacaccggcaagggcgatgaaagagagaagccgctcctcctgccggtgaggaagctcaagccggcgaccgaagaatccgcgacactaacggagagcttcagtgacggcgccattgaagaagaagaagaagaagaagaagaagaaacggagttcctcctccgcaaggcgagatacggcggcgtcgttagcatcgttgtgttggagtcccagtcgtgatcagttattcccttgcaggg

SEQ ID NO: 83960 - DNA, 690 bp, Oryza sativa
ttcctgcacccctagcagtttcgtgtgtaactaccacaatttaacttgatcaggttttgcatataaacaaatagatatgcaaggttatcctaatatgaagatttatcgtgttccacttttgtaactctttctacacaaaagattaaggacaaattattcaaactaatatcgtgctttaaaagaagcatcagtgtggtggtgtaatcatctgtacatgactccacccaacgtgtttcaaatccagcgtcaacgaatatggacagggtgacacgcattgcccaaagaagtttttacagaacatacgacaaccttatttcaagtagggtttgaaattcgtttcaaaatttctgaaatcccccccccccaccagcaagctcatatctcgcatggaattttttgtttttctgcatatttttgagaatttgaccaaatattattcaaattcattcaaaatcagtcaaaattttaaataatttcggccaaaaaaatttaaaatttctaaaatttcggtgcccccagcagaaatagcaatttctaaatttaaaaccctgatttctaagagatttattttatgcaggcatcatcggcgggcggtggctcaagtactggacggaggccggcgcggtgctctcctccgtcgggttgttcgaagcgcagctgagcagcggcgcgttccagctcctcggcatg

SEQ ID NO: 83961 - DNA, 518 bp, Oryza sativa
aatggaaagcgcacctagctcccctagttatgtcgcaactaagattttgtttacgtgacaccagccggacccaataacagagtttgcttttccaatggaccaaaaatgttaggtcgagtaccacgctcagatcccacgacagtgacacaccgcattaattcggagcaacaaatgcacaatcccatgcatctccgttacgagaaaggaacacggaatcttctccgtccacctttggtgatttgatctgttaccaacctccggagccgaattctctcacgcgccaaaaaagatgcaggaggaagcacagtactcgtgcacggtaacgtttgtctctgttttttttcttggaaacaaaaaaaaaaggttattaatttgtggttaaccgggcgaaatgcacgtaccttgggcagagcagttgtagagagggccggggaggccgttgatggtgaaggcgtcggagacgttcgggcctccgccggtctggaccgcctggttgaccacctcctccgtgtccgcgt

SEQ ID NO: 83962 - DNA, 793 bp, Oryza sativa
caaccattgaaagccactctgcacaatgaattgttgcttccacatcctaaattgtcacagcaacaaaaaattatgaggaaataggccaaaatcagcaatgatacaagcatcacaaacacaaataagagaggaaggttgggatggcaacagcggaaaagattttctgcataggatgctctacaaaagaaaaatagcttgccttccacccatctttttgccgcattgaatgctccaacatgataatcaggaaattgtgtatgaggtcttcaatatcaccaatgcttatgccatcagcatatttcttagcacccatctataattagaaatttgtgaattagatcaatgggtagtggacagcacaaaatgtagcatgattcttcttgcaatatattctgacataaaaaaaaggcctacgatacttacctcatgattataaatcaaaacctccaaaatccattctggccattctgaaattgaggtcatcgtggttctattctctggatgactgcaagccaaaaacagaagatcctgaaataatatagagggaaattttgacaccataagaaatttaaacaggtaaggtcgcaaacaaggtttcaggaaaaaacaaagaatagataacagcaaacagtactgatgagcaaaaataataaaaaaaaaacaccaaacagtactaacatagaggttatatgtgggcatataatgcaatggaagtgaatatgattgtgcagccatgcaggtgtttggttaaaagcataagaatatagttaaacacggcatggaatattcgggc

SEQ ID NO: 83963 - DNA, 717 bp, Oryza sativa
ccactagctcagtcgatgggataattgcagtattagacattctagtatcttgttgagccgcgtgctcgagacatctggccatgttttatggtcgtaattatccaactaaaatgcgactgaatggtgggctgtgggtgcgtggttttgtgagtcgcacccatggcaattaaggaccggttcacgggaaaccctggaagacttacagcgcttgccacaagcgggagtgggtaactgcttgatctgaagtatagctcgcccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgcgaagggtctcgtcacaatcactcgacacggtgacgtgtgcatcatgggcacatgatgacgcggtgacatgtcggtgggttgtgtcttgtgggtacagttgtgcacctctggccagagtaaaactattcgaatagccgtgccgcggttatgggcgatcgaccagattcaccgtgattagtctcacacttaataaatcgacccaatacactgtagtttaggtgggttggttgggcctgttcaacgtggtgtagcgttgatcagtggagatttaatgttactttaattactca

SEQ ID NO: 83964 - DNA, 1176 bp, Oryza sativa
gttagtactacgtaccactactatttacgaaaaccaaacgttaaagctgacagccgttgcccgttattacgacttgttggagtgatatcactgatatggcaacaaccctcaaaaccgagtcaagttcccgtataaatatttccaccacctgtacataattcgcaagaattttgagtcaagccgtttaaaagatccggaagtttcgtacagaaaccaaacaaattttgtacgaaaaccgcggctttatattaattaataatataataatatcataatccgagtctaaacgaacggaaagcgcggcatcacgtaacaaccctttttcctttcacttccctagtctcgcgtctcttctactgctctccctccacttcgactccactcctcgtctccacggctgcacctttcccactcccgttgaggccgaattaaaaataccaaaagaaaaagggagaaattccaccgcccccctcgaggcccagctcaccggcggccgacgtctccggccattcccggcgaccctccccgcccccccgccggctcatgcttctcggctcggctccggcgaccccccgagcgtagccagatctgggcgtaggtggtgggggaggaggaggaccttgctccgtcggggatggggcggggctgcggccgctggtggtgggtcgccgtggctttggtggtggtggcggcggcggcggcggcggagggggcgcgtgaggaggcagcggtggcggtggcggtggctccgcggcggcacgcgtacgcggcgatgatgtacatgggcactccccgggattacgagttctacgtggccacgcgcgtcatgatgcgatccctcgggaggctcgggtcggacgccgaccgcgtcgtgatcgcctccctcgatgtcccgccgcgctgggtccaggcgctgtaagcccccccccccccctctctctctctctctctctctgagtctatgtcgctctcgcgccactagcctcacggttgtcttttagcttggatcgctgggtaatgatcaaaatctgtctccctcgtagatgttcgatttgtactttggagtatatttgaatcgaggtctgattcagctctctctcctcttttttttttcacgcgctggagggttgacttcgtgcctgttttgttgtttgatgcgaatttgtgggtttctta

SEQ ID NO: 83965 - DNA, 705 bp, Oryza sativa
ctgcagccctgaccatgtacatatcgggatctttcaaaggttggtctgacagttgtttctatatttttgcctatctaggatgctaaccgttgtgagtattatttgatgcagccgattggtgcactaaaccctgagcgactagaaaaattccaagagcgctactctacgtttgaggatccaatcatcccaaagttccattatggttcacattactccagtgctggcacggtacatcttaaagctgaatcaaatgtttatttattactccctccatcctaaaatataacaacttcaatatgttgtttgattttttttattcaatgtatatcttggttgataacaatacatatccgttgcaggtcttgtattaccttttcagggtggaaccttatactacgctctcaatacagctgcaaggcggcaaatttgatcatgctgatcgtatgttttctgatctatctggtacatgggacagtgttcttgaagacatgagtgatgtaaaagagctagtaagtcttaccagcaatttgttttcctgagtaggcagcgccgaaatccagtcaagatcttttgctgcaatataactatctgatgatatttatcaggtccctgagatgttttacctccctgaagtatttaccaatataaattctatcgacttcgggacaactcagcttggaggaaagctaggtacttgtatttcag

SEQ ID NO: 83966 - DNA, 622 bp, Oryza sativa
ttagaactttctttcagaattcctatccagtaaagtggtatgcatctttctgtatgaaccattagacatatacctccgtccattcagtattattgtctatgtagatttttttttaaaaaaaagaagagcagtattcaccatggcaataatattctcctgtaacatgtggttaaaaaccaatgcaggacagggtagcctaagtgactggcataaagagcctcaaagatataggtaactatgacgaaaaaccagcagtagtaagccagaatatagattaaaaaaattctaaaaacttaggtgactaattgtgacacatagtgccaccttttgcaactatgcaccatcttgaagaaaatagtaaatggaatctcagaacaaacatgttgacgaaacatgctagtgcatatagacctaaaaatacaagtattccagttttgagtcctgttagaaataaatatcatttgatcaaaatgatgctaatagctgaagtaacataaaatatatatagccatgcgttacatacatctaatggaaggccaccagcatcagtggacaaagatgatcgtcttgaggtcccagcatccataggctcattaccacttctacacaatgaatttgatcg

SEQ ID NO: 83967 - DNA, 726 bp, Oryza sativa
aaagctacgcgtgtcaactgcaccaagcaaactttctgcaaaaattaccaagaagtacgcaattttgcttctctttgttacctgtcatcttgttttagaatataaaacaaacacttcaagaacatgaaatacattcagtgtgattgcatgatagaagttgcagtaacccataggcactgttagtgttacgcctgctaccataatgcctctaattctctttacgtaatctgccaaaataccaatattttgaatattatccccttgattctgtattgctgtctgatatcagattcaaggagaagagctatggtagcagtggtgcaacatcggggctgacttctagtttggcgtttacaccagttcaggtaaattaaagattttttagctgtctcgtttgcttcaaagataaataaacggtatgcttaatctttagttgttttgacttgggtcatggaaaaggtagtacatgtaatttttgtttatcaatagcttcaccagtagaactcttctaaattaggtgtattctgctatgctgctggttattgcacagcttcgtggattttatgttgctattcttgtacggtaagttgggtactgcacaccattgcatggttggttttgtcttgaaatctgacgctgtatgttttgtaggctaatatcagagttgatatgcgcctgcattgtaacatatttgcaattacatcgattagtatttttaatgtaact

SEQ ID NO: 83968 - DNA, 1234 bp, Oryza sativa
atgtattccagagtaccccaccagctctgaggactcgtgcttgcagacttatagctgcaaagtcaactctagcagcaaggattgattcgatcagaggtgatccaacaggaaaagctgggcgtaacttgttagaagaaatccgtaagaagattgagaagtggcaagaaccgcctcctgcaaagcttccaaaaccacttcctgttccagactttgagcctaaaaagaagagagggggtcggcggcttcgaaaaatgaaagaaaggcaggccatctttaacctcctctttttttttctcaagcgaaaaacaaacaataaacattctcttatttaattgtgtgttctactaatcattcatatttctattggcctattggtgcaaacttggttcatcaaatgcacagttttgtatcttgtcgtaaagttggaacttgattctgcagatatgcacaaactgatatgatgaagcttgctaaccgaatgcagtttggtgtaccagaagagagctcattgggtcagtattggcatccccatttgaatgatgttttattgttttgtttcacaataaattatcatggagacttagatttattttcttaacataatcaaatattggtgtcatcaggtgatggtttaggggaaggttatggcatgcttggacaggcaggaagtggaaagctacgcgtgtcaactgcaccaagcaaactttctgcaaaaattaccaagaagtacgcaattttgcttctctttgttacctgtcatcttgttttagaatataaaacaaacacttcaagaacatgaaatacattcagtgtgattgcatgatagaagttgcagtaacccataggcactgttagtgttacgcctgctaccataatgcctctaattctctttacgtaatctgccaaaataccaatattttgaatattatccccttgattctgtattgctgtctgatatcagattcaaggagaagagctatggtagcagtggtgcaacatcggggctgacttctagtttggcgtttacaccagttcaggtaaattaaagattttttagctgtctcgtttgcttcaaagataaataaacggtatgcttaatctttagttgttttgacttgggtcatggaaaaggtagtacatgtaatttttgtttatcaatagcttcaccagtagaactcttctaaattaggtgtattctgctatgctgctggttattgcacagcttcgtggattt

SEQ ID NO: 83969 - DNA, 1119 bp, Oryza sativa
caaatatgtcgctattcttgtctctggttttgcgttggcgcggaacttacagcgagttgaggtgaatccacttggaatatgtccatttctgatatataaatttaccataaatcatatgaactctggaacatgcagatggagaggcaaacacaagctgatgtgctgaatcgacatcgggtgtcaactggagttcgagcatggcgccatcttcttcattgcctaacagagatggacagactatatggacctttcggtgaacccttgtgtgctcctgatcgtgtatgtacaactttttctaatctttcttcttttttttttgcatatgtgtgtgtgtgtgtgtttttctgccctgttccccagcaaattttgtttccagaccagcgcattctggtatactagcacccttacaaaagaaacaaaaatagaaggaaaagacaacctgcaggacatcttttgatgtttcttttctttcctgtatttcagattttctggaaattagattttactgaaagttcttcaaggatgagaagatttatgaaaaggaaccacaaggggtctgatcatttgggtgcagctgctgattatgaagagcgaaagctaagtaatgttgcacaatcaaatgaatgcaacccagagggtacagaacctttagtaacagacacacttccatcaactgcacctataataacggctgaggccatgtcagtggatgacagaaatgaggacaatgagcagttagaatcagacacaactcaaagcagtgttgacgatcgactccaacaagcagatcaacagtctgtgaaaggatcaatagattcacgaggttctggcatttctgctgatcgcaatttggttcggtcgacggttattgcacctggatatgtgcctagtgatgctgatgagagaattattgttgagcttccatcgtcgatggtgcgaccattgaaagttgtacgaggaacattccaagtaagtaattgatatttactaaattttgatggtgccatgaccagttcttaaaaaaaaataatcagaaagtgaactttaattttattacaacttggctcatccacgatctgtcatactgatgtgttctgatagactccagaatgtcaattt

SEQ ID NO: 83970 - DNA, 582 bp, Oryza sativa
tgcattgcagatcttgctgaaagttggaagtacaggagccgcttgtggtatggcgttggaatcccatccaaatctgatacatttggtggcggtggaagtggttgggaattttggaaatctgttctggagaaggactcaaatgggacttgggttgaccttccacttgtgaagaaatcagttgcagtgctgcaggcattgctgttagatgattctggacttggtggtggtctaggtattggagggggctccggccctggtatgggagttatgactgcactttatcagttgctggatagcgaccagccattcctttgcatgctcagaatgactcttgtttcaatgagggaggatgacaatggtgaaggtgatgccttcacaggcaacatcagcataaaagatgtcatatcggaagggttgggccatcaagctggaagcatgatgccacttgacagcaacaatcgctcatctacaaggaaaccccgatctgcacttctgtggaggtatgcactatgcaccatcaagtatcatcagttaaaatcaaagttagtggtatgtgtttaactgcaggataaaaaatggaag

SEQ ID NO: 83971 - DNA, 601 bp, Oryza sativa
agaaaaagtagaaactaaacaagtcccattctagattaattattttgagatagagtcagttactacagctgatctggatgacaaccactcggcaggtgttgatttggagtaaccatcgttccatcgtaggtggtaggcctgcatagttaactgatggcatcccaatccaagctcaacagttggtgcggggtgtttggatggggctaaattttttttagtctgtgtcacatcagatgtgtagacactaatttggagtattaaatatagattaataaaaaataataatttcataaatgagagctaatccgtgagacgaattttttaagcctaattaattcataattagcaaatgtttaatgtagcatcacatagactaatcatggattaattagactcaatagatttgtctagcgaattagtccaaggttatagattatgttttataattaattcatatttaatactctaaattaatatttaaacatcttatgatacgaactaaattttagtccatctaaaccacaaacttgcggagggcctgtttgtttcacggcgactggggaggcaagcttgaccagcaatatatagctgctcatttcgg

SEQ ID NO: 83972 - DNA, 611 bp, Oryza sativa
acatgtgggcgtaggcctgttaagcagaaagctcctatggtgcttgtcgattgggtgctcgactattggcgcagcggttcaatcatggaaacagttgatccaaggctcagaaatggctatgccgaggaggaggttgagcttgtgctcaagcttggcctgctttgctcgcatccactggctagtgcaagcccgagcatgcgtcaggttgtgcagtacctcaacggcgacagcgatttcccggaactgagggcagcgcaaatgggcttcagcatggcgactctgctgaagaacaaggggcttaacccagatgctatgtcatacgcaatgacatcgtcatcaagcatcggtactatgtctagtactctctcgggaggaaggtgataatatggttttgtgttgacagatgatatttactacaaatgatgtaggagtatgattgtagtagtactagtggcgctaatggaaaattgtactgtaaatctgtaatggacagcaaaattcctggtagactggattcgtggtagacatggaagttttataggagtacaaatcaagactttgctttcgcatgggaaacatccggagtctgattcttagtgtacagtgtatat

SEQ ID NO: 83973 - DNA, 701 bp, Oryza sativa
gtgctgtgtaaacactatagtgtatggaactaaccatagattactcggatataccattagctaatggctaaaacacacaaaaaaactgcgaaggaggaagaaaacatacccataaaagaatgttcgccatccacttttcagcctctgataaatgaaatagatatttgctgcacaagagatggccacctggagagttggcccttcttcagtagggaaaacaagggtaagcactccaagcaatacaaaagttattgctgtctgccaaatcactttactagaaggtgtttgaaatcttccctgaatagccttgactggacgtgactgagtaagttccctatactttttcttgagatccacttttggtttttttctatcagagaaactctgcatgatgattctgtcatgggcagactcaattgcatcaacacttggcttatgccctgcatacttgtttatcagaaaattcctggcagctcgaatttcttcttcagatgcttccctgctgattccaagtcgctgatagggatccttcacatggattctaggaaagatggctgaagaaattaagcggttaaaaagtgaggtgataattacaaaaaagaactaatccaaacaacaaaaccgacaggacaataaaaagtatatgtgatctcaaataaaacatgagaggaacagattgtgagaaaaagtatatgtgatct

SEQ ID NO: 83974 - DNA, 942 bp, Oryza sativa
actgcatcatttgtgctgcaagcatacacacatatagcatggttattacatctaaaagaaccgcggtgtatttatcatgcactggccaataccagtctacaagcaaagcatcagaaatcttcagaaaaaaaaatgtaacagtaaatgcttgacagagaggattttttccccaaatgcattgaaagaaataactttcagcactacgctcctaaaggatgatgctagtacagttacaggtagctttagactgggattctaaaacaaagaattcactgaacttgactccatcaaatccctaacaatgtactacatagcaaaataaagactgaccaaataaaaatcaaaataagcctggttcctactgtcagtgtaatattgcaggaaatactgatgtattcattggtcaataagttagatcctaacttgaaataacagccagactacagcatacaatgattaaacatatagtggaagatatttttgatagcaatggaaatcctcgcccctcatatatgtacagattagagagtaaagatgttgacaaatatcttgcagacttccctgctcatattagtgcgtggatgtttttaacaataagtatctactgaatgaacagtacaaagtagctaatcagtttctgtgattaggctccatgcacaattttccttatatattcttatagcatgttatggaactctctggagctctggtttgtacaaaaatcaacaatgttcaaacacgaaccggaataccgcttgaattactattaggatactggcatataatgatcaacttacaattgatgaaggcaatcattcaactcttttgcttgtttgcggcattgccataccaccgaaaaagttctacctcgagcacactcagcatattttgagcagtagaaatcacactccttaagggccttctgcttcattttgctccgca

SEQ ID NO: 83975 - DNA, 1676 bp, Oryza sativa
gtagtcgtgggtggttagttttaattgtaagctccttctctgtttgctggtgctgtgtggggttttcagatggtgacgaccaggagaaatgttaacaccggtgaaggcaaccaacccgaaggcagcaaccccaaccaccaaggcaattcacctccaccaccaccaccagacaccaacgccattctcacccagatcctcgcccaacaagccaacatgatgactgctttcttccaccacctccaaaatccaccacaacagaatgctccaccaccccctccccaacactccaaactcgccgaattcctccgcatccgcccacccaccttttctagctccaacaaccctgtggatgcgttggattggttgcatgccgtggggaagaagctggacactgtgcagtgcagtgatgaagagaaagtcatcttcgccgcccatcagctgcaggggcccgcatccctatggtgggaccacttccaggctacgcagccagcgggacagccgatcacttgggcccacttcaccgccgctttccggagaacccatgtgcccgccggagtcgtggctcttaagaaaagggaattccgagagttgaagcaaggcaaccgctccgtgatggagtatttgcacgagttcaacaatctggcccggtacgctccggaggatgtgcgggaagatgaggagaagcaagagaagttcttggcaggaatggaccctgagctgtccgttcgtctagtctctggggactatcctgattttcaacgactggtggacaagagcatccgcttggaagccaagcacaaggagctggaatcgcacaagcgccgcttggcgaatttccgcaatcagcagggtgctaaccagagggtccgctacaccaatccctacccagggggatcctcctcgcagcagcaacaacagcagcagcaacctcgcccagcgccccgacctcaattcgtggtgcgcgtcccacagccgcagcaacagcagaatcagcaagggactcgtgcgccccgtcctcctacgccagctgggcagcccgttcaaggccgcagggacgcttcaggtccgcagcggctgtgcttcaactgcttcgagcccggacactttgcggataaatgcccaaagccaaggcgtcagcaaggccaagcgcctccccgctccaacaacggcgggaaggatgtcattcggggtcgtgtgaatcacgtgacggccgaggacgtgctgacaactccagacgtcatcgttggtacgttcctcgttcattccatccctgctacaattttgttcgactctagagcttcccactcgtttatatctgtgccattcgtggggagaaatcagttgggggtagaaaggcttagaaaccctctgcttatcaccacccctggaggggttatgacagcaaagtattatagccctgccgtccctatagaaattcaggggattccttttccctcggatctgattcttctagacacaaagaacttggatgtgatccttggatgaattggctggcacaattccaaggagtagtggattgcgcgagacgcactgttactctgtaccgaggaccagaacaaccggttgttttctttgcacctccaacctctgtcagaagttcagaactgcatcagataggtctgtcagaaatccccatcgtcagagagttcggagac

SEQ ID NO: 83976 - DNA, 1243 bp, Oryza sativa
agctcggtacccaaacaagtaccctcttccccggatcgatgatctgttcgatcagcttaaaggtgccactgtattctccaagattgatcttcgttccggatatcaccaattacgtattcgtgaagaagatattccgaagaccgcattcaccacgcgatacgggctgtatgaattcacggtatgtcgttcggcttgaccaatgctcctgccttcttcatgaacttaatgaacaaagtgttcatggaatacttggataagttcgttgtggttttcatcgatgacattctgatatactcacaatcagaggaagaccatcagcaccatctccgtctggtgttgggaaagttgcggaaacatcaattgtatgccaagcttagcaagtgtgagttctggttgtccgaagtcaaattcttggggcacgtgatatctgctaaaggagttgctgtggaccccgaaacagtgaccgccgtcaccgattggaagcaacccaagacagtcactcagattcgcagtttcttgggtttggcaggatactaccggaggttcatcgagaacttctccaaaatcgctcgacccatgacacagttgttgaaaaaagaagagaagtttgtgtggagcccgcaatgggagaaggcgttccaaaccctcaaggaaaagctggtttcctcgccagtgttaatcttgccggatactcgcaaggacttcatggtgtattgtagtgcttccgccaaggattggggtgcgtgctcatgcaggacggtcatgtggtagcctatgcttcacgtcagctacgacctcatgaaggcaactaccctacgcacgacttgaagttagcagcggtggttcatgctctaaaaatctggcggcactatctcattgggaaccccgctgtgaaatatatactgatcataagagtttgaaatacatcttcactcagtcagatctgaaccttcggcaaaggagatggttagaactcatcaaggattatgatgtgggaatacactatcatcctggtaaggccaacgtggttgccgacgctctaagtcgaaagagccactgcaacactctcaacgtccgaggcattccacccgagcttaatcaacagatggaagccctgaacctaagcatagttggtcgcggattcttggctgcgttggaagccaagcccaccttgctcgatcaaatccgcgaggctcagaagaatgatccggacatgcatggactcctcaagaatatgaaacag

SEQ ID NO: 83977 - DNA, 849 bp, Oryza sativa
tagtgacttcaacaataccggaggttttgttgaagacacgataggcatgtgcatttgattcatagccaagtaagaatccctcatccaccttaggtgagaatttagatgagcaaggcctcttacttaaaataaaacatttgctcccaaagacacgaaaatatgaaacattaggcttcttaccactcaagagttcatatgaagttttctttaggatcttgtggaggtacaagcggttgatggcatgacatgcggtactcacggcctccgcccaaaagacatccgaagtcttgtactcatcaagcattgcccttgcggcttcaatgagggttcggttcttcctctcaacaatgccattttggggaggatcataaggggcggagaactcgtgcttgattccttcttcatcaagaaattcctccacttgagtgttcttgaattctcctccattgtcgcttcgcaccctcttgatagtgagatcatagaggttttgggcttgctttgcaaagcgcttaaagacatcttgagctttgcttttgtcatggagaaagtacacccaagtgaagcgtgaaaaatcatcaacaatgacaaaaacatacttgttacctccaatacttatgtaagccacgggcccaaataaatccatatgtaaaagctcaagagggcgtgttgtagtcatgatgttcttgataggatgtggattcccaacttgtttccctgcttggcaagcactacacacacgatctttctcaaatgtgacattagtgagcccgaggatgtgttccccctttagaagagttgccaaattctgcattccaacatgggctagtctatgatgccatagccaaccca

SEQ ID NO: 83978 - DNA, 2266 bp, Oryza sativa
aaaatcatactgtataacagttcaagaagcatactcattaatccattcatcaaaatggaacaagcagggcagaatgaaggtgtctgatggtatagtaacagaggagcaagcactggacatatgatcaaatcaagatgctttcaaattccaattcagaaaatagagatgtgtacaggggaagggggaatggagcatactgcatacacaccgtcaagctagacaaactgacagaacctaacagacacgcatgaaacttataggaagctagctaaactctaccggtagctgcacatcgatccaacattttcgtcatcatcattggcaaacacgcatagacccacttctttattgtaaccaactgactagcttcatcgcgttctttatctgcatattttttattcttcagtaactcaaaagtttggtccagcagcgaggatcttgtctgtcaggctgctgtctcccccgatcttgtagttggcgaacacctcgaagttcttcttgaacaggccagccagcttcaggagcgtctccttgtacgcgcccttgtccgtccactgcacagaggccacatttccgacgaagaacaactcagactctgcattttttacatgtatagcagaaatggcatgaactgatgcgtgatgctacggagcttacggtgttgatcgggtcgaggatttcagaggggatgccgtcgatttcagtggggatctccaggccaaacacctccgtcttcttgtagttggcggagaggagctcaccggagtggatggcgtcgatgatcttcctggtatacggcagcctgatccgcttgccaactccgtacctgaacagtgaattcagagttagttcatgccacaggtaaatgtgcaatggtgtggacgctgttacagtggacagtagcagataccttccaccggaccaaccggtgttgacgagccacccggtggcgccatacttctgcatcttctcggcgagcatggcggcgtacttggtcgggtggagcatgatgaacgctgcaccgaagcaagcagagaacgtagcctgcggctccttgatgccatcctccgtgccggcaacctgttgaaatggcaatgcaataacgaagattcaggctaaattcctttgttgatcatcaaggtgataggaaggtaaggcaggtgactctgcttctgaacaaaaattgtttaccagagcagtgtagccactgatgaagtggtacatggtctgtggaaggtttagcttgctgacaggagggaggacgccgaaagcgtcgcatgccaggagaatgacgttcttcgggtgtggcccgacgcacggtatcttggcgttggggatgtactcgatagggtaagcagcgcgcgtgttctctgcagaaaagttcagagttgtgagatttccattttttgttttttgctgtaacttttgtgactgactgaaaccggattgcgctttggagataacttaccggtgacagatttgtcggtgtaatcaacttcacgggtgtgctcatcaaagacgacattctccaacactgcagacgccaaacattttcgatcaatgaaatggcaagcgggagaaactagaatgatcgactaaattaaactgaaggttcaggcaacttccggtcccaaacttgatggcattccaaatatcgggctttttctcctgtgacaagtcaatgcacttggcatagcaaccaccctcgatgttggacacgccagtgtcactccagcagtgctcatcgtcgccgatcagcagcctgttgtggtcagtagacagagtattctttccagtacctgccgattaaaataacacatactcaaaatcggccaaaaggatgacagtaaacaacaagggcactaacaacacaaattcttcagtgaaacaggcatcatgcacacagcatcttaagatctcaaacagatatgatgtatgcagttattatatatatggggatcaaggggaacgcgtcagatgagactgacaggtgacggcaccacgggtgttttttcatttcatccaccgtggagagccatcttattacctgacagtccaaagaagagggcgacgtcgccctgcttgcccatgttgcttcccgagtgcagggagaggatgcccctcctgggcatgaggtagtgcatcaccccgaagagccccttcttaatctacccagcgtactgcgtgccgaggatcaccatatccctcctagcgaggttgatgtctacgctcgccgacgacgtcatgttttgcgtgttccggttgc

SEQ ID NO: 83979 - DNA, 3732 bp, Oryza sativa
  unsure (1)..(3732): unsure at all n locations
catgttgatatttatttctaggtattacgttgtgcatctgagaaagtatttgtgccacttacagttggtggaggtataagagacttcacagatgcaaatgggaggtcagttccatttatgttcatgagtaccatggatcgaaatgtttttcttctgccaagcaatcccttctcttactgacttgatgagatagttttttctgcaaatgattcccaaagtaccttttccttctctaggcagacttttttttttttgtattccatctttcttacgaattaagatagcctgtattttatttctttttcgtttttttccctgcaacctctgcatatttatgttctgatgttcaatcttacaaccttaagtgcctctcccccatctttttgaggtgttatttgttgtttgtcaatagtcaatactgagaaggaaaaggacagacagagtaattatgtattcttcccttgtcagatactactcaagtttggaagtagcgtcagagtacttcaggtctggtgctgacaagatttcaattggtagtgatgccgtttttgctgctgaagcctatttgcagactggtgtatgtattttatttttccatacaatcttcatctatttcccaattatacagttctttttgtgtatcaggtaaagacaggaaaaagcagcttggagcaaatctctagagtatatggcaaccaggttttccacgagaaatccagttacaatttgtttattaccgtatacaaccaaaacattatttttagtattcatgttagcagctaatcttcataatatatggaaaacattcctcctttttttcttcctaaaaaatatcacaaaaaagtttttgttcttccatccatgtgccactaatttcagaggtgtatccattgttgggaactctgctatttatattgaattggtgactgataagttttttgaataaaaacatataatgtatcttctgcatttgctcaagatacttggtgtgattacttatgttcaaccttgttatatagcattcaccttagtcattggtataccatatatctattcatgtcctactattatagttattaacctgtcaatcactaattgcagtgatgatatttctcttattaggcagttgttgtaagtattgaccctcgaagagtatatgtcaagaatccggaagaggtgcaattcaaaactgtaaaggtgtccaataaaggtgcaattcaaccactcatcctgaatctccatttgcatttcaagcattaagatctcatgtacttttttcaggtccattaggagaagaatatgcatggtaccagtgcacagtaagccatttgttttccatttactgctaatttcgcgttactctcttatccatgcacataaggggtatttttgtatattcatatgaaaagtttttcccagtacgcaggaatattattacccaaaacgcccataccaaatttcagactgattaaaacatgtgctttcttcagatatttggtgtactaccttttaggcaacattaaatgactttatgctggcataatctactgtggcatgctgtcctttaataagattgctcttttgttccaacaagtgttgtttatgtcttttccaggtaagtggtgggcgtgacagccgtcctataggagcatatgaactagccaaagcagttgaagaattgggtgctggagaaatacttcttaattgcattgattgtgatggtatgttcatggttttgaacagttcaatattatgctttgcctgatttttatttacgcaatatttgtagattttctgctaagtaatagcaaagtggaacccactaacaataaccagaacattctagttatgtttttctttcaagaatccaagttttccttttaagcgtacaatcacagtaaactttgtcgtcattaatagcccagtggtaatcacacatgcatatttgactattggtagcagtttgaccatgtatgtacaccnctaanagtntcggttaggggtggttttttgccagttgactttatttttcactgtctccattactcatgttaagaggtactccctccatcccataatataaggcatggtcaaacttggcacagtcttcaaaactaatctttgacttataatttatcatatgctataacatttattgcagcaacattataaccatcttaaagtaaatttaaatgtcaatccaatgatattaattttaacaaataaaatttaatttatattataataattgttggtcaaatgtttttaaagttgaatcttggaatatgtgcacgtcttatattatgggatagagggagtataaaaaacaggtgaataaagacaagacgaatgccaatatgccatgatgttgttttatttttcaggccagggctgcggatttgacatagatctggtaaaaatggtgtcagatgctgtgactatccctgtcattgcaagcagtggtgctggtactgtcgaacatttttctgaggtctttgagaaaacaaatgcttctgctgcccttgctgctggcattttccatcggaaagaggtattgtcccgccttgtactttttattcagcatgctatgcctggagctctacatgataatcctttattccctttcttgcaagttctggaaaactttgacctagcttacgttatttgcatttgctcagcagtgttagtctgttctatatgatcaacagagctacgtgctcagttaataatacttgcccacgttatgttagaatctttgttcacgttccatagtacctgtatagtaagattatttagggttgttggacgtaactgagcgcttctgctttatcacaggttccgatttcagcagtgaaagagcatctggtagatgctggcgtggaggtcaaagtgtaggatggaaatcctttgatctattgggaaaataaatcagggctttgtaacagttgtgtgttctattttgggaataagatggtaattcataggccatggattggaaatgcaatttcgtaataaattgtttgaaatcttctgtttgattttttttctgcctgtatattactttttgtcttttcttatatcagacaaagctagaaaaactaattcagtcccaattagttgctactcatgcaaacaaatttggattctgtttggtttactgcaaatattgacaagatagtctggtaacatcaatattgtgtgacgaagcaaagtggacgaaatgatccatttcaataatccggtgaatgatctgaaaaggaaaacgctcgagaaccccaacctttaaccagtagtccacaatgtggaatttgcacgagcctttgaaaatactggcagtgccaagggccacaataaagaaacatatttaatcagaacaaccagtctatctggacctgaccaaggattataatacagctagctgctctgtatagatttttatagcccatctctcaattcacttgtacagtgggtaactcttcactataaatatatggtctacctatctgtttacaagattttcttgggtcatgtgtctaagccagctgtaatctaacaacccgcttttatctctcctctcctctctcatccacctcagcattcaacctttttatagccctctattatacttgctcttaggctgtgttcgagaggcctcacttcccgcacacgcaaaacggagagacgtattttcttatgattaattaaatatttacttttttgaaaaatggattt

SEQ ID NO: 83980 - DNA, 546 bp, Oryza sativa
aaccacaatattgcaaaagatagtgattcggttagtgagatgtgtggttgtaccggtacacccccaacacataggggagccgtttgggctcaatttttttggttcatatctttcttataaaaaacacacgggtcctcatggatattcatgttctttttttaactgtgactagtcaatactagtattcccagacggcaaacatacttcaatttaacatagctgccattgacaggcatacatgtggcagtaaataagtacagctagctgctgacagtacactcccatactcatcaataggagcatcgtagtcgtagctcgtggcgatgaatggccctcccgtgcttcgtccgaagttggtccccccgtggtactgcaagccaacaaaaaaccagtgttagaatcgcagagcgcctctgtttacccaagcgaattggcaaaacggcggtaaaaaaggaaaacaaaaaagaaaacgtctcgtcttcgcgcgcgagctgcttaccatgtaatagttctggaacgtccgccgcgctggtagaatcgcgcgac

SEQ ID NO: 83981 - DNA, 1453 bp, Oryza sativa
caagtatccagctatatattatggtattgtgctgttggaagagttccagacatatactttagaagcactgaattatttttccctttgtgattctaccttatctctttgctctcctttttgtctcaataactaactactcctttgatggtggaccaacaatgggaaattgagttttgttagggtaataatgcaaataagtgatattgcttactcttttagcttttacttgtcatcccgcttgtcttcattgcaacaattaaatatatatatcttctgttatgctaatatggtatcaaaagctatagaaggtttttcccattttctcctgccccaacattttcttgaacttcccttccactcccattaggattagtagtggatagaagtgcttgtgaagttaaaataaaagcacacttccataatcattcctggaattttttggttcttccattgcatgattggtgaattttccagttgcttctgtattgtactgtttagagtttgtctcttatctttggttaacatatttaaaaatatcaaatcaagaacagttggaaactttaagagaagatatcaaacagcttttacactgttgttaaattttgagatatttcttttaattcgaaattttcaactaggactcttattgagaagcttgagaacagcaagacagatctccaatctaaaattactaaggaggtacagacttttccctggaatcaatgagagattctgtagcattaaatacttacacatgaggtgatgtgctgtctatttcaggcgaaagaaaattcaatcctacaagcaagtctcgaaagaaggaaagtagaattgcataaacgccgattagcactcgaaaaaaagtaagagctcaaactatgggaaaagtattatatttttttctagaaagagaacgcccaggtagattttatgatttagtctctacatccataagaaatccttaaatctatgtcaagcacaccagaaattttatacatcttaatatctgcctgaaacatgcattctctgttcactgttaaacaagaaaatgtttttgctgtttctgcactcaacaggtggaaaatttgcgagatcagctacagaaggagagaaatttgagggtctcattggagtcagggctgatgaatttgcgaagagggcaggcgtccttcccatcaacaattgacaacaaggttttctttttaaaattttattattgagttaaagtgcaagtgttttttcaccatttgaaaaaaaaattgttctgctaataaaagactaaggctgatcttgaggaagttgctactgctgaagctgatattttgaacttgaaacaaaagggttctgatctccgtggacaactcaacaaccaggtccagatgagctccgcctcattatgtgactcatgcaacaaacgactgctaaatacagacaagctaaccgagtaaggatt

SEQ ID NO: 83982 - DNA, 2538 bp, Oryza sativa
  unsure (1)..(2538): unsure at all n locations
ctcattgcattattatcactggaggtagaatctgacaaggtcttgataggttctgtatttggggcctcttgatatagatatacgctatttctggtcatcataaaattattttaacacctgacaaacacagtaatcattttggtctttgagcactaaatatagaaatcgaattataattgtagaatattcagaaataggaaacccgaacctttgaatgaggatttttttttagaaaatatccgtacctgatcagcattcatacaccccagcaatagcattctggcttggtcataatttaagcacctatgcctacacagtttatggaaaaagaaaaaagaaatacgcggacctgaatgtgaagcggaatgcttatttttttcacatactattagttgtatatgaaagtgaaaaaacaaacactgaggctactactggctgtcagtgtagccatgtcgaagcggatagacttgaatcacatgattaaaagaactacttaagcatattatttttcgttcataataatgtacgtttcagattgttattgaaatatcatgagggttggttacttgatttgataatattcaaaatgaaaaagattaaggtatttataaccatgataactcatcccaaatttctgctttaatttcagaatgcacctcccagaggaaatgaaccgattgttacactaggtggaattgacttgaataactccggaaggtatgcattgagaaattaatgtttgtttaaaggctatagttcctgtaatctgataaacatattcttgagctatgatttcagtgttgtggtcaaagaagacaagaaacttttaacagtgttatttcctgatggccgcgatgggcgaactttcactctcaaggttggtcgcacacctgtttcatttttaatatactgttggcgttcatctgcagtatgtactgctaccattgggtggcagcgattaatgcagcaataaagacgagggaagagagaggggatgatcatctccggcagaccaactgtttggttgagattagatcatgcaattacaaggagttgttccattcatgtttgacacacctgccttttatcgaactgtaatggaatgattttcattgagcaggcagaaactacagaagaactcaatgaatggagaagtgcactagagaatgctctggcacaggcacctgnngnancaagtgatgttggtgcaaaatccaattttcagcactgacatancannacctgctgaagctccagctgaacagtgtaagttaagataactttcatcagttgcccacgatctaaagtactagattcagctagggggttgggaaccctacattctactgaacaggcaaatcctatcgtttccattgcagcggacaataaatctatcattggcagacctgcagagtttgcccttgtagatgctgatggtagtccagctttcctggagaaggccttaaagttcattgaagattatggtgagtgttttttttttcaaattttaatttcatgctatcctggtgaatatcagtaacagtcaaatagaagtatgatatttatctaaaaaacaataactcattgtatgtatatttattaatctgtagtttagtgacgagcagaaacatactctgtttgtaggtgtcaaggtggaaggaatcctacgtcagtctgctgatgttgaagaagtcaaacgaagagttcgggactatgaaaagggtgattctctctctctctccctctctctctctctctctctctaacaagagctgtactctaatcaaataataaaatgtttattcatgactcctgaggatatttatgtcacttgtaagccgttaagcatagataacagatccttgaatttcctatgtcctgttcacatgataaataataccatttaaatcactaatgtgatcttatagggaaaaatgagttctccccagaagaggatgcacatgttattggtgactgcatcaaggtaatctttttttgccaaacgttgactacatagtgacaacatagagttaccacattcttcagtaacatatcttcagttcttctttgctacagtatgttcttcgagagatgccttcatctccagttcctgcaccatgttgcactgcactggttggagcttaccgtaagattgacttcaatttttctttatatattacttcttttttcgccgggccggcgtaagatacgcggccgaagtttattaagattgagaagaggttcaaactagtacaacagatacagctgccatggaggctaagagctgtacaaccgctattgttacaacgatgcacattactttacagcaaaaacaggcactctaagccacaactccggctaaaaacaccatccacattactttatatattacttcaacaatcaatcaatgtagtcttgcatttaactgatgcataagtaaatcttctaaagtcagctcagcgcatgcccttaacctgaaaacatgctgatgttcctaggattacaaactgatatagacgtgtgattgtacaggaactg

SEQ ID NO: 83983 - DNA, 1045 bp, Oryza sativa
aaaattactgacacggtcactgaacttgagagtcgtatatcaccttgtcaagggagttgaggtagtcgacggccctctccctgttggtgaggaaagtggctcgccatctcgatgttgggcgaacccctgcagtaggagagacacagggcaaaaaacaaggatcagtcgtgcaatcacagcagagcctgcaaacagagctttgacatgcacaatgagtagcgggaactacttgcccaccaagctctgccggaggcctatcttgacatgccttgtcctcgcgaccggcggcttgggccggcagcgtcgcagcgcgccggtggactgataacgaccccttctcgtacttgatcgcctgctcgtacagctctgctcgcccacatcccaacagaaaacacgtcacttacacatgtacgagttataatccctgaacaaaaattacagccgttctggcgtcgcgtcgcgtaccagcaggcgagaggttgtagagcacatgggtgaacttgagggagctgtcgctgacggcgatggtcggggtgacgtgcgggtggtggtggtgcaccggctgcgggtgcggcgacggcgcgcccttcgccgcggcctcgcccttcctcgccggatctcccctgacgaccttcggcccggtctcacgcgtcagcgacgccaacgacgcgctgcatcagacgtcatcgtgacagggatcgttccatcagttaattaccactttatcaggtcaaaataataataataagaacatccaaagaaaatcagcacttgctcagttgcttgctaccactgctaaacttactcctaaataaaagtaagaccatgtctcaatgaactcattgtgtctagttagtccgaatagaatactgtgtcgagcggcttgtgtagaacgatacgaggtttcctctaatttcttgggggaaattcaggcgcaagttacgcgacgggaacagctaccgacgccgccgcgtcaggctgatgaggagattatcgggtatccccgcggcgcatgttggcgccccaaattgcgctcgcgttcgtt

SEQ ID NO: 83984 - DNA, 1091 bp, Oryza sativa
actcccacccggaggtttcgcccggtttgtccggatgttccgggtccctggcagctcacaagaccagtcacctcacttgcttgtggagctttaccttctcgcacaaacatcaagcattctttcccatttaccatcacacgcttagacacaggacttctacccgaaaacccgaacccgtgtccatccttgttaggatgagcggtgatggtcttgtaaagggcatcttttgaatggtatgtcttgatgcatccatatttcaccaaagtgcacaacttttcattctctttcttaagagcttgcatagcatcaatattagtagcataagagttcaaatcaatattgtaacacctagcacaccattgctagtagaagggttagaagaattagaaaccacatttggttgagaggtgctattccaaagagtgtcaaattgaacttcaagatctttatgacttttgtctaaattagcaaatttttcttgaagagtttcattaacatccctaaggctagctaaagaaccattagccaaattaagctcattagcaagttgtttatttttagcacattctttagctaagctctcctctaagacaaggtttctttttttctcaagaataagcaattcttcttgcctttcgagtgattgttctttactatccaaagctctcattaacttagccaaatgttgcatagcgggtttgctaaagctcttaagcacatcatctaattcattatcactttcctcatcactagaatcaacatcaagagaagtttgagagggcttttgagtcatcaccttgcggccttgggccatgaagcaagagtagtggtaggagtcgtcgtcgtcatcactcaagttgttgaagagacgctccttgcttgaagaggatgatttgaaggcgacggtagcaacaccaccttctccttcaaccttgtcttttgacttgggcttgggcttgacctcgggatcttcttcatctccgaagtaccacacttccgccatgtgtgcctccgccacatgagcacgctccggcttcttcttgcctcccttagcgttagcttcatttgacttgggacaatcggcaatgaag

SEQ ID NO: 83985 - DNA, 574 bp, Oryza sativa
ccctgctctcaacccatctaagctgcctgtgttgccaaaactagagcagaggcaccatcgatctgaaattttggtggttgtgctgccgatagccacggctgctcttgtcattggattgcttcttgtggggttcatgattgtcaagagatggtttaggcatgccgagctgagagaagattggaaggttgagtttggaccacaaaggttttcttacaaagatctgttcgatgccacacaagggtttgggagcaagcgtttgcttggaattggaggattcgggagagtgtacagaggagttctctctgtatccaactctaactcagagattgcggtgaagagagtgtcacatgactctaggcaaggggtgaaggaattcattgcagaggttgtcagcatggggcgccttcggcacaagaatctagttcagctacttggctattgccgacgcaagggtgaacttctcttggtctatgaatacatgtcaaatggtagcctcgacaagcacttacatgacaagaacaatcctgttctagactggaacacaaggtttcacatcatcaaagggattgcatct

SEQ ID NO: 83986 - DNA, 1003 bp, Oryza sativa
  unsure (1)..(1003): unsure at all n locations
aacccctctcgtgctcccctttgaaccggtgaactccctctcgatcgaatcgctgcgtcgtgctccagtgaaaccccgccgtcggccaccgttggttggagctcctgttcttcttcctcctctctcccggcccgcgtggctgccacgtaggcgccacgtcggcgccacctcgacgcgaccgggtcaaagctgacctcggtcagccgcctccctccgtcccccaccctcgcgcgcggtccacggagagccaacatgctgcgcgtgggcccgccgcacaccgggtccacccgcgggccgcgcgtggaccgcttcccccccgaaccctagcgccaccctcgcatgcgcccatcccaccgtgggccgtatcaccgacaagtgggccccaccgggcccccgcgcggtggaatcggtccaccgggccgtctctctctcccccgcgccccctctgttgggccgcctccccgtggccgcgcccggcccaatggctcggccgagcctccttcaaccctttgggccgcaccaatgccacccgagaaaagtccaaatcacaatcccttcctttttcctttattttcaagggatttaataaatcttttctttgttcataaataaaattctttattccaaaattctatgaatcattttcctttggtcccccacctcggagactgncaataatattcttgagaatattatttctataaattccataaaccatttctcgtcttccagaaattccaattaaacttccaaaattcatatcttcccaaccgctcttgcgattgactccgttcaacttctagtaattccgtaaaattgagatctatttaatggcactattattcaagtctaaatagggtctttttcttggtcttttgtttaggtttttgtttgtttgcgtatagttgcggttaccggattttcgccgatcgcgggttttctcgaagattcctgaagctccgtgaagaccttgagcaagacaagtcaccccttcaaccaattg

SEQ ID NO: 83987 - DNA, 600 bp, Oryza sativa
gacccgaaggtacacaaaatcatccactgcgaattccagatcacggcgtcggttatctgcataacttttctgccgggactgtgccacctttagattatcccgaatgattctgactttagcttcagcttctctcaggatatcagtcccgaacacttggctttctccaacttggtcccacaatagcggtgtccggcatttgcgcccgtacaacgcttcatatggtgccatttgtatgctggcttgatagctgttattgtaggagaactcggcataggggagactcttatcccaagtcttcccgaagtccaggacacatgcgcgaagcatatcttctaagatctgatttagacgctcggtctgtccatctgtctgcgggtgatacgcggtgctgaaatttagtcgggtaccaagctcttcttggagcttcttccaaaagtgagaggtgaattggcttcccctatcagatacgattttcttgggaacgccatggagactcacgatcctagcgaagtagagctccgctagtttattccctccataggtggtcttcacaggaatgaatcgagctacctttgttagtcgatccacaattacccatat

SEQ ID NO: 83988 - DNA, 678 bp, Oryza sativa
gtcacctttcttcaaaataataaagatatctttgcgtggaaaccatctgatatgcctggtattcctagagaggggattgagcactccttacatgtcaaagaagacgctaaacctattaaacaacgactccgccgcttcgcacaagacaggaaagacgcgatcaaggaggaattaaccaagctgttagcagcaggcttcatcaaagaagtccttcatcccgactggctggctaacccgggtctagttcggaagaaaactgggcaatggcgcatgtgtgtcgattataccgacctcaacaagtcttgccctaaagatccttttgggttgcctcgcattaaccaggtagtcgactcgaccgccggctgtagctactcagttttttggattgctactcagggtatcatcagatccgactgaaggaatccgactgcttgaagacttcattcatcacgccctttggggcctattgctacatcaccatgccattcggactaaaaaatgcaggagcaacttatcaacgtatgattcagagatgcttctcgatgcaaattggccgcaatgtcgaagcttacgtggatgatgtagtcgttaagactaagcagaaggatgatttaatctcagatctagaagaaacctttgcaagcatccgcgctttcaggatgaaactaaaccctgaaa

SEQ ID NO: 83989 - DNA, 2221 bp, Oryza sativa
ttcggaacacattgatatccaggaggacctaacatatgtggagaagccggttcgtatacttgataccagcgaaaggagaaccagaaacaaggtcacccggttttgccgagttcagtggagtcatcattcggaagaggaagcaacctgggaaagggaagatgagttgaaagccgcccatccgcacctcttcaccagctcctccgaatctcggggccgagattccgtttaaggggggtaggtttgtcacaccccgaagttttcctcccaagccaaaattgtaatttttataaatgaccctaagaaaatgcaggtgaaatcaggagaaaaccctaagaaagtaatgcaaataataatcggatttgacatgtggaatttttcttgagttctacatgtcgaaattcattaacaggatttttagtggaattttcagagctctagaaataattttaaccaattaaaattgagcaagcaatattttaattccagggaaaatcctttttcctttttctttttctttttcctctctttttcctccttttttttcgaatgggccgccggcccattccctccttcctcccctcctccttgctgggccggccgcaggccgaggcccagccaggccgccctgccgcctcctctctcggggtcgccgacaggtggggcccacctgtcggtccttcccccacctcccgccgatctcgctcgcgccgtcgcgcccgcaaccgccgccgcgccctcgtctccgcctcctccgggccacgtcgaccacgcccgcgcgtgcgccgcgtctcccgcgcccactcctctccctctcccgctcgcgcctgcgcccgagatcgccgggattcgattttcgaatcccgcctctctctcctcccccactccccacgtcggccggcgattcccgcctctctcggccagtccggttccctctccccctttttaagcatcgccgtcgtcccctctcactttttccccatttcgccacactctctcgagcctcccatcgctcccgcgccgtgcaaccccttgccgccgccttttccgctactccggccgccgctagccgccgttagggtcgccgccaggccgcgccgtcgccgccgtcgggttcgcgtggccgagatccaccccgtccacccctcctccgtcgaggttcgtcgccggagcctcgttccctcgcattcgggtgagcaccacctccaccgccgccttcggccatggtttccggtcgccgtggtccatctccctctctctaatccctctcttctccttccttagggcaccccgaagctcgtccgcccgccgacgtcgtcctcccgtggcttgccgtcgccgttcgccatcgtcttcctccgcgccggccaccctcggtgaggcaccccctccctttttttttcccctccctctccctcctagccgccgctttagcgccgccgcccgttagtcgtcgctttagcatcaccgcccttcggcgccttgcgccgccgtctccgccggcggttgccgtcgtcggcaacgcgcgtgcgcgtgcgcgcaccgtcgccatgaccgctcggccggctttgtgccgagccgagcctagcctggccgccgccgcaccgtccgatcggccccgggccgatccgggccgtcgatcccgtggaccggcggtggatcacccgcgtggtcccggtccacggtagaccggccacccgtgcgccgctgacatgcgggccccgcttgtcggcgccgcaccccccccctccgtgctgacgtcagccctggaatatattgcgcaataaatgatttaaggtttttcttttatagtaataaacacagtgaatcttctaaaattcataactaattcatccgagctccgtttaagcccattcaagtctcagtaaatcaagaaaaatgtgtagaatacattaaaaatggttttgttccctgtttcagtagtcttatagcctgtttgcaatgtttgctttgtatgtcgctagattccgattcctccgacgctccggtgtactttgagatagtcaccgaggttcctccagcagcagagcaaggcaagtcatgcttgtcacttgaacatgttgatcctatagtgcaaatgctctattgttttctttcaaatattgcattgttttataatattactatgggatggttacctattgttacagccatgtttttggatatcttgctcctttgttagcttggggttatagcatgatta

SEQ ID NO: 83990 - DNA, 661 bp, Oryza sativa
  unsure (1)..(661): unsure at all n locations
aatccacttggagaatttggcaatggccacaaagagatgcctgtaaccgcccactgtctttttgaacgggccaaccatgtcgagcccccaaaccgcaacggcaaaaacgtgggaatggttggcactcttgaactggtaaaaggatntggctgggcgaaaatgggcaaccttcgcacgtgcgcacaatnttgtcggcgtcggacactgcagtaggccagaaaaaaccctgccggtaagctttgccgacaatggtgcgtgcggcggcatggtttccgcatattccagaatgtatgtctttcaacaattgtctcccttcctctagagatacgcacggttgcagaattcctgaagggcttttcttgtatagctcggcttcatgaataacataaagtctgcttcgccttgaaatccgctcggcttcatctttatctttggggagttcttgagaagtcaaaaatcatatgaggggctctctccagtcggcttcaatcatagctatgttatgagtgtccgcaacttgagttgtttctttctgaggtacggcggctcataaaggtgttcgacgaatacatcggagggcgccgactcgcgcttggatccaaagtggcaagtctgtctgcggcttcattgctgtgtctgagaacgtgactaacctcaagtc

SEQ ID NO: 83991 - DNA, 591 bp, Oryza sativa
tgagcacgagtgaccttatttcaagttaagattcttcagaaggaaaaacggcacagacacaacctttaggaaattgaaaccgcttttattgaaatgctgaaataagaaaagtaagactgtgcatgtgtggtagcccccggctaaccctgcacacccgaggggggtgcggggttagcccgagcccgaaacctgacacccgacccccccttcccctcaggggtagaagcgacgaaggtgctcgatgttccacgggttcggcagttcagtgccgtcgcccgtggccagccgtacggagcccggccgggggacgccgatcactcgatacgggccctcccacattggtgagagcttgctcagtccagcacgcgtttggacgcggcgtaggacgaggtcgtcaacgcagagtgatcgggcccggacgtggcgctgatggtagcgccgcaggctctgctggtagcgcgcagctcggagggccgcgcgccgccttcgctcttccaagtagtcgaggtcatctctacgaagctgatcttgatcagcctcgcagtacatggtggcccgaggagacctcaggggtaccgagctcgaattcgc

SEQ ID NO: 83992 - DNA, 1087 bp, Oryza sativa
ccctgaaaaagttgttgcggcaactccaacgagaaagaataagcacaaaaaagtagtaagagatcgtttggggacgagcctcctactcctagaatgtattttccgacgagtttagatatactcttggagagacaataacatgatcacttttggacacaattatgtgtacttctgctctccttggattagagagactgatcccaactggccttggccaggaaaaacgaagaactttttatgcgatctacaaacgaatgagatcagaaagataggcggacgacttgaccataaggtcggatgtttccgtgagcagtaagctgcggatctccccttttttgggggaaagctggtggcccttttggcgtgttaattctttcgacggggcggccttcttcgttcggtagatccggtcgaggtggttttcgtttaccagcgcgtaggtggtctaagttcctatgaccgagtctttctggcccctgtgaacatattttcttaatgtattaaagagggcctctctaaccggtgaaaagtggtaggtgtccactaacggctattcctggctcggctccgataacgcaattccgggaggagtcggtagttgggcactggatcccttcggacctggagaacgtgtgacactgggtcggggtttggtgaaccaacaggtcgctcctttagttgaagtatcgggcccctttttcgttgcctaggttacaccttcggaataccccagacggggattgagctctattccccccaatcttcactttacgccacgccgactctctgtcgtggaattagaccaagggtcgaagacccataccataggaccccgtcccccgtatcttatctttcgcgcgtaggagatcgagacacagccttagggctatgaggaaagtagatcgattgccctagaattacaactacatagagggtctctacaagtctataaagaagtttaaaaaaattgatcggtagtagtccggtcgcacctgaacaataattttccagagggaaatgcacctaagatcaaatattttgagccggcttccgtggaaaattcagactttctttttgatgctgcgat

SEQ ID NO: 83993 - DNA, 661 bp, Oryza sativa
attgacgctgcgatactagatgtcgtagttgcaatggctattaacccatcagatcgcaccctagcaagaagtgccttgtaaaggaatgttttcccagtgccacctggaccatgaacgaagaaaacctagctcttcttcttaatacatgttgtgtgatgtcatcaaaccctgcacgttgctcatcattcagatatttgtatatatctagatgctctgggtctattggcacagactgctcctctttgacttcaatcggtgtgtcattggaaaaaacatctggttgacgaaagcataacatgcgtcacgaattcattgatgataaaaataaagacaattaaggtcaacattatagaacacactcctctaaaatattacctatatcagtcaacttaggaagaccatagtctgagatatcctttcccatgaaatgaagtatatcccgtatgtctctaagcaccatctgctctactaacatcgggttgcgattatctcgggcataatcttcagacattgactccttatgtttgtcgcacaaagcacatttatcagtaacctcacaaaaggcaagtataatcgcaaacaagcgacggagtgcaaatggcatttggaaagatgccgcttcgatcaagcagtcgtcatgtgacctgtctgtctcaacaag

SEQ ID NO: 83994 - DNA, 548 bp, Oryza sativa
cggatatacaaggaataatatgtagtggtctctacatataagataggcttattggagacagaaaattccgaagaagataaattaattaaacaaaaagaagagagagcttacgtgaactggtaggggaccattaagacatctttgtcggcgtgcgccaacattgctattgccaagtatgttgctacttctagcttcttcctcttgtgcaatgtcttcacatattcttccttttcttccggggtcttgccaaccaattgctcgcagtcctgtctcagctctacggtgtgttgtgttttgcatattcttgttggatcgacgtatccaacctttgctccagttctatcagcttcgtggaattgcatactgtacaatgaataaagaagaaatgagatttggtttatttgtttcgaatgaaacgtgcaacatgtaataaagagtttagacttacagacagaaagccgcaacgagattaacgtccattttatctagcttgtagagggcgtaaaggtcttggaaagagataaaaaatatcccattaggaccactca

SEQ ID NO: 83995 - DNA, 533 bp, Oryza sativa
aatttggatttgagcatgcattgatcctactcacttgtcttctctagatggccggtcacccacccaaccaccgcggagaaggcatgatcgactttgtggcagagttggcacgcatgacactggtggtgggctaccccaacgcgccggagtacacgactattccaccgctcagtggcgagcttcctcaccgtgtcagcttggaggtccatggctacgtggggacttgcctcgctaacatggcagttgaggcgtcaggaggcacagcagatcacgcctgtcaggaggcagcctacttgatgatggccagactgcgggagcgccacaactacatcttccatgacacggcgtaccgcttccacccccgtcgagccaacggtgatgatgtcagttccttccgtccgacagccggcgagaacgacaccacctttggtcacatgtgtgctgtgatgaggggactggataggatgcactcggacctgcacaaggcgaccaaggccttgaacgatgggaagctcatgaggatcgtcgctctg

SEQ ID NO: 83996 - DNA, 615 bp, Oryza sativa
aggtatgggttaaggaaagaagagcttagcacaccaatgagagttcataccccgggaaatagttcaacctcagtcagttttagcccttcagtgctaatagaaatccaaagatcaccatttctagccaacctcattcttcttgaatccaaagacctagacgtcattcttgggatggattggctgaccaagttcaagggagtcatcgattgtgcgaatcgcacagtcaccctgaccaacgagaagggagaaaccgtggcgtacaaatcactagtctcaccaaagcaaggggtctctttgaatcagattgaagcagaaatcccagtggacaccgtggagaagaacttgaggaaaatggaatatatacccatagtctgcgagtatccggaagtgttccccgaagacctcactaccatgccacccaagagagagattgaattccggattgacttggcaccgggaaccgccccaatttacaagagaccgtacaggatggcagccaacgaactagcagaggtcaagaagcaagttgatgagcagctgcagaaagggtacattcgaccaagtacttcaccttggggtgctccggtcatttttgtggagaaaaaggataagacg

SEQ ID NO: 83997 - DNA, 620 bp, Oryza sativa
tgggatcacacccgtaaggcccaaatgcgtcggcgaaggagcacgcccgtgcaacgcagtctcaccacgactttctaggatcagttcttggcagggtaataaactcactcacttagattggtgataatcgctattacagactgtgtttctatgattcttctttctgttcttgattgatggaaacaaaaataaaatgttggactaatgcacggacgcacgcagtaagcaaaaataaaatgttggactaatgcacggacgcacgcagtaagcaattggccaaggacgcgatactctactcctacaccaagaacatcaacggcttcgcggcgcatctggaggaggaggtagcaacccagatcgcgagtaagaagagaacatctaaattgatcaagaaccgatgagtagaatacataggacaaattcgatggcacatcaacgaaaatgtttggagttgcagggcaccctgacgtggtgacggtgatggcgagcacgatgctgaagctgcacacgacgaggtcatgggacttcatggacatggagagggacggccagatcctcccggactccatctggaagcacggcaggttcggccaggacgtcatcatcgccaacctcgacag

SEQ ID NO: 83998 - DNA, 1196 bp, Oryza sativa
aaacaaaaaaactaccagaatatgttcaatgttggatataatgaaactaatttggtgctataagtgttgttatatttttctataaacttggtcaaacttttaaagcgtttgatttaaaaaatcaaaagctacttataatattaaatggaaggagtaattcataaagaaatccacattattttgacgaccaaacgtcggaacctctgggctaaactgtagagcacattcatcctccactaattggagctaaggaacaccatatgtaattgttacaagtatcgtttaaatgttcatcatacatatattatagcagacatcatttaaatcttcagtatatactctgcacaaactaaaagtttgcacaatttgaagggtaaaaaagaggcactgtaactgcaacgataaatacgtgtgtactttgtctgatctgtatttgcaatttacacagggagatggattctaatctctcgggtggacgtccacccgtttcttgcatgtcacctaaatgattatgaaaaaatttcaaaaaaaaaattgtaacataggttaatatgtaatatatcatttcacaaacatgcaagttcaaatttgactcctacaagctataacaaaaataacaaattaaactttaactagtatatgtatatttacagtcaaatttgttgtttttgttacaacttgtggaaatcgaatttgaactcgcatgtttgtgagatgatatattacatattaacctatcatgttattttttttaaaaaaaatatcataaccattcagatgacatgtaaaaaacgggtggacatccacatgtatattcacagcttggtaatcttggagtgcacacacagcacctagtttttttttacatttttgagctggtatcaaaggaagtatagcttcctgtgagcaccggtgcttccccacctgacttgtgatatacactaataagatccatcagagttagaaacagggttgtcgtcttgagtactctgagctcccatagttgttctagcatgatgtgttgtgctcaagctcccgattttggagtatcagttctttctttcatcccttgatcgcatcttggagctcagagaagtccactatgatgttgttctccatggctatctctttcgtcaccttcctctttagctccatgcttttcgcatcactggacaacttccacaccaactgcaaga

SEQ ID NO: 83999 - DNA, 904 bp, Oryza sativa
ctcatcagattcttgggagatgaattatccctaaagtaccacaaactactcaagatcacgaacttagatctaacccttaagtgtaaaaagttgaacaattcttaggggaaatgaatagagcttggtacctctttgctactactatggtctcttacatcatactggtcaccttttgttaccacaagatccccactatcatttgaccgaacatcaagacatgcaatgacctggaaattttaaggcaataagaagggcgagaatggaagttgcattgacgctaaaacatttggcgatacaaagcttactctctttgcaaggttcgatgctttcctacgagatgggacctgtgttataaatgcaagtatgaacttttacatcgaagaagttaatgaaaaggaactagcaacaataagcatacatatagcagctacctttgatcctgaagtgtttggactgagaaaatttttcaaaattgaaagcccagtagctgcagtaaaacaataatgggtatgcttagaaaaatctgaagtatctatatattctgcattattaagtattaacagaccttggtgatcaagaccagtcaagttatcagaactcaagaatctacatgtttcaatcctgtcttaaaatacattgtacatacttggctatggcatatcataacacattcaatatcaaactgcattttacctccgctcttttctgggtgaaactgaactgcctgaatgttgcccattgagatggatgatatgaaactctcgccatagttgcacacagaagaaatccactctttgttttcatctgactaagcatgtgaaaagaaagaaataactcacattccataagtccactaacgaaagagcatctaaaaaagagctgttccttacaggcagagcatgat

SEQ ID NO: 84000 - DNA, 555 bp, Oryza sativa
aattggtcggcaagttcgggcgtaagcctcccaaaacagtcaaacttatgtttaaaaaagccaacgagtacgccaaggctgaagatgccgtcatcgcatcaaagcagtcgggctccagttggaagccaaaaaaggatacgccggctacgggagggggtggaagtaacaatcataaggaccgcaagcgtaagcctgaggaacttgttgcaaccgctactcactcttctcgacagcattcgcgcgtcaatacattcgacaagatcatgaactcccaatgcccgcatcatcctaactccaaccacgcggccaaagattgtttcgtctacaaacagttcgcggaacaatacaccaagactacacggaagaactccgacgaagaacaaagcacgtcaaagaagaaggacgatggcgaccccccggcaggttttcaaaaccaccgcaaggagcttaaccacatctttggcggccccttggcttatgaatctaaaagaaagcaaaaggtgaccgaacgggagattaacgctgttcagcccgacacaccccaatatcttcgat

SEQ ID NO: 84001 - DNA, 1301 bp, Oryza sativa
gatttttctttttataaaaccattttaactttgtttatttcttaataattattatttgtgctctgaaaattccactaaaatttgagggctccttttagaccaaggagaatttaacaaaaattctccgggccacattcgaatttttcttggacgtattttagtgtttgccaatttcttttcgaattttaattaattctattattccttttagaaaatgatttttatttcgggatgaatttatcaggacgtgacactggcataaccataaaaaagatcattaaaaaagcgtgagctgttattaaaacattataaagttgatgattcccaccaagaatttgatcgccgggtcgggctaattccatacgaatcagtacggagaagcatgtgcccatcactcctgcaatggcaccgaagatgaaatatagagtaccgatatccttgtggttagtggagaagagccatcggaccagatttgtcatttgattttcgttttgaaaactttcaagccttatcagagaggggctcagggctggaagagaagaaccttgatactaaaccaagtttcgataacttcttcagctttcatttcctccatcttcaaaatcgcagagttaattcaaaagtcctgttaggtcacatatgcttgcttttgaaaaaaaaagtggtatacggcatattattcccccccccctctttcgatcttctaattggaagatcagtagagtgtgttggaattcggttctttcgagccttgcttgggctcgttctatctttgaatatagcgaattccgttccacctcaatccacgttcttttcgcgctttgcgcttccaggaaatcatggttgtgggaaaccacatcacggaagaaaaatgatccttcctcatgatcccgcagatcctgataagctgcctggagaatagagaaatcatccgttgctcggatagagtcaagataggaacgaagcgccccctccaaaaggtagggttctaccggaagtacggctccgttcctcgcgtatagagctagaaattcttgaattagatccatcctaacattggatgtcctttcttccattaggaagagcctcagccgcccaggtatgtcctccagaggggtgttgtgattcagctcctgctgaatgaacgcaacccactccggatcctgctcgtaaaggctcagatagaagtttagcccttctaaatgagctagagcctgtgggtcttgaacttttgggggaagagtgataagaaaggagcaacaagttagaagggaaaacatctgtactatggggaggactat

SEQ ID NO: 84002 - DNA, 653 bp, Oryza sativa
cagtatgaacgtcttgtaatgctgcgcctgaaggagatgaacgagattgtcctctatgtcttgcggatattggtcgagcattgcgacgtttactttccgagggtcgatgaatccagtatcgaaaaccctccgccgtcaggccctttgaatctccattctacaacgataaaagggagtattttattttatatagtctacttatatacaaggacctaattaattaaaggagacgtagtaattaagaaatctaactgaacgatatacttacaaaatccagcaactcataatagagacgtcgagggcgtccagctggtatagttcgtagattcccttgaaattgatccagagaatgtcatctccttgcaagaagtccgggtccctgatcctcgctccgatcatctctctaccggtggcgctcatctccatgtacagctgatggaacttgtacatttgtgtgggtagggactgcaccagctcgggcttgacaagcggtttgccgagtttgtacatgtatttcacttccgccttttctattggttcgactcctagcaattgatccgtagttagaccggtgtcagtaataaattcttctatcgtcatgtcttccccggtcaccaacggctcgatatcatggtttggttgctctccaagct

SEQ ID NO: 84003 - DNA, 829 bp, Oryza sativa
accgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcagagggttggtgccctgctgctagggggctcaatcctgcctacctgtcccggaggttccggccgtaggtgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaggttagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgattaataattttgtgtagctctagggtcgtctttataaaatggctttgggcaactaagtgacttttaaatgctgttttctgcaaaacttaacccctatattattaccccttgtacccccttgcattaatcatgcatctgccggtgtggcttgctgagtactgtggttgtactcattcttgctctatctttctcccccccttcagtaagagaagctttggagaagaagtctt

SEQ ID NO: 84004 - DNA, 1289 bp, Oryza sativa
ttcatttaattttttactccatgtgtcaggcatacagcgcttcttactaggtattagctatatgactaaatagtagttatgtatcaccctcacaatacttcttaccaggtagtaaggatgtattgaatgtctaatgcctggtttctagcaacattatggatgccctaagaggcagagaggagaggagaggataagataaggatggggaagtgaaaatataggagagaatgggagagagaagacgagatgaaaaaatttgaaggagggaggagggaaaaaaattaatttcaaaatattaaaacttcgaatcgaattttatcatattaaataaactcatgtgaaaaaactgtcaaaaacaaagttgtagaactcattgagatctaccaattttcttttggtcatttctccatctaagtttgattgtactatataaaatttgaattttaaaaatataagcaattcaaataattttttgggtagtaagtgacttcaaatgggaaagtcatcaacaacaaagttatataacttatcaaggtctacaactttagtattggtcatttttctatatgactttgtttgaacggtatgaatttgaatttcaaattatgacaacttcaaacagcatttacaagtactagatgatttgaactgaaaaggtcatcaataacaaagtggtataactcatcaatgtctataacttttatttggatcatttctttatccgacaatgtgatttgtaacattgttcacaaaatgtacatatctcttatatagtttataaactataagagagatatgtaaattttctgaataatgttactatcactttaccgatgaataaatgaccaaaataaaagttatagacattgatgagttatacaactttgttgttgataacattttcagttgaaatcatctagtatttgaaaatgctatttgaagttgtcaaaatttgaaatttaaattcaaattattgaaacaaagtcacatagcaaaatgaccaaaacaaaagttgcagatattgatgagttatacaactttgttgttgatgactctttcagttgaaatcatttagtatttaaaaatgttattagaagttgtcataaattgaaattcaaattttatataggtcaataaaactcatatggagaaatattcaaaataatattggtagatcttaataagttatacaactttatttttgacaactttttcacataagttcatttactatgaaaaattttgattcgaaggtttaatattttgaaattaattgaaaggagggatgc

SEQ ID NO: 84005 - DNA, 664 bp, Oryza sativa
tagaagatccccggactttttagggtttttgtttttataaaaacctttttaactttgttaatttttaaccaattataattggtgctctgaaaattccactaaaatttatttacacattttaggcttttaagagatatacaaaaatcctctaagccttatttgacttttaactttgcacattttaatttttggaggctttcacacggattttaattattctaggcataatttagaggatgtattttagggtcgttttgggacgtgacagaaacagagaacaaaaccatttttaatggattctacacatttttcttgatttactgagacttgaacgggcttaaacggagctcggatgaattagttatgatttttagaagattctctgtgtttatttctataacaaaagtccttaaatcatttattgcgcaataaccccagggctaacgtcatcgggggggggtggcgccgacaggcggggcccgcatgtcagtggcgcacggggtggtcggtctaccgtggaccgggaccacgcggatggtccaccgccggtccacgggatcgacggcccggatcggccggggccgatcggacagtacggcggcgacctggctcggctcggctcggctcaaagccggccggccggccatggcaagggtgccggcgc

SEQ ID NO: 84006 - DNA, 744 bp, Oryza sativa
  unsure (1)..(744): unsure at all n locations
ctgtcatgtcctactantggtacagtagttcatcaaagttcacccgctacgcgcggaagttggcggatccaccggaggtgaccggttcgtccatgtgacctaacgggcacatgtgccccggccatacaccgataattggcttggactgacggagcatcattcccggggccttgatggcgtcaaaagccgcaagggaaaggatgttgagggccgctcccccatcaatgaggacaccccccaacttcacgttgcaaaccgtgggagaaaccaccatctcaatctgccctccccgggcaacgcacggtgggtggtcggtctggtcgaaggtgagggcaatcttcgaccaccgtgcccgacacgtcgcctcatgagtagaggccgcggccagaagctctcgcttgatggccttgaagcttcggcgagaaacgtgagcacacgctcccccatagacggtggcaatggaggacccaggctcttggaaacctaggtcatcatcgtcgtcatcgatgtcctcggcgggggccttgtgcttggcctgacttcgacgattaccagaaggaaccgccggtgatttgccctctcggcgctcctgtctcgggttctgctaccacttgctcgtccgctcaggcaaacttttgactgcacgggacttcgcgaggtcgtgaaggggaattgtgtggactgtgcaccacttgnccggtttgcgctacctgttgggagcgcctgtctcgttctttgtgcctt

SEQ ID NO: 84007 - DNA, 1420 bp, Oryza sativa
cgcaaagatatctttattattttgaagaaaggtgatgagcgcgctttcctatttacaatctaactcggcgcctattacagcagttttggtaggatcagaaggatctaagggaatctttttagtctcggcttcggtttccccactttttgaaatcttggcagcgggcacttctccttcgctcgccgtggttgcagccagtcggatttcctctcgggcagacgccatctcgcgggtttgggccatgtcgcaactctccttgtcgcatgtgacagcttgcttgatgtcgctccgtagggttaggactcctcggggaccaggcatcttcatcatcatgtatgtgtagtgcgggacggccatgaacttggctaacgctgggcgtccgagtatggcatggtatgctgtctcgaaatcggcaacttcaaagctgatattctctgtgcggaagttttcccgagtgccaaaagtgaccgggagagtgatctggccgagtggagttgcggataatcctggaattactccatgaaaaggcgcattgcttggttttaactcggagcgagggatctgcatatcatccaaagtcttggcgaagaggatattgagtgcactgccaccatcaatgagggttctgcgaagcttgacattacggaccactgggtctagtaccagggggtaccgccccgggtggaccactcggtcatgatgatcctagcggtcaaacctgattgcgatctctgaccatcgaaaatattggggcgtgtcgggctgaacagcattgatctcccgttcggtcagcttttgcttccttttagactcataagccatggggccgccgaaaatatggttgagctccttgcggtggtcttgaaatccagccggggtgtcgccgtcgtccttcttccttgacgtgctttgttcctcgtcggagttcttccgagtagacttggtgtactgctccgcgaactgcttgtagatgaagcactctttggccacgtggttggagtttggatgatgcgggcattgggagttcatgatcttgtcgaaggtgttgacgcgcgaacgctgtcgagaagagtgagcggcggttgcaacaagttcctcaggcttacgcttgcggtccttatgattgttacttccacctcctcccgtagccggcgtatttttcggcttccaactgggacccgactgcttcgatgcggtgacggcgtcttcggctttggcgtactcgttggctttttcaaacatgagcttgactgttctgggaggttgcgcccgaatttgccgaccaattcttcgtggcgaatccctttggtgaatgcggcgatgatgacgtcgtcggtgatgtcggagatcttgttacgttgttcagaaaatcgccggatgtaatctcgaagagattctccggacttctgaatgacgttgt

SEQ ID NO: 84008 - DNA, 627 bp, Oryza sativa
gatggagaagcagaaccaaatcaaaaacaagtcttgcaaataacccttgagatttgcaaggaggatgtcctttccctctttgttcagaatctgccttcgcttggttggggagtaagtgttttatcacttaaaatctgtttgcattctccatttaaccagcctgttgaaatcgttagctctgaattgcaggtacgaaaagatctggttcactgctggtgcattttgctcaggcagaagtttgatgagagctactgctgtgtgaagtacattgaaaacccaatctggagcttttagatttcctagttggctggtaacacatcaatttcttgacttaatatcacagataatctttcgaacttctagtacaattctgtagtaataacatgatcgttcagatatttacaggatattgactactcacggcctttagtcagtcagctgtcacattttctcctttataaacttttgtaattgttggttattgctttagccatagcgtacattcaaagtgtcctgcactttggagcctaacttgtggtttcttggtcattttctgcctacagtgtatcttttgaaggataattataattgatcaactcttgtgacagctacaagaacttggacgtt

SEQ ID NO: 84009 - DNA, 3672 bp, Oryza sativa
  unsure (1)..(3672): unsure at all n locations
actcatatattttggaaacactctattaaaggaattcgtttcatttgttgtttcacaaaaatgtttcacctagtatactcacaatgcttcactatatatagatctaatgttacagtgaattaaaatattcttttgcaataaatcacccacatattatagaaaccctctattaagagaattcgttttatttttttccaccaaaaatgtttcatctagtgtacttataatgtttcactatgtatggatatatcaaatatgcagtgaactgaaatattctttcgctatttactgaaacattgtttttatatgaggtgaaacagcgcacgatttaaatgattgaaacattttcgatctacttagttaaacaattccgatatacttggtggaacatcgtacaacatttaaaaataattcaatactaagctaattttttttcgtcggaatatatccatgtgtggtatgttttaaagatttaattgcaacgaatttaatggtgcgatcggatcatgatttggataaataatttaagagaaaaactagtttaaagtggtattgcacccatgtatcgtgctgacgtcatgccagcatgacgtgggcgcccaaattacccaccccgggatcaggcgccggacgggtagtcgcctccaagattttcctaattgacatgtagtggcttataagcatttgtgagaatatttaatggatattttatattgatatgaaaaatacaaaccgtgattaaagtatatttaataagaaaaatccactagtacagatccttctatctatgacggcctctaacatgcctggaaatagcgggccatcacaaggaagtcatctcaatcaagccgaaaaagtgtccgattgagatatgatcgcacagacatattagaagggcataaaacttaagcccgtcatggatgacacctatcagtgacgggctatagtttaggcccgattgagataacattccatatctcaaacgggccttaagttggggtccgtcacatatgaccatcatccgtaacgtgcaccaacttgaggcccgtcacatatgactcatcagtgacgggctatatactaatccccggttgacatgacttaatctctatcgggcattaattaaagcccgtcactgatgagtatttttccatttttcataagaaatgtttatatttgtaagttgaactatagcaaaataaataacttgcagtataataattcaatttataagtcaaaataattttacgcgtagtaaatgatatcaaatagaaaagtcatcaacaacaaagttgtataactcatcaagatctataacttttattttggtcatttttctatataacaatttttgaacagtttgaatttgaatttgaaaatatgacaacttcaaacaatattttcaaatactaaatgatttcaactaaaaacgttatcaacaacaaagttgactaactcatcaaaatctataacttttattttggtcatttttctatataacattttttcaaccgtttaaatttgaatttaaaaatatgacaacttcaaacaacattttcaaacactaaatgatttcaactgaaaaagtaatcaacaacaaagttgaataactcatcaagatctaaaacttttattttggtcatttcttcatctgataaaatgttagtaacattgttcacaaattttacatatatgtattatagtttataaaaaccagacaagagatatgtaaattttgtgaacaatgttacaatcactttatcagataaagaaatgaccaaaataaaagtcttagatcttgatgagttgnttcaactttgttggttgataactttttcatttgaaatcatttagtatttgaaaatattgtttgaaattgtcatattttaaaattcaaattcaaacggttcaaaaaatgttatatagaaaaatgaccaaaataaaagttataaaatcttgatgagttatacaaatttgttattgatgacattttcagttgaagtcgttcactaacaaaaaattctgtttgaatttctcaaactttgaacttcaaatttcaaattgtttaaatagagtcggatggagaaatgaccaaaataaaaattgttttaaattgtttgcacctcgataagctctacaactttggttttggtgacttttccatttgaaattatttattaaccctaatttttgttcgaagttgtcaaattttgaaaattcaaaatttgaattgttcaaatgaacttatttgtacaaaggaccgatacaatagttgtggatctcggtgagttatacaattttattgtttaggatttttgatggttgtgtatgtgaatgaatgtatatgaatgagagatgttaggattaatagaatactcataccaacaagttacaactactctttcgtaagccgatgcttggcctatagcaatttcgggatgggtgactgattgggaagttcttctcaggtgcacatgagtaaagacaaaaaagactagcctgagagatgctagacggcatgcctaaaaataaaatttattttttttgggattatactcatctgtgacagacattaacttagacccgattgagatgactcatctgtgacgggcattaacttatgcccaattgagatgactcatctgtgatgggctatatttaatgcccgtcacagataagggtcatctgtgatgggctatagtttaaacccgattgagataggtcatccgtgacgggctatagtttgactgatcgtctgggtcaaagctatcggtgacgggctttaattatggccagattgagataggttcatctattacggccgtttgcccgattgagataacttttcatatcagtggcttctagcctgtgacggacgccatgcccgattgagatgggggttaccgcccgattgagatgatggtatccgttctagtgatcgtaacaaaacaaatacatatacaatatttttataagtcagttgcttcgtatatgtaaaatagatggtacacatatagaatttgcactgataaatggactatatgtacgaggaagacgaaaaatgcaagtaataatacagctaattatccaaccagttgcctcatgcaaaacaaaaaccgtggcagctcatgcaccagtaatcctacctactacgaccatgcaatcgttctcagccaattacatcctcagctatggcccgaaaaaagttgttggtctatcaattcataatgttgttagtcacagataaaatcagcaaacgtacgaatatattgctgtagcacttcaccggaagtattccaaggtatcgaattttcacaagaaacgtgtgtgcttaactcttctccagattcacccaagggacacaaggcataaattgggaaaaaaatagagatgattttctagtaaggaacagggtcttaagaaagcttaaatttaacattatcacactacttcatgcactagctttctcgttgctacccaaacgcgctctaatccgtacccaaacaggatggactcaagtgatctcgagagctgtcaccacctctacatcagcctcaaacgaactgttgaatacgcagcaaatataggtattcaacagtatagacatcacgtaggctcaaccgcacaaagtaaatctcaattactcgataaagatattatcaatttaagtag

SEQ ID NO: 84010 - DNA, 1907 bp, Oryza sativa
caacgcgggcctccccaggaccgcgttgtagggcagactgaggtccgccacataaaagttcacccgctccgtgcggaaagttggctgatccaccaaaggtgaccggtaggtcgatgtgacctaacggccatgtgtgccccggcgtcacaccaatgatcggttgagacggctggagcaccatccccgggcctttgatagcatcaaaggccgcgggggaaaggatgttgagagccgctcctccatctatgaggacacgccccaacttcacattgcagatggtgggggaaaccaccatcgcaatctgccctccccgggcaacgcacggtgggtggtcggtctggtcaaaggtgagggccacctccgaccaccgcgaccgacgcgtcgcctcatgagtaggggccgcggcgagaagctctcgcctcatggccttgaaactccggcgagaaacgtgagcacacgctcccccgtcgacagtggcaatggtggccccaggttcttggaaacctaggtcatcatcaccgtcatcgatgtcaacggcgggggccttctgtctggcctcacttcgccgtttaccggagggaactgccgcggacttgccctcacggcgttcctgcctcctgtcctcctcccacttcctcgttcgctcagccaagtttttgactgcgcgacagtccgcgagatcgtggagggaggtgttgtggacggagcaccacttgctggctgggcgctccctgctgggagtaccagcctctttctttttgtcgctcgcaggcctcccctttcgggtggcccgcggagcgccctcgacggcgaggacgtgaccctcgtcgccggaatggaccgaccttttcttcctcctcctgtcacgccgccctgtctgagcggcggatccgggggcggccgaagctgccacaccggaaccggaggggttccaggtccaggcctcctccttacgagccactcggtccgcgagctgaaaaagctctgcggtagtctggggctctttggaggcaatcttttcgagcatgcggttgtgccgcacaccccccctgaacgcgtagatcaccgcgtgtgcagggatgcaaggtatagtattgcggacttggcagaaacgctgaatgtacgagcgaagggattcatcatcccctcgctgtactgcgtgcaagtccgcttcttcacctgggcgtggataggtgccttgaaagttcatggtgaactgctggcacagatcctcccaggagtggaccgacgcgggtggcaggttcattagccaaccccgcgcctgtcccttcagggccatgggaaagaaattcgccatgaccctgtcgtctcccccagcggcatcgatcccggtcgtatagacctggagaaactcggtggggttgacgctctcatcatacttctcggtgatggtgggccggaaccttgggggccaacggacattccgaagactcgccacaaaggctctacagccaacaccaccaaccgggggcacggagggctgatcctcacgtccatgtcgaggtgacaccctggacgaagaggcaccctccgttgcgcggggagcacgccgatcactacgtcggcgctcgatgtcgaggcgggcatccggctcttcatgctgatcctcccgagtcggaggcgccgacgagggagtggtagccgaatggcgtgcagcagccgccgctcgccgcgccctccgccttgatgacacagagccggtggtggcggcgccggaggtcctggtagtggcggaccgtccaccagcacccaggcgctgctgtgccgtcatgaccaagttggccacgtcgtccagccatcgctgggctggagactccgggtcagggacgacgggcgggtgacgtatgagcgcgccagcagcctgaagcactccctggggcatgctg

SEQ ID NO: 84011 - DNA, 2069 bp, Oryza sativa
agttcactagtgaattgggtgccattatccgtaataatacggttaggcactccaaaacgggccgtgatgcttttaatgaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagggcctgggccggctgatggatttgcttggcgtggaactgacacgctctgcatcgccggaccagatcgactgcatcattgagagctgtcggccaataaaatccttgacgaaaggccttgccaaccagggtgcgcgaggcggaatgggctccgcactcgccctcatggatgtcagcaagaagctcaacgccttgttcctgaggaatgcacttcaggaggattccgttagccgcgcgccgatagagggtcccttctaccagcacatagcgtttggaaatgcgttgtacgcgttcactcccttcgcggtcctcaggtagagtcttatctgtgaggtatgtttggatctcagagatccaagcgatcaatctaagggagcttggagcgctcccttcgggtcccgaggcctggactccgacgggcctcgggggtcggtcaggcgcatccgtctcccctaaggggtcgggtcgcgccgacggctgggtaagcctttcttcaaaggcgcccggtggggtctgggctcgcgaggacgcgagccgtgagagttcgtcggctatcatgttatcccgtctgggcacatgccgaagctctattccgtcaaaatggcgctccatacgccgcacttggcgtacataggcgtccatttgcgggtcggagcaccggtactccttacagacctggttaacgaccagctgggaatcgcctaacaccaggagacggcggatccccagtccggctgccaccctgagtccggcaaggagtccctcatactctgccatattattggtcgctcgaaagtcaaggcggaccagatatctaaggacgtctcctgtcggggaggtcaacgtgacccccgcaccggcaccctgaagggacagagaaccatcgaactgcatcacccagtgggtggtgtgaggcagctgcgaggggttcgtgctggcctcggggattgagacggtctctggagccggggtccactctgccacaaaatcggcgagggcctggctcttgatagcgtggcgtggttcaaagtgcagatcgaactcagaaagctcgattgcccattttaccacccgtcctgtaccctctcgattatgcaagatttgaccgaggggtaagacgtaaccacagtgaccctatgtgcctgaaaataatggcgcagtttcctcgaggccatcagaatagcgtaaagcatcttctgggcctgagggtatcgggtcttagcgtcccggagggcctcactaacaaagtagacaggccactgcacctttcggtggggccgatcctctctgctaggggccgtatccccggggcgttcttcgttcaagtggcctttcggggcgcacttgtcttctgtgccgatgacctcggggtcggaggatgaaaggggcggccttccctcagtggcctcggggccgtcctgggggtcgggggctcctggcatcgtcggacaagcgggcaaagggccaactccggtcgtcaggggcctctggcctccgttcgactcgggggcctcttctccctgctctttcccgggtcgagtcagcacagggttagcctcggggtcagagggcgttaagtgcggccttcccgcagtggccttggggccctcctgagggtcgggggcacctagcaccgtctgacaagcgggcagagggccgactccggtcgtcaggggccgtaagccaccgtccgactcgggggcttctcctccccgctcgctcccgggccaagttagcacagaatgggggtgcacgaaatgaggattgttttcatcgcgctccacaccaacgctgcactaactacttggggggtcgccgcta

SEQ ID NO: 84012 - DNA, 610 bp, Oryza sativa
cctgcagccccagacaaacaaagccaaaccccccgcctcgcctacatctcgcgctctccgccccccgcccgcctccactctgcatggacgcctccgccggctcgtcggcgccgcactcgcacgggaacccggggaagcagggtggcggcggcggcggcggcggcggacgggggaaggccccggcggcggagatcaggggtgaggcggcgagggatgacgtctttttcgctgacgataccttcccgttgctcccggacttcccgtgcctttcttccccgtcaagctcaaccttctcgtcgtcgtcgtcgtcgaactcgtccagcgctttcaccaccgcggcgggagggggttgcggcggtgagccgtccgagccggcctcggcggcggacgggtttggtgagctcgccgacatagaccagctcctcgacctcgcgtcgctgtccgtcccgtgggaggccgagcagccgctgttcccggacgacgttggcatgatgatagaggacgccatgtccgggcaaccgcatcaggcggacgactgtaccggcgacggcgatacgaaggcggtgatggaggcggccgggggaggagacgacgccggcgacgcatgcat

SEQ ID NO: 84013 - DNA, 725 bp, Oryza sativa
ccattgcgaaggggagaaagaagacggaccgccccgggtagtctggcgccgggcgtccctcacccagcattactatctcacggccggtggcagattccggcatgaagcggcgcggcaacccagcctgcttctcgctcacaatgcgagaaggcggcagcacgctaccatcaagcagtgcggagccccgtgccatggcgccggacgaagagaaatgaagagcgagcgcgtgtggcgaaagaagggcgcagggaagaaggagttaggacgcaagcggcgaaggcaagggaaatgatggcgaaaggaaggagacaaatcccatcctcagtgcctttatacccttgccaacgctgtgcccggctcctcgtttctcgcgcccattatttcgccccctcgtttctcgcacccacgcttccactaatcccattcgcccgcttgcggcgcgtgagatggatatgcggttgcggcagtcgagatagatcgtatcgtgcgcgcgttaattacgctcgccgaccgaagcgacattaccgtatctccaggcgaggcaaatcggctcgcccagattcgtgcgccgctcaggtgatgtggcagtcttgaagagaccgcccattattgacagccaattaccattaccggtgtgcatggtttgagaccgttgggtttttgcccaaccatggagaccggtcccacctgtcaccaggctttaggagtggcgtcacgcccggccg

SEQ ID NO: 84014 - DNA, 661 bp, Oryza sativa
attactgactatgagactagctctgaacttgtcaatcctagctgttcctccgggagcagcgtcggagaggatcaattgctgcaactgatggatctgtagtgctgaaacaaagtgacaattcaagaggccataagcagtgctccaaggatacacaaagcctctatgctaaggttaggacctaattgtgttattaatttgtctaatgtttgaatctgaagtattttttctgacggcgtttctgaccatcttaacagaggagaagggaaaggattaatgagagactgagaatacttcagcagcttgttcccaatggcactaaagtaagcttttgctgattagtatttagtaattatcttactagtttggtgaacagaacaatcaatgtagtaagtttgagtgcatcaatgaataatgtaatctgtctcccattttcaggttgacatcagcacaatgctggaggaagcagttcagtatgtcaagtttttgcagttgcaaataaaggtactagttatgttacagtaaaatcaaatcaacagaaggatacaaaatcatagattttgtagaaaaagggtacttcatggctgcaagtacattaataaaggcaatttcactacacattttagaatgttccctggtttcacagcactttcagaatacatgt

SEQ ID NO: 84015 - DNA, 687 bp, Oryza sativa
tgtcacagttaccatcagtactttggtctttgcgtactacgcccagtcgggccacgggccagtcaccttttttccttgtctacggggcagaagcaatgttgccgagtgaagtcgagttcgaatctttgcgcttccgtaatttccgtgaagaacgctatgaagaagaccgagtggacgatttgcaccgactggaagaggtccgcgaagcagctttgattcagtcagctcggtacttacaagggttgcgacgttatcataatcgcaatgttcgatctcgtgcctttctagtcggcgacctggttttacggcaaattcaaaccacacgagatcggcacaagttatctcctctatgggaagggccatttattatctctgaagttacccggccaggttcatatcgactcaagcgcgaagacggcactctcgtcgacaactcttggaacattgaacatcttcgtcgcttctacgcttaactttatcattgtatttccctattttgactgtcaaacatcaagtttctccttgaagttgtcagtcgggggctatcatcataataatggagtgtgattttttatcaattcagtttgcttactcggtttatcattgccttgtttggtttttctacttagtttgcgaggactgaaagtttttaatagcttctttgggttttaggctcaacaaagctta

SEQ ID NO: 84016 - DNA, 708 bp, Oryza sativa
tatagggcgaattcgagctcggtaccctgagcatctgttgcattataaggagagaagctcagattgttagctggcgttaccttcgacttccttcaaggctgagtccctttgcgcagccagttctgtcttgtctctctccagggcttcaatttgcttcaccatctgttccatcctggcggcttgcgctgtttgaaatccagatggttgaggatgcaattatgacagcacaaatcaatggaacagatctggatgattaccttttgatgaaccacttagttcgaagtttgcatcctggagctgggcgattcggtcccttaactctttctctgtctttttggcgcactccttggcctcatgcagctggtccctaactgcttctagagttcccaaatgaggaaccagcttttccaaagttgtagtcttggcctcattgcgaagatggattctctgcatgatggatcatggttcagttctgctaaaaagaaaacaaagttaccgaaggccgtcactcggaagacttacatttacaatacgagtggcttctccgagcgctttcttcagctggcacacttcttcatcttctttttgacggtttatgactatgccggcagcttgtgagttctcgtcccaccatttgatcaagataggaggacgagagtcgtcggtcgcctttatgcgagggatttcttctccgtcatcacctgatgg

SEQ ID NO: 84017 - DNA, 525 bp, Oryza sativa
caagccatccctcggatcaaatcagcacatttgagtgaaaccgatggcggaagagagagaaagcttcgaaggccaatgggcgtcatctgacgtaacggaggagaatcttaaggagatggtggcgcacggcgttctccctgccaaggagatcatcgggtggcgaccagcgcacggtgaggctttcccgtctccggatactcatgagattgtggtcttctcgcatttcttctacggcggctttgctcttccgacctcaaaatttttccgcgggatcttgaatttctatggaatcagcttgcatcacctaaacccgaattccatagtgcatatcgccaatttcatccatgcttgtgaagcctttttggggatcaaacctcactttgccctattccgccggatcttcttcctcaagccccaaccaaacaagaacaaaccgtgtgtagtcgggggggcaggattccaactaaggggaactctgagccaaaaatatttctcgatgcccttcaagacttcgaacaaaggctg

SEQ ID NO: 84018 - DNA, 1248 bp, Oryza sativa
ttgaagacttcattcatcacgccctttggggcatactgctacgtcaccatgccgtttggattaaaaaacgcaggagcaacttatcaacgtatgatccaaagatgcttctcaacgcagatcggccgcaacgttgaagcctatgtggatgatgtagtcgtcaagaccaagcaaaaggatgatttgatctcggatctagaagaaacctttgcaagcatccgtgctttcaggatgaaattgaatcctgaaaagtgcaccttcggagtaccgtcagggaagctgcttggttttatggtgtctcataggggcatccaagccaacccggagaaagttactgctatcctcaacatgaaaccgccaagcacccagaaagatgttcagaagctgactggatgcatggcggcgctcagccgattcgtttcaagacttggcgagcgggggatgcccttcttcaagctactgaagaaaacagataatttccaatggggacccgaagcacagaaggctttcgaagatttcaagcaactcctcaccaagccaccggtcttagcttcaccacacccgcaggagccgttgctgctgtatctatcagccacctcccaggtcgtgagcacagtcttggttgtcgagcgtgaggaagaaggccatgtccagaaagttcagcgaccaatctacttcgtcagcgaggtcctgaccgactccaaaacgaggtaccctcaggttcagaagctgttatatggcattttaattactaccaggaagctgtctcattactttcaaggtcactcggtaacggtggtcacatcatttccactcggcgatgtactgcacaaccgcgaagcaaatgggcggattgctaagtgggctttggagttgatgtctttggacatatcattcaagccccgcacttcaatcaagtctcaagcgttagctgattttgtcgccgagtggaccgagtgccaagaggatacccccgtggagaaaatagagcactggaccatgcattttgacgggtcaaaaagactttcaggcactggagctggagtggttttaatttccccgactggagaaagactaagttatgtgctttggatacatttttcggcgtctcacaacgtcgccgagtatgaggcgctccttcatgggctacggattgcaatttccctagggataaagcgtctaattgtccgaggtgattcacagctggttgttaaccaagttatgaaagagtggtcctgcattgacgacaac

SEQ ID NO: 84019 - DNA, 710 bp, Oryza sativa
gatgaagccgagcggatttcaaggcggagcaaactttatgttatgcatgaagccgagttatacaagaaaagcccttcaggaattctgcaacgctgcgtatctttagaggaagggagacaattgttgaaggacatacattctgggatatgcggaaaccatgctgcagcgcgcaccattgttggcaaagcttaccggcagggttttttctggcctactgcagtgtccgacgccgacaaaattgtgcgcacatgtgaaggttgccaattttttgccagacaaattcatctaccagctcaagagttgcagactatcccgctgtcttggccgtttgcagtttgggggctcgacatggtcggcccgtttaaaaaggcagtcggcggttacacgcacctctttgtggccattgacaaattttccaagtggatcgaagctaagcctgttgtcacgatttcagcagataatgctcgcgatttcttcatcaacattgtgcacagattcggagtacccaatcggatcatcaccgataatggcacacaattcaccggcggagttttcaaagacttttgtgaagattttggaatcaagatttgctatgcctcagtagcacacccaatgagcaatggacaggtggagagggccaacggcatgatacttcaagggattaaagctcgagtttttgaccggcttaaaccatatgccggcaaatgggt

SEQ ID NO: 84020 - DNA, 1123 bp, Oryza sativa
aaagcgtcttaaactatgtcctcaactaataaagcgtctcaaacatcgtccctatttcaatttcacttataaaaaagagacgacttatagaatgacttaagtgaaacgtcttaaaacaatggttttgttgtagtggatctagggatgaaaaatttaaattttattgtgtcacatcggatatacggatatacatttaaagtattaaacgtagtctaataactaaattaataaccaaataaattacagaatccgcctgtaaactgcaagacgaatttattaagcctaattaatccgtcattagcaaatgtttgctatagcaccacattgtcaaatcttggagcaattgggtttaaaagattcatctcgcaatttagacgcaatctgtgtaattattttttttttatatctaatactttatgtatgtgtccaaacattcgatgggatagggtaaaaaaacttatcagggatcaaaacatgcccttcatttgtgatcacatatgtaaagatttccctcctgacccctaaaaggtactaaagatatatgcagttaagctggaagcgacttggtaaaaatctaggcaaaataaatgcagaaaagataaatgatttatgagatcagcgatgcgaccagtgatccatttggtgttacgttgctattctaaatacactatagccgatttataattccaaacagtaagggcatgtacaacccgtctcctcgccccgtctgtgtgttgatgattttgcaaaaaaaacccgtgcacgcgcagagacgggcagcccggcgcctcccgacgtgaccagttcatcccgttctcccaggtggagtcgacgcgagcccacgcgctgtagagcgccgtcgtccccaggcgacgggcgaacggatcccgcgtgcggccgcgctcgcccacaaatttcccaggcaaccacgcgtgctgttctcccgcgctctgctcgcgagttgccccaaatttcttcgcccgcccatctgcgcggccgccatctgctcgccccccatctggtattctcgccggagttggtgcggcgggatgtccacgcccggcgcagcttggagtaggaatggatcgaggacattggatgcggcggcgacggccccaggccg

SEQ ID NO: 84021 - DNA, 2758 bp, Oryza sativa
gggagattgcaggcgccggcgggatttggagatcatggccggatcccagccccaaccaccggatctggcggagccgcatccatccccatcctcctcccccttctttgtcctctcctccccattctctaatttgtagatccggtgattcttgcagcgacagtggcacggtgcggcggcgaggtgaagaggggcagcggtgcgcggcggcaaggcggatgtggaggagacacccctctcccccttcttccctcctccccttagaaaaatttgctcatgtgtgtgatggattttgtgaatgtgtgatggatttgtgcatgtgtgtgatggatttgtcccttactgtcatgggtgatagatttggaatttgggaatatatgtgatatatttggaaatgcagggaaattttgttatgcaaattaggttgatggatatattgttgatgagaaatttaggttatattttggctaatttgtgatggatatattttgtgctgctgctgatatataatttctaaatattggctagcaaatcctagggctagccaatatttagaaattattttttttctggatgtacctcctcactaacggttcatattgaaaaagccgtcacaggtaaccataccagtgacggctttgcacatacatgccgtcacaagtgacacacctgtgacggtttttactctccgagccgtcacaggtgagtcatctgtgacgggttgcaaaatggcatggattagcgcatacacttacctctgacgggccgtagagttctagcccgtcagaggtgactgtcattagtgacggtcctccacccgtcaaaggtgactggacccaccagtgaccactgatcactgaccaaatccaaagccgtcaatggtgagggtttgggtccgtcacaggtgaccctgtccagtgtagtgttaaagaaacacataaatgtgtgagttgttgatacatattgatctagtactaaaagagtgtctcataaacaagacaaaaatctcaactgcttgacaaatagagatagtctcaaatattagtgaatagcatctttggttttcttgatgacaatatatatatatgataaagttatgcatgtacaatcgtgtatgatctgtcaggatcattttcatgaattcagtacgatttttctgttgacgttgtgattcctaagatgaataattaatttagcgcgtgcgatgattgataagccatgcatatgcatccggcagtctcaattattggtctaatcgatctacatcacataaagaatactatctccatattttaatatatgacgccgttgatttttttatctaacgtttgaccattaacgtttgaccattcgtcttatgtaattatcatttattttattatgacttgattcgccatcaaatattctttaagcatgacataaatattttcatatttgcacacaaattttaaataaaatgaatggtcaaatgttgatcgaaaagtcaacggtgtcatacattaaaattaaaatacagaggatacagagggagtatattatactatcaacaaaacttgaaatgaacgaaccacattgaccgtagagggcataaaaatatctattttgtcttatcattacatattacgaagatagctcaaaataaaactggcactatattcaaagtggatgttcaagggcatggagaatagtgtgatgactgagatgtactgtttaggacagctatctgaaagcccgtgcttagctatgggtaaaagataatatattaatgtgttatccatcttttagctgtgattttttttatgaaaaagttgaagttttaactgtcattaatactatctttaaattttaaaggagtatgtatatgcatcatatcatgattatgacactatcacagcacacaggtggtaggtaacatgtttgtgcaagcatctttttttgaaccgcttacaaggtcctatacagcagcagggtctcgcatgtcaatttcacacccactcgtaaaaatcaattttaagactcgactcttttaagtaactgcccgagacaatgaatttttgggtttttttaattttgtaggtgcaaaaaaaacttaaatcaaccgttttcacccatgtttttttgggccacctgtgaaaaagaaagctaaggtctgtaaaaattatttttgtagtagtgtcatggaaagagaaagagtagagaggtgattggtgtttgttgattaattaattactatatggtctaatatatagcttaaatccacctatgctattgtagaatcaattcattactctaagaattaccacattaatcaatgaaaatgagatcaatcttatcatgatgtggaggttctatttaggcgtatacaaaagttttggacctgtaatgtggaggatctagctttttacgcaatgttttttaaaaaacatggtataaatgcagacgctcacaacacgtgcacacactcactcctataaatgtacgcactcacatccagtgacgaattcaggataaaaatagatggtgggcttaatagaactgaaatcagagggtgtcggttaaattgttgttaaacaattaataaatattgctttcttatgctttgcaatttgcaaatctaccaaacaaatgaaaactacgagacataaagatctttttctaataaatcccaatggccccatcatgtcattcattaaatagacaaatagattaggagtagaaaataaagaataatcgcttagaggcacaaaatcacagtagctag

SEQ ID NO: 84022 - DNA, 1955 bp, Oryza sativa
tctagtaagtgtgcatttatttaaacagaacaaatcaataattggatattttgtgattggcataaaattgttatggcctaggtatacaaacctgttggatatacttcttttcaaagttagttactccctccgtctccgtttcagactataagtcgttttaattttggtaaaatcaaattgcttttaatttaaccaattttatagaaaaaattagtaatatttttaactcaagataaatattttatgaaaatatatttaattatagatgtagtgaaactaatttgatattgtaaataatattatatttgtatataaatttagttaaatttgaaatagtttgtttttcttcaaataatattatttagttaaataatattacatgtgtgaggtactagggctgagtttagattccaactattttcttcaaactttcaacttttccgtcacatcaaatatttggatatatgtatagagcatcaaatgtgaaaaaaaaaaaccaattacacagtccaactgtaaattgcgagactaatcttttgaacctaattatgtcatgattagctataagtgctacagtaactcatgtgctaatgacggattaattaggctcaaaagattcatctcgcagtttagagttagaatctataatttgttttgttattagtctatatttaatactttaaatgtgtgtccgtatatataataaaaatttgaccaaatttttacagcatctaaacacggcctagtaaacattggaagaataagactctaattgtggcgtggcgccctgcagtcgacgcatgaaaattagtaaggctgtgtttagattcagtggtgtaaagttttagcgtgtagacacacatttgaagtattaaatgtagcctaataacaaaacaaattacagaatctgcctgtaactgccagatgaatttattaagcataaatattccgtcattaacaaatgtttactgtagcaccgcattgtcaaatcatgacgcaatttggcttaaaagctttgtctcgcaattaacacgcaatatgtctaattaataatttttccgtttataataaatactccatacatgtgtccaaacattcgatatgatatggtgtaaaattttgacaagggatctagacaagccttaagttaggaccaagtataaagtgagatgctatctgaacgtgggcccacttaacgtattatcttttatgtaaaagtagtagcgtttctgaccgttttcaatactatgtaaatttgacttatctaattttggttatgtcctcatctatatctgttccaaagctataacggaatataatcgagttgaaaccatcatctataacagctaagccaaacgttacttaggttgcgtttagatcactacaacaaaacaaaccaaagagacatcttatttgtaagatagagacgttttattttgtctcgcacagataactgagacgcttttataaagcgtcgtaggatcgtctctgtttgcaccgtctcagaattatggagacgctttttaaagcgtacctatattatttaagacgttgctagagacgtgtaaattgcatctctataaaatatagagactcttttatataggcacgcacatcttaatatatttgatattaatgctttcatctgggctcgaacacagcacctgcaggttgcaaagttcatgcactaaccaagtcattaacgtgacaatcttgaaggtaaatagatagttttttttatattgcaactctgcaaacatgcgtcctgtagcggtactcttcttttttaatctaagactgaatattaaatatttatttttttttccaaataattataatattattataatggtatttgatgatgacgattaggaacagtgtgtttattttcttctttttctatataaataattatatattatctaataacgatgacacggatataataaaaacgt

SEQ ID NO: 84023 - DNA, 2134 bp, Oryza sativa
attggactcgttttgttgtacatttcaaatagaaaataatggttcgaatagaattcaaatttgatgcaaaattgaagagatatctaaagtaatgaaaaaactaaagttgttcatcacctagatgtgccacgtcatgggaaaattagaaccgttggatgcagccagatattaaacaacagccgatggttctcaaaataaccaaagtaaaaagcttggtcaagggacttcggaagtcaactggaagactcgtgaatccaccacggtaatatccgaagacccaccaatattaaaagcccacgtgtccagcataatatatagggcatcacggatatagcccaaaataaaagaataagtcgaatttcatggatacctcttttaatgaacgaagaatgtttatttcttccatcattgagccaggtatacttatatagcataaacctttggatttggtgtgaacggttggattaataatgaagatcgatcgtaggaagagtcaggagacttccatcggagagatgaaacagaaagacaaaagtaataaaaatccattcatggggtaccgtcacgtaagagaaataaaaaaacaacacagttaaacttaattaaaataaaagctactactactaaatactcccttcattccaaaatataaggcacaaccacccttaacccaaagaccaagaaataattattatcatcttgtagtttgaatcatcctaataaatataatgcatgcatccaataggattagataacatgagagtggaggatttaaaaaagtaataatttaatggagaagatgtcatagttaattgcatgcttggaacatctaagacaagtggttgtgccttatattatggaatggagggagtatgaaatacaaattttctggcgaacttgttcaaggaaagtgtgtgtggcagcaattgtgcataggatatattccctaatttaaattcatttatacaagatggatgtaaggtgattgcactgggaacagattttgttttgggtacaatcttgatatgcatttgtgaaacaataacaaaaatccaaaaacaaaaaaaaaataattaggaagagatactaactttcagaatatgagaaaaattgaagcattaaaagaatttctaagaccagtcctcttcagtgctcatggctgcatcaccttcctgacttcctctgagctcggaatggcagatcacaattctgcctctctggtgcttcgtacgccagattgattattatttcaatagaagattacataacatggcaaggaaaaacgtaatcaccacaaaattgacactatcaagtgtgaccaaaagaaatttccctgttgccattcattctcaaggttagttgagtccacatcaggagcagaacgattatattatcacaatggctatggatgaaaggagaagatatatatagacaggaaagaagctatgaagaaatgatgcatagaaaaattcagtgtattgaattgatacccgttttttttctggtatgtgtctgtcaaaagcaattgtagctgttttttttttgtttttttaaaaaagaatttatgcagtgaacaatgaattcatacagactagttttattcctcttgtacaggttcaataacaattctttgtgggtacaaacatttcagttcagcattgtaaatacagatgtgctgatagaaaatgtttattccaaaataatagcggggaaagtaactcgcaaacacaggaagcaagtgctatttttcaaaagggcctgactttgctacagcatctggaggtacatggacaaattcacaatcattcaactctctagttctgaaagaatccattggcttcaagatatgacactacttgatcagccattgatttaggtgaagggcagtccccaactttgcactgtatcacaatctgcaaagagtaattcaaggtcacaatcagagaagttacaaatcatcctcataattttttttattttggaatcttttctcagagtagtactgatactgatgtttttattttattgagaagctgatgttagtatgaatatgaaagatatttggctaacctcacaatctgaaggtgtttcataaggatcatctatttccgtaaagcctgcatgcatgtaattt

SEQ ID NO: 84024 - DNA, 576 bp, Oryza sativa
ctcggtacccaatagatgtatgatggaattacgtctcacagttgtaggcaagtgaagccgctgctaaacgtctcttttccccctctgtactcctgatgcttccagttgtcagagtatcatccatctgcaagcacaagaataattcatagtgacaaacaagaccatcttcaaccatacgaggaagaccatctttaaccatacgaggaacaagaaataacaaatttgcacttatttttcttttctttttttttgacggcaagtggatatggttttgttccaaccacatctggacaattgtttcattgttgtttaagcgccacttaaattactcacatgacaaatagatgagattatcaataaaataaggaatcggtctgagttaagctagattacagaactgcgttctcgcaagcgaaaagcaacagagttgcttgagggtggggggtcaagattaatcattcatgggtcagcaattaaaacaggatgagaatctttcttgctaagcctgagctgatgcaaaagtaagggcgtccatgccaaatgaactaataaggcacagtaaataaaaatgcacat

SEQ ID NO: 84025 - DNA, 1250 bp, Oryza sativa
tttcggaatagaggaagcaacttaactaacaatagtcagtggtggaggatggggacaaaatattatggcaaatcctgatgtcacggcaattaatcgtacagaattaattaaagttcacgtgttaaacgtgctgattattaaatgccttaacagatgatgaccgattacgtttaacatattaatctactagaaattatctaccggcactacaagaaaattgagctattgccaccaaattattacaacaaaaaataattcgtagcaatatattgtactattgcaatgataatttttctgtggcaaataattatattttattgcaacaatctacaatcgttgttttatttagtacttttgttgtaatagaaaatgagatatcgccacaaaaaatcgtactgttgcaaaaaacatgttctatcgccataattttaattcttgtggcaatttacatagtacatgatacttttcactatttttttgttgccacgatcaacaaattggttgtaataaaaaattgtcatctcataatttaacttaattttttcatatggacacggattgagacaaattttatatgaaaattatagctctcgacgagatctacaattttataggtgataactttttcatttgaaatcttttagatattcaaatctatgattcaaatctcagttaggtaggctcaaatagaatgatatgcattttccaactgaattgatgcgtaggtgagttggtaaaggagagcacgcatgaaggataggtcttgggttcgaatcctagccaagacatgatataaaaaaaataaatagataaatagataggatgatagactagtatttgaacttttaatttggtacgtaaaactaatgccacatatagagtggtggcaataatttttaatacaacgatgtgaagtgtggcaacatctaaatttattaccacggctagcaatgattttaaaattatgacaacatatatctattgccacaattttagtgttgataccacgatttttttcgtggcaacaaatgatttttgtagtagtgcggacaaagataaacaatatgtaatatgcataatactggcttaatttgtcaaggtttcacttgaagcaatattcgcagttatgtactacctccctttagactttttcattgaccattcatcttacttaaattaatttagtataaatatacaaaattataatttaatagtatattttatttgatgataaagcaagtcacaataag

SEQ ID NO: 84026 - DNA, 861 bp, Oryza sativa
gatcaggggcctgcgtccgactggtttccagtcgggggctcttgagttgttgccgtttcagttgttgccgactggtttctagttggcgacaggtcactcggatcggccctatcgcccgaagcatgggtgccagttggctggctttcagcggtcggctggttttcagcagtcggctcggggtccttgggtatattttgctctgtcatggcaggatcggggtcttttccagatggatctatatcagatggtttcctgcagagtgttctttcagtatttagcattatcttcattggaaaacatgccgaagcggaaatcataccgagagatctaatacctggaagatgttctgatctttggcatcgcacggccagccagttttttcctgggcatggtgcgctttgggggtttattaggcgagcccttatctccagatttatcatcgtcgccttcatcatcatcaagtaccagctttctcttgcgaggacctgtttgaccagttaatttggaagtctgaggttgcggatctggtctgatcgttggccctccacctccctgagcggtgtgttggcaaggagaccggcgctgagtgactggtggatctgacttcatcaatgcatatccctgaacaagatgcttccatagttagtcaactcagcatgaagataaaattatgctctgatcacggtttgagggtttctgatgcgtacctgtggaggcggattgaatgcattatatggcacaactggcagttgatgagagtagctgactacaattgcatttgagaagattttatacatcctctccttcatgattttgaaatccagggaatctggttcttcacggttgggatcatgtttgccg

SEQ ID NO: 84027 - DNA, 712 bp, Oryza sativa
ggtactgccaacgtgaggttattgaaaggttttgccttggcaagtctcattcgttgggacgtaggctcatgtgttgggcaagtcgcggagtacgggtaaagtgtacatccactgcagtgtgagtaaaaccaatctattcgaatagccgtgctcgcggatattgagcatcaggacatgtattacacttggctagactctaaattcttaaattgaatgagatgggatatgcatgatgattttatactggtggatcatcttctcgagagacgagaaggagtaaaccccagaaaaccattacagccagtaacgggaagccatctttgggaagacaatggatggtgaaaagaaccgttgctgtgtaataaatactggaattaaaactggactagtctatgctagataataagcttgtgaaaagaattgtgaaactagctttatgcaaataaaccaacggccatactttgaatatcactatctgacggagctcgtggctcctcaccgggagaccgcgcaggcccccctttgccggttcggccgggggcttaggtgaaatccaagctctctctgtatgtggaaagattgttctgctagcaagggaacgcgagacacggcgatgtatacaggttcgggccgctgccaagcgtaataccctactcctgtgtttttgtggatctgtgtatgaatgagctacaaagtgtgagccaaactctcc

SEQ ID NO: 84028 - DNA, 544 bp, Oryza sativa
atcatcaattggccgacgcgacgctccacggtttcgctgttcatacctgtagaccgagaaccagaattcggtaagtcaggagaaacatgcacataaggaagtcaaattaaatacaagaaaaataccccgaggagaaacccgggtcgcgtcctccggcccagaatagtcaaaggctgggtgggctcgagcctggagtggctggatccgcctaccaatgaagtcggcagcgacttcataccccgacaaaccccgtactcggaggtcatcgatggcatcaatgaaggactgaagagaaggggtcaagacgggtttggcggtccaagacggaatcttgtctggttgttcctcaggaacaacaaagattggatctgaatcctctatctgaagatagaaccacctcgcctgccacttgctacgagaagaagggcactggaaggggatatagcgcaacttcaggccatcccaaagtcggaaaccaacgcatccagataccctggtggattctatccgacgcaactcgtagtagaagcgaaagaggtcgaga

SEQ ID NO: 84029 - DNA, 592 bp, Oryza sativa
ttcatctttcaaaataacactgcattgatgaggttttctcaatatttgtacctgtggtgcttcttctgattgttaggttcgcttatatgacactgcttcccaaagaaggcctgtaatttcagttgattttagggagtcaccaatcaaggcagttgctgaggacccaaatggacatgctgtctacattggtacaggaagaggggaccttgcttcctttgacatgagaacaggtattatatgatagtagctggtgtgtgataattcttgctgatggcacttggaagtcaaaatacattctgaattatattttcagagttgtagcttagtttgaattttgtatctagtatactatagttcaaataaaaatctcttttcattttcgtactctaaagttcactctggcatgtgtatttcattgtactattttttggctaccatgctctgatgcttacataggtggtacaacattggttgtttatttattttcctgatcgattcatagttagttcatcatgtgctatatggatacatttaactgcctggagaagttttatttaaatttaacttaatattctgcaatgagcttatgcat

SEQ ID NO: 84030 - DNA, 1208 bp, Oryza sativa
cgagttcgaccgccccctgggcgaggtccctcgaggatgacttgatggtcttctcgagctcctcggggagtcgttcgaggacccaggccatcctgttgaggtgcggagcgaggccttccaggttgctagggcgcgtcctcgtctggcctttccagaggcccgcttgccgaccggcgcgatccatgcgggagaccgagtcccaaagcatgtcgggccccatctcgcccgccaagcggagggcctcggcctccccgatggaagaatccagcgcgcgctgcatgtcagcgacggtgtgttcggcagccgcgaggcgagcggctaagtcgctttcgcccgcagccgccccaccgatgcgcgccctcgcggccagctctttctcccgtgcctcgaggttggcagcccgctgctccagcgcggctctctcggcacggacgcattcaaggttgcggcgcgcctgctcctcttgcgccgcctcgtgatgaaccctgagttcctctcgacactcaaggttgttgttggcccgatctttcggtgagttgatgaaaactacgatttggaagaaacgttgacgacccgactacaaccgtacaagacgttgcgttgcgccttagcgatcgatacacctctccgtgggttgttgatcttgccggtgcaaatcaaccttattcctgcaagcaaatcgaagaaacaagcaagaacaagataaaagcaatctgaattgcaaataggagttaaatacgaatgataagttggggttccgaagaacaagcagacggacggtctagccgacacgcgcgctgcaagcaagtagcaatggctaaactttaatctaacaaaacccaagaaaccctgaaggggtacctaactatttatagaggtgggaggacgaccaagagggtccaagggtcgtgctccaccagattggggcgcaccccacatgggcctcacatgggccagggtcccaaacaaagttacaagcccattggcccaatacaggagacgcagcaccttggttttgtgattgcggccaaacgagatagatttccgagatgaggctggatccgttggaaggaggacttcgagagctttccatcaagtactcacgggcccaaaacggagcacgtatgtagatttggcggccgtttgaagtcagcaatgtaacacgtggccgaatcagattgcagcacatggaggacttgatcttgatg

SEQ ID NO: 84031 - DNA, 677 bp, Oryza sativa
acgttcgacctatccaggcggttccccaagggtcgccgttcgggaccgggcaaccgaacacgatggcccaacctcatgcgcaagtcatgacttcacccttcaccacaccatatccgcagctggtgccgaacaagccagggggtgagaaggggctaccgctgagcaggggaatcaagattcatccaatcccaccccagtttaagttcccacctgttccgcggtactcgggcaaaacggacccgaaggaatttctgtccatctatgagtccgcaatcgaagccgctcacggcgacgaaaacaccaaggcaaaggtaatccatctcgctctagatggcatcgcccgttcttggtactttaatttaccagccaatagcatttactcatgggagcaattgcgcgatgtttttgttattaactttcaaggcacctatgaggagccgaagacgcagcaacatctactcggcattcgccagaggccgggggaatcgataagggagtacatgcgttgtttctcgtaagcccgatgctaagttcaggacataaccgaagcgtctgtcatcaacgctgcttcggccgggctgctcgaaggcgaactcaaaagaaaaatcgccaacaaggagccgcagacacttgagcacctgcttcgtatcattgatgggtacgcaaggggcgaagag

SEQ ID NO: 84032 - DNA, 702 bp, Oryza sativa
cctgcagcccctgtggtattctcccccggccttctgagtttctcctgctcgttttgaatttctacggtctttctttgctccatttgaaccccaattccatcgccttcctcagtatcttttcgcatctttgtgaggcctacattggggtagagccgtttctcgacctctttcgcttctactacgagttgcgtcggatagaatccaccagggtatctggatgcgttggtttccgactttgggatggcctgaagttgcgctatatccccttccagtgcccttcttctcgtagcaagtggcaggcgaggtggttctatcttcagatagaggattcagatccaatctttgttgttcctgaggaacaaccagacaagattccgtcttggaccgccaaacccgtcttgaccccttctcttcagtccttcattgatgccatcgatgacctccgagtacggggtttgtcggggtatgaagtcgctgccgacttcattggtaggcggatccagccactccaggctcgagcccacccagcctttgactattctgggccggaggacgcgacccgggtttctcctcggggtatttttcttgtatttaatttgacttccttatgtgcatgtttctcctgacttaccgaattctggttctcggtctacaggtatgaacagcgaaaccgtggagcgtcgcgtcggccaattgatgatc

SEQ ID NO: 84033 - DNA, 616 bp, Oryza sativa
cgttgagcgagtggaggatcagatttcatcagagaaaattcctatgcaagataatttaagctctcagccgataatacaaaggataaaaggatatcttgagaaaggccggattatttgatacataccggtggaggagggttgaaggcgttatatggtaccactggcagaaggtgtgagtagctaaccacgatagcatttgagaagattttatacattctctccttcataatcctgaactcaagagattctagatcttcacgattagggtcatttttgccatcaaactcgaaggcagtgtgggatctctccttaataggcgccagtcggctcttgatgaagtgtcgagtaatctgttccccttgcagaccttgctcttcgattttagcatgcgttccatcagagtaagcgcttgagcagcttcatctcccattggaagcgagttccaggtttcttgaaatgtcggaggaaggcaggaatactcgggaagcgctggctcaggattttgcacataaaaccaatttgcatgccatcctttgtttgaggttttgaaaggcatggagaagtatttctggcctaaggatccccttaactgaaaacctgccccaccaacgacgca

SEQ ID NO: 84034 - DNA, 1112 bp, Oryza sativa
agactggaggaacaatccattagggttacctaaatggtccgagcgtccaaagtgtgggtgcagagatcgctggcaggtggctacatcctttgctgaacaaacatttcgaaggagatattttgtctgccccaatgtagacaacgatttcgttgtatgtctaaccatttacaaaatccgctatgatttgcacaaaattactacccaaactgaataacattactatttttacagggcaatccaaggatgggtggatttactcgatggatcgacaatgtcactccatcatatcatggccagaagataacagagtcagaaacacaagtagagtatcaacgattgaaggaccacgagaatgcaatgcattctgaccgacctagaaggggccgataggttaccgcatgcttgattcgtcggaatcgacaaatttgtaccgtgtatcgatggcacttcttatctatcttatcattacaatgtttaattatggtggtgattttttgtatgcgtaagactaagggcctatttggattgctaccaaaaacatgccctaccaatattttggtaatttgaatagtacttgtgtttgatttcgattgaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacattctaaataggccctaaaaaataataaaattgtattttaccagtcttggagattttaatcttgtatagttttcaatataaaaagatttgataactattgatatttatacaaaaatataaagcacagtataaaatcgccctcccccagggcggcaagggggccgcctgcaaaattccaggccccccgccgcccatttgcaggcggcccccctgccgccccgggggcgggcgatctgatgccgtgcagggggccgtcggctaattatcatgagtgctctcgtccgagagcgaagggaactatgccagattaatttctccgcgactggtgatgtgcattttta

SEQ ID NO: 84035 - DNA, 645 bp, Oryza sativa
tagtagatccgatgcttctcatagtccaaacacaccaaaacgtacagctgatcgagaaaatcaatggagaacatcatggacggggtctgaagagtcgatctcaacaaacccgtcgcagagagatgcacaaagtgaatatggaagactagagagttctacagaagatgtaagaccttttttagatatgctatttgtctaattgtagtgttgtttctaactaatggttatcttccagaatgaccaatctataagtgggtctggaactgttgtactgcgctcgccaagagcatctcaggtgtaccctgcagctactaaccacagttccaaggtgtgttttagattcctaatatgaatgtcatagttttcccccaaaacaagacagataagtatgtcctcccaatccgattctgaatataggtcattttagccttcacaattcttttctaaatgtatgttgttttggtacttttaagcactttttcatcttttactagcctagaggccatgcgttgcaacagaaaacaaattgagtttctagcttattaaatcaattataagcacttatttagtccaagtactactattatttttcttattgaacaagtaggattttgaaacataggggaagctaatagtgaaatgggg

SEQ ID NO: 84036 - DNA, 567 bp, Oryza sativa
gaggccacccacgacgaggccgcgggcgcgccgctcggacccgacccttcgggcgacgttcgggacgagccagcctcgggggacgcccctgagtccggcacgtcgattggcgggccgagccgcacagcgcccacaccaaggcagctctcccctctgccttccaccgccccactgaacacagagcccctcctgcaggccctggccgccgcgaacacgacggtgctggacgggttaggtgcccagatggaggtcctgcaagcagagcgggcggaactcgacgcggcgtgggcgcgcgtcgaagaggggcggcgctcggtggaggccatggtggaggcgggccgcaaggcataccgccggcacgcctcagagctcgaggcccgtcggtgggagctggcggagatcgccagggaggtggaggaggagcgggagactgccctcatcgccaccgccgtgctcaacgaggcgcgggacgatctccgccttcaatacgggagccgggtggcggagctagagaagaaactcgacgccgcccggggagtccttgacgccgccactgcacgggaacgg

SEQ ID NO: 84037 - DNA, 683 bp, Oryza sativa
atttaccgagaaagcaatatctggcctcgtactatttgcaaggtacataagtgcaccaatagcactaagatatggaaaatctggtccaagcacatcctcaccataggggttttggaaggatatgacttgtccatattaaatttctacaaaattttctaggtatatgcaccttggtgcacaaggattccagaagataaatgctcaagttgtagacctaagcaaaatttggtttgacccaaatccttcatctcaaattccgtctttaaatgatgacgtgcttcattaatatcttgtgtattgccaataatgttgagatcatcgacatataccgagataatacaaaatcctgtggggtctttttgataatgacgcacgggcaatcatcatttttagtgtatccctttagtgaaaggaattcacttaatcggttgtaccacatcctgaccgattgttttaagccataaagtcacttctgcaacttaacacaatacatgttacgatttaccttctgattcgggatgtcgatgccgtcaggaaccttcatgtaaatatcagaatcaagtgacccataaagatatgcagtcactacgtccatcaactgcataaatagacgattttgtactgccagtgatattcaatatcggaaagttataccactcataactggagagtaagtttcgttg

SEQ ID NO: 84038 - DNA, 564 bp, Oryza sativa
aaatgatgttcagactggatgttttgaagcacaatgcaatcaatgtatcaaatgtacaagcttcaagaagataaggagacctttttgttcagtggctttgccttgaacttgggagccttttctaattcttctagttccaattcctgagaacttttcaccctgcagaaagatgatgttagagtaatcgaaaataatcaataacataaaatggcttgttttctgaatgatgcaagtggcaaagggaaaccttggtggtctactcgtaatgctgtctcaagttggggtggttttggcgctgtcaaggtcagtggcttactgctctgactctgcaagatttgattaaactttcagtaatgccaagaattttaatttttaggagactaataagaagaagaatttacatactgatattaacaaccaagttaagtgaaaggagcttaccctgatagtccccacggaagaagcttcggaacaggtgtctgcatgtcgtgtagctctctccatcgttttaagaagaaactcctgtaggtgttggaaaggaataactgaatcagccaaacaaag

SEQ ID NO: 84039 - DNA, 601 bp, Oryza sativa
cttgcacatgtgttctattgcttcgactcttatcccttcaaggagttcgagcaacaactcgtgcgcatcttcgcctccaaagaacatcacccttggcgaattagctcctagttctattagggtcattgcttcgtcgccatagagaagcatgaacgggctgaacttggttggcctagtgggggtcatccgaagggcccagagaacagatagcatttcgtctagccatttaccctttgccgccccctcaagccttttcttgagcgccatttgcacgttcggccgccccatttgactgtgggtgcgcgaccgaagcgaacctgatttccaggtttatcccctcgcacatctctctgaacttgtcagagtcgaattgcttgccattgtcagtgatgaattccttcggcactccgaaatgacaaacaatgttcttccatacaaatttctgtactgctaccaaagtgatcgcaccaagtggttcggcttcgatccaacgggagaaatattcgattgctacaattgcaaacttgtacccatttcgcgctaccgggaaagggccgattatgtttagcccccatatggcggaaggctagaccggagcgat

SEQ ID NO: 84040 - DNA, 584 bp, Oryza sativa
tgctgcccgactgcttggatgcgatgacggcgtcttcggctttggcatactcattggctttttcaaacatctacttgaccgtcttgggaggcttgcggccaaacttgctgactaagagttcatggcgaaagcccttggtgaaggtggcgatgataacgtcgccggtgatgtccgagatctgttacattgcttagaaaaacatcggatgtaatctcgaagggattctccggacttctggatgacgttgtaaagatcaaactaggtaccagggcattcaaaagtaccctggaagttggcgatgaaatggtcgcgaagctccgcccagaacccgatcatgccacggggtagcccgtgaagccaagatcgggcatagtccgctaaggccacgggcagataattagccatggctttgctatctcctcctgctgcgcgaattgcgaggcctttgacggtaagccaagactcaggatttgtcgtgccgtcgtacttctcgatcccagttggtttgaagccggccggccaatccactcgacgcaggtcacttgtgaaggcagcaactccatccacgtcgtcgtcgtaacgat

SEQ ID NO: 84041 - DNA, 692 bp, Oryza sativa
attcctgcaccccgttcataaagatgttcaacaaacacatcggaaggagctggttctcgtttcgaaccgaaattggccagtctgtcggctacctcattgttatgtcgaagaacatgggctagctcgaggccatcaaacttatcttctaacttgcatacctcctgccgataagcagccatattatcatcaagacaggaacactctttcatgacttgattaacaactagctgagaatctccacgaactatcaaacgccggatccccaaagatattgcgatccttaatccatgaagaagcgtctcatattttgccacgttatgggacgcagaaaaatctatccacaatacgtagctcagtctttctccagtcggggaaatcaggacaactcttgctccggtgcctgaaagcctttttgacccgtcaaaatgcatagtccaatactccatcttctccatacgcgtgtcttcctagcactcagtccactcagcgacaaagtctgtcaaggcttgggacttgatcgaagttcgcggcttgaaggatgtatccaaagaaatcaattctaaggcccactttgcaatccgtccacttgcctcgcgattatgaagtatgtccccgagtggaaacgatgtgaccaccgtaaccgagtggccttgaaaatagtgagataatttcctaacggtaattagaacacc

SEQ ID NO: 84042 - DNA, 924 bp, Oryza sativa
tgtatggtatgccttttggggggggagagatgtaatttatacccttgataaatcatccaaagcctaaaaacaatttagataatgcgaagaggtgcaatttacacccttgatgaatcatccaatgtgacggagcgtggggctcctcaccgggagaccgcacgggcccccctttgccggttcggccgggggctcagggtgagatcccaagctctctgtgtatgtggaaagatcgcgacctattgaaagagcatgaagcacaagcgatgtatacaggttcgggccgctgagaagcgtaacaccctactcctgtgttttggtggatctgtgtatcaaggagctacaaagtgtgagccaacctctcccttttcttctagctactgaatctggaaaaagtcatcccccttccctatgggcaaggtcctccttttatacttcaaggggataccacatgcacccctctctttccaaactggacttttcttctcttcataaatggacggagatttgcacggttgtcctccgaacatccttctgacgggacggcacacacctacctccacttctgccggaggcaggcgcgtcgtgggaacgtggctgtgtgctgacgacatgagcagtgtcagaccgatcacaaatcggtcattcttgtccaccacgcgtcagcttagcaacgtgcatgtttgcccttcttcacacaacatcttgcctgtaatggttaggatgaagcctggcatatatcgaccggggctaacgtgccatctctgggatgtaacacgctaactccagctggggacgagtgcctagaagctctcgtcttgacgggatggggcgaagcgtgcgtcagaccgcctgtcgccacctaacccgcgatttgaccggtctgtgactggtcacagaccggataaacgagtggagtgcactgta

SEQ ID NO: 84043 - DNA, 697 bp, Oryza sativa
cagaagtaaggggctactgtcagggttacgggtaaggtataccctctacccttcgatatacgtcacatatcggtacggtatacctgcgcgtatacggacgttttctacatacattaaggaaattcatcacggagttcatagatggaaggagtcctactcggacaggactgggtcgtcactgtatcgtgcagggtctgatgtctccgagttctacttggaaaccgcctgacctgcgatataaaagggaccccccgagaggacctaaggcatcgaatctcatagccaacacatccaccacagcctacgaagtcggagtctacaggagccaagtcgccgggagatctagtcgaaccagctcgattacgatctcgccggtaccatcgaattccactgttccctttgtaatctatgatttccatcatataatcccatatcaactggattagggctattacctatcaaggggcctgaaccagtataatctctgttttctgtctgcttgatgtcgtattacgtagatccttgtaccagcgtatcccccgtcgacaatactaaaagtccattaaacttcctacaaacgctcctaagttgccaagtggcagtctaaatctaaccgttgattttcctttaaattggtaggcccaatattaccaaccattagatcaaataaaaaaaataaaatcctcctctccacacc

SEQ ID NO: 84044 - DNA, 1280 bp, Oryza sativa
ctccccctctccccgggccatctcctctcccccggagagctccgctccccccccccccccgctcagctccgctccgcctcgcccgcgcgccgcgcgcgcgtgcgcgaagaaccgcgccgagtgctcctcctcctccgctccgcccgcgcgcgtgcgcgtgatccaccgcgccgagcgcccccttcccctctcctgtctgtgccgcgcctgcgtaagccgcccgcgccgagacaagtcctccctctccgctccctcgctgccacttcccgcgcgccgtgttcgcgtgcgcacgcccgcgcggacgccgcccgttgcaagccgcgcgcgcgtgccgagtggccgaccgcccggtcgccgccgccgtcagcctttgcacgcgtctgtcgcccgtgttgtcgcgccgctccaaaccgcccgccgtcatcgctgtcgtcaccgcccggcccagccactccgcgcgcaagccgccaagggacggaggcagcgcccctcctccctctgccgcgtcgcccccgctcccctcctcctttttcctgaatcggcaaaagggcaagcccctttcccccccccccctcctttttccccttttcccccgccggcgtcatcctccctgtcgccgctttggccgcgaccgccgagcgccagctcgcgccttgaccgccctaagtcggttcccaaaccgacattgccacccccctttaaaccccagctccttcccctccaatctccctcgttttcgcctcctcgccatagctgccgcccccgtgctctgttcgccgtcgccgttcgttgttgcgcgtgtcggaggagtcggcacgagcaaggacgcggaaggggacttcggccgcgccctctccttcctcttccccggcccgaggccggagagattactcccgcgccgtcggcctctcgtcacagcgcccctcctcatctcggtgatgcctccctccgttcttcctcctcgctccatctcctccccctagctttcggtagtagctcgagtagactccccgtagttagccggcgccgccccgaccgttgtcgtcgctcgccgcgtgctcgccgccgtcgccgctcgagctccgtagcacccgctcgtcgccagcctcgctcggcgtagttccgtccaatccgacgctagcatcgagttcccgaaaccgcgtagatgctctcaccgccgggaatcgacccctcgtggcctagccgctgtttccctcttccctccccaccggttgacgccaccgcgattcgccgccgtcgagcttcctctggcaaatccg

SEQ ID NO: 84045 - DNA, 1438 bp, Oryza sativa
aaatcctaattgcgaaaattttcgttttttgtgtgcgagtctaagttgtgccaaggatctcaatttaatcccgttgttccctctcatcgaaatcaaaatcctccacctcaaatttctcttccgattcaagtctccaaatcaaattccgaaattcagtcgcatcctttgaatcctcactaaacgctcgctcccaatttcgaaaaataccaaactctatcttgagccttccttgattcctccctgaaccctcgagttcgagtatcaaatttgaattcgaatccaaaccctaaatctctccaattctatccaaatcagttttctctgtaaaagtctattttacctccctctggctcggtgggccgactctttttacccggcccatcttctctcagcccgcttttccaccttcccgcacgtgtgctgcatgtgccgagagagagagaggcatcggctctctacttcctctctctttcctcgctctctctctctgcttcctttctccctctactcggcgccgatttccccgccgtcgccgttcgaaatccggccgcacccccgcgttgcgcgcgcgcgctcgctcgcgaggaggtcgaccggccggtcgctgccgctgtcagccctgccgcgcctgcgccgggcaaccgcccggccccgctggccttgcgcgctggaccacacagctgcacggccccgcgcgcgtgcctgagccgctccacgcgcgtcctgccaaaacccggaggccgagctctccctctccctcctactcccttcctgaatcggcttggagcgagcctctcttttcccccttctttttctctttccccgaccaccatcggcatcaccgcctgccaccgcctggaccacgggcgcgaccgccagctcgccgcccccaccttgacccagcgccagctcgccccgcgccagccggcgctgctcctctcgctcccgcggttcaatttccgccgcacgatccaccgccttcgccgcccaatgcatccacgccgtcaccgctttcgcatcgcccacgaaaccgccgctgccgccagccgagcgcttgaccgccaaggtcggttctcccctcccaaaccgacatcacctcaccccgtgcctataaaacccgaagccgagctccccttcccatctcaatccctcccgcttcacactcctactccaccgcgccattgtcgcccttcctctgctctcgccgtcgccgtccgccgccgagcaccgggaagaccggtgcgtgcgaggacgcgtgacgcgggactccgggcacccatcttcctcccctttcccggcccgaggccggagagctcgctcccgcgctgtcggccgctcgtcacagcgcccgtctcggctcggtagtgcctccctccgttctcccttcccgcttgccctctccctcctatagctcgcgcggtagctcggtagtcctccc

SEQ ID NO: 84046 - DNA, 582 bp, Oryza sativa
catatttgtcaccgtgggtaccagcactatgtcttgggactggtaccgagatcgcggtttcgtaggaagcggtcgcgtcgttttccctacgacacgctcctgtcaggtgccgttgtacggcggtatcagattggggtgtgacagaggatctacacgatacggcatcaagcaaacatgaagacaaagattacactggtgtcacgccccgaactagtcccgaccggaactagcccgtgacgctccaaattaacctgttaatcgataccagtcccaggaaacagtgctggtatcacagggagacagaatatcacagcaacagaggtctctttattatagagtagaggtacagtcatgttgggctgcggacagatcccgagctcacaactgcattacaaaagggaagcggaagccaagacttggaccaaacaacacaggcgcgacttgggaactaggccgaaaccctaaaactcatcgtagccggcttgctcctggaagaactcctcatcagcaggatccgcttcatcttcttcagcaactggggggagattatttctatagagcaagggtgagtacgggagtact

SEQ ID NO: 84047 - DNA, 522 bp, Oryza sativa
tttttttttaaaaaaaaatctggagagactcaatttttaagctctctgccgatccaaggtccaatgctcactatacagacttcattcaatcagtagaaatccacttatgcagatgaaaaaaaaagcaactcttgattgcaatcaatgaatgatccttacagaagcctgtttagttactcatcaacggtagtgtatttgatgtctgggtatatatgagtggcctctactccgaccgttggtttgatctcaaagttgatgtgatctcatttatatatacagaatgaagtatggccagatcgatgcttagtggtgaacactctgcaagaccaaatacaatgatttttatatatattccaactatatagacactattaagatttgatatatagcaacaatcagacaagtatagaattcatttccatggtgtttctttaaaaaaataaacaacattgttaacttatttcaattatttaaaacaaatatgtagtaaatgggaaggtttaattctaattggaatatttt

SEQ ID NO: 84048 - DNA, 616 bp, Oryza sativa
atggctaataataacatcaggggtagagtgatagcatacgcacatgtgcacgtacgtgtgcgcatgcgcacacacaataacaaaattgtgcaaaacaatatgattgattatgttttatttcagttgctagtaatatgtcatagttgtagtttgacataaagaaggaagcaaaaaagataaattagcctataaaaacatactacaatgtagacaaatcattcattcccattacattaaaaaatgatctagtctacatatggacgggtgtaagcagagttcagctcccaaatctttagcgattgggaagtgactttaacatttgtgggattgttgaaaaaaaagattttgcccaactcgtagatggctttggggggatacacacgcgaggtaatgcatgtcctccctccttgagggaagccctcaactatggagtgatcaacctattgaaagaaattgcacacaaagagttaggttacgacgtatcaaaatatatgcgttgtggcatatgaatatgcatgctctcaacattgctagaaagacttaccaaaatccttattgacaggttttcgccatctagcacaggtaccaagctgccatagactctcttaactagatc

SEQ ID NO: 84049 - DNA, 656 bp, Oryza sativa
cggctcaccgtccggagggagcacgcgacgcacgcgcgcgggcagggaagggacgcggtgcatgcgcgcggtccgcggttgacgcaggtgcggcgggcccacgtgcagcctcacggctcgcggtggattgcgcgcacgcggagggaccgaccggggtcggcccgaccctgtctggctgagctggcgccgacgtggcgcctacgtggctgccacgcgggccggcgggaggtagacgacgacccggccgcgaatggacggcgggcggcggcggcgagcggcggagcgaaccacggcgatacgggcaacagcgagcacaccgggcggttgcacgtgacaagggggggcgagccaacggctcggattcgccggaggttgctcgacggcggcggattgcggcggcggcaaccggcggcgggagaagagggaaacggcgacgaggtcacgagaggtcgattcctggcggtgagagcatctacgcggcttcgggaactcacgctagcgtcggattgggcggaactacgccgagcgaggccggcgacgagcgggtgctacggagctcgggcggcgacggcggcgagcacacggcgagcgatggcaacggtcggggcggcgccggctagctacggggagtctactcaagctactaccgaaagcta

SEQ ID NO: 84050 - DNA, 1330 bp, Oryza sativa
ccgtcggttccgtggactggcggtggaccacccgcgtggtcccggtccacggtgaaccgccctcccccttgagtcgctgaccggtgggtcccgcttgccggcgccccttcctccctctcccgagccgctgaccggtggggcccgcttgccggcgccgcgccccgccttgatgacgtcagccctgggatttattgcgcaataaatgatttaaggtttttcttttatagtaataaacacagtgaatcttctaaaattcataactaattcatccgagctccgtttaagcccattcaagtctcagtaaatcaagaaaaatgtgtagaatccattaaaaatagttttgttccctgtttcagtagtcttatagcctgtttgcaatgtttgctttgtatgtcgctagattccggttcctccgacactccggtgtacttcgaaatagtcgccgaggttcctccagcagcagagcaaggcaagtcatgcttgtcacttgaacatgttgatcctatattgcaaatgctctattgtttttcttcaaatattgcattgttttataatgttactatgggatgtttacctattgtcatagccatgctattgttgtaccatgtccctttgtaaccttggggttataacatgactagagattggactagggattgcttagccatgcttagttcaactagtgcacaatggggaaaattctattaatgtttagactgctggttctaatggtattgttggattagtgccaccgctttggtgttggttaattaaaataaatcacatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagccgacgcatccaggcaagggtgggcgtgatggggtttggatgggccctgcgacggcctatacggcttccggattcacctaggcacgagaggggactgcccgttgccttgcgaggagtgggggtgaaacctgaggtatgatgtgcttggttagagggggttatgcgaagggtcctgtcatggcctctttccggtatgtcgtggtggcatgtcggcgcacggaaacgtgtcgtggggctgtgtcttgtgggtacagttgtacacctctgatcagagtaaagctattcgaatagccgtgcccgcggttatgggcggtcaaccagattcaccgtgattagtctcaccctagtttagtcttttgaaatttgatagtataggtggatggttgggcctgtcgcaacgtgg

SEQ ID NO: 84051 - DNA, 946 bp, Oryza sativa
aactaacatatgaatttcagtcgatataacacatgaatctgtcatgtattgcaaactgaaatgctaattttgtaactccaatccaatatgaagaatcgatgtttgttggtgacaagagcgaagtggtatttaggagcaaatataaacaacttaaccgggagataagcaacaacccaagcgtagaacctatcaggaatatccttaacctttagctacatctaccttccagcacatctgaaaaagttgctcccaggttgtacactggtggatagcagagggcttcgtgcaagggagaggtggaaacaaaatgcaggaattgagaaacactgtatgaaggcagtgacctgatgttggcaagccagcgcacttgatgactgatagcatactttatggagtaaaatggacaatttccttaaaaagaagaactgatgaagaaccactactttaagtgcatcagttgttaaccaatagtattaaatttaaaagtagcaaattatcatgagttgctcatataatgctgaatgttacctgaccaacatcggcacggtagaagtaggaaggcctcgcggaatcaaagctgcatctccacgggtttctaagacccaatgcccaaacttctagttctaagtcactgtcatcagtgtatgggttgtcttttggaatggagtagttaccccacaagctggttagcaatttcactctgtcctgtaaagggaaaaaagggaacaaattatcaaatacagtacatgctgatgctccatatattgctaattgtttgtcttatgtgagaggagatttatcacaaataaatatgtgaagtcgtttgcaaaaaattcagttcgtatgtttgaagttcatcataaacatatttatgtacccaccccattacctacttacacaaatataagtagtgaatccatattactgggttgttgctatataggaa

SEQ ID NO: 84052 - DNA, 1105 bp, Oryza sativa
gccgcgtatttggccacctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaagatttggcggattctattgggatctgggtgggtgtccggtacttttgtacttacgtttcatgttgcgctcttcctcttcattgggcacgggcacatccaaggctacatccgtatttgaaagatggagggaatccaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacccaattccggcattcataccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactaggaaagtgctttgtatttgaggatgtgcgg

SEQ ID NO: 84053 - DNA, 684 bp, Oryza sativa
aatctcttgatataatcaatgacatattcactgtatttttgcctaatcgatgttaaatcacttaggctaagtttagttttaccagtatagaaataatcatgaaatatttgctctaattgaggccaagtatggatagaatttgccggtaaaaaagtaaaccatgtaaaagcagtaccggacaaagataaagaaaacaagcgcaatttataagtatcagaactactagcctcaccacattgcgctaagaattgacctacatgctcccatgtggtcctactatcctcaccactaaatttggtaaattcggaaactctataaccacgaggatatgggatgttgtcataataatcaggatacgacttttggtaaccttagcatgattccagcttcaatcctgaatttatccctaataataccactaatcatcctccatattctcaggcctatgctgatttggtggtgggtttggtggcctaaaaggttgcggttgcggcgcaatataattatattggccatacctagtattgggaggatatcccctagtaggattattgtaaacatttggaatatgtgggggaacttgggtattaacagtagatacaggggaatcatgtactggaatatggtataaaaacccattatttgtcattggatcaatcccctgtattgggatgattgcgccgg

SEQ ID NO: 84054 - DNA, 639 bp, Oryza sativa
aaagaagctgaaatacgagagtaccgtcatatatgggatgagccatacctgatagggttgctctgatggtctattgagaagatgcgtgccaactgaagagggacttaagatcatagaacgatgccacgcctcgccttatggtggacattacagtgcattccgcacccaggcaaagatttggcaatgtggtttcttcgggccgcaatgtacgaagactcaaaggaatttgtcagaagatgcccaagctgctgtaggatcgagatgtcgactagaggggggtgaataggcgatttaaaactaagtggcacgtaatcaaaactaacctatgttgctagggtcggtgagagacaagtctaactaagcaactaagttatgttttgcaatcctagggtgaaagtggttcaagtgtatcactaggaaagtaaatcacacaactaaattaagttttgcaatcctagggtgatatggccacaaataagtttttatgaaatataaattgcacaaatgtaaatgcaacaaataaatgagacaagagacaaggaatttttcactgaggttcggaaactcgccgatttcctaatccccgttgaggtgagcccaactccaccactcaaccacgaagccgccgcacgccccctt

SEQ ID NO: 84055 - DNA, 778 bp, Oryza sativa
attaatattaattaattattacgactgttttcttctttaaacttctgtttataaatgctcgctttatgcaaatgaaccactctagctcttctttgataattccctgcatcatacccctattccggtatgacttctgagtacagtgggtagtactcagtcttgctctatttttcccaaccccagagcacgagtatgtgtcagatgaaggtttctccgaggagtaggcttcgtccgtgccgtcgaggatgcctgtggagtggtgttcccgctgcagatctagtcaaggcttagctcctgttgtctttcgttttccgctgcatttatgtaagacttttatgatgtttgtaagacgtggatctgaatgtcaacattgacgtggatctgaatgcacattctgcttggaattctattcgggaatttctaggcgtgacagtgaccatggctactatggatacaaccatagctcacatcatggatgaaccagaagatatcaagatcaagtcctccaagtgttgaaatccgattcggccaactgctacactgctgacttcaaacggtcgccgaatctgcatacgacctccgttttcggtccgcgagtacttgatggaaatatctcggagccctctttccaacggatctagcctcatcaccaaattccatgtagtttggccgcaatcacataaacaaggtgttgtgtcacttgtcttgggcctctgggcttgtaactttgtttaggaccccagcccaggtggggcccatgtaagggtgcatcccatcc

SEQ ID NO: 84056 - DNA, 503 bp, Oryza sativa
acgggcggggcgctaaagcggcggctaggagggagagggaggggaatagaagggagagggcgcctcaccgagggtggccggcgcggaggaagacgacggcgaatggcgacggcgagccacgggaggacgacggccaccggcggacgggattcggggtgccctaaagaaggagacgagagagattagagggagggagatgaaccacggcgaccggtatccatggccgaaagcggcggtagcggttgaactcaccggagcgtgaggggatgcgaattccggcgacgaaactcgacggggaaggggcggccggggtggagcttagcctcgcgaacccgacggcggcgacggcgcggtgcggcggcgaccctagcggcggctagcggcggccggagtagcgaaaacggcggcggcgggtggttgcacggcgcacgagcgatggggagctcgggagagttcggcgaaatggggaaaaagcaagagggagtgacggggaagcttaaata

SEQ ID NO: 84057 - DNA, 639 bp, Oryza sativa
aacacagatggagcaacaacagatgccatgagacgagatttccgacaacttggttgctgcagcagttcatggagtatctccaatgcttcagtttttaactctgaatcaagaaatgaagcaacgagacgcactgcatcttcactaatggatggaattcgggtcctgtatgaaaaggaaatcagccgttacaaaagtttattggagaccaaacaaacaaattgccataattgaaccctttgtttttaaaaagtagcacaaaacaatcttcgtttttgtaggataaatatagggcactcagttttatttatggatttttattgaaaaaggtagaaacagcaaatatcttatgtttgtcaacagtaaaatctgcacaaggagatttttagataattaatgaattaaaaccagagctctacatccaacatggttgtacacagccaaactcaaggagaatatattatacaagaatgctcacctgctattacgtagaaaagcaagaaaaaactgaatgccagttctttgagcttccattgtgcattttccattatcgttcttaagaaactcaagaaatgaatctaaaaaaccattggaaatcatagaacgccaaatttgatattcacgattcagaacacttttgaa

SEQ ID NO: 84058 - DNA, 619 bp, Oryza sativa
cggtggcccgtagcgtgttcgccggccgcatgacgaccttctacgcgcagcacaacttcctgactggcttcccggtgccgccgctgccgctgccggactccgcagcgctgtgcctctcttacaattgcatggagctaccgtccgcttctgccgccaacgggtgccccaccatcggcggcccaatggagtccaggcccgccgaccagtgccggagcagcaccgcagccaacgccggcagcagcggaggggacggctgagccgccaacattcctcaaggctgacaggtggggcccacctggttcagctcatcagctgggcacgggtgggggcgtgagaaagggacggccaggatagctaagcctggctcacacattttcgttttgtccgtttgtttcgggtgtggttttcatgtgattgggtttgaattcatcggcatccgggcttgtcgtcgggcgcgcaacggttacacggctacaaggttagcgcgttcttgtgcgtgtgtgcaattactcgctctggtagtttgtacgctgcgtctgtgttactctgttcattgtgagtagctggcagtgtccatttaaacaactctgttcatactctactaagtcagctaatgtaa

SEQ ID NO: 84059 - DNA, 551 bp, Oryza sativa
tgccagatctgcacacgctcgacctcggcaataaccacctcacggttccattcccagcggcttgctgctgccgtcttcgcagagcctcaaggtgctcatcctagcgaacaatggcggcctctccgggcagattccagaccaattttccagctcacagcttttccatgtcgacctaagccggaattccatcactggctcgctcccaccgctggcgcagacagtccgctacttctccgtcgcggcgaactcaatgcaggggagcctcgacggcgcgttcggcaacggttcggctccgaccgacttggccttcctcgacctctcgatgaacaacttctcgggttcaatcccgcgggagttgttcgcgctcccgagcgcgtcgtcccttcttctgtcccgcaataacttcaccgggtccctcgccgtgccagcgttcgcatcggagcgtgccgcaacgccgccgtggtcggttgtgaacgtcagccacaatggcatcacgggggaggtcccggaggagctagcggccgtggagagcctgtacgtgaacaacaacc

SEQ ID NO: 84060 - DNA, 1342 bp, Oryza sativa
  unsure (1)..(1342): unsure at all n locations
tgacccgggaaaggggcctttatcattttgccaagtaaacaagattcgcatgtctcaaatgattcaaattcaaaagagtgtagaagtccatctctatgaagcttctccatgcgtttctcatttatatgacccaagcgacaatgccaaatataggacgttgcctttttgcattcatgttatagactgaacatccatcaagattcacaatgtataagccattcatcatgggtgcatggaaatagaaaatgtcattataatagactgagcaaccgtcgtccacagatctaaaaccataaccctctgcttgcaaacaagaagcagagataacgttcttacacaaagctagaatgcaataacaattatttaactccaaaactaatcctgacggtaaagataatgccattgtgccgaccgcaacagcaacaactcttgctccattggccacgcgaatgtccacttcgcctcttgctaagctccaacttctttttagcccctgcaatgatttgcatatatgagcaactgaccccgtatcaaatacccaagaatcaataggaagtagcaagattaatttctataacattaatacctgaggtggaactctntncatcttgctgcttctgcttgagctgctctaggtatttctttcagtttctcttccaatgacctgtctccttgcaaaagaagcactatgcatccttagcggaccctgtcttttgaaccttggtcttagagttgctagtactcgtgatctcatgagagtttagctttctcttttgaccactcttcttgttgttgggtttgcgcttatgcataaccatcacatggttggagtttttcttaatgctttcctcggcagtctttagcatcccatgcaattctgccaagatcctgttcaggttgtttatgttgaaattcattatgaacggctcaaacctgggagggagcgattggagaatcaaatcagtagccaactctcggctaaggggaaaaccaagcttatccagactctcggtgtaaccaatcattttgatcacatgtaggctcactggattaccttctgcaagcctgcacgcaaacaagaactttgaggtattaaacctctcagctcttgcttggtcctcaaacatgttacgtagtcccgtgattattgtatgatcattcagtgcctcatattgcctttgaagctcaggggacatagtagcaagcatgagacagcttatatcaaggtattcattgcatcgcctttcatgctccctacattgagcagcaggagcattgttgggcaagtcagctggaaaaggctgtgtaagcacaaactctttgtgctcttgcctgagaacaa

SEQ ID NO: 84061 - DNA, 1999 bp, Oryza sativa
gagcattgcgcacccgcagagagcttgtacgtgctgggctgaactttttcactttcacccatctagtttttcgcttttttcgctcttgatgtacagaagggcttcggcttcccctacccaggttctcgtggcgcacctgagcgcgaagcggtctgccttggagcggctggacgtgtaccgtcttcgacttccgaaggccgaagaggaccttcaccataaagaggacaaacgccgagtcgtgccggacgccctgaagaaggcgagcgcagagaacaagtcccttgtgggggaaaataaatctctctgcaccgacttggagggggtgaacaatagggccgccgaaagggagaggcagcttgctatggccgaagaaaaagtcaagtctcttgaggcccggcttggcccagccgaagctgctgctgaagctttggcgccgacgacagagtctgccaaacaggcttgctatactcttcggctggctctcaactaccttggggcgcatgtagaaggcgctctgggtgaagatggatcagcgttcgacttctctgagtggacgcaggatgcggccggctcagttgtcgaagcggctggcgcatacggcgactgctgcgcacgagttgccgtgggcttcatgctcagcattcttcacgaacatggttgttaccatgttgaggactttccccaaaccgtgaagaaggattggcccgaaagttcccaatccgtcacgtttgctttgaaggcctttcggaagaacttctgggaaagcggcggtaaggatggggcgaagacccggcttcgcgagcagctggagaaaatagcaagggccgaagatgccactgccgccaacactggcgaagaccccgagccgtcggggccggctgttggccgtgagggccaaggcactgaaagccgacaccaccctgaagtgtgaggacctttgccctcacgtttttcgcttttttagacttttatagccgtagtttgtttacatatatatatataagtgctttgcatgttcggctggagccggttttttttaaaaaccccccttaaaaattttcccccttttttgggggtaaaaagggcccccccggttttggttggcctttttgcttattaatgaaaagtttttgtttcaccaattgtgcaacttttctagaatgtgttattgactttgttagcacttcttcccccttcgctgcactattatgccttgttggtaggattttagccgaaagtcatgcgttcggccccccttggggattggtgaaataagaacgagaagttcgtggcagtgaaggatttgccgaagaccaagtgtctctttcggcctatttaccgcgaaatgttaataaatggcaagagttacaaggttataaaagtagcggggtggatgcgtgcacatccaggtcgaaccctggaggactgtgaccgctaccatgtcgctcgtcgtgcggaaagcaccagtttgggttgtgtataatattagtagtgatgacgaaccctgttcgccaatttgtagcgtagactgggacgaatgtataaatgatgatataatatttttgtaaggtttacttacataaatacaacagatttgcaccttcgcttactttacattgtgaatctttcgaacatattttcgtgctatcgttcgcatagtcactattgtgctgtcgttaggtcgaaacgtgtcggcccctttgcgtactatagcaaaaggatatgtttatttctcagatctcttcttccgttttcggctcgtggcaggcgtgctacgaagcatcatggcatgtgcataagccgagtacaacagtgttttgacttgtattttcaaaaatcaagctgtcgtggtttcgacgtttggtgagctatgcttcgaccgattcgtttcgcacccctggcgtgttcgctgatcaggagtttgccttggggtttttccacgaagacattgttcacaaaaaggaaggcgaaaagacacaaagatttttatactggttca

SEQ ID NO: 84062 - DNA, 706 bp, Oryza sativa
acattgtggtctctaggtcttccaacaaaagtccacaccttgtttcttgcaaagttgttgagctcttcatgaatagcattcatccaatccggatcataaagagcttcatctacatgttttggctcaagacaagaaacaaacgagtaatgttcacaaatcgaagcgacaggagatcgagtttgaacacccttactaatgtcacccaacacttggtcaattgggtgatccttggaaagagcggtgtatatccgtggaggcataggtggatcttgtgccttctccttctccacttcaacttgagcttgacttggcgaagcggaagtagatggctcatcttgagtggaggtggatggcttgtcttccacttcaataggcttgacatctccaatagacatgttcttcatagctctcatcaagccttcatcacctacatcatccaaattctcgtgcccctcttgggagccattagtctcatcaaattgaacatcggcggtttcttccacaatacctttattcttgttgtagacccggtatgccttgctatttgaggcataacctagaagaaacccttcatcacaccgactttcaaatttggttagtctaacaccctttcggtaaatataacacttgcaaccaaaaactcgaaaataggcaacatttggcttcctcccaacaattagctcgggtaccgagctcgaattcgccc

SEQ ID NO: 84063 - DNA, 2510 bp, Oryza sativa
ctggagattatcctgattcccaaaagttagtgaataaggctattcgccagaggacaaagtacacccgcatgaagcaaaaggaacgccggattgctcaattcaagacacaccaggggaataatcaaaacccgcgtcttactttaggaccccagtccatgccacagggaggttcttcgtctgttgttcgtccgcagcgtcagttcttcaacaacaatgccggcaacaacatccgtaatcaagctccacgccctgttgcagcctcgacatagcaacaacctgccaagagggagcaaggcagcaagcccgtggtgtgtttcaactgtggagacccaggacattacgctgacaagtgtccgaagccccgacgtgtgaaggttgtccctacccagagcaactctaccgcaccagcatcaaaggcccgtgtcaatcatgttgctgctgcagaagctcaagatgctccagatgtgattttgggtatgtttcttgttaacttagttcctgcaacagtgcttttcgattctggtgctacacattcattcttatctatgagttttgcgggaaatcatgggatggaagtagaagatcttagacgtcctatgatggttagtaccccaagtaatcaggcactctctttgcaacgtagcccctctgtcagaatagaaattcaaggcgtaccatttctggccaatcttatcctattagaatccaaagaccttgatgtcatcctagggatggactggttagccagatataaaggtgtgatagactgtgctaacagaaaagtacctctcaccagcaatgatggtcgagttgtaactgtttatgcattgtcttctgagtctttaaggtcaagactaaaccaaataactttggaagagatttctatagtccgggagtatctgatgtgttcccagatgatttacctggtatgcctcctaaaagggatatagagtttagaatagatttggtaccaggaacaactccgatccataagagaccttatagaatggcagccaatgagttggcagaagtcaagaggcaagtggacgatttgcttcagaaagggtacatcagaccgagttcatctccatggggagctccggttatttttgtggaaaagaaagatcatacccagaggatgtgtgtggactatcgtgcattaaatgatgtgactatcaagaataagtatccgctacccagaattgatgatttatttgatcagcttaaaggtgccactgttttctccaagatcgatcttcgatcaggatatcaccagttgagaatcaaagaggaagatatacctaagacagcttttaccactaggtatgggttgtttgaatgtactgttatgtcttttggacttaccaatgcccccgctttcttcatgaacttgatgaataaggtgtttatggaatacctagacaagttcgtggtggtctttattgatgacattcttatctactcccgaaccaaagaagagcatgaagaacatcttcgccttgcactggacaagctgcgagaacatcaactgtatgctaagtttagcaagtgtgaattttggttgttcgaagtgaagttccttggtcacgtcatctcagcaggaggagttgccgtcgatcctagtaatgtggaatccgtaaccaattggaaacaaccaaagacagtttcagagattcgtagttttctaggcctcgcaggatattatcagaggtttatagagaatttttccaagattgctaagcccatgacacgattacttcagaaagatgtaaagtacaagtggtcagaagaatgtgagcagagttttcaagagttgaagaatcgcttaatatcagctcctattttgattttacctgatccaaagaagggattccaagtgtattgcgatgcatccaaatttgggttaggttgtgttctaatgcaagatgggaaggtggttgcttatgcatctcgtcagttacgtccgcatgagaagaactacactactcatgatcttgagttagctgcagtagttcatgcgttgaaaatttggcgtcattatcttttcggtactcgtacagaggtgtataccgatcacaagagtttaaaatatatctttactcagccggatctgaacatgagacaacagagatggttggaattaattaaggattatgacatgggaattcattatcacccgggaaaggctaatgttgtagcagacgctcttagcaggaaaggctattgcaatgctacggaaggacgacagttgccattggagttatgcaaggaatttgaaaaattaaatttgggaattgtcagtagaggtttcattgcaaccttagaagcaaagcccactctaattgatcaagtgagagaagcccaaattaacgaccctgatattcaagaaattaagaaaaatatgaggagaggaaaagctatcggtttcttggaagatgagcaaggaactgtatggttgggcgagagaatctgtgtccccgacaacaaagatttaaaagatgcaattctaa

SEQ ID NO: 84064 - DNA, 783 bp, Oryza sativa
agatgttaccttaaaggagccctttgccatgagacaaagtggagcgaagagtgatggagcctccttgatggcaacaacggccatcttcttcttcatggagcttgcatcatcaccaccttcttcctcggacccggatgaggcgaagctctcctcatttgagtcccattccccaatgaaggcctcaatcttcttcccttccttcttaagcttccttcctacatccacaatactccaaatatggaagctcatagccttgaggtgagtagacattttaattttccaagtggagtagtttgtgccattaaacatgggagccttccctacatggtttacctcgttcgaaatcttctctctaggcggtgaagcccaataaagagaaacctggctctgataccacttgtaggatcgagatgtcgactagagggggggtgaataggtgatttaaaactaaataacacctaatcaaatctaacctaagatgctaggcttggtgagggtgaactctaactaagcaactaagttatgttttgcaaacctagggtgatagtggctcaattatatctctaggaaagtaaattgcacaaatgtaaatgcgacaatcaaattagacaatgagacaagttatttttcaccgaggttcggaaactcgccggtttcctactccccgttgaggcgagcccaactccaccgctcaaccacgaagccaccgcacgcccccttcgtcaaggggtgggcaaggcgggagccagcccacggagaggtctacccaagcctcgatcactc

SEQ ID NO: 84065 - DNA, 724 bp, Oryza sativa
tcgagctcggtacccatccttgagttgcttgatttgaagtccaaggaagaagctcaactcttcaatcatggacatctcaaattccctagacatcatatcaccaaattccttgcaaaatacctcattagtagaaccgaatatgatgtcatcaacataaatttgacacacaaagaaatcatcaccaatgatttttgtaaaaagagtggtgtcaacttttccaattttgaaatcctttgacaaaagaaaatctctcaatctttcataccaagccctaggagcttgttttaaaccataaagagcttttgagagtttgtaaacatggttaggatatttaggatcatcaaaaccgggaggttgttcaacaaagacaagttcggcaatttcaccatttagaaaagcacttttcacatccatttgaaatagttttatatcaaagcatgatgcaaatgcaagaaggatgcgaatagcctcaagtcttgccacggggccaaaagtttcaccaaagtccaaatcttcaacttgtgtgaaaccttgcgccaccaaccttgccttgtttctcaccaccaatctgttctcatcttgtttgttcctaaagacccactttgtccctatgacattgtggtctctaggtctttcaaccaaagtccacaccttgtttcttgcaaagttgttgagctcttcatgaatagcattcatccaatccggatcataaagagcttcatct

SEQ ID NO: 84066 - DNA, 908 bp, Oryza sativa
cagcatcggctttagtcttctccacttgtataatttcgttgcatctccagtaggtacttgaacatcttgagactcctccttggtagtaacgacctccagagctttggcttcttttctcacccacaccttctttacttttttaacctttgatccaccggaccgattcttgtgtgagaaacggtcttgtcttgagttaaatgaatgacttggaactgtcctaggtgattccttccattcttgatgaaacgacataggtgattgaggcatccacggcatataatacataaaaggataaccgtatagcgacattggatatggataccatggcgttacaaccggaggtttgtatggagttggtattgttgatggctccgatttctttgccgtttgaccaaatctcttcctaggagacgatcttggtcttttcgaatcactaggccgattatcaaatcgatcggccaatcccttcttgtatttagccataagcatctcaacagtgagcttcggctttttagtcttgttggaactagatgactcatcttttgtaactttataatcttcggccttagcattattaatcctaattgtcttgggccgaggatctctaataataacatttttccctttcgtggattcggcttgactaggccgaatcaacactttcttgttgtcaaagtcaataggactaataggaagaggattactagccattccagtcttaggcataggtgtaaccgaaatagtttcacaagtgatcgatgaattatcaattggtctttgctccatcaagcttgcatctttaaaataatcatcaaactcatgctccatttgtgaccatgtagaaattgaactaggaggaagtaaactaaaccatgtagatgcaaagtttgacaaagaaagatgaaaca

SEQ ID NO: 84067 - DNA, 1092 bp, Oryza sativa
tgagattagaaggtttcatggtttggcaggatactatcgtcgcttcattgaaggattttcaaagattgccagaagttattgaagaaggataaatcttttgagtggtcagataagtgtgagaagagtttccaagagttgaagacaagattaactagtgcgccggtacttgtgttgcccggttgccaaaaggactttcaggtgtactgtgatgcatctcgacgaggatttggatgtgtgttaatgcaacatggaaaagttgtatcttatgcctcgagacaactgcgacctcatgaagagaattatccaacacatgatttggaattagcagcagttattcatgcattgaaaatttggagacattatctactaggcaacaagtgtgaagtgtacactgaccataaaagtttaaagtatatttttactcagccggacctgaacttaaggcaatgcagatggttggagttaataaaagagtatgatgttgacatccagtaccattcagggaaggcaaatgtagttgctgacgccttgagtagaaaaggacactgcaataatgcaatgattcaacagtgtccagcagagttacagaaggaagtgcaacaactaaggttagaatttgtaaaacctggacttttgttagctttagaagttaagccaacattttagatcaagtccgagaggcacaaaaggaagacaaatatttagaacagattcggcaggatattcagaaaggagtcaccacttattctactaaagatgagcaagggacaattaagtttaaaggaagattatgtatacctgataagaaggaaattagggacatgatacttgaagaagctcatgattcagtattttctattcatctaggtagcactaaaatgtaccatgatttgaaggatacattttggtggaagaatatgagaatggagattgcagaatatgtcaacttgtgtgatgtttgtcagaaagtaaaagcagatcatagacgaccagcaggtttgctacaaaccttgccactaccagaatggaaatgggatgaaataggaatggattttatcactggttttccaaaggttaggtcaggttacgatg

SEQ ID NO: 84068 - DNA, 4766 bp, Oryza sativa
aaccaatcgttttaataacgaaggataaatttgaccaatgaaatccaaagcccaacctcgaaacagccatggttttgatgatagaattcaatacggcgacaggtgccaattgaacattgccaaaccgttgataagctgtgcatcccctatagtatttgaaataatcatcgattattttcggacaatagaaccccgctctcctaagcaaccaattcatcttatgggccaattgatgaatttccgcaaatcccttgacgtacttctcccatagcaaccttagaaaaatcactccatctatatttcggcgatataactctctatcaagcaaaatgtatttgaatgcttaccaccgaatttcccgatcaaccctaagactagaatctttcaaatattccatcaaagggattttccagtctacttctgactcatctatatctatatctatactaatataaaaatgaggagttgcacccctccaatgctacaggccaaatcatctggatcaatccgtaccatccatcctcaaatcatgtaaatcttcaccatacgatttcaccacgtcaccacgtgaatacacagcctctccactcgtgcgacggactgcactggatctcatgtctttgattccactttaattcccctattgatgtcaacaacatgtgaccatgtgaactatctccagtggttgaattatctcgaggaaatgtacttgaatgtctctggttaatctaactaataattcacagcagttatacattttattgaatcaagtatgtgcagtttcacataataatttgcagtacatgtgtttgatttgatgcacgttatcttcaataggtccagagggctggagctacacaatcagctaggtcttaccctggtaaattgttttcggttattctcaattgccgttcggtgggctcaggataaccgatcgaaattagagttgtgatagttgatttgcgggtctatggaggggaatgtggggtttacgctcatgattttgagggggtttctgttcggttcatgcaccggcctcctatagtgtctttgtttgatttatcctatttgcgcacataatgcaaaccatttaggtttacggtggtcgttggacagaagtagcatgtgtttacccatcggcgtgcccaatgcccacctacatctattttcttgttagcgaggatatcgatcaattgactgctcaattaatcaattcatctattgtgtgggttattcaggtcaatcggctcctcccctcagcccacttccatggtcaatgcagtaagctctacatccggacctgctgcaaggccaggtcaatacactccatattttgcttcatttgcaaatcggttttgcagctaactaattggatgagaacagatgtcacatgtatgtactgctcatatatcttgatatcatctcgatctcacaaaattttgatggtttgcttctcaaattgttttttactgctcaatgtaatttttgtattccgttttatagcgatttgtcatatacttctaatagatctcaacctgtattgctgatggttgcttcttccagctcaatgctttttctccctgtattccatactcctgatttgtcataagtttggagatctcaaatgcttcactatatgacaacatgtacagttcaagctgaatagtttacagaggaacataatagtagctgtctaggattggagataatttctgaacctcaagacctcattttttctacatatacggccattacgattgtttagctgtatattaatgtttagttatatatgattgtttaacttaattatatgcttatcaaattgctttgaattttatccaaattccacttggaacatcaggtcagcagctgtcaacaggtgcaacgaggacaaatttgtttggccaatgttaaattcactcgacatattttcaacagaaattttatttgtttaattctgttcatcgagccgcgccccgccgtcggtcattgtcgtcgtgcactgatccactatagtcgccagccagacttgtgagcgtgacggagggagcacgccactcttcaatctctacctcaagcggcgaccctcaccaatggtaggagcagttgtgtcctcctcccctcctccttactgtgctttatttggggatccatccatgatacatctcagtctcaggttctcccgatctattgaatcacatgcatctttcctttacttttggattcaaatttcttttaggtcttggcactttagttaactaggaatttctgcaatttctgcaatgttgagcgatttgggtgtttcagtggcatatcttagtggaactcagtagttaatgtcttgctcagtttgcttgtaaattagacagacttcactgaagttgctctgaactgtttactctcacaaaattacaattttatgagtgttttgtatccaaactatatttatctaatttacagctgaagtagctccagcgaaacgtaatttcataatgcatcgagaataccttgtggagttattactggtcgcatgggtgaatgaactcatcacaagcattggcatcaatcaacttcatgttccctctagaactactaaggaaaaattcatgacatcaaagtttatacctgacaaccactgctcggtggataaggtgagaagcagcaaagattttgatttctcctttaatataaattattttgtttggtttaaatatttgtatactccctaaaatttattcccactattattcaagcttgaagccttgaatgttgttcactaaaggaaagacatgccgtgaatgttgtataatctattgtctcctttggttttcaaggtaactgctacattgagagagactggtcttcaatcatcaattttgatttcttggttttgaaataccaaaagcaatgaatagtcagatgaggttacttctgtattacggttaaatgcactggctgtttcctttaagctaggtttctatcaattttacttgaggacacgttttggtttaagcaagcaaattttcttgctaaatttctctatgcagatatattcctttagaaggaaaattctgcaacattgtttggatggatatacatgctccgccagttgttctcccatgatcagcagtagcttgatgatcagcagtagtgaaacatgttgattagcttaacccttacctgaattattgtttttatccgctggttgcaaattgttatggtgaggggatatagttgcttatttatgataaaattagttgctatgatttaactggtggtggcacttgcaaaagtttctttcaatgaagtgagtactgaaacttttttttagacggtagcggaaacaaaagggaccaaggagggttttttccttattcttcaccgaagaagtccctcatttgtcacttatttttcatgttagcattagtggtttagaatgaatttgttgtttttaactattaataaaattgaatcaataagtttaacatgacgtgcattgcacgtgcacgattactagtgggcacaaatgtccgaattcacaattaattcggcctttgaatcaattgtaatgtgcccccagcttcctgtctgggaccggtcagaccagccacgcaatgtcggttagaccgccccgtctgcccgatcagaccggccatgcagagccggtcagaccgcctctggtctatgactttgccaatttcttccatacttttgaaatcaagcatcggcttttagtatataaatttttttcacattatagccagatgcttggtgtatcaaattattgaaccaaaattccttctttctagacatatgaaaaattataacacccaactaatatgtctagatgaatactagtttcaagtggctattgaaacaataatcattaaggcataaaaatacttagccacttgaagtgtgattaataatgaatcaccaaagtcatatgtctcgtacacatgaattacaataaactccaaatataaataatcggcttgagcatgtatgcaaaatattaaaacaaggccaatgttccaaaacataacaactctaggcaatattagaacaaatcatcacattggccgttgacataagccaaattactaagaagcaaaactttcatggtgtagtaattatgaagtctatatcttatatggtgatccatagaaacacgcatgatttggcttttagtaaatatcaaatactcatgagccaaatcatacttcaaataaattatatgccaatttgccaattctaccactcggaactagcatttgcaacatatatgtataatatcaatttgatgagcaaacacatgtgctagatagcaagcaatattttaacatggcataggcatataatataatgatgaccacaataaatccataccttgccttagcgtccaacaaacggcagctcaaagatgtgatgttgtatccatcgccgttcttctctctttatttcttcataagcatattgacgtcttgccccccaagcaaaatcggctttcttgattgcgcgatttcgaaggcaagatgaataccgcactaacacccatagcatcatgtgaaggagacttatctctaatgaccggtgattcttctctcatcaaattggatttatcactactttgggaaatcaccgatctcttaacttttacctctttgagtctccacacttgcctaggtgatgttcgaggctctaaattattacatgttttgttctccacatctttggcctccttttcttttagacctatggctcga

SEQ ID NO: 84069 - DNA, 552 bp, Oryza sativa
ggacagtcttcaatagatggcgacctcataccttcattccaacaaaatctaaaaaactcacaaccccaatgaggatcaaggccgcccttacactaactacataatgcctctctgctgcttgtcatacttcttttgatacttactgataatcctaaccaaattcacctaaaaacctctagctcttcctccatcggctgttcggccagctgtgtgcaccatattaacaggaaaaggattgccatcgaccttcatcgacctcttggagtcatcaaacttgattttgcccccttcaatatccgcctggatctgctgtctgaagactttacaatcattggtagaatgagacccacaattatgccatttgcaatacctcctcttacctaattcctcagccaatagaattgtatgaccagcagggaaattgaatctgcttctcccgaagcaacaaatcaaagatcttatcaaccttggtaatatcaaaatcatacctctcttcttttccagaattcttcacccattagcataatataaacttcttacttctaacccatt

SEQ ID NO: 84070 - DNA, 556 bp, Oryza sativa
tcagcttggggggcagattgcagaacaataacaatattggctcggggggtaaacatatcagtatcgacatgatgaggcatatcaacaatatcggtcagagggaattcaaatacatcggtatggagaagatttggccgatagaattgcaaagataatagaggagtggtttggaatcaaacctaaggaacatacttctgtgtatcggctaccatatcctgagtggttgatagggtttcattgccacatcgatacaaggttccagatttctccaagttttcagggtaggatgatacatctacaatggaacacattagccgattcttagcataatgtggggaggtatcggctgaagaagctctaaaagttagatttgttccattgtctttggctggatcggctttcacatggttttcatctctaccatcacattctatcataggatgggctgatctttagaagaaatttcatgactacttctttgctggcgtcgatgagatgaagctttcagatttgatatcagttcagcaacaagcaggagaatcggctatagaaaata

SEQ ID NO: 84071 - DNA, 1243 bp, Oryza sativa
cttgttcctcaaagaactccatcacctccagtacgtcccacatataaaccaagagtatgtattagttctcaatctatggtctgagtttattttgcctttataccaatccttaacttttgattcattgcagaaaaagtttgcttccaagaagccacaagcaccagccccatcggttaaatttctcaatcccaacgaatttcattttcagttcttaagtaaccgaggctaatctgtagttgtgttgtcagcctcctcgtcctccaactctgatttctgaatccagtgagcaaactccatcggctgcaggaagtcatcacatagaaggagaagaagaagtagcttgccgttgtccgtgatgaactctttttgcactccgaaacggcaaacaatgtttttccatacaaacttctgtactgctgccgaagtgaccgctccgaggggttcagcctcaatccatcgggagaagtattcgacggccacaattgcgaacttgtacccgtttcgcgccaccgggaacggcctaatgatgtccaacccccatctagcgaaaggccagattggtgcgatgggttgcaactcgtactggggcgcagttgggcttcggccatggcgctgacagctttcgcatttcttgacttgcacaacacagactttcagtatggtgggccaatatattccttgtcgaaacactttggaggcaactgttcttgcggcctggtttgcgccatagagcccctggtgtatttccttcgccatttccccgccttcggcaaaagagatgcagcgaagcaaaggttggagtacgccggagcgatatagttggcccgagaacattttttatttcgcggctctgagctgtaagcgctttgcttctgcttcatcttccgggagctagccgctcttgaagtattttacgaatggggttcgctagtctgctggatcttcacccagtcttgcttggtcgattgccatgacatccaagtcctctgcgtgcacacttggtacgtataggacttcgaaaaaaatgcccgatgaatgtgggcccccaaaagcagcagattttgccaaggcgtctgcttgctcgttctggcctctaggtaaatgttcgaccgttatgccgacgaagcgtttttccatagaccgaacaacctccaaatacctcttcattccttcttcctttgcttcaaaggacttatcgacgtgacctgccaccaacttggagtcagggtaccgagctcgaatt

SEQ ID NO: 84072 - DNA, 1664 bp, Oryza sativa
ccaaagggtactgcaatggcaccgtgactttgtgggcctgaaaatagtgtttaagcttgcgcgaaaccatcaccaaggcgtaagcaagtttctccatttcaatgtgtcttgttttcgctccttgcaatgcttcggagacgaaatagaccggtttctagcctgactctgtttcttggacgagggcagcactgactaccactggcgaagctgccagatatagtagcagttcgcttcctggtgttgggctgatcagagcgggcgggcttcgcagatattgctttagctcgtcgaacgctgcttggcattcgggtgtccaggtgaattttcccgcgcctcggagggtcttgaagaagggcaaaccactttcggctgcctttgagaggaatcaactgagtgccgcaatttggcctgcgagcttttgtacttcacgtacgctcgacgggggcttcatttgctgaatggcatcgattttctcggggttcacctcgatgcctcattcagaaacaaggaaacccaacaacttgcccgcgcgaacaccaaaaacacacttcttaggattcagtttcatacccgccgcgcgtaagttgttgaaggtctcctacaggtcagacgcgtggtcgaaagccttgcggctctttacgacgatatcgtcgacataaacctccacatttcatcccaacttcttgtaaaggaccttgtacacctggcgaaggttgccccggcgttcctcaggccgaaaggcatcctgaggtggcaaaaggtgccaaatggcgtgatgaaggttgtcttggagatgtcggccgggtccatgtggatctggtgatagccggagtttgcatccaagaagctcatgagttcgcagccagctgtcgaatccagaagttggtcgatccgtggcaaggggaaatcgtccttcggacatgccttgttcaagtctgtgaaatcgacacacatgcgccatttgccgtttgatttccgcactagcaccggattcgccaaccactcaggatggtcgatctcttgaatgacccaagccttgagcaatttttggacttcggcttttgctgcttcttggcgatcagcggacgtcttgcgtagcttctatttccttggcttggcacccggcttgattgccaggtgatgcatgatgagatctctcgaaacacctcccacctcatcagggccccaagcgaagatatcaatgtttttcttgagcacatctatgatattgtcaacctcttctttgcccatgtcgccccaatgatacgagctttgaggggttggcgtcatcaatctgcatctttattaccttgccgtgaggggcgggcttcggcgcgtgcttcgctcggtcctgtggttcggcctcaacattatgcactgctctgttgattatggccagattgccttttgaagcagccgaaggctgtatccccttgaccacaatcactcctgccgggccaggcatcttgagcttaagataattgtgctgggaaatggcttcgaacttgttcaaggttgcacggctgaagatggcattgtagttgtacgggatgtcgacaacgtaaaactatatttgctcttcgcgtctattttcgcctgtgccaaaagctaccagcaattgtgcttgacctagaacttgaactgcttctccgctgaaacaatgg

SEQ ID NO: 84073 - DNA, 826 bp, Oryza sativa
gtctcatcaaattgaacatcggcggtttcttccacaatacctttattcttgttgtagacccggtatgccttgctatttgaggcataacctagaagaaacccttcatcacaccgactttcaaatttggttagtctaacaccctttcggtaaatataacacttgcaaccaaaaactcgaaaataggcaacatttggcttcctcccaacaattagctcataggaagtctttttcaagagacgatgcaaataaagcctattggttgcatggcaagcggtgtttatggcttccgcccaaaaggaatcggaaacaccatattcatcaagcatagtccttgccatctcaatcaatgtacgatttttcctctctactacaccattttgttgaggtgagtaggtagcggaaagttcgtgtttaatactaagatcatcacaatagtcctcgatattggtattcttaaacttggaaccattgtcacttctaattttcacaagagtgcaactaaattcattttgggccctttttgcaaactttttgaaaagctcggcaacaatacacttatcatgcaaaaagaacacccaagtatagcaagaataatcatcaacaatcacaagacaatggctattaccaccaatgctcttataggttgttgggccaaacaaatccatatgcaagagctccaatggtctagatgtggacatgatactcttagtaggatgagaacatgcaacttgcttgctggcttgacaagcactacaaagcttatctttctcaaacttcacatctttcaagcccacaactagatcacgttttgaaagtttgctcaatt

SEQ ID NO: 84074 - DNA, 3126 bp, Oryza sativa
ccaaagtctctcctccttccctctcttttcctccctcctccattccttctccttgggccggccaaggccgccctgccccctcccgcctgggcctaccccggcccaggccgagcggacgtcttcctcccacgcccctgacatgcgctgactgcacccgaccggtgggtcccactcacccgagtcatcgtcctcctcccgcccggctcctccctctcccatgaaaccctatccgtttcctccctcaaatccgcgtgaatcaattcccttcattccaaattgattgggggaattaatcccctttccctcctctctctttcccccataattcccccttgaatggcgccctcagttgcccggaacggccgcgcctttcccggccaccctccttggccgccggccgacttttccgccaccattccccgctcctccctgtaacatacccaaaagtccaggactcagaaatttcttgtcaaaataattagaggttaacttctccaatttttgagagccaaacatttccgttttaatttaggtgatgaccaacttaaaccattgcatgattaaaatttgagaacaaaataaaaccttttcattcccaacattatactagaaatgtcatcaagcatttgagcatacatgtgcataatgcatgcctaggctcgagtcccttgtgcatttggattatggtctcgcatttcataataggtcccatgagcataatctaaaagaattatattactaaacaaacctatagttaatcttgggtgataacatgtggacttaatattaaactcaaatatcatcttctcagcccaaaagaagtttaatgtaatccctgtaacaatattaggtgcaattaagaagtgggaacacatatataaagtaaagtaatcctaattctctaaaatattatgtgcaagttaaaatcatggaaaaaaattagatagacaatgtttagcacaaccaattcactataatattggtacaagttaataactaagtttaataccacaaataaatcagtcaaagcagaaaactaaaaggaatcaaattaaattttaatcggctaaagccatacttcatccaaaagtacatttaactgctcataagtgaacatggaaaataatttattcaaattctagattatttatcatgcctaaatataatttttctagaattgtcctcctctgtttaagcctcctaaaaatcagtctagctttctaatagcccatctttgtttaatttctgtgagcagtctacccattatttttacgtgcaaccaaagaaaatggaatctagatataaacatctaccaccagtaaaatctacactaattcttctagtccacatattaagatattgagttgcaaacttagggggaagaaataattctgaagattatccaaaaactaagtctacccaaactcctacccatacctctcttcccagcctagcttccatcgacatggccccacctggcagcctctccagctcgcccttcctctgtccctcatcctcagccgaccaagaaacacagagagggagagatcgagagccgaccgagtcctggacgtgtcgacgtgtggtgacgacgtgtcgatgccttcaagtcactgagtcatgcctccatctcctctagaccgagtcgcccaactccacacatcactctggagctgaagaagccgagggagaggtcctcagcctcttcgtcatcctcaacttcgccgccaggcgtagtgacgacgaccttcgccatctccgtttgagtcaaggtcacctccatctctttcgcgttcccatctctccacacaatgccgagcatttcctcttttgaccaaaaccactctggtacagtgcatcgccgggaacgcaagccacaccaacaacgccttggagcacgcaccggagcgccgccgcttcaaccatcgtcgtcgtccggccattctcgaccacctcggagcaagccactgcgccatcgtcatcgcctcaacctcctcttcaatacgcctcaagaaacccagccgaagatgtgaaggactcggagaacacatcttttcttcaccggcaccgatctagaatcgcctccgccgtcatcatcgataaccgctgcctcggtgagccattgttcgattccttcagtatacaccatctccttgacctcacaaccctcgtgcattcttgcttgaagcagctcattgtcccgttcgagccgtcgtcgttcacccgaggaggagcactgtcgccgagccgttccacaagtcaccgctgccgccaagaccgcgacaatcctagcttgacccacggtgagcatcctgaaggctagaagaccacatgcatgcatccttttcatacggaatcgacttccatgcacacatgcactttcaccccaagaaccactgccgctcacactcgccatcggcgctactccgatgtcctctaaccaataaaactagaggaatggaatcacgagagcttgctcttcattttatctcttgacctcaacctcaaacgagccaccgtttgccgccggcgagctcgagatcgagctcagccatggctagctctgctctgtctagagcagagggatgacttccgtgaattagattaagtgcagggatccgtttacaattgtagaaacacactgacatatgggcctaggactgcgggttgattcctagaaacctcaagggcctttgtgcatattggtccctcacagccatgtggacccaatcctttaaaatctgaagaataattaagaaaatgcccaaacaaatatatgtttagcagaaaaatgcacaaagttgtaaaatctatataaaatcaaatatagctcattttgaagtgattctagttgctgtagattcttgaagttatgaactttattccaggcatataaaacttgacactcactgtacaaataatgtctctaaaatttatctaagataggtcatacataaaacatgtacaaatttataaaacacatagaaaattcatctcaactcattttgaaacaacctcaaacactgcagattcatcatcatgcactctctggttaggtgaaataaaagtaattacttactttgcatcaaatgcctctaaaactattatatctaaaatgattagttt

SEQ ID NO: 84075 - DNA, 912 bp, Oryza sativa
acacttgtgtttgcatctatgtcctagggtaaaaatgaaaaagttttagtttgccctcaaattttattcatgcaagagttagatcaacttcacctaggtttaaaacggaaaattttggtccacaaaattgaagaactttcctttcaactagttttgacgaaaatttcttaatcataaaattcgggtatgttacagtacgacaccactcgagtccggatttggtgagaggaaaagggaaactgattttcaatcaatctgatctactatttccttctagatttggaaattcttcttcctcctcccagtgccggaaacagcacgaccgatctattcacgggcaaaccagaaactcaagcaaaacctagatgcaactccaaaactgaccgataaaaacttctgaaaactacgaaaatagaaccgtggcaacgagccgattccgttttcgtaggtcccgacgacaacagagacacggtggctgcgatgactgtggtacaaaacatgaccagaactcgaaactctaaatgaactagacactaagaccagcaacatgacatgacgatgcaacacaaaactcaaaaaagaaaaaactgaaaagaacaatgcaatggcacaatatggctaggtaaatgatggtatttttttatggctattttctggttatgggtagaaaaaaactcaccggggaaacctctagagtcgacctgcaggcatgaaccttgagctccactctaggctgttgttggcccgatctttcggtgagttgatgataactacgatttgggagaaacgttgacgacccaactacaaccgtactagacattattgtgttgcgccttagcgatcgatacacctctccataggttgttgatcttgccagtgcagatcaaccttattcctgcaagcaaatcaaag

SEQ ID NO: 84076 - DNA, 591 bp, Oryza sativa
tggagtgacggcgacgagggcggcgttaggtcacagggcgctaaagctcttccgacggcgagacacaaaggcaagggtgccggtgggtaaagcaaacaccgggggtccttatataagggttggagggcagcggcgaaggcccacggcggccggcgacgcgaagaaaacttcgggaaaaatgaatccgaatcaaactcgaatccatgaatttccaaagcgatttagacgatgattcgaaaagagaaaaggtagaggagatctcgaagattgtttcccctcaattgatttcaccggagaaggaaagacgcggccgaatttggaaggagacggcggcggcgcggcgatagggtttcgggcggcggcggccggaggtaaacgatgagtccgacaagtgggacccacctgtcagcgacagcgcgctcgcgcggctgcggactggactgggccgacttgggccggggagagagagagagagagagggttttgggccgactttcggcccaaagcccaaagagacttttaaaaacctttttcaatttaaattattcatgaaatgcaataccatttattaaaaatacttccttagctcaa

SEQ ID NO: 84077 - DNA, 526 bp, Oryza sativa
taatggaagctcacgatggtcaatcgtgattggttaattaattaatttgccaaataaaacttgataaaggtgggttgtgagcacatggttttgatggtcgtgctcaaggcaattaaggaccggttcacgagtttcggttgtgaaacattaaccgtgccaactacaagccagcgtgggcaacggctttaccatttgtatagcatggttcattgcggagcaccagactgagaagtggcagagataagcccacgggggtcgctggagagtccatgccttgtttataagggggtgattatgatccaggaacggtgcactgtggtggattgtgttgtgcgaggggtactgtcatagctcctttccgaggtaccgtggtggtattgaggcgtatggtgacatgtcgtggggctgtgtcttgtgggtacagtggtacacctctggccagagtaaaactattcgaatagccgtgcccgcggttatgggtgggtctaacaatgtctttcgtgattagtctcacacttctcaccat

SEQ ID NO: 84078 - DNA, 595 bp, Oryza sativa
attgtactctagtcaaataaaatcacccatcctatcatttgtgaggtttcctcctattcttagaaaactatatataattcctacatttgaaaggtggaaaattaaactaaaccgcttgacatcattagaagataaattcacaattggcaatagagagattttttagtacttaagatactcccttcgtttcaaaatatttgacaccgttggctttttagcacatatttgaccgttcgtcttattaaaaaaatttgtgaaatatgtaaaactatatgtgtacataaaaaatttgtgaatcaaatgatatgaaaagaataaataattacttaaattttttgaataagatgaatgatcaaatacgtactaaaaagtcaacgatgtcaaacattttgaaatggagggagtatatagctatacatacctcacagtgttagttaagttaggaggtgtttatatctgccccagaagggatatacctactcccccacaaaaaggggaaagttaagatcatatataaaagatgagttttcaatattattctaatcggattagattagttttggtaactccctttatttagaggtatcttctgtat

SEQ ID NO: 84079 - DNA, 940 bp, Oryza sativa
ttcctgtcttccatagaataggaacatatccttagttcttctcaagtacttaaggatattctttacagctatccaatgactctcacctagatctgattggtatcggcttgttgcactaagcgcatatgaaacatctagacgtgtacatagcatagcatacatgatggatccgattgccgaggcatatggaatcacactcatcttgtttcgctcatcagtcgtttgaggacactaattcttgccaagattaatgccatgtgacatcggtaagaaacctttcttagaatcttgcatgttgaatctcttcaacaccttgtcaatgtatgtactctggcttaatccaattagcctctttgatctatctccatagatccttgtgcccataatatatgctgcttcccctaagtccttcattgaaaaactatttttcaacgatgtcctaacggattcaagcaaggaatatcgttcccaatcaataatatgtcatctacatataggattagaaacaccagtgcgctcccactaatcttcttgtatacacaaggctcttctttgtttttaacaaagcccaacgtcttgactacttgtcaaaacgaatattccaactccgagatgcttgcttcaaaccatagatggatttctacaatttgcatatctttttagctaattgtggatcaacaaatcccttgggttgtgtcatgtacacatcctcatcgagatttccattgaggaaagctgttttgacatccatttgccatatctcataattgaaataggtagcaatcactaaaacaatccgaatagattttagcatggcgactagcgagaaagtttcatttgtcttaaaccttttgttaccaatcgtgccttgtagatgtgaacatttccagctacatctgtctttttcttaaagatccattttgtcacgaccggaaataac

SEQ ID NO: 84080 - DNA, 1910 bp, Oryza sativa
ccacaattcgtgtgctactttccctagcagcctcacatggtcttctcgttcatcaaatggacgttaagacagcttttcttaatggagagctggatgaggagatctatatggatcagcctgatgggtttgtagttgaaggtcaagaaggcaaggtgtgcaaattgttgaagtctttgtatggtctgaaacaagctcctaagcaatggcatgagaaatttgacaaaacattgacatctgcaggcttcgcagtcaatgaggcagataaatgtgtgtactattgccatggtggaggtgagggagttattttatgcttgtatgttgatgacatactaatatttgggacaaaccttgaggtgataaatgaggttaaatcattcttgtctcaaaattttgatatgaaggatttaggagtagctgatgttatcttaaacattaagctaattagaggtgagaatgggattacactcttgcagtcccattatgtggagaagatcttgaatcgctttggctacattgatagtaagccttctccaacaccttatgatcctagcttgttgcttcgcaagaacaagagaattgctaggaatcaactagaatactcccaaatcgttggctcgttgatgtacctggctagtgcaactaggcctgatatctcctttgctgtgagcaagttgagccgatttacctctaatccgggagataatcactggtgtgcgcttgagcgagtaatgcgctatctgaaaggtactgtggaattggggcttcactatactgggtatcctgcggtactggagggttatagtgattctaactggatctctgatgtggatgagataaaagccactagtggatatgtcttcacactgggtggtggtgctgtttcatggaggtcttgcaaacagaccattttgacgaggtcaaccatggaagcagagctgacggcactggatactgctactattgaggtagaatggctgcgtgatctattaatggatctgcctattgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagctagaaacctagcagatcccttcacgaagggactatcacgaaatgtgatagacaatgcatcgaaggagatgggtttgagacccatgtgagttatactatggtggtaacccagtctatgtgatcggagatcccgtgaattagaatctgggaagaacaaaccattagtaaactagaggagagtaccaatctataccctctctaagtgaagatgcatgtactctcgtgagctgcaaggcaggttggctatgccttaatgagttctgttggctttaattagcgaagatgttgtcctgcatagcattcttgaaagaactcacctttgtgagcttgactgttggtcgcagtctatggagattttggctgaatcttctaggaagcttactatagacctaggagtatgacttatacgctccacccgaggggtagtctacaaacggtctagtaccagataagactctgagtgaaacttgcttgcataagacttgcaattcaaggcatagtccattgttcaatttgtgagtaagtgtagcttggagttctaggtggatgttcaaccttaatcggtctccatcgaaccgctggtatataaacagtacattggaaaaggcaaatctcagtgggattttgagatttggtgggggattgttggaattaatgaatgagccttagctcactcgaagattaattatttggaaaatcacaaaagcccacctcatgggatgacatgcatgtgg

SEQ ID NO: 84081 - DNA, 1685 bp, Oryza sativa
atctaaaaaattcctgtaaaaatgccttagcccagttgttaagagaagaagaagttaaatggtatcaaagagcaaaaacaaaaagaatagtaggagataggaacaccaagtactaccatatgatcacgaatggaaaacacagaaagacaaagatttttcaattagaacaagaagaaggggtgattaagggagatgcacaactcaagaaatatgtcaccaattattataggggtctttttggagctccggatggaaattgtttctccatgtgtgaatctcaaaaggatgatatccctcaagtgtcaatggaggaaaatactttcttaacaaaagaatttacagaagaagaagtgaaacatgctgttttccaaatggaacataacaaagctccggggcctgatggtttcccagcggagttttatcaagtgttctgggaagtaattaaagaagacttaatggctgtctttagagattttcacagtggcgagttacccctacatagactgaattttggtatcattaccttgcttccgaagaataaagaggcaaaacagatccaacaatacaggcgcatttgcttacttaatgtaagcttcaaggtattcacaaaggtcatggcaaacagaattgctctagtagcacagaaagtcataagaccttcgcaaattgcttttttaaaaggtagaaatattatagaaggggccataattctccatgagacattgcatgagatgcataagaaaaagtcaaatggagttattctgaaactcgatttcgagaaagcttatgataaggtaaattggaattttcttcaacaagcgttgagaatgaaaggtttctcggacatttggtgcaagtggattgatcaagttgtgtcggggggtagtgtagctgtgaaggttaacgatgagataggccactttttccagacgaaaaagggtttgagacagggggatcccctctcaccaattttatttaatttggtagcggatatgcttgccattctcatcaatagggctcgagaccttgagactctaaatggagtaattcctcaattggtagacaatggtctctcaatcttgcaatatgcagatgataccatcttgtttatggaccatgatttggttaaagctaataacctaaaattggtactagctgcctttgaaaggttatcgggcttgaaaattaattttcataaaagtgagatgttttgttttgggaaagctaaggaggtggaaaaggattacaccactttgtttggttgtaagatgggtacttttccattcagatacctaggccttcctatgcatttcaaaagactgtcaaacaaagattggaaggatctagaagataaattccagaagaaactcagttgttggagaggcaagtttttgtcgtcaggaggaaagctggtgctcattaattcagtgttgagtagtctggcaacattcactagtaatatgcacgtgctaacgctacgacgatatttaccaatgtattgtaacacattttaaagaaaaatttctttcacaaaagaaatttattgtcataatatagttttgtagataattatatactttgattcttatctccatacagtgaatagcaacatgcagtatattatctgtttaaaatgtaatccccaacaatcagaattaagaaatcaaatctcaatttttcaacca

SEQ ID NO: 84082 - DNA, 703 bp, Oryza sativa
aaatgttgtgtccaagcaaagcacaaagtttcatttggcttctcatgtaagataggcttaacagaaggaatcttctcaagagaaaagaaaatgcttatgaaaatgtagtgtccaagcaaagcacagccctgttcgggggagcttaacattctaagaagcagctggttgatagtcagcttttgagaatctggaaaagctagattttccagcttctggcttctagttcattttctggattctacaataacagcttctcagaatctggaccaaaagctggactgtttgggggagcttctgattctgggagaagctgcagtagcttaaagctcccccaaacaggcccaaagtttcatttggcttctcatgaaagataggcttaatagaaggaatcttctcaaaagaaaaaaaatgacaggctagatttcacttgtgcagttgtgctatgtcagcaccagcaagaggaaactttgcaacacctgtttttcacctgtgtccattctcacaaagatgctggaagcctggaactatatatatgtacaaaaaggacagttgacatctcagtgcaaaaagcaatccaagatctacaagataaattgcaagtcccattctttatggagattatcattctaatggcctggagcatttggattactagaaacaacaaattttcagagagattaattcttccatacagttctgtaaa

SEQ ID NO: 84083 - DNA, 787 bp, Oryza sativa
agtgccgcactccgattttgtgggatcaaacgggagaacgtcaggttttcgggaccgatatcctgagggaagccgaagaaaaggtgaaaatcattcaagaaaggttgcgtgtggcccagtctcgtcataagagttatgccgacaatcgtcgtagagatctaagttttggcgaaggagattatgtgtatcttcgtgtcacgccttttcgaggagttcatcgttttcacaccaaaggaaaattggcaccgcgttttgtgggaccttataagattgccagtagaagaggagaggttgcttatcagttggagttacctcaatctttggcaggagtccataatgtgttccatgtttcgcaattgaaaaagtgtttaagggtacctaccgaggaagctaatcttgaacagatagaagtccaagaggatctgacctatattgagaaaccaatccgtattttggaaatagatgagagaagaaccacaaatcgagttatccgtttttgcaaagttcaatggagtaatcactcggaagaagaatcaacttgggaacgagaagatgaattgaagtcagctcatccgcatctgttcgccagttcttacgaatctcgaggacgagattctgtttaagggggtaggtttgtcacaccctgaaaatcctaaatatataaattgttgtttaattggaattattagaatttattttaaaagtctagaagagaagatctaattttaattaataaattccaatataaaatggggccagataaaatttcattaaatactttgcttaa

SEQ ID NO: 84084 - DNA, 1711 bp, Oryza sativa
tcgttcaccggtgtagtttatccctagggtcttaatccaatctaacctaatccgatgtttgtctagcgtagtcgtcgtctccgtgtgttgccgccgggtggccatcgtcatctctccctctccgatcattttggtttggtgagacttctattcgtgttccttcggtttaggttttaatctctcatatgtgtcgtcgagtagccacgttgtcgctgccacaccgccgtgccgcgcttagctgctgctttagtgtgcgctagctgcctagccgccgccgcgtcgctccctgcctcagtcgtgctgttgcgccgtgccgttttgccgttgccggccaagctgctggtgttgcgatgccaccgctgccgccagcgccttgttcccatgccgtcgctggtgtgccgtgtcgcagcttgtgtgccgcttaaacctagccccccgctttagccgttgctcggtaatcaagttgtctagccgtaggtgcatccctaggttcctaccggcctatcatttgccgtaccggggctttaccgtgaatcgtgtctagcccaccggtttagccgcagctgttgttgagtcgttcgctcgttcgttcgaacgaggtgttccccgtgcttcgttcgttcgtctgtgtggagtcgtcctttagtttagagctgtccagagccgccggttccgttcgcctgtttcggtttaacatttggatgatctcgtgtcacgtagaattgactcgttgagtcggtatctcgtgaagcccgcttgccggatcgacccaagccatccgatattggtcaactcttggtcaagattaatctcagccgtcaaaaattgatataaatccgttctctcttttcagtggcatattatttctttttaatatatatcatctaccaaatataatctaatctttttccggaggttgttttaatcttttatctcagttataaatcattcgtaaatgatttaattaatttggaatagtcttttctttaataggtttaattggaattaaatcttgtaaaattcgtaactaattcatatgaagtcagaatgaggccgttcaagtctcataattcatctaaaatcatgatctacatgtttgtttactttaattgtactattcatttggtttttattagtgttttttcttgttttgcgttttaggtttagacttcccgttgtttcggaggatcattcgttcattggagaagttcctgaagacgaattgaagatgcttgtttgtaaggcaagtcacacagatcccccaaacaaccctttgagcatgttgaacatgtttaaagctattgatttatttcaacttatgcattgttttcgaatgtcattgggtggtgagcctttcccatttaattatggccgaacatgactttattttcctatgggttataatttgactagcatggaccttatatattggattggttcagctagatgttatttatagttgcttagccgtgcttagaaacattagctcattaatgggataaatcatgcttcactatcacttatggatatttaatggaagctcacgatggtcaatcgtgattggttaattaattaatttgccaaataaaacttgataaaggtgggttgtgagcacatggttttgatggtcgtgctcaaggcaattaaggaccggttcacgagtttcggttgtgaaacattaaccgtgccaactacaagccagcgtgggcaa

SEQ ID NO: 84085 - DNA, 2792 bp, Oryza sativa
aaccctagccgctgacgcaataattcccttttccttttcaaaaataattcattattgcgtcataattcaattaaaatccatataagtgttttaatccgatttaatctttaaaaattcataactaattcatcttagctcggatttagttggttcaagtctctaaatttttctaaaattgagatctacatgttaaaaatatccacatgtactgtttatgcttgtttatgtgctgttttggtgattttgctcttttctgcttagattccgacgtttccggagagtccgttttcgcaggagaagaatttgaagagttccaaggccagcaaggcaagtcacacagatcccaaacaaccctttgagcatgttgatcccgattaaagctattgtttctattcaactattgcatttattttcgaatgtcattgggtggaattaacctattgtttgttatagcccttttgttcttgattactttattccttgataccttgggttattataacttgactagttgggctttatatattggttcagctagatattagatatgaatgcttagccatgcttagaaacattagcacactattgggataacttatgattcactattaattatttaatgaggacttaatgatagttcacgatggtcaatcgtgattggttaattaattacttgccaattaaaacctgataatggtgggtttgtgagcacatggttttgagagtcgtgctcatgacaattaaggaccggttcacgagtttcggttgtgaaacattaaccgtgccaaccacaagccagcgtgggcaacggctttaccttttgtatagcatggtttattgcggggcaccagactgagaagtggcggagataagcccacgggggtcgctggggagtccatgccttgtttataagggggtgattatgatccaggaatggtgcgctgcggtggattgtgttatgcaaggggtattgtcacagctcctttccgaggtaccgtggtggtattgaggcacatggtgacatgatgtggggctgtgtcttgtgggtacagtggtacacctctgatcagagtaaaactattcgaataaccgtgcccgcggttatgggcgggtctaacaatgtctttcgtgattagtctcacacctctcatcataataaaagatgctataactggtaataatttgtttagctcctggtttggaatggtatattcctggtttggagatagatctgtacagccgggtatggttgttcagaatggttgggcctgtgcagcatgggtatgttgtacaatgttgattaatattgatgattaattgctctactgtttcacaattctcaaatgtttgctaaatgctgcttttgcaaataagccctatattatgtcattctttggtatccttgtgcacttgcatatttgctgtgtggcttgctgagtatgtcatatgctcaccttgcaataatcaatcaaacctcagttgaagacaagttgcgatggagaagacgtttggcttataccccagttgagctgcctatgggagtggagccagagcttcgctagattttatttttccgctgcagttttcttcgtggtgaggactaagtgcctcttatgtaaatatttattgctttagttattttgatgaatctgtatattaaactgtcagttggtgtacctcggctgattcctggacgaggatttcatacacaaattagttcggaaattactagtgaatttccgggcgtgacagcagcaaaggaggctgtttggataaagaaatttgtttctcaactaggtgtgatgactagtgcttctagccctatggacctctattgcgataatagtggtgccgttgcacaagccaaaaagcctagatcgcatcaaaagtccaagcacattttacggcgttatcacctcattcgcgagatagtgggtagaggagatgtgaagatatgcaaaatacatacggatttgaatgttgcagatccgttgacaaagccactccctcagcctaagaatgaggcacaaactagggcaatgggtataagattcattcatgattggctcgagtgcaagtgggagactgttagtgatatgccctagaggcaattatagagatgattgtatcacatactatgtttacatatttatccgacattgttccttgaaatagatagctcattattggttaatgaatatgtgattcgtttatgagactctatatgttttttgttactatttctaaaggatctctgatcaaatatcatatgtggaacaaatatgtttatatgatcagcatatgtattaattgatgatcatgtctcatggatcatggtatagagataccaaattaataatgtggacacatgttaatgaacatgttgttgaatagacccaacatgagacactgcaagagatatatgtgtcgtgtcatcaatgatctcatttagtgttggtgttgaatccttagacctgagatataatctatcaagttatataatctatcaacaggttcgagtgaatgattgagctattagaggatggcacatatctagccttgagcttaatcgatatcgtgaggcaaaggggttcacacaagtatacactagaggttcagccgatatgatctttatgtatgcccgatgggtcaatacgttctgctaggggtcactgttgacacgtggactgaaaaggagttttcgggttataaccgagtatacatgaacctacagggtcgcacgcttaacgggccggaataagaggattggatggatatccaatatgagctta

SEQ ID NO: 84086 - DNA, 4829 bp, Oryza sativa
ccattctcacttcacacacacacctcaagcaagagctctctcatttctctcaagcttattttattagtatctaggataaactctgtaaccacaatataccaggagtatttctacgtcattgttgagtattatatttctagtaatgtcgttaagaaataccaacaagcatttctggcgccgttgccggggaagattcataatagagattacatgaactaatactttatatttacctctgtataatcattttcctttgcaggcttaccttggttgttttcgcttttgttgtgaaaacagggtagtgcacgactggtttcaacttgacggaaaacttcaaagaaaatctagaagctttcttccggtgcgtcaggccgcgagtcgttgctccacagaaaactctaccgacaaagaaaccagtcgtaccagcgccaccaaccttcaagactatggctgacaagacccttcgcgagtttgctgctccctctgctgacaatgtggccattgggccacaaatcaacatgggagacgtggatttcgacttgaagtccagcctcatcatgatggcgaaggctagcccattctgtggcaagcctaacaaggatgccaatgctcatctgcagcagttcctggagatctgtagcacgtacaccatcaagggtgtcactccagacgccgttaggctaaggctgttttcattctcccttctcgggagagcgaagcagtggttctatgccaaccgtgctgctgtcaacacttgggacaaatgttctacggcattcctcttgaaattcttcccgataggcaaaaccaatgcccttcgtggaaggatttccagtttccagcagacgagggacgagtttattccgaaagcatgggaacgactgcaggagtatgtggccgcctatgcctgtcctcatcatgggatggacgactgactgatcctgcagaacttttacaatggactcaccccgatgtcccgtgatcacatcgacgcgacagctggaggagcattcttctctaaaacggttcgaggagccgttgattttaatagataagatggtgtccaatatgggttggagcgaggaacgactccagatccgttagcgaggcatgcacaccgtgaaggagtcggaattacttgctgccaagctggacctcctcatgaaacgcttggacgaccacgagaaacgaccacaaggcaccattaaggccttggactcacacgttacgtgtgaggtctgcgggtcactctgggaatgactgcccgtaaacccgtgaggaggcgatgtacatgggcaacaacaacaacgggtatcgtccacaaggaggtcaggggtggaaccaaccacgcctatatcatcaaggaggtaacaacaacgatccagagaagaccatgccgcaggagtactgacacacgattgctgtcgtttcctcaatggagtaggaaaccgtcagtggacgagcaattcgctcgttttgttgaagtaatccagaaaatccacatcaacgtgccgttgttggatgctatgcaagtgccaacatatgcccgttaacaaaaggacatactgaacaacaagagaccgctcccaacaacggaggtagtcaagctgacggagcaatgcagcaacttggtactccacaagctcccagagaagaacaaagatccgggatgtcctacgatcacctgcttgatcagggtacaacagttcgaccaggccttgtgcgatcttggagccagcgtcagcgtcatgctaaaggacgtctttgacaagctcaacttcacggtgttggcaccaacaccgatgcgtctacaactggctgactcgtcagtccgttacccggcagggatagtggaagatgtgccagtcaagatacgggatttcttcatcctggttgatttcgtggtactagacatggacacgggaaaagagacgccgttcatcctgaggcgcccgttccttagcaccgcgggagtcaatattgacgtgggaacggggagtgttcatttccatatcaacgggaaggaggaaaagtttgagttccagccaaggacggaacaatgctccatggtcaaaataaagtacgggccgaacccacagaatattcaagtggtcgaagtggagccacccaagacggacagcctggtgaagttcatgcagaatttcctggagaagaaaacaacgatgcccaggaaccgttataggaagacaccggtaaaagcaagtacaccggccaagaagctagagcagctggctcaaaggaagccgccgtccgcaccaaagccaaggaaggtgtggaaggaaaagccaaagacgcccgctccatcacctccgaagacgggtggaaaatccatgaactgaatcagaaggaggtacaatcttgcacgtcgaactttaaatgacgcgaccttcgccaataggtaaattggtatgtatccgcatatttattttcaacaatttaattcttgcatcaatacatgtttgaatttcaaaattgcatttaggatttttgaattttcaggaaattcttcaaatgattttttcagagcaagccaaaataaaattttcagcgaaaattcactgtgccataaccacactaaccgttggaatccaacggccgaaagtggggccggttgggcccaccaggggttcggccgaacccactggttcgaccgaacccgaacccactggttcgaccgaaccagccaggcaacggttacctgccacttttggcagggtaacggctagtgggtcccacatgccatttctgaccgttgtgggtaccctataaaagccagccggccaagagagggaattccaccccatttcaacacattttcattccctctccaaagtttgttctcaagttcattcaagctttgataatttccctcaaattcaaacgcttagttgcatatatacaagttgctttggtgaaactaaccggcgggtgaaactcttgctattctaacccccgccgagttagtccgttcttattccattgtgcagaatgaggaggtgattgtctcgtctgttcaaggggtccggctcttcatcaagtcatcatgacgagtctagtactcgttcatcagctattgtctcaatggaagacgccgaagctccgcgacgactcctgaacgacaccgatctcgaccttgtcggtgatcgggagagacaagcctactacatgctgagcgaccgggagtatgctaacacgcgagaatactctccggagctgctgaaaaagataggtatggatgttgaattttgtgctatttggaaagctgttggttggcagaaatttgttgtagtagatgagcctagttctcgtttgcttactttgcaatttctgtgcactttgaaagaaatagaagatggaatttcctttcgctttttccataaggagtatacacttacatggaaaggcttaagtacacttcttggttttcacgtatcctgtaaaatcgatctttagaaaggaatttctggattcgagaaaaataggtcttgggaagatatttctagtgctccaatttgcaagaaacctaggacgaatgatatccataatcctacacttaggcttatacacaaatggattgctatgacttggtttcctagaggtgatcttagacccattagggaggatgaattgattatcatgtttgccatggttagaaagatcaaaattgttcctatgaaatatatgataaggcaatggttagaaagtataaagttctctgctcctgttgagtgcacttctctgattactcggatagcaaaagggctaggggtcgttagcgaccaaattgcttttatctcagccactcgtccctgtattgatgagacctatctagtgcaagggcatattgtgaagcatggaataaatggatctttgatttactttttccccggttgtacaaatgaaatcccattgccaaatgcggggtatcatttgtacaactgccatgaactaaccattcccctgcagaccatagaagaatctcgtgcaggtggagcatacagggagacgcgcaacatgacaaggaacgaaagagaaagttcatcatcctaacacccgtgcagatgtatgaggcaggttgggagtcaactagggatgcacccggatggatccaagctccacgccacagcatcggagtctcaagctgggcgagtgctagtaaggcccggtggcgtgcgcctcatgacatacattcgggggacgaccaaccttccagatcaagtgacggaggagatccagtacaacctcatggaacacatcgctcaaacgcaagaatggcaacaatctgttaatgctcagttcgccagcatcaacaacatgatgcagcaacaacacgatgaccttcaagcgtacttccgctttcaagggtttaatccttatcaaggaccctgagcgaaagctaagcttggggggagagacatctgtatcacattgcatatttccctttccaattgcatatttgctttccaattgcatcttataaaacttgaaaacaacataaaaatttgcaaaatagaaaataccaaaaagataggataggtttgagtcatgctaggtaagacaagctagttctctttgttgaaatgatggatagttgctctgttttatatctcttatatattggttcataggtaagtgctctctcaaaggttaaatataagtagccaacaattatctgggaacctgaggtaaatgagctgcacttgctgatctgagtctaagttattgtaagatatgagatggtaaataagagttctatgatcttgatactagtttggcttgaattccggatgttttgtttttcaatgata

SEQ ID NO: 84087 - DNA, 1260 bp, Oryza sativa
ccctagcgacgagttcagcgagcgggtcgtgcaggtcaatcgcgtcaccaaggtcgtcaagggcgggaggcagttatccttccgtgcgatcgtcgtcgtcgccgacatgaagggccacgtcggtgtgggcgttggcaaggccaaggaggtcaccaaggccatcaccaagcccgccatgaacggccgtcgcaatctagtcaccgtgccgctcaccaagtattcgaccttcccgcataggtaggtgacatcccttgctttattcctaattttgcatacgaggttatcatgtggatgctcttatacccatcgacccactagtttcaacttaatgtgcaaacagccggccgactagtactaattaatactacaagaaatgagttccatggaaactaaaacataagatactgtaaggatcgtgatttgttaatgatattgtttattagttgttactactagtttttgtggttttagccagcacagcaatttgtaacctgatttgctattatgcccaaatggtgtattcttattttctgttttacacagaggcactgataatttgcacaacagttcatggttgatagtgaaattggtagtatgcatcttcccttcgggcaggcattgcactcctatgaacaaatattttgtagaagatatcaaaatcgaaagtacaaaagattcagacttaatcttgtgccacactgtcacctacttcctccatccaaaaaaaattcaacctaggtgtggatgtgacccctccagattcgttgtactagaaggggtcacatccaattctaggttgagtacttgagtttttttgggacggagtacttatctgcattttcatggatatatgtattttgaatgctcctcctgtttgcatgagctaatgtgcaattatatttttcatcaaaatgtacctggattatcataaattgtggtgtcgtggtagatacctgacattgatggagtgattcttgacaaaggcatttgtagctcgtagtaagtgtgatcgagaacacattttcaactgcaagggttgttttatttaaattatgttaattgtactaaaattcaattcggactttaaagaataaagtgttgttaaaactcaggtgcatactagcgactctggtttttgaacattgatacgattgaatttttagcgaagtgctacaattgaatctggactgatgtgttctattctcatgctgattgtatggttacgtagttgtctgaaagctagttgataatcataaaaca

SEQ ID NO: 84088 - DNA, 832 bp, Oryza sativa
tgtgagagtcttcagtttgtaataatgaaactcacttaagatcaataaaagttaaattaattctctgtcctaagtagttttccccggtttctcttcttgtgctctgtccatgccagatggtgctcactcgcagcaacgggaatggccccaacaacaacaacaataacaataacaacaacaatggagagaatcccacacttgcccaagtcctggctcaacaggcacagcttatgaacatgatgatgcagcaactccagaaccagcagaaccagggaaataaccatgcacctccccagaacaagttagccgaatttcttcgtgtgaggccgcccattttctccagtaccactaatcctgttgaagctggtgattggctgcatgtcatagagaagaagttggatttgcttcagtgcactgatcaggagaaggtctcatttgcatcacaccagttgcatggccctgcctctgaatggtgggatcacttccgcctgaatcggactactgctgaacctatcacttggcttgaattcaccgctgctttccggaagacgcatataccattgggagtggtgtctctcaaaaagagggaattcaggtcgctcactcaggggtctcgctctgttacggagtatctgcacgagttcaatcgtctggctcgttatgctccggaagaggtacgcactgatgaagagcgccaggagaaggccttaatgatgagctttcttatccacttatgactggagattatcctgatttccagaagttagtggataaggctattcgccaggaggccaagtacacccgcatggagcaaaagaaacgccggattgct

SEQ ID NO: 84089 - DNA, 670 bp, Oryza sativa
caagttctctttgtaggtttggtctaaaaaccttccattccacccacaaggatgggtgtttatccgtatttgtttaacaagcttcgcttggcgggtttgaccttctaaacccatattgaccaggggatttccttaaggttaaggtggttggcaactgcatattacgggaaagatttaaggttattcgggaacgtgtggcggcgtgccaaaaaagggcataaacagcagggggtcaaggttgtcacgcgtgggcgacagggcgaggcacctcatagcaagcagtaactccggcttggagccgtcctcctgcccgaaaatgaatgacatgccaaactcctatcggtgggtgaggtgctggagagagaaagaagagaggggagttttggaggaaaaagatatgtagtcacttatatgtgccacacttacattgttttaattacttcgattattggacagcatctggacgccacgtgagctaaaaaggctctcaaatatttgagggagtcgaaatggacgtttttcctattttgttgagttggggaatggcaatcccactggcaaaacaaggcggaaaaagtacaccgaaggtccctcaacttgtcattgaattgcataatcgtccttaaactgcaaagctggatacaacatgtcctccaacttataaaacaag

SEQ ID NO: 84090 - DNA, 696 bp, Oryza sativa
ctttgttcatgccatgattattgtcttaatattttagattaaaatatgtcagtatatgactatattgtcaacaactgacaccgatggctttggtaagacctagcatctggcactactgcatctccctgcatactcgctccatgtccatcaccgcaaggtgctccttagcgaacacagccgatggtgggccttctggaactccaaggctcaccggaaagtgaaccaggtacaagtcgatgtactccacttgcaaattcctacatacatgaaccattgctcaaaccaactacgaaaatgcctgcctttatcaattgtcaaacatatatatgaacatactccctccttccctaaatgtttaacgctgttgacttttttaaacatgtttgaccgttcgtcttattcaaaaacttttgtgaaatgtgtaaaactatatgtatatataaaagtatatttaacaataaatcaaatgataggaaaataattgtgacatccccgcccagagcttaataggattaatagaatactacaacttctttttcggaagccgatctcagaagaactctaaggttaagcgtgcttggcctggagcaatttcgggatgagtgaccgaccgggaaattcttagcgggtgcacgagtgaggacaaagtgtgcagaaaagatttgtgttggtctgcgagggctttctatgacctat

SEQ ID NO: 84091 - DNA, 535 bp, Oryza sativa
ctatagggcgaattcgagctcggtacccatactagtggatggaggtgccgcggtgaacttgatgccgtactcattattcaagaagttggggcgtgaggatgatgagttgaagaagaccaacatgattctcaatggtttcaatggtgaaccaacggaggcaaagggtatcttttcggcagagctcaccgtgggaaacaagacgctaccaaccgctttcttcatcgtcgatgtgcaaggtaactacaatgttattttgggtcgttgttggattcatgccaattgttgtgtgccttctaccttgcatcaatgtttaattcaatgggacggcgatgatgttgaaattattcaagcggatacatcggccgaggttgcaatggccgatgctacttttgagtggcgccatgggaatatccaatgcttatcggggagggatctttctagctacgattttattagtatctccgatggcaaatttgtatctatctctgtaaagccggctagtatagcacgactaagccatataaatttgtataat

SEQ ID NO: 84092 - DNA, 3260 bp, Oryza sativa
agatcgttgccgatcatacaatagatcttggcttgtcgggttattttctcggcctctgcatcgtcctcgggcaactcgtcggtactcaggaacttgatgagcggggtccgccagtcctctgtggtctcgatgtcggcaatgacgtgttctgcccctatagcccccgagctaatgtcggggacaactgtgctatcttcgtcatttgctttttcactgatggctttgtcaagacgtccagaaaagtaccaggttcgagtggctctcgtctagacgcacgccgtgctaggtcgtttggttcaatgttgtccttgcgatatacgtgccggacctcgatcccatcaaaccttttctctagcttcctgacttctgcgaggtacttggataactcggggctagagcacttgtagtctttgtgcacctggttcgcgactagttctgaatcccctttcacgattaatcgcttgactcctagtgcggctgctgctcttatcccgatgagtagtccttcgtactcggctgtgttgttggtcgccctgaagttgaggtgaattgcatgcttgaactgatctcccgaaggtgatgtcaagatgaaccctgtccctgctccttggctattgaatgcgccatcgaacgccattgtccatgtctcgctgtcggtctgactgtctgacctgttgtcgagcatagtccagtcagctacgaaatcggcgaggacctgggacttaatagttgttcgtggcacaaagtgaacgtcaaattggcttagctcgactacccattttgcaatgcagccgacgacgtctctgtttctcacgacttctccgagggggaaggaggaaacaactgtgactctgtgggcttggaagtagtggcgtagctttcttgatgtcatgattactgcataaagcagcttttgaatctgtgagtatcttgtctttgcgtcgtggagagcttcgctgacatagtaaactggtctttgcaccttctctctcttgacaacaatgacggtactcacagaatatggtgtggcgacaatatagaggaataattcttcattaggttggggagcaacaagtacagggggatttgacaggtagcatttgagcgcgatgaacacgtcttcggcttcctgtgtccacacaaatttgtcttgtttcttcagcagagcgaagaaaggttgtcctcgctctcccatcctagcgacgaatctgctcagtgccgccatgcatccagttagcttctggacttccttgagtcttgtgggcgactttatgttctcgattgccttgatcttctcgggatttgcttcgatccctcttccggagacgaggaatccgaggagcttgcccgatggtcctccgaacatgcacttctccgggttgagcatgaggcgatattgtcagaggttgtcgaacgtttcctggaggtcatcaatcaatgagtcgcttgtctttgtcttcacaacaatgtcgtcaacgtaggcctcgacattgtgtccaagttggtcattaagtgccccttggaccgtgcgctggaaggtatttcccgcggttatcagcccaaacggcattttgatgtagcagaatacaccgaatggcatgatgaatgttgtcttctcctcgtcctcttttaccatgctgatctggtggtagccggagtaagcgtcaagaaagcttaacaactcacatccggctattgagtccaccaattggtgtattcgaggaagaggaaaatgatccttaggacactccttgttaagatcggtgaaatcgacacacatcctccacttctcgttggccttacgcaccatgattggattggctagccactctgggtggaggacttctcggatgaaaccagctttgagaagcttgtcgagctcttctcatatggctcatttccgatctgatgcgaatctccgcagtttttcctttactagcttggcatcggggtcgcaccatgagtttgtgctcaatcacctccctggggacccccggcatgtcggacagctgccaagcaaacacgtctgcattgtcgcggaggaaggtgatgagcgcgagttcctatttctcatccagtgacgccccgatcttaacagtcctatcggggttggcactggagagcagaacgatcttgattgcgctgtctggcttcgacgtcttgttggttttgttcactttcttgggtggctcagctatggcgggcgggttgggagcatgctcgaccatgtcgaggctccatttgtcgcactgcaccgccagcttcgcgttttcctgaatagtgattgttctcttcggcccaggcatcttgagcacttgatacgcatagtgagatgcggccatgaacttcgcgagtgcagtcctcccgatgatggcattatatgttgtgtcaaactcagcgacatcaaaggtgatctgctccgttcggaagttgtttgcttggccaaaagtcacaggtagcgtaatcttgcccagtggcttggacgatgagtgaggagtaattccgtggaagggttgatcagtgggcgtcaactcacttcgtggggtccccatcgcgtccaaggtgctggtgaagagtaggttaatggagttgcctccgtcgatgagaacccgtgcggaataaatgtgcttagggacgtcctagggttgccctagggcgcacaccccttgggctaagcccacgacacaattacaaggcccaaaactcaaaatcagattcggactagatgagatatgtgtcttgttttgctgattgtcggcagctcggtaggaattttgacatgggaccaaaaccatatgaaagtagacttcataatctttccaacaagtgctcatgggcctctaaattccttctagatcagcggctagatccgtttgaagttgatgctatcaggaggcccgaatccgaatccaaaacgtgtacaacttgatctcttgtcttctatgggctaaaagtgacatggtgagatgaaagaagacttggagaaggtcttggtttggtccccaatcaatttcttcaatcatccatgcattccttacgctcagtctcttttctttcacccaagcaagtacctctgcaaacgaaaacacacaaaactcattgtgttgcaacatttgttcaaacatataacaagtaaatctaatatcacaaatcacaaatcaccacccaaatccttgttaattatcttgcaggcatgcagcccctgctcacctccccacctcgccgcatcaaagggtaccgagctcgaattcgccctatag

SEQ ID NO: 84093 - DNA, 2737 bp, Oryza sativa
cgagctcggtaccctttggttgattaatacataaagtagccatggttatatccaagctagttgtgtcctcatcatcctctccttcttgattggaaaccatcctcggtttcaccttgtcatggagcgtattacacttatctttgtctatcacaacatcctgcgcggaacatttcttgatggccatatgattggatcctagaatctttgtagtcgaaaaaccacaacactccccttcttgcaaaccaacctgtaactcatttaaacaactagaggaactagatagagaattacttatatgcatgcggtcctctagataatacatttcatcatgaaaaggaggtatagtcaaattcgaacaaatatatactcgatgcacattatattctcctttactatcataattgccaataatatgaaaaatcacatcagaaggacatggcaattcaaatctagcaaataatttcttctttagacagttgagtggacaaatatcatcaaattgaatataaccccaagtatttaaagaagatagcaatttaagctcttcattctcactagcaatgtgaataacatgtttaaactgaacacatggtggctctactatagaactaacatgttcattcactagttgtggcatggatataagtgaagcatcgcacaacacttctttatcacaagaaacatcaaggaaattgttttgtgacaaaggtatttcaacaattgtttccaccgtgggttgctctaatgtagcataagtagtggacatagttggcacctcataaatatgcataccttaagtagctgtagcaccattatcattaccttttttctcatcttcagaaattataggtgcttggttaattaaacattcttcaagcatgcatggagctaaagataggtctttttcctcttcgtctttcttctctttcccattaccttgtttattctcagatgcctgcaaaatattagtatccaaaacaataggcacaacattacgttcattttgtaataacttagacttagttgaaggcatcataatagtatctttcctggtatctctgaaaatctcatcgattctatttttcgtcctttcaatactatctttgaaaatttcctcgattccattcttcatcctttcaagattatcttcgaaaatttcagtaaaactcataggtaccaatttcattttccgaccattatgtttaaatgtgtatgtattagcaacaaaattatgcgatccattattatcatatacccatggttgacctaacaacaaagaacatgcttgcatagggacaagatcaaaattggcagtatcatggtaatttccaatcgaaaagtttattctcacaattctatttaccttgaacttaccacaagagttgaaccatttgatgtaatatggatgaggatgcggttgtgtaggcaactcaagtttctcaaccaaatctgaactcaccaagttattgcaactctcactatcgattatagtacgacatgctctatccttaaccacaaactttgtttcaaataattcatggtactgccattgctccgctttctccatttgagaacttagcaaggtaaatctaatatagaacatatgcacttttggttgattaatacataaagtagccatggttatatccgagttagttgtgtcctcatcacttctccaacgccagttgcttcgtgagtgcctttttgaagacgaaacaagtctcgagagagtgcttgtccgactcgtgtatcgggcaccatatttgcttcgtgtcgtcaccttgtgggtctaggtgcttgggtgggtcagcatattctgctgtgaggacctctgtttgagctttccttttcctactcctgcgactcttcctcttgcttgcctcaggtgcatccttggctggtttcttctctccccctgtcttcggcttgtcgttcttgcgtctcagggcgtcgtccgcgtgagtgcattgatcgacaatctcgaataacttacgagcagtcgtgatccatcttgtcgccaactcctgggtagtgtagcgatctcgaacatcagacttgaaagcgcggattacggaagcatcggtgatctcggggatcgtatttctgcactcattaaagcgccgaatatagtccctcaatgattcgcccggattctgcttcaacgcgtgtaggtcgtcttcgatcgcgtggcgcttgtatgttccttggaagttagcaacgaactgctgccacagatctgtccatgaagaaatcaagtagggtgggaggtgaaccagccatgaacgtgtagatcccttcaacgccgccggcaaataatttgccaatgcgttgtcgtctactccggcagcatagagtactgtggaatagacctgaagaaactcctcagggtcggtgcttctgtcgtatttctctattgttcctagtcgaaatttctcaggccatctaacctctcgcagaaaacgagtgaaagctctgcacccgccgctaggggcggtgggttgtcggtgatcatgtgctcgtcgtggatgcctgttcgatgatgaagatgatgaagatgacgaggatgatgacgagtcactcggcttcggagtgcgattacgaggatgacgctcaggttcttgagaaccttgtcatcgcccaccgttgttgtcccggcgctgatctccatcgtcgtcgtcattacggcgtcgtcctcgactggtatcgcccggcatttgttgcttgcgattagtgcgtt

SEQ ID NO: 84094 - DNA, 646 bp, Oryza sativa
ggtcgactctagaggatccccctccgtctggtattgggaaagttgcgggaacatcaattgtatgccaaacttagcaagtgtgagttctggttgtccgaagtcaaattcttagggcacgtgatatctgctaaaggagttgctgtggaccccgaaacagtgaccgccgtcaccgattggaagcaacccaagacagtcactcaagttcgcagtttcttaggtttggcaggatactaccggagattcatcgagaacttctccaaaatcgctcgacccatgacacagttgttgaagaaagaagaaaaatttgtgtggagcccgcaatgcgagaaggcgttccaaactctcaaagaaaagctagtttcctcgccggtgttaatcttgccggatactcacaaggacttcatggtgtattgtgacgcttcgcgccaaggattggggtgcgtgctcatgcaggatggttatgtggtggcctatgcctcacgccagcttcggcctcatgaaggcaactaccctactcatgatttggagttagccgcggtggttcatgccctaaaaatctggcggcactatctcattgggaatcgctgtgaaatatatactgatcataagagtttgaaatacatcgggtaccgagctcgaattcgcc

SEQ ID NO: 84095 - DNA, 1094 bp, Oryza sativa
aaagcacctcatgccacctctttgggtattcctcaatcttcttcttcactaacttcaacaatgttttattactcgactcggcttgtccattagcctgagcgttgtaaggagaagagctcaacaatttaatatcataagattcggaaaaattcttcacttccttagacataaaagaagcaccttgatctgtagttaatgtttgtggaataccgaatctatggataatatgcttcaaaataaagtcaactacctccgtatgagtcatattcttcaaaggcacggcttcggcccacttggtgaagtaatccgtagcaactagcacgaaccttttctcctttaatgacgaaggataaatttgaccaataaaatccaaagcccattctcggaacgaccatggtttgattatagggttcaacatggcgacgggcgccaattgaacattgccgaaccgttgacaagcttcacatcctctataatatttgaagcaatcatcaatcatcttcggctaatagaatcccgctcttctaagcaaccaattcatcttgtgggccgattgataagttccacaaattccttcatgcacctctcccatagccactttagattgatcttcatctaagcacttcaacaagacaccatctatatttcggcgatataaatcttcatcaagcaatgtgtatttgaatgcttgccgccgaattttccgatcaaccttaagtgtgggatctttcaaatatcgaatcaaaggaattctccaatcttcttctgcttcctgggcacaaatgtccgaattcacaattaattcggcctctaaattgattgaaacgtgccccccagcgctctgcccagaaccggtcagaccgaccacacagggccggtcagaccgctcggggtcgccggtcagaccggcggcatgtagccggtcagaccgcccctggtcaccggtcagaccggccacgcaatgccggtcagaccgcccctggtccccagctttgccaatttcgcacaaagatttaaaagcaagcaccggctcctctaatatcagaaataatcccttcttcacattatagccagatgcttgttgtgccaagtca

SEQ ID NO: 84096 - DNA, 601 bp, Oryza sativa
ataatctttcaaagtagataaaagccaaagaatctgtgaacaacaattagcagcagcaacatattcagattcagcagttgattgagcaacactagattgtttcctagaagaccatgcaatcaatgatgtaccaagaaaatgacatgttccactagtacttttcctatcaattctacaaccaccaaaatcaacatcggaatatccacttaagcatatagaagatgaagtagaataccaaattccaaactcaagtgtatgattcaaatatctcattattcgcttgaccacttgatgatgtgaagcacgagaagaagcttgaaagcgtgcacacaaacacacagcaaattgtatgtctggcttagaagcagttagatacaacaaagatccaatcatacttccatattccttttgatcaatagcttcaccatcttcatcaggatccaacacagctgtagaaccaattggtgttgaaattggcttgcaattctccatcttgaaccatctcaaaagatccttcgtatacttcgtttgatgcacaaaagtaccttgaggtgtttgcttaatttgcaatcccaaaaagtatgataactcacccatcatg

SEQ ID NO: 84097 - DNA, 1127 bp, Oryza sativa
cgaagggcctgctggtagctggctgctctgacaacaactctttctcgatgttcctcgagtagattcacatcgtcacttcgctgcttctcctgttcctcgtcagagtacttctgtactcgtgtgctctgatgccgtagctccgtggggagcatagcctatgagccatacacgaggaagaagggtgtctccttattgaacgttgtcggtgtggtgcgcacggcccatagatcagaggggagttcttcgacccacttcttgtcgtgtgacatgaatctgtcgtagactcgggtcttgatcccttgtagtactatgctgtttgcccttttgacctgtccattgctctgagggtgagaaaccgaggcaaaacaaatcttgactcccaatccaatgcagtaatcctggaagtcggcattgatgaactgggagccattgtctattatgatgcggtgaggcaatctgtatctgcagaatatcctttgataaacttgatggcgtcgtcagccttgatttcccccgtgggcatcgcttcaatccacttggtgaacttgtcgatcgccacgaaaaggaacttgtagccgccctgtcctcgtgggaatggtccgagtatgtcgagcccccaacacaagaacggccatgtaagagggatagtctggagcgcttgtgccggtagtcttgtgtgtttgctatgaaattgaaaggcttcacaccgctgaaccatgtcgcaagcgtctttacgcgcggttggccagaaaaaaccttgtcggaaagcttttcctaccaacgtccgaccggcggcgtgtgacccgcacatccctttatgtatgttgaggaggagatgtttgccgtcatcgaacgagatgcatttgagaagtaccccttttggcacctttttgtacagatcgttgccgatcatacaatagatcttggcttgtcgggttattttctcggcctctgcatcgtcctcgggcaactcgtcggtactcaggaacttgatgagcggggtccgccagtcctctgtggtctcgatgtcggcaatgacgtgttctgcccctatagcccccgagctaatgtcggggacaactgtgctatcttcgtcatttgctttttcactgatggctttgtcaaga

SEQ ID NO: 84098 - DNA, 1479 bp, Oryza sativa
tatgttgattgctttgcatgggaatatcatgaaatgctgggtcttagccgtgagcttgttaagcatcggctttcaattaaaccgggttttaggccttataagcaaccgccttgtcgttttaatcctttgctatatgaccgagtaaaagaggagattgatcggttgttgaaggcggggtttattaggccatgtcgttatgcggagtgggtttctagcataatcccggtggagaagaaggggagtcgtaagattagagtttgcatagattttagagatttaaataaagccactcccaaagatgagtatcctatgcctatagccgacatgatgattaatgatgcatcgggtcataaggtaattagctttctagatggtaatgctggctacaatcaaatctttatggcggaagaggatatgtataagacggcttttaggtgcccgggatttgttggtttgtttgagtgggttgtcatgacttttgggttgaagaatgccggtgcaacctatcaaagggcaatgaatttgatctttcatgattcgctaggtattatcttagagatctacatttatgatattgttgtcaaatcggatggtatggaaggacacatagcagatttgaggttagcttttgagaggatgcgccggtatggtttgaagatgaacccacttaagtatgcttttggtgtgtcggcggggaagttcttaggatacatggtgcatgagagaggggttgagattgattctaagaagatagaaaagattcgtgatttcaaagcaccgacatgtaagaaggaggtccaaaagttgctaggtaaggtgaattatttgagaagatttatttctagcctagcgggtaaaatcgatgcttttattcctatacttcgcttgaaaaaagaagccgattttacttgggggcaaaacaacaagaggcgtttgaagagttgaagagatatttgtctactccacccgttgtgcgagcgcctaaagccggaaaaccttttcggttatatattgtctccgaagacaaagtcattggtgccgttttgacgcaagaggaagatggcaaggatatatcattacatatttgagccgccgtcttttggatgccgaaacgaggtatgtctttatagaaagactttgtttatgcttatactatgcttgtaacaaattgaggcattatttgttatctagtacatgcatagttgcttgccaagccgatgttattaaacacatgttgcaaaggccaattctaagtaggagaattggcaagtgggcatatgctttgatagaatatgatttggcttatgaaccattgaaatctatgaaaggccagattgtatgtgattttatagtggaccatcatgtagatattgcttatgagaaagagatttgcctagttgaagttatgccttggaagatttattttgatggttcttcttgcaaagaaggtcaaggcataggggtaattttgttttcacc

SEQ ID NO: 84099 - DNA, 1033 bp, Oryza sativa
cccgtcgccatgttgaaccctataatcaaaccatggtcgttccgagaatgggctttggattttattggtcaaatttatccttcgtcattaaaggagaaaaggttcgtgctagttgctacggattacttcaccaagtgggccgaagccgtgcctttgaagaatatgactcatacggaggtagttgactttattttgaagcatattatccatagattcggtattccacaaacattaactacagatcaaggtgcttcttttatgtctaaggaagtgaagaatttttccgaatcttatgatattaaattgttgagctcttctccttacaacgctcaggctaatggacaagccgagtcgagtaataaaacattgttgaagttagtgaagaagaagattgaggaatacccaaagaggtggcatgaggtgctttctgaagcattgtgggtgcataggatatctaaacatggtgccactaaagtcactccttttgagttggtttatggtcaagaagccgttttaccggtggaggtaaatcttggttctcttatatcaagcaagatgatttgtcaagtgaagattacaagatgttgatgggagacaaccttgatgaagtcatcgacaagcgcttgaaggcattggaagagatagagaaagagaagaagagggtggccaaggcgtacaacaagagggtgaaagaaaagttgtttcaagttggagacttggtttggaagacaattttgcctttgggtactcgattcaaggagttcggtaagtggtctcctagttgggagggtccttatcgagtgtgcggcattgttcgagggaacgcgtactttttggagacacttcaaggggagcgttttcagcgagcgattaacgggaaatacttgaagaaatacttcccgagcgtttggcaagacgcttaggaggtactatggccggtaattgggttatcgtcctaagaccaaaaacgtgttctatgcttttagattcacgttgttcatcaaaaagataggggggcatgtgtttacaccca

SEQ ID NO: 84100 - DNA, 1102 bp, Oryza sativa
ggaataagtatagttgtaataggataagaataaggcaaaagataggtttcagattgaggtctagatacctcaaattgagagtgggaagaaggatcttcatggcttcttagaataatgggttccataggaattgttttggaatcttgttgttcaggggatagatcttgagttttctgttgttctactaaatattctaggaaattattctctgtggatttctcataagtgctttctggaagacaattttttcctctgatatcctgagattgttgaataagtttaaaaggagaataagtaatataagttttactggttgacccataatctgaaaagaccttaattactgacttgtcatgttcttgttttctctcttcattgcataccccttttcctttcttctgggtcttaaaaaattcttcaaaatatataatctggctattctcatactagtcaaagaagaaaatattcctcctctgttctctcatttcgttatgccaaacttctcttatcttcattctgaatgatttgtcaacctcttctagatatcttttagttttagttctatttttggggagtcttagttctctcataagcaattctttgtcaatttcaaactcgtcttattctatggcaataacaaagccaacatcaagctcgataacattgatatcgaagtctgagattgaaggttcgtcggagttgtcttcataggtagcatagacaacattttgaggttttgtcctaggcctagaatctagactgaccgaaggtctggactggagaaaggctttctgttgtatcaaaatagatcacatcgtgtcttaagatgagatttttttttcgaatgtagaaaatgctactgtatcgagacatcctaatagatcaaaatacaccttatacttcttaaaagtaggtagcagtaaatcctaccgatggccggccacgtctgtgcgactttgatgcggcgaggtggggaggtgagcaggggctgcatgcctgcaagataattaacaaggatttggatggtgatttgtgatttgtgatattggattcttggatttttggttggtgatttgtgctagagtatagatgacggcagtgg

SEQ ID NO: 84101 - DNA, 688 bp, Oryza sativa
aatagcactacctttggattcaaattttttggcattggcctttttccatccttggggggccaccttggcccactcttggctattagaattttaccgataatatctaacaaattattattttggaaaaagtcctggtaaaaaaaaccctcccgatttaatttttattgtttccaaaataaatatttggaaacctatggatggtaaacttttccaaaatggaccgattaaagtcaatgggatcatatatttatatacgaaaggagtatatatctagtttctgtagattagggtgttcttctcgttttcctttgccaatggccggtgtctatgtttgccttttggagctaatccaatagataaagtgatttctaacaacaaaaaagcattaaagatggatgaagattgaagagctataattaagaatagagaattctggagttttatcttacgagatggtgggtcaaggaaatcaaacttcagtatgttgatatcaggtagatctaacgattttagatacaaaacacttccggcaagagaagaacgctggatttctgggattgtagcctcgagaaactccttttgataaatggaaattgggtataacctatagcacttcccaggccgagttcttccagctcgcccagctcgctggtcagcctgcactcttgttattcaagaagtagtatgg

SEQ ID NO: 84102 - DNA, 533 bp, Oryza sativa
tgcttttaaaataaatatttgaaaactatcgatagttaaaattataaaagtttgacccaaccatgtttaaaacgtcaaaaattatggaatcaaaggatgtatatcaaaagtgatcaaaacccgaaagtttagaaattaaatgaatataaaatatttaattaaaccaaacaaaaaatcaggtcaaataaagtttcactatataattactctgtcgtgcagatttgtttgaggtggttgtacgagcaaggagatgttttattggtgaagacatataatgagaagagaatgaaggaaaatctggacattttccactgggagctcacagatgaagagagggagaggatcagtcagctgccccaactgaggggcctgcctggattggaattcatctctgaccatgggccttacaaatcagttgaagatttgtgggatggtgacgtctagcaagctacttagatacagtggagtatatatctaaataatcatgatggatcatgatgtggatctatcttaattatgtgcggcaggcatgg

SEQ ID NO: 84103 - DNA, 1938 bp, Oryza sativa
ccaacgccattctcacccaaatcctcgcccagcaggccaacatgatgactgctttcctccaccacctccaaaatccgccacaacttaatgctccaccaccaccctcacaacactttaaacttgccgagtttctccgcatccgcccacctaccttctctagctccaacaaccccgtggatgcgttggattggttgcatgccgtggggaaaaagctagacactgtgcagtgcagcgatgaggagaaagtcatcttcgccgcccaccagctgtagggacccgcatctctatggtgggaccatttccaggctacgcagccagagggacagcctattacatgggctcgcttcaccgccgctttccgaagaacccatgtgcccgccggagtcgtggcccttaagaaaagggaattccgagagttgaagcaaggcaaccgctccgtgatggagtatttgcacgagttcaacaacctggcccgttacgctccggaggatgtgcgggaagatgaggagaagcaagagaagttcctggcaggaatggaccttgagctgtccgtccgtctagtctccggggattatccggatttccaatgtctggtggacaagagcatccgcttggaagccaggcacaaggaactggagtcgcacaagcaccgcttggcgaatttccgcaaccaacagggtgctaaccaaagggtccgctacaccaatccctatccagggggatcctccttgcagcagcaacaacagcagcagcaacctcgctccgcgcctcgacctcaattcgtggtgcgcgtcccacagccgcagcagcagcagtatcaacaagggactcgtgcgccccgtcctcctccaccgactgtgcagcttggtcaaggccgcagggacgctcaaggtccgcagcgtctgtgcttcaactgcttcgagcccgggcactttgcggataaatgcccgaagccaaggcgttagcaaggccaagcgcctccccgccccaacaacggtggtaaggacgtcattcggggtcgtgtgaaccatgtgacggccgaggacgtgctgacaactccagacgtcatcgttggtacgttcctcattcattccatccctgctaccattttgttcgactctggagcttcccactcgtttatatctgtgccattcgtggggagaaatcagttgggggtagaaaggcatagaaaccctctgctcatcaccacccctggaggggttatgacagcaaagtattatagccctgccgtccctatagaaattcgggggattccttttccctcggatctgattctgctagacaccaagaacttggatgtgatccttgggatgaattggttggctcaattccaaggagtagtggattgcgcgagacgcactgtcactctgtaccgagggccggaacaaccggttgttttttttgcacccccaacctcagtcagaagttcagaacttcatcagatagaactgtcagaaattcccatcgtcagagagttcggagacgtgtttccggaagaactacctggtatgccgcctaagcgagagattgagttccggatagatcttgctccaggaaccgctcctctgtacaagcgaccctaccgtatggcagcaaatgaactggccgaagttaagaaacagttggaagagctgaaagaaaaggggtatatacgtccgagtacttccccctggggtgctcctgtgatttttgtggagaagaaagacaagacaaagaggatgtgcgttgactacagagctctcaatgaagtcaccatcaaaaacaagtaccctcttccccggatcgatgatctgttcgatcagcttaaaggtgccactgtattctccaagattgatcttcgttccggatatcaccaattacgtattcgcgaagaaagatattccgaagaccgcattcaccacgcgatacggactgtat

SEQ ID NO: 84104 - DNA, 2480 bp, Oryza sativa
gggttttattttcctagggtgaacaaggtaataataaggtcataacaaaggtaaataggcatggctaaataaaacagtgataacgcgggaatttaaataaagcgataatgcattaatttaaatcaaaataattttataaactgggattcaatatgctcaaggatgatgtgacttgccttgctcgcttttccaaacgtcggcttcaacctccacgtagagcggatcttccgaagctacagcgtctacacgaccaaagaaaaggaaaaagtattttactctaataaactccatataacaagcaggaacaaagtacaaaaatgggttcttgacttcttgaggaaaaattagagacttgaacggtccaattccgagttcaaatggccaagttatggccatttgaagtttatatgctctttaagtgaatatttgcgaatttcttcatttaaattttaatttaaaaaggatttattgcgtcagccgaggggagagcgcgcgcggaccgggtccacgggggtggggcccacgcggcagcctcacggtccacggtggactgggtgcacccgggctcacaccggccggagccgtgggccccacgcgtcagcctcactcgagggcacgggcggctgacggccgggccccacgcggcggccactcggcgcgcccgaaggcggccacgacggcgcggtcggcggcaggcggcacccgcgcccctatggtcgccggcagcggccataggcacggcggagcagcggtcgagagaggggaagggaagggggaaaagaggcggtggtccacggctcaccctaggtcgacggcgacgacgaaaaaggcggccaaaacggaagaaggcggcggcgcggctcgggtcgacggggtcggcggcgttccggcggtcagcgagctcggcgtgggggtggacggggtcgacgccggtgcggctaacccgaagaagccgaccccggggcggaagacggtcctggcgagcggagaagcccgcccggaggtcgtcggcgacggagaagagagagggcaacgacgcgagctcgattccggcgaggagaaggcgcggcaaagggtggaaacgggcgaaggaggtgcggggagggtttaaatagggttggaagggggagaggccggccggaggggaaggaaaccggcgcgggaggtccggccgccatcaatggcgccggcgagatttgcgggggcaaatccgcccgtttgaacgcgagagagagagagggaaaatggggggaaagggagaggggatcccggggagtgatttcccccactttattgcacgcggggacggcgggatgcggtggatttggcggcggcggcggcagcgcttggcgcaggcggaggcggcgggagcggcgggaggaaggggatgacgggtgggccccacccgtcagcgagggtggcggacgggcccgcccgtgtgcggcgcgcgcgcgggaagggaggccgaatgggccgcgggggagaggagggagagggggggagagatgggccgggccggcccaagggagggaagggggactttttagggtttttctttttataaaacctttttaactttgtttatttcttaataattattatttgtgctctgaaaattccacgaaaatttatttacgcattttaggcttttaggaaatatacaaaaatcctctaagccttatttgacttttaactttgcacattttaattgttggaggctttcatacggattttaattattctaggcataatttagagaatgtattttagagtcgttttgggacgtgacacatttgcactcaatggcttttacaccatcagggggatcaaccaagctccaaactttattgacatgcatggattctatttcggagatcatggctccaagccatttctcagagtctggtcccaccattgcttcctcatagggagtaggatcgtcgttgtctaacaacaatatatcacgttgtcctgtagttaacaacgcataccttgcaggtgtacgccgtatcctttcggacctttgtgaagccggtgctttcacaactggttcaacaacaacttattcaacttgttgaacaacatcttgctcagcttgttgtggttgtgtggacgttgaatcgttttccggtgtttcctgaatttcttcaagtcgcaccatgctcccactatcctttcttgaaatgaactctttttccaagaaaacaccgtgtcgggcgacaaacactttgccctcttcccgattataaaaataatatcctttcgtttccttaggatacccccacaaagaagcatttatctgatttaggtgtgagtttatccgattgcaaacgttttacatagacctcacagccccaaatctttaggaaagacaagctgggacgcttccctgtccatatctcatatggtgtcttatccactgattttgatggaactctgtttagtgtgaacgcaactgtctctggagcgtaaccccaaaa

SEQ ID NO: 84105 - DNA, 1125 bp, Oryza sativa
agcagacgccaccaagcaagcaggttgtgcagccgatccagcagacgccacaaaggcagcaggttgtgcagccgattcagcagcaaggtttgctaaatgcatcggccgggttcagaacacccgacaatcagccaaggcagcacgctgcaaatcaagttgtcccagagcatttagttcataatgtgcatccagatcaaacggtgatacctcaagtgattcccgaacatttggtgtgcaatatacagccaaacttccagaattatcaagggggcaatttgaattatcaatatcagcctccatcaccgcaagttcagtatcaataaggaggatcggctcagcctcagtttgctcctcaatacaatcaattcgagcccgtgccacaacaagcacagggagtgtctcagcaaaggcaatgggccgatatgattgcagatgtgataagagaacagtttgggctcaagccgaagaatgctggaaacttgtatcggcatccataccctgagtggtttgagagggttccattgcctaaccgattcaatgttccagatttttcaaagttctcaggacaggacagcgtttcaacctgtgaacacgttagccgattcttagctcaatgtggggaagcatcggctgtggatgccctgagggtcaggttgtttccattgtctttgtctggatcggctttcacttggttttcttctttgccatgtggatcaatcaacagttgggccgatttggagaagcattttcatagctatttctatagtggggttcatgatatgaaactgtcggatttaacggcgattaagcaaagacatgatgaacctgtgcaagattacatccaaaggtttagggagatgaggaataaatgctacagcttgagtttaactgatgcctagttagccgatttggcttttaagggtatgatagctccgatcagggagaagttctcgtctcaagactttgatagtttgtcacatcttgcacagaaggtaactctacatgagcaaaggtttgcagaagccaggaaaagctttaaaaaggtcaatcatgtctttccctacatctatggatctgatgatgatgatgatgatgatgatgatgattctgaaatagctacagccg

SEQ ID NO: 84106 - DNA, 2881 bp, Oryza sativa
  unsure (1)..(2881): unsure at all n locations
attcacctaggcacgagaggggactgcccgctgcgttgcgaggagtgggggtgaaacatgaggtgtggtgcgattggttagagggggttatgcgaagggtcctgtcacagcctctttccggtatgtcatggtggcatgtcggtacacgaaaacgtgtcgtggggctatgttttgtgggtacagttgtacacctctaatcagagtaaaactattcgaatagtcgtgcccgcggttatgggcggtcgaccagattcaccgtgattagtctcacccctagttagctaatggaactggtgtagttcaggtggttggttgggcctgttgcaacgtggtgtagcgttggacagtgattggttaatattgattaatttctgcaactgttttactactttcaactactacttttaaatgctagctttatgcaaaagaacctttagcctcctttggttatatcttgcatcataccttctcttccggtgtgacttgctgagtatagtgggtagtactcagtcttgctctctcttccccacaccagagctgaagatcttcctagttggagccgtctcgttgaaggttggtttcgtcgctgccgtcaaggatgcctgtggagtggagtcgcctcgctgcaggagtcaagtcttcaggcttagctcgcttttatatttttcgctacatttgtaatcttttgtatttttctaagacgtggatctgtatgtcaacaattgtcgtttgtgtatcctggctggtcctggacaggggtttaatgcacattcagcttagaaattctggtttgtgaatttctgggcatgacagcttccaagcgaagatgtcggagttcacccgcaggaaggagatgagcgcgctttcctatttggcatccaagttgccgccaatcttggcggtcttggacggatcatcgccaagggtgatgtccttgacgggtacctcatcgcccgaggtaatgcgcttcttggaggcgtgggatgcggaggcctccggggatccaccggcctccaccggctcggtggccgccgccaagctatcggcgcgctgctccgcacacgccaaggcaatcttgacgtcgccagagatggtgatggggctgttggggcccggcatcttcatctggaggtaagcgtagtgggtggcggccttgaacttgaccagcgcgggccttcccaggaccgcgttgtagggcaaattgagatttgccatgtcgaagtcgatccgcttagtgcggaagttggtggagtcgccgaaggtgactgggagctcgatgtggcccaaaggccatgtgtgccctagtgtcatgccaatgattggcaacgacggctgaagcctcatccccgcggccttgagggcatggaaggccgcatgggagatgatgctatggctgcccccccacccccgtcgatcaagacacgagggccagcttccctccatgggcgagcaccgtccgggtggtcgctctggtcgaatgtgagcttcacttccgaccatcgcgcccgccgcgccaccttctgggttgggacagcggccagaagctcatgcctcatggccttgaaactgcgacgggaggcgtgagcgcaagccccccttgtcgagtgtggcgactgtcccctgaggtacctagaactccatatcctcgctgtcgtcatcgtcatcgacgggggccttttccttggcctactctcgctggttgccgaccgaggtcgcggaggccttgccctccaggagaccctgccgactttgcccatcggtctttctgtaccgatcggacaagttcttgaccgtgcggcaatcaacgagactgtaccgataggtgttgtgcatcgagcaccacttatctgacgaacggctttcgctgggggtagtggcggtgctcggcttatcgacggtggcctttttcttgcgcggggtcgggaagggttcgtcccaacaaagaacgtggccctcgcngtcagagtgggcacgatgcatctcttgggaaggaaaacctttaggccacggataagcttgagatatcgactctggaggatgagagaaaacattccacatatgagcatgaaagtttctctttcaaaaacccctaggattcatgctcacaaaaggaatcccagaggaccacttccctgtgtgaggaccgcaaccacctttcggtcctcatttctaacatgtatagaggtgtggttgtggacgcttatatttatcacaaatactgcaaatctcgtacttgtttgtggcactaatcttgcagagtgatgtcccaatggtcgagcttgtgaccataaacaaagcactactgggagatagcccggattaatatggtaagtttcctttctaataaaagcaagaaccagttcttaggataatatgcacctttgggtattcttggccgctaaccatttcaggttgagattaagagcgagggtcatacaatgcctaagaacatggtagctacttcaattgtacactttggtgacccttggtattggaacacactctataggagaatccgacatcacacacttggtttttgatgtcttgcgacacaaaagtccaagtgtgaggtggagatcgacgagcttttcatgacaagttccatcaaccaaagtcatcttggtttgaacttggttttagtcctagcttgctagaaaaaaaaaagaaacaaaaagataataaaaaaagaggagaaaagagagacagaagaaaagaagaaaaaatatgggaggtgaagaaaagagcaagagagctgacgagctacatttggatcaaaaaccgcattaagtgcgtgtctttgaaatatggctgtacacctgggtagtagcaatcatgctgcctggctatatctagtccctctctcgagctcatgtgccgtctt

SEQ ID NO: 84107 - DNA, 680 bp, Oryza sativa
aggcatagttgtataaccaaaggtgcctacaggagtaatgaaagcagttttttctttatcttccctagccatgcgaatctgatggtatcgcgaataagcgtctaggaaacacaaaaggtcgcacccggtagtggagtcgactatctgatctatgcgtggtaaagggaaggaatccttagggcatgccttgttgaggtccgtctagtcgatgcacatccgaagcttgccgttggtctttggaacgaccaccgggttcgctagccactccggatggatgacctctcggatgaagccgggcctccaggagttgcgttaccttctcgcggatgaaggcttgccgctccagggcctggcgccgtaccttctaccggatgggtcgggcgttcggccgcacggtgaggcggtgctcaatcacctccctggggaccccgggcatgttcgacggcttctgtcacgcgctgaagttcccctcccttgctttaaattaataaaataaatcgcctcaagtagttggtaaaaattaacctagagttgaatccttaattaataaatgcatttaataatcgaattcggcgtggtggaatttttctttagttccccatgctctaatatattaatagaatttttagtggaattttcagagccttgtaaataattttaaccaattaaaaatgagcatg

SEQ ID NO: 84108 - DNA, 516 bp, Oryza sativa
ccgtatgcggagttctcttacaacaccagctatcaggccagactacaaatggcgccgttcgaagcgttgtatggccggaagtgccgcacacctctcttctgggatcaaacaggcgaacgtcaactgtttggaacagaagtgttaacggaagcagaagagaaagtcagaaccgtcagagagaggctgagaattgcccagtttcgacataagagctacgcggacaaccgccgaagggagctcacttttgaagcaggggattacgtgtaccttcgtgttactccgctccggggagtgcaccgtttccagacgaaaggcaagttagcaccacgcttcgtgggaccatacaaaatcttggaacgaagaggagaagttgcttatcagctagaacttccatccaacatgatcggcatccatgacgtgttccatgtgtcccagttaaagaagtgcttgagggtacccgaagaacaagccgattcggagcacatcgacattcaagaagatctgacttatgtggaa

SEQ ID NO: 84109 - DNA, 1325 bp, Oryza sativa
atcccgtcctagtaatcctccatgttcggatacatcatagagctataaccggaaccacgctggcagaccagcaagggtcggtgcccgaagcaacagataggaaattacctttgcttagcttagataattaaaacacatagagagtcctctctagcctgcctacctatagttgttctccttggatcgtcttagccttaggtagattacacacgttccctgagttcgatatccttttgggtcacccgaaggtgaagtgctacatcggtattccgtgcgcttgcgggtttatctatggtcgtaagaaataccaacaaataccaacattggtctctgctgtttccggatttacctaggcatgagaggggactgcccgacttggcacaaggagcgggtgaaaccagaggtgggcatgttcggttagggagggttatatgaagtaccgaagtatcgcggtggtacttcggggcatggtagcatgtgtggaattgttgtgtcttgtggatacagttgtacacctctaatcagagataaattattcgaatagccgtgcccgcggttattgggcagtcagctagctcaccgtgattagtctcactataataatatgacttattttactgatgtagttctggtggtttggttgggcctgttgcaacgtggtttagtgttgggcagtgatgatttaatattgcttaattatatatattgttttactttttcaaaatatgatttataaatgctgcctttactgcaaatatcttgcatcataccttcccattggtatgacctgttgagtatggtggttggtattcagttttgctttatttttccccaccccagaggcagagattggttcagatggtgagttctttgaggattgagcttgttctggacgttgaggatacatgtggtttctatggaggatgctacacttttggtcgtaaagattaagtttagtttatttgtttttccgctgcgtttgtgagaattatttattatttttgtaagacatggatctgtttatcaaattgtcgtttgtgtactctgggtggtcctggacaaagattttaatacacattctgtttaaaattcgggtagcgaatttctaggcatgacatcaacgacaagaagctacagttctcgactatatgttccgttgtttccctactaaccatagagtcgggggctacacaaacacaagactaaaaattcaacagacgttatatcaagatgaagcaatcaatcaatcatggagttctatggaatcaactttgggagtcattagactcgtcatcgttttagagcaggcgttttatttgaacaac

SEQ ID NO: 84110 - DNA, 1974 bp, Oryza sativa
cgataacaggctccaggaatacatcgatatcattgccgggttgtctcggaccttggattaacaagcacaacataatatattttcgtttaaagcataaccatggcgggaggttatagttcgcaataagaactggccaagtggtgtgagtactactcatgtcaccgaaaggattcatgccatctgtacacagacatatcctcatgtttctagggtcggcagcaaagtctttgtgttttcgatcgatattcctccattcaatcgaatccgctgggtgtctaagcataccgttattccttctctccgtggcgtgccaacgtactaacttcgcttcgttcaggttggcaaagattctcttgaaatgatcaatgataggtagataccacacaacctttgccggaccacccctctttgacttatttccttcgtcagcacttttctttcgcttgtatcgagaagccttgcagacaggacaagcatccaagtccgcatattgcttgtggtacaatatgcagtcatttggacaagcgtgaattctacggacctctaaccccagtggacacagaacatgctttgcttgtatgtcgtcgcgggcaatgtgttctcaacaggaagcatagccttcaaaattcctaaaagatctgtgaaactcttgtctgtccatccactacttgccttcagcttcattaggtccaaggtaactgacaacttagtgtgttttgctttgcatccagcgtacagaggtgtctcggaatcactgaccaacctgttgaacttcattccatctctctcattctgggatgggtcctcaacgtcacgtaacatgtcttgcagcagatcgtgatccacatcaaccatttcaccgcccaatggagaaggtataaacatgtcatgctcatcttcatcttcctgattatgtgcaccacttctgtctgctgctactccacttcctgattcttgcactccatgcttcacccaacatgtatagcccttcatgaatcctcgttgtatcaaatgaccgtgtacatcctctgcgctatcaaacatattctcattcttgcaatctgcacatggacaacacatgtaatcactgtttcttcttttccgatcctcctccgcggcattcataaaatttattatgccctttctgtactccgtagaatgacgtttcaaatttttcgcatacatccaacttcgatcgattgctacaaaataaaaaaaacaaattacatgcacatcttataagatcagtattgcaaaagtaatacgtgatgaaattgctcaattaatgattaatattactcacttgattgatccattttgatcacttttgggaattttctgtttttcttggaaaaaaagacaaaaaatcgccccctacagcctcccaccaaaatagtgaacagtaggatacagttacactaggtggtggggggtatttatactgtgcaacaaatatctgtaacggccctgaaacaatcaaccgtgacgggcatacaagtaatctctatcgggccttaataaaaggctgtcaaaaaagagtgtcatctgtgacgggtattaaacttatctcaatcgggcctctagttggagcccgtcacagatgaccctcatctgtgacgggcttcgtttagggcccgattgagatatggaaccctcatctcaatcgggcctcaactatggcccgtcacagataaatgtcatccgtgacgggttttagttttatgccgatataccatggctgtgcgaccatatctcaatcgggcgaaacttcggcccgattgagattacttccttgtgacggcccgcaaattccaatcttgttatgggccatcacagatggaaggatctgtactagtgatatttcgtgaactgaggattaatttggggagaattcgctctctgctccgatgaaaccgaggaatgtatgttagaagcaacagaggaactcgatcggtgaaaagactcaggaaaagg

SEQ ID NO: 84111 - DNA, 979 bp, Oryza sativa
tcctccatcgccgccggttgccgctggcgcagtgccgccgcctccgccaccatctcctccgccacgatcacgtgcatttgctcccggcacagcgcggacacctgcttttttttttttgtccatcgatcacaccaaaaaaaagagaaaaccaaacaaacacacgtcactgatcgagcagtggtagtaaaaaccaaaaacgaaaattaaacgacaaattttataaaaaaaaaacgtgtcgacctcggtttcgatggtgctagaacattgccaggtggatcaaacagtgcaatgcggtacaacacaacagcagcattttcgcaatcaatcaatccaatctctatctctttttctctctctctctctctgttttttttttctttctaacccaagattatgatgagtaggattagcatgaaataatgatgggattaagcaaaggattagcgggggggcgacgtacatgggggccgccatggccgtcgaagacggcgaagaagtgcatcggcgagccgtcgagccaggtgcagaaggagggccggagcgagacggcgtcctccatgtcgcgcatccgccccgcgagcgagacggacccgaacgcgacgggccacaccgcggccgccgtcgacgccccggacgggagcgggagccgccgcgccgcggcgccggcggtggaggagcacccgtcgtcgtcgcggtcggacgagcagtcggaggaagccgccgacgaggtcggggacggggacggcgacgcggaggaggccgggaggctcctcttctcgcccccaccgttgctgctgttgtccccgtcctcggacgcggcggcggcggcggggacgtagcggcgcctgcgcaggcggtggcattcctgggcggccgcgggggggtggtccccatcgccacccggcatgttgacgccggcgctagccatcaccatcaccgatcatgggaagggaggaggaggagagggaagaggaggagg

SEQ ID NO: 84112 - DNA, 649 bp, Oryza sativa
tgctatgattgccccatatgacgtagatggtaaccgtattacgtacccttctcttgggggacgaaactacaactctactacccctgttaaatttacaaaactagcaaaaccacttaaagtcggggatacagaggtttttgtagaagatgttagtctatggaacggacaggcaccgcaagactaccaacgtagtattatcatgtggggttataaaaactcgttcggctatacttatcccgatggaacgtatagtcagctaatgcagatgaggacatatgatattggtgcagttgacaccacagctaacaagattacgttaaacaagccatgggcagttgcaaacccaaatagttcagatgggattttcccagtagggcatacacttagcccaacttctgacggctccacatatttgtatttgaatggtcacgtaaatatacaagtacctactacgtacaccaagtacagccatttgattagtggctcttctgagtttgctaatacaacgattatcccagtagaaacaggttttattcaacttggattcttgttgaaccgtgatacaacaggtgaaaaatcttggctaaatggtttacgtctacgtgactatacagatacgtataaactaaacgatgacgttagagaaaca

SEQ ID NO: 84113 - DNA, 754 bp, Oryza sativa
ccgtcatggcgcctagcgggaaaaattatctcttaaaaaccctaattgtgaaatttgtttctttgcttgttgtctagtgtccgtgccatctcagatctcaaatccccgatctatcgtcaagttcaaatccgaatccaaatctttccaaatcaaattcctccgcaaaagtctattttgcctcccccggggtcgatgggccgaatttctctcggcccatcttcccctctccctcggccctctcccctcccccagcgcgctccctcttccccttttcctccggtccgttccgccccgcacgcgcgcgcggcggggcgcgtgtgcgcgagcgccgcgccgagcgccccttcccctcgctctctttctcctctccctggcgagctccccgcttgcgaagacagcccccgcgcgccgtcgttcgcgcgcgcgcgcccgcgtggttccccgcccgagtcgcgtcgtctgcgtcgtccgcgtcacccggccccgctgctctgccgcgcctgcaaccgctcggccccgcgagccattgcgcgtgcccagccgcgccgcccgttgtttcccgcgcatgcgtgccgagtggccgacctcctggtcgccgccgccgccgtcaccctctgccgcgccagcccgcgcctgtcgcccgtgtcgtcgcgccgctccaaaccgccccgccgtcatcgccgtcgtcatcgcctcggtcccgccactcccgcgctagcctacaagggacggaggcagagcctccctcctccct

SEQ ID NO: 84114 - DNA, 719 bp, Oryza sativa
  unsure (1)..(719): unsure at all n locations
catggttccaacaaacccttaaataaaactagcatggtgacccgcagattgcgcggctagcatcattgtattttctctcatataatagcatatatgttttctcattatattattcaaatatattaaaatgacaacataattttaaattttgcaataactttataaacctactaatgtgtaatattcatattatattttatatacgtgttagttattaattatttttaatatcaaattttagttatttgtaaattatatatattcctatatggactctagactcgtcttttaatatttgtttttttaattccgaattttctgtaaattgtatttctatatagactctatgctcttcttcccatattatttatttttatttcagaatttttgttatttctaattgtatttctatgtggactctaaactcatctttcaatattctttaatttttaatttcgaatttcagttacttctaaattgtattcctatattgactttaaattcttcttctcatgtttttcttaatttcgaattttagttatttgtaaattatattttatacggactcaaaactctaatttaatttaattatgttattccaaattttagttagttttaaattcctatatggactctatactctacttctaatattncttactttttattcccgattctattttttttcttaattgatttctatatggactctatactct

SEQ ID NO: 84115 - DNA, 2292 bp, Oryza sativa
gggtctcgccggcgccgttgatgccctcccgccagccgacgaggcgggcggcggcgcggtggtggcgggggatcgggcggagccgctcgccagcgcgatgggaggggaacgggaggaggagaggttgagattttgtcaacagatgtatagatagccccttttttttaatttacttcattcaatgtatgtcgacgtgccttgcacgtgcacgctaactagtgcatggaaaaagtaggccgtttcctgttatcaaatacttcctccattctaaattgatctacatatagttttttttagattattcctaaatgatctacatatttgtgttcattcattaagtctattcgttatttatgcattggagtaaatggacattgatgcatgcatccatgtacataagtatttataacccacatgcaatatcttaaatggacattggctaggaaatagtggggatggtgcatgcatcgagtttgttgctagagtaaatatagtatgagagagttattagctttttttggtcttggtgtacctatgaaatatgtagatcaatttggaatggagggagtatagcacacgtacaggggatcgctaattagcgcatatgcgcgaattgctttcctggcgcacacgtacatgtgacgagcatagatggacggtgtcgtcagaaacggaaaacgggaaaaaaacgtgattagcaccagtaatttaagagggcagctagcccacgggataccgtggaaaagtgaagtcacgggacaatttttacgtgtgattaattagcgtacaacatgttgtaccacaggtaccaggtatcacaagtatcaggtaccaggtgtcacaggtatcaggtaccaggtataacatataccaagtgccaggtatcacaggtaccaggtgccaggtatcaggtatcatgtgtcataggtattaggtaccaaatgtcacaggtatcaggtaccaggtatcacatgtaccaagtgccagatatcacaggtaccaggtgccaggtatcaggtatcatgtgtcacatgtatcaggtaccagctgtcacaagtaccaggtaccatgcaactggtaccatactggtatcagctggtatcagcatagcggcggaaaagcgaacaccagtcaaaaagagaaaaaaaataaaatctatgttacataatatcattgtgtcaattaatttacatgacatactaaatctcaatgtgtctcactcaagaaaagaaacaaagcaagaaaaggagaaaacgaaaaattaaaaatgaccgtggtatatagaagatgtaagtcaagcctacagaggtgcatgcccaaattgattcacatggcccaagtgcccaaccaatatatctagagtccttgtgctgcaggaagaacacatacacgtggatgtgttgtggagtatagacctgccacttagtaggaaattgtgtcgcatgcgtgtacaattgttttgatggaaataacgtagaccttttaagtcatcccgtaggaacgggatgccgttctagattttctggtaatttaatagcgcgtgcgtctggtcccctcccgcgtcctattttttttcttttacgattttttttctttcacaatttttctttccttttgcgcttttttctgattatttttttaatcttcaacacacgtattttcgaatgttttgagttgaaaagtttttaaatcttaacttgaaaatttttaaatcttaacttaaaaaattttcaaatccaagttgaaagttttcaaatcttgagttgaaagttttcaaatctcaaacctaatcgccgtcggcgcccgacgcccggcgatgtcgcagctgccgacgttccggatggcccagtcgagcacgacgggcacggcgaagtcgctggttcggttgaagaaggcgcgatagctgtagttggtgttgatccacctgtcctccgccacgaacacgtactggcattcagtggagtcgagatggcggaagacgggttccgtcggcgggagctcctgttggtcggggacgtttcgcgttggttcctctgtcttattcaacgtgagtatgtaaggcttgtagacgttgagagcgcggggcatggtgttctggcagcaccccgactcgccggtgcactggcccggcaagtcaccctgcgactgcgaccgccggcacgtggatgtgcagccagtgacgtacgtatagttatcgtcggcgtcaatcaagtagccaaggacggggcacccgagcacgacaaggcggttcctcttcgtggagaacccggaggcaatgctgctaccgtagtc

SEQ ID NO: 84116 - DNA, 538 bp, Oryza sativa
gagggagctcgacggggccggattgcggcgccggcaaccggcggcgagggaagggggaaacggcgacgaggtcatgaggggccgattcccggcggtgagagcatctacgcggctacgggaatccgttgctagcgtcggattgggcggagctacgccgagcgaggccggcgacgagcgggcgctacggagcacgggcgacgacggcggcgagcacacagcgagcggcggcaacggtcggggcggcgccagctagctacgggaaggctacacatgctactaccgaaaactaaggggaggagatggatcgaggagggagaacgggggaatgcactaccgagatgaggcggggcgctgtgacgagaggccgacggcacaggagtgatctctccggcctcgggccggggaagaggaagaaggcgagcgcccggagtcctcttccatgtcctcgctcgtgccggctcctccgacacgcgcgacggcgaacggcgacagcgaacagagcacgggaggcggcgacaatggagtggaggcgaatggg

SEQ ID NO: 84117 - DNA, 817 bp, Oryza sativa
aaagagacgacggcggcgcggcgctagggttcgggcggcggccggccggaggtagacgacaggcctgataggtgggccccacttgtcagcggcagcgagcgcacgtgggcggctcggcttgactgggccggcttgggccgaggaggagagagagagggttttgggccgactttcggcccaaagccaaaagaagacttttaaaaaacctttttcaatttaaattattcatgaaatgcaattccatttattaaaaatacttccttagctcaaataaatcccagaaaaatctaggaattatagaattaagcaaagtatttaatgaaattttatctggccccattttatattggaatttattaattaaaactagatcttctcttctaggcttttaaaataaattctaataattccaattaaacaacaatttatatatttaggatttttagggtgtgacacccttgctgctggggagtgggtatatatacccctaaccaccaaaactaaccgttggaaccgaaatccccaactttgtgctctgtcggtcagaccgccgttgtgaggccggtcagaccggactactttgtaatggctagaaaactagccgttacagggcaatcattgagcccactcaacctggccggtctgaccgcagtgtagtggccggtcagaccgtccacggctcggtcagaccgccgtcggctcggtctgaccggttgcagctctagcggctctgtatcgccaccaaaaaccagaccagtgcaacagaccagtggggctggtcagaccggccttaccacgtcggtcagacctgctaaca

SEQ ID NO: 84118 - DNA, 625 bp, Oryza sativa
tcatgtaaacatcctgtttctctgttgaaactatgcatcattgcttcacatctctgctacgagcttgctgtattgatccagagcgaggtcaaacgaagtgaatgaaaaaggagggagcactgcttccatcacctctgcagcatttggcagctcgctttcaaccggcacgacctgcatgcgtcattcacaaagatacttgtatgttagatgaactcgccaacacctgagaatattgcgtgttagagcatctctaacagactctccaaactaaatttggcaactctatcaaaaaaaggtgcaacttctagaaatacttgtaggaaatgattccagacattgagacataaccaaataaactatttcctggaaaacttacagataaaactgaaagacagaggagagggctcggtgaaaaaaaaagacagaggagaggacatctataagactacaaaagtttatgccttatgtataacatacactacttgattaaataagtcatacggcttgcatatatattggcagactgtaaatttgtaatggtaaggttgccctctgctaaattcagtgcatggttatgaaacaagaaacttgtgatggaaacaatggttgtcttgccttgtttggt

SEQ ID NO: 84119 - DNA, 585 bp, Oryza sativa
cgccagctgccccggaagttgtcgcctgagcgtcgcccgagggagtgggcccaagcgatgcgcccgcgacctcgtcgcgagctgcctcggaagaaaccattgcctcgtcctggcgaaatccggctttctcccgagcggcttcctcggcctggtgggctcgggcggcctcctcccgagcggtatcctcagcctggcgagcccgggcggcctcccgggcggcctcttcagcttcccgtaggcgatctgcggcctctcgccggtcagattctcgcctccgtgcctctgcggccgccggatcctcggcctcagattggccagacttggaatgacgggagggacgcgacgggatctcgctaaaacagaagaaaagaccagaagacgaacaaagacgggtgagtgaaaactcgcgttgaagagaatggatacagccacgatgagtgagagatgaacctgcgagggggtcggttgaacgaccactttggaggggagatgaggtttccccgagatggttctgtctcccccatcttgcggagccgtttcttcttgggctccccctcgggctgtgatgttggcgcggccccctcc

SEQ ID NO: 84120 - DNA, 692 bp, Oryza sativa
aatttgatagagatatttttgttgttttgtcttttgatgtagaaacttactgttggcgggatgccagaaaagattgtaacagcatatcagtcagtgcttgatcaacattttgatgaagacacagctttaaacaaatgcaataatgctgttagtgttttggataggatggataaagatgtagatgatgcttgtactcaaggtaaagcatttttctcacttcaataggtctgttatgttatggatatgtaccgtcgaaagattggcacttaatgcattctgataccttggcctgtattgcatcatgattgttccagcgctattttacttctagttccatcatgtacttgacttgagaaaaaaggaatttacatagtatttccggttttttgttgatctgccatgtaaattctagactaaacaaacatctcaaatacataaatatgatctagcatgttgacaaagaaaattgctgtacataattttataattatgttaaaaaaactataatgatgtgattgtagcatgcattggcatataaagggaagaaaatcaattttctggcatttgttttcataggtggtggtctagcatacatatccttattctgtggagcacatccagcagcttaattattttacattgtgatagttccttgagtcctttatagtgcacactaggcctgtaggccatga

SEQ ID NO: 84121 - DNA, 757 bp, Oryza sativa
tcctgcagcccgacaaaattataacaccggcatccacacaaaatagtggtggaaaaggaaacagtggaatgagaaaaagatgtacaacataggagttattttctgaaaccagaaagaagatttgcatgaagatatatgaagaaccaccatagttaatacagtgcagtgtagtgtgaacaatggtaattcaactgaaaagactagctgcagcagttaggtaaggttgactaaattattgatctcatcctaacatattttgatgccggcagagaaagtgacgcgataagatgaactgacagagctaaataggcaaaatctgacctcaaaaaataatccaaatagtgtgtcagggatctttcgtgaaacctcccatgaagcatcaacctctactagtgctgtctgaggcaggtccagctctgaagataggcatttggaactgaaacaaaaaagaagcaaggagcagaaggtgcaaaagaatgcatctttggaacccatgccctcggtcctgcctgccgaacaacagtaggtcagtaaaaactgtaattcagaccattgctacttcgctagtagtcatatagaaatatagagtaagaaaaggagcagtaaaaagaagagtacggaatcgattgagttgttaaacagcaagaaatttaacagaaaacagtatgcatcattggattagacctactagaaaattgaaactgcagctgccgcaacagaagtccgctaccaaacactaacaaagggaactccaaag

SEQ ID NO: 84122 - DNA, 851 bp, Oryza sativa
ttagtaaatctatggagacatactaccaggtacatctaattatttaaccaactttcttcttttctctgactacttggtccattttaaatagatcttattgattttaggaaagtggaagggcagggagagatggactaccttcagaatgtattctgtattatcgacctggtgatgttccacgccaagtaaactaaagatgtcttcctttttctcttggtgtggcttcttgcttcctcttatcgatatgctgttttttcaatgagcagagttcaatggtcttctatgaaaactgtggcctgcaaaatctttatgacatagtacgatattgtcaggtaaattcccagtgctccgccaaaatgaataatatttgattttcttaattctttataccctcaacatagattttgttagtctcagttccgccccttttctactcataactgtacaagaaagtcatttatgtataatctcacactgctgtttaagtgatcaatccaactgaacttcctgcctggaattttgtacaacactccaaaaataacttccactgaaaatgtacaggagcatagggatcaatatacctttccacagaaaatggacatcataacttgctgtcggatctctctctctaggaataaaacatgcaataggtccgagataacataggacaaaagttgttcatacaacgaaaagtaatattgtaaagttttattgcaatatacttatactagagtcctactcggaactgtgtgaacagacttaggcctatataacaagtaataaagattaggaaatagtttgaagctcattaacttacatgacctgagcatgctatatttgccataattagc

SEQ ID NO: 84123 - DNA, 1209 bp, Oryza sativa
caaaagttgtggtattaattggcacttcccaaattttgtggtattctttgaatttggcaaaatctgtggtatggatggattttcctcgatttgaaattgagaaaaggcatactttatagaaaaggttgggcctgttaattgtgctgacaaacttgacacatctagggatatgaagcatctctatcaaatcaatttgcactttatttgtcgcagttgcctgcaaaaaaagaagcaggccttatttcacattacagttaaaatttaattattgtaaaaaatggatattattttcgcaactcacagttaaagctatcataggaacactgggaaactggacctttaaaatgccaagattcttgtagtctgggcgaaaatcatggccccattgactacagcagtgtgcctcctgcatgataacacttaattacaatgataaattggtaatcgcagactctagatacacatgtgcttaactgcttaaaacatatgtcaactagctatgctcacacttgataagatcattatatgatgagaaacataataaaaactaaaaaccaatatgaataacttataaaatgtgaacagtgaataaaccaattcatcataactgctcattttgtacaagtgattagcacgagtgtagacaatggcaacaagtcttcttcgttttttttgcaaatcatttttttctagtccaagaaggatgggttagtatttaaatagtaaaacacactcaaagcaaaacaatattcttaagagagacagagtaagcaaaagcatgtacaagcacatcatccaaccttaatcagagtaaacatgctttattgtgtggtaaaaaactcacatctattgcaatgagagaaagacgccctgcatggtggcatttctcaagcttagacatgaaccttttacttttggatatcttttcaggtgtcacatacaatatcttcagttctccttcacctttatcaagcgccttgtagacgaacttctcgacttccttattggtagttgaagccagcatgtatgcttgtatacctaaagctgctagtcccatgacctagaattgaacaaatcaaataatggtaatgatcatatacaagataaaataaattctcatggtagtcatggtggcctagacaacaccatgtcagcaagcagactaggcaggtgtacaggcattgcctggagaagacaagagacttaaag

SEQ ID NO: 84124 - DNA, 543 bp, Oryza sativa
tgattacagaatttctaactaaaatgtgtatatttttcgtatgaaaatatgtacatatgtataatcttaatgtggtatggcaaggaaagatgatgatggtggctggaagaacggctcttataaagtcagtcctctttgcataacccatctaccacatgacggtcctgaagcttttgaaggggatcctgaacgctatagacaaaacaagacgcaaattaattcctgtgggcaggaggggatgatatcttgggagaaaaatgcaaagttaattgggaaaaagtatgcaagccgaatgagctaggagggctaggagccctcagattgatatctgtggttcgaataagaccttgggctggcaccctagtgttaggtgatcatttggacagagagctgttcgcggtagcgtagcgaccaccataaccataggcgatgggaagacaacaggcttctagagcactcgcattgattgcgccggaatctacacagcctccataagcaagaatagatctgtctgtgaggccctcctctccaacaagtgggtca

SEQ ID NO: 84125 - DNA, 2270 bp, Oryza sativa
tgacaacaaaacaggcaccgctactttgcactacgccaacacagtctcgtcaagcatggcatccctcactctcgtcaagccaccaccacaaaatgccacccatatcgtatcaaaatttactgattcactccatagtctcaattccaaggagtacccagccaatgtgccacagacagtagaccactcccttctccttaccgttggcgtaggtgtcaatccatgtccaagctgcatcaatgggacaagggtggtgggcacaatcaacaacgtgacgttcatcatgccatcaaccccaattcttcaagcccactattacaacattccaggagtgttcacagaagacttcccagcaaccccactgcacaagttcaactatacaggaagtggtcccaaaaaccttcaaaccatgaatggaaccagggtttacaggctgccatacaatgcttcagtgcaggttgtactccaggatacgggaatcatatcaccagaaagccacccaatccatttacatggctttaatttttttgtggttgggaaaggggtcgggaactacaaccccaggacctccccttctacattcaacctcatcgaccccatcgagaggaacaccattggagttcctactggtggttggacggcaatcagatttaggtcagacaacccaggtattgattttaaaacctatgtttttttaagataaataaccccttctgtttccagacacattgattgagctgttatattgcaggtgtttggtttatgcattgtcatttcgaggtgcacacatcatggggactcaagatggcctttgtggtggataatggaaagagacctagtgagactctgattccaccacccaaagatcttccgcagtgttaacaacatgggattcaaaactgcccccacggagaggagcctattacaagaagggtaattggctttggtccgatgtacggaaagaatcaacggtgatttctaccatgtgctactacttgactcttgccacacatttttttctcctttttgatttttttgggcttgtttaccaaagatagtgcatacagggcattcaggttgtaattagctcttgccatgaccaacttgttccccctttttcaattaatgaaaatgtatatgttggcatgcctcatgaattgaatgtttgttgagaattagagaaagatgaatccgccttaaagtatctcagtcaccaaattttagaaatatgtcgccgctatctcctcctttctaacacctatccagtactccctatcttctctggctggacccacccctgtatagtctatttagtactagatccagcttagtactttaagttactgtaaacctgttcaccgacagctcaatccaaaaaataccaggccagcctcgccatgcctctcgggccaggcttgacccagcttgagcctccacacgacccctatattaagcagccctagtttctagattttcttagaaaaaccttccaagaaacaagtgatggatatctattatcttctaacttgtagtattatgtccaacacaaatagtaatcacgtactagccataataccaaagtagtcactaatgaattggtaaatgttaggaacaggcattgaatataccttacaatgtgccaacacggcatctgatgcatgtggtactccccagcaactgaattattgagatatgctgtcagtatccaagaaataattgtttagcatttgacaagaaaaatcacgctgaaacaagctggtacatgaacacttgcaacagaaaaatactgtaatatgatgtcataccaaaatatgttcaaattttctccttttctttttgaggaaaactgttcagattttcatactgcacaaagcaggaaaagaacatttaacctgggaagaagagcacagaggagagaccatccatttgcgcccctgcgtcgctctaggattgggcgacatgggcgatgtctccctcccctgctgccacccaccacctcctcccttctccacctcaccgccgcctgagcaagccgccggaaaaccatgtaactgcaaggacagcggcagcggggccttccctctccccccggaggtctgaggcctgatcccatggcctcggggacagccgccgcagcaccgggaggcaaagagggagagccggtggcactttgggagtgggctctagcgaccggtggcgcgtggccggatctggtgtctcctgccagatctggtcagagccggcgacaacaacggctcgtcggcaggtgttgg

SEQ ID NO: 84126 - DNA, 632 bp, Oryza sativa
atgcaagctgtgcaagggaagaagaggctgcacatagtggattacggcccgcgctgtgggctgcactggccagacctgctccgccggctgggaagcagggaagacgggccgccggaggtgaggatcaccatcgttgacatcctccagccggcgtttcgtccatttcagcgtattgaggaggctgggcattgcctgagcagctgtgccaatgagtttcgtgtgccattcagattccaagctgttgcagcagcaaagtgggagacagttggtgccgaggacctgcacatcgagcctgatgaggtgcttgtggtgaatgacctctggagtttcagtgctctgatggacgagagcgtcttctgcgacgggccaaaccccagggatgttgccctccgtaacatcagcaagatgcagccagacgtgttcatccaaggcatcaccaatgatagctatggagcctccttcctgtcacgcttccgtgcagtgctcttgtattactcggctctgtttgacatactggacgcgaccaccccaagggatagtgggctgcggctggcgctggaacacaacgttctggggccttacgccctcaacgccatcgcctgtgaaggtgcagacctggtggagcgccctga

SEQ ID NO: 84127 - DNA, 2059 bp, Oryza sativa
ctagagaataacaaaaggcacggtaaatcacttccttgaattcaaaaccttgttgaaccagtagctgaattgcactttcaagtgcaaactaaaagaaatacatagcttacataagggcctgttgctgttgatgacttggcacaaccaccagagataggtggtcgcacaaaacagttttgagcgcatcctgattcacgacttcttccatcatgtagaagcgaattgacagaaagagacgcctgatcccttgtgttgtggtgaaaacaaggatgtgcacagatgaggcttggacagactagcctgtcggttattgcatcagtgaaggaaagctggttctagttgagcaggctcacggatttgtttggttctcaccctggacaagcaagagctgcacagcttcagcaacatgaagcgccattgcatcaagatcccccttaaccttgtcagaaacatgcaacatggatgcatccaaatcgcaaggggttctgtctcgcagatgctcacccagatcacgcatcgcttgatttagcttcgagttcatgtcatccagggaccttgtttgatgctgcaaggactcctcacatgccctgatcttctcctccttcaagttgactttaaaaacgcactcttggtaatcaaccagcaggcaatccatgtctttctgctcttccttccaaatctctgtcaaggtattatcacgtacaaacttctcgacgtcagcttccagcagggtcaggcagcaattttctacttctgattcaagagatgcaatcttacaatcgatatcatcgtgtctgttcatgcttttaatttctttctgcaccatgataagctgttcacgggacttcttaagttcagataaaagctttgttcgctcctcctcagatctcagcagctcagatgccttaccaaaattcacaggcttcgacaatgtaggagtggaagtgtcgatattatcaatagcaaaaaggaccctttctgcctcctttctctgagcttcgaaagagcggagttttactttaagaccgtcgattttgcttctcaacgcggtttcagattcacgtgcttttgtagatgcaacagaaaattcttttttgagagtttggaggtgactcagttgttccttcttttgattcaataattccaagctgacatcaaacttggacccaacaagggctttggttttcaagtccaagttccagcatgatgccacaggcgagaaatacttgctttccaaagcttctttactctcctgtgattgtgacagttcagccttaagggcattcatgtcttcctggtcgtgcttcagttctaggcaatggtgctgaatgcttgctgaaagttcttctgccttagtactagccatttcaagaagtttaaaatactctactgcatcctgggtagttacaagcttgtcgtggacattcttcagtttgacacgaacaagccgcaggatttctttaaacgttgatattgcagagtcatgtacatgttttacttctagatcttcatcatctgttgcatcacgcatttcaacatcttcatattgagtatctactgtagttaaagaattgctaccctcaaaaaatttccttttgaattcatctctttcctgcatagctttctcatacagacccataagtttatcattttcttcatgcatctcgtccagttgaagttgcaaatctgtcaattcacttcttgaaaaattatccttgtgattgcactgtccatccattatcttggagtccgatacctcactggatgagttgtctgctggcaaaattgttgcactctctggcttgtcatctggcagcaccccattcgcagcagcccctccataagaatggctgctttgctgctcattcacaccttcaatttgaggaatggcaggatggcccccatcttgattcacctcaccattggcgatagcatgttcatagagctcaactaatctcttattatcctcaatcaaaactgtaagccttgttcttagttcctcattcgctttggccaacccaatagcagtttcatgagcttctgcttctctttgacttgc

SEQ ID NO: 84128 - DNA, 1313 bp, Oryza sativa
ccagtttaattaaagtggatcatcactgtagacccgtggctgtctagggctctgggcatagcgaggtgtgcagcttcggcttcagtaatcagtgacccacgacggaaatctatccgtaaatcatgcctgacgagccaagttcaacgggccaataatcgagtagctcccccaattttgttcaccaataaccctgcagaactgtacgtttgtgatcgattttgtttggttcagtggagcattcttgtggagaaaccctatgtagtcccggttcgtaaccccttgtagtcccggtttctaaaccgggactatcaattcgggactaaagatcattatctttagtcccggttggtaacactaaagatcgagctgacctttttttttcatggccctgttgctgcatggtttatatatatatatatatatatatatatatatgtcatgcaaatgcatatgtgtgtgtatatgaccaaattaaaatatatttacattatagaaaatgtgtacacatgcatatagaaacatatgtagtcatgtattaattacaatccattatatgtcctagctagctacgattttgacgtagtagtagtcgctagcttagaagctaaggacttatgaattgtgtttccgtcgtagtagaattcacccttgggatcaaggatttgttcgttgatgaatcccatgagttgttcttgaaccgccgcgataaatttcttgtgtgtggtcaggttatccctcatgcgaataaactatatgaatgtatgaaattgattagtaattaaacaagaaatcgatacgtaatgaaaatttgaatttatttgtacgtacatcgagctctcttgtggtgatgatttggtctgcaaggcagtggcaatactcgcacacgtagtagccgcacaagttagttccctacttttgctttgtgcactacaaataaatgacaaacgacgagagatctaattaatatacacttgtatgtatttgaatcggagaaatataaatgtatagcatgtgtactcacaggaaatttgaacttccgcctaagtctttctctccagttgccgcggaccaaatgacggaaccaataccaagccctatatggagtttaaaactatgattcgtagtagcaattaacataacaagattttcttaattaacagaggaacttatgacagtacctgtctatagacacaaagaccttgtggaacgtgaactctatggtattcattgagtcatatacgttggcagatgcaggccgacaggtttgtacagtatgagcacacaccggaatctacaatgtgcgtgggatgcat

SEQ ID NO: 84129 - DNA, 627 bp, Oryza sativa
ttctcccttcattgatctggttgcattatgttctgatgcacaagaggttgttttgcttctatgatgtccaggaatgtcgttctgctggatgccgtacattggctgaagcaaagattcacatagagcaaaagaggaaaaaggaacatgaggtgaatgcccaaaaagctaaggaaagtggtcagctcttatccaacactaaagtggtgcataagacgaatcgacctatgaaaatcgagtcagatggtaatttggatcagaagaaaggtggtgccagcttggattctactggcagggattctccaaaaaccacagggcatgcaggcactaaacattgggatgactgggatattgttggttttcctggggcagagctattaagcaccagtgtaagtatatttcaaatttcaatgttctaacattttacatttatttgtgcatattttatcttgtcattgccttgttcatactccctacagtaaataaatgatccatttttcaatttcaggaaaaaaatctatgctgtcagaacagattgctacccaaccattacctgaaaatgcaggaggttttgatgcaggaaatattcaagggtagtgtcgccaagaaggaagatgcccatgtattatt

SEQ ID NO: 84130 - DNA, 1411 bp, Oryza sativa
ttacttgagtccagccagctacactcttagcaaggcagagaaggaaagtatgtttgaatgcttggagagcagaaaggtaccgtctggatactccacgaatatcaagcgaataataagcacgaaggagaagaagttcacaaacctaaactctcatgactgtcacgtgttgatgacacaactgctaccagttgtaataaggggtatccttccagacaatgtctgggcaacaataacaaagctatgtgcattcatgaacgcaatttcgcagaaggtcatcgatccggatagattagaagcccttcagaatgatgtggtgcaatgtctcgtcagttttgagttgatatttccacctttatttttcaatataatgacgcatctgctttgtcaccttgtgaaagagatcagtattctcgggcctgtgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagatcttcacccaatcggggtacctgaatcacgccatgaagggagactacggggaaagggaactctcggaaggaaagcaataatgacagtagacaacaatttattccgtaaagcccatttcacggttctgcaaaaatcttcattcgtagctccttacatcgaggagcacttggctctagttcgcgccaggaacatcggtaagtccgatgcatggattacatggcatgacattgatactttccccgcgtggctacgacaacatctcatgggtaacgagtcaatcaaccaacaacttgccttcctggcgaggggaccgtctgggtcgatcgcgacattccagggatatgagatcaatgggtacacattctacacgagagcccaagacatgaagagcatgaaccaaaacagcgttgttcgtgtcgatgccatgggacacgatggaacaactggcacgtattacggtaccatcgaggacatatgggaacttgactatggtcctctcaaggtccctctgttccggtgccaatgggttaggttgactggtggaggcgtaatgattgatgacagtgggatgacaacggttgaccttaacaaggttggatactcggacgaaccttttgtccttgccaatgatgtaacgcaagtctttttcgtgaaggacatgtctagcaaaggaaagaagggcagagggcctgacgagcctaagcgtcacgtggttctcccaggcaaaagaaaaatcgtcggagttgaggacaagactgatgaggattacgatcagttggatgggcaaccccctttcacggtgacgattgaccctagcattctcctatcaaatgaagacaccccttac

SEQ ID NO: 84131 - DNA, 723 bp, Oryza sativa
cgctgccgtagaagacaggcacgatagtctagtaggctatatataccaaatatggaatggactgtaactactacgtggaaggaaatgtgtacgtggaggcgtggagctaccaatgttttctctgcatcatgcgctaccgtgtctgtgctagtctgtggcccatcatgcatgtagtggggcgtcgtgacggcatcgattgcacattgtatagcaccaatgcgtcaacgcgtgacggatctcatacataatctttgaccctttttagatcctactctaaaatttttcaccctgtcatatcgaacgtttggacagatatataaagtgttaaatatagacttaaaaaaaaactaattgcacagattgcgactaatttgtgagacaaatcttttaaacctaattgctccatgatttgataatgtggtgctacagtaaacatttgctaatgacggattaattaggtttaataaatttgtctcacggtttactagtggattctgtaattagtttttttaattagtgtctgaaccccatacgacagcctatataataccccatgcgacacgctaaaactttgcaccctggatttaaacacccccttttattgagatcaggtacagctatacttgcaactgcacaaaatttttaccatccgtttagatgatcaacggttcagatcaaatactacagtaataacatgaacagtatcttgatgctttgggaaag

SEQ ID NO: 84132 - DNA, 671 bp, Oryza sativa
ttagtggagaccaaatgatggggctggctatatcgaactatggtctcatggagttaaatcgccgcatgctaaccatccgcatgcaaaatatggccctcatctgcaagtaatatgttagactgataagctatcctccggtatagttaagatggttattacattaatacatcatgtgtgacgatagaaattgcaccttagtcaaagtcatcatagagcacagaggacattatagatttaggacggagatagctaaacaggcgagtctcgatacactagggcacaaaaaaagctgacacacacgactatgagatctgcttagcttctgagcaggaccgaagcttgatgagatgccaccggaccaggcagtttaattcgcatactgacaatgtatgcaaatagtatatcaaaacagccgatcggctgataagccgatggagtactagcagccgatagctcgatgccgatagctatagggtttaagtaatcggctatatgtacaatgtacatgatgatataaatgctatcgactgtgggtgataaagtataacaataatatagtccagtacaaaccaatcggctataaacaatatataataagcattgatccgaagattaaagcacacatctgctggaggttcgatatcatgaaatccaccagattagattaaaca

SEQ ID NO: 84133 - DNA, 628 bp, Oryza sativa
cgatgtttaggctttgtacggtggtcagccttatgttcgaagtgcttgcctttcttccgtaccgggtggtttgctgcaaggaatcgacgatgacccatgtatacaaccttcctacagtgcttaagatacgtactttctgttttatccatacagtgagagcaagccttgtaccctttgttggactgtccggataggttgctaagtgcaggccaatcgttgatggttacgaacagcagcgctcgtaggttaaactcctcctgtttgtcctcgtcccacacggggacaccttccttcttccacaacagtttaagatcttcgaccagtggtcttaggtacacatcgatgtcgttaccaggttgcttgggtccttgaataataatcggcatcattatgtacttcctcttcatgcatagccaaggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcataccgtcctgttgacgctcttcagcgtgcc

SEQ ID NO: 84134 - DNA, 620 bp, Oryza sativa
atgtagaggccacatacaatactttcattatgtaaaaaaaaggtggagttttacagtggtctctattggtagtagaatcaatctagacagttcatgcaatactgcaaaacttgcagatttggtcgttgctgcggacaacgactctctcagagggccatcttggttctttcaactggaggtgggagagttcggggtcgtactccacccgatcagcttaccttgccctcttctcgggcaggatctcgtttcagcacctaccaatctggcgctcttttgccccacctcagtgtcacgtcgctactttctgtggctggtcgctcactggcgctactggacgactgaccgattggagaagcgtggcctgccgcacccaacctattgtgtcttttgtgaccaactggaagaaacagttgatcacattctgattgggtgccttgagtccctatagctgtggtggactgtcctttcaagccccggcctccctcagtgctttccctctgacgctgattccttctttgagtggcactgctcctgtcggctcaaagttccgagggagcatcgtcgtgggttcaacacgattgtgactcttggcggttggtctatttggaatgaaaagggac

SEQ ID NO: 84135 - DNA, 548 bp, Oryza sativa
cttcctatacacgctcggtgttttttatcctccctctccatttcatccacaatggcaccgacagtctccccctcgtcggccactccacctggttgaatgcccactggagctactacgcccccgtcctctcgtgcgttgacctcctccacagaagtctcgtttacttcagcacttggtccctcaccatcatccatgttcgtctgcacacctggatccttcgggtgaacaaacggaaccaaagctagaggccacccacattgcaatgcattttccaaataccatctccacactcgagagttttgaactggcattagttcccaataaaaaccctcagttgcccgacttactataacattgattgttatgtcacttgtttgtggatcaactctcaagcccctcattaaccatccttttatagaaggtacactcctctcagccggtctatcaattcccctttctgatacaataaaatctgacagatctaccccagttggcccgtaacgaacgttttctggtccatgggggtaccgagctcgaattcgccctat

SEQ ID NO: 84136 - DNA, 603 bp, Oryza sativa
caaaagatagcgacagatatcaagaagaccaaagagatgctggatgagaataacccggatgagcgtaagcagatattatctaatatccagaaggagataactgcaattgagaaggcaatttcccatgtcaaggatgataataagattcagctcggcactgcagataatagtgagtgtgagatctcttatgctaaaaaggctgcagagtgtgctgttacaaagccaagtgacccgaagcatgctgcaaaaggtatgaatactgatgaattagaggcgaggttctttccacatcataaattgttgagagactgcaaatcgtctagcgctactcaacaggaatcgtccatggctgtcaaaaaggattgtaacacagatatggaactttcttcccttgagcctcaagaagatgagaatagtatagccatggagtttctggcttccttagatggtgaagaaagcggcttcttcaagaaccgcagagcgaagaacttggaaaaaaccatcatctgtgaagcagcagatgttagcagcaagacatcgggccaaggttcctcaaataatccggtaggcccaaaccatgacaaagaaattgaattgcttgct

SEQ ID NO: 84137 - DNA, 971 bp, Oryza sativa
tgcatgaaatgcactaggccaatggccatcgatttatacatgtgttcccaatttccggtgacttaggtatctctggtcttaatgcccggtgcaaattacaaatgggcacaattgatctttctttttccttgtcaaaagttaaatggccggtgaggctagctatgagaggaaaggaatctttgccttaagaagagtcattatatttcaagctatggatgtctatgactcaagaatttactattctttcttctcatagtgagagaggagtacggtttttatgatcacatctcatgagtacttttaaaagttaaatttcatgagaaaacagttttctagtgtaaagattgcctctcataaatcaatctctagtagattataacacaaataaaaatactggaagcaattacctgatggttaattttctaggggacattatgcaaaaatgattatgtcaataaaaacatcaacaaataatgtgccataaactgaataaaattatcaaacctgcatctcatcgctagttggtgcggcagcatcttgcgaagcataaatgtacctctggtatctctcaagcgtcttaagcatgctgaaatatgaattagagatagatggttaactagcacactatacagaaaatatgtttcccctaaaagaaatagtatattaataaagctgttaattatgtcttccgatcaatttgtgaatgtttcgttgtcattttcttcctcaggaaaaaaaaaatcaagcctcctttagggtacattcattggagagggttgggaactgttccctctcgcacacaaaacaaagtaacgcacgattaattaagtattagcttaaaaaaacttaaaaatagattaatatggttttttataagcaactttcttatagatttttataaaaaacgtattgtttagcaatttgggaaacgtacaaagtaaacgagataatagaagttgagaaagtgtcta

SEQ ID NO: 84138 - DNA, 745 bp, Oryza sativa
gggcgaattcgagctcggtacccacaaatgtgacgcgccaagatgtcaatgtgagcatggcaatgtatgaggccagcctgggccgtttgaccagcacaaactatccccttgtcaatttcatcatggccactgaagcagatttcttcattggagccctgggatcaacctggtgctacctcatcgacggcatgcggaacaccgcaggaaaggtgatgtctggctatctgtcggtgaacaaggaccggttctggtaagcaattcagaagctgctaaaccttgttcattgtattttagctcctctgaatagatatgtttggcctaagtttgcttctgtacggcaatagggcatgtatatatgcaccatcctagcagataactttagcgtgtgaaacttctgagctaataggaaaacagtatcgttatatcaaatcaggtccatatattttgatctggtatccacttaatcctagatatatattatcctgaggtccagtgtacccaagaaaaaagaggatgcacttaccaaattttcagtggtactcataatgctgataagtggtacacgagagatccaattgcagaattttatagtagtatgacagtaacagctatgccatgtaaaagaaattgacacacatgttttctgtagaacatcggtttcaaaaaaaaaaagtttcctgtagaacaaccagggcattctcctctttgtcaaccatttgatttgttgaagacatgacccaaaaaa

SEQ ID NO: 84139 - DNA, 718 bp, Oryza sativa
ccaaggacggcagcggcaaagggcggggcggcggcggcggcggaggcggaggcgtgctgcatctgccagcgacggtgaggatcgacatcccggcgacgagccccgggcgggcggcgctcaaggtgtgggaggagctcgtgaacgtgctccgcaaggacggcgccgaccccgccgcggcgttcgtccaccggaagaagatccagcacgccgagaagaacatccgcgacgccttcatggcgctctaccgcggcctcgagctgctcaagaaattcaggcacatcttccctcttcatctttcctttttgccatatctgacaagctaaaaccacgaagtcacggtattttagaacaagacttgccttttgcgtctatgtatattgtcttctatgccatgcatgatgcatatatatacgcatttgtaagctatttagaattctgatggccaaacctcacactaatagcatgcaactgatcgatcacactaattgcatgcacacacatgatatagatagtttggttaactgaccaactaggaaaaaaaaattaagagtgttcttcatagatgcatatctaacttattactactatgaatattagttgcagcatgagtcatggagcactgtgtgagcagcacacaactacacctgcactgaacccaagcatgcagtacagtagtagtttagtcaaatttcaacctcgttttgcatgcaagcatccg

SEQ ID NO: 84140 - DNA, 606 bp, Oryza sativa
tagaggatccccgtacgtgtaggatgtgtagtatatatgtgcgtgtctgtacggtgcgtgcttaattatacaggaggagagatcggagaaggtaattaaggagaagataacgatgatcattaggtcacatgatggcgcaggcgtaggaggggtcctcctcgcagacgatcctgctcagcctttttttgtgacgtcgacccggggacaaaaaatgggtcaagtagggagaatgacagtaaacacctggcagtaattaatgaggtgattataatgtcaaacctaatctgctaatcatagttcagagatttcggagcagcctttcaaagttggggggtcgttgcacggatgggcgaagcaggcaggctgcggttggaaacctggaccatgcatgccgtgcgcccacaagccgcaagtctcgtgcaccagcacgttctctcgtgcagtacgtatatatcctagttataggttgtgtttcagcgtaaagttttaattttgattgaaattagagatgatatgactgaaaagttatatgtgtatgacaggttgatgtgatggaaaaggactgaagtttggatccaaactaggaatctaaacacaaccagggta

SEQ ID NO: 84141 - DNA, 720 bp, Oryza sativa
gatattacgttatagatgtttattgcatgaaagagtaatatgatctagttaattcgttgacagatatgtcgaacaaaccaatattccaagtttaccatggaccaggaaacgtccgttacgggccaactggggtagatctgtcagattttattgtatcagaaaggggaattgagagaccggctgagaggagtgtaccttctgtaaaaggatggttaatgaggggcttgaaagttgatccacagacaagtgacataacaatcaatgttatagtaagtcgggcaactgagggtttttattgggaactaatgccagttcaaaactctcaagtgtggagatggtatgtggaaaatgcaatgcaacgtgggtggcctctagctttggtttcgtttgtgcacccgaaggatccaggtgtgcagatgaacatggatgatggcgaggaaccaagcgctgaagtaaatgagacttctgtggaggaggtcaacacaggagtggacgggggcgtagtagctccagtgggcattcaaccaggtggagtggccgacgagggggagactgtcgcagccattgtggatgaaatggagagggaggattttgacaacgagcgtgtagaggaaggtgattcgtcagatgaggagacggatattaatccagcagaatgggctagtcaggatttttctgggctgatcgtctctgaagaggatagtgtgagatgggagtaca

SEQ ID NO: 84142 - DNA, 547 bp, Oryza sativa
gttcatttggacttgaaacctgctaatatattactggatgagaacaaaatgccaaaaattgctgatttcggtttgtcaagactctttggttcaacacaaacttttacgacaagaacttttattggaacagtgtaagttatgcaagttgattcattgtgaaagttccattgatttctatacccttttctaatcattaacaacatgcagtgggtacatgccgccagaatacattgagagacgccatatctcaatgaagtttgatgtattcagtttgggtgttataatcatagagataatggcaggacaatcgggccgttctacaagtgctgaaatgtctccccaacaatttattgatactgtaagaattgttttttttttctcaaactttttatcattcactttctactttctgctttattattcactttggatttgcaaggtacaagagaaatggaaaaagaggatgcaggaaatttcgagtcatacatcatcacatgaggcagatagcctagaagtcaagacatgcatcgaaatagctgtaaggtgt

SEQ ID NO: 84143 - DNA, 605 bp, Oryza sativa
acttattaaattttaatcaaataaaagtatttcttcatataccttttatatcaaccaataacaaacatccccaatttaatttcatcatctactttattttcttagccaattacaactttctcccaatcatctttaataacttttttattacccatgcttaacttacaaaatgtgtacattttactgctagccttctccgacattgcacatacaacatcacccactagattggacaggaagactcttcagatgcttttaatggtcaatttgcacattgaaacaacatgttagttcttttttttttttgcacattagcacttgtttaagcttcttccaatgtactactccctccattttctaatagataacgccgttgactttttctcacatgtttgaccattcgtcttatttaaaaaaattatgtaattataatttattttgttatgagttgttttatcactaatagtactttaagtgtgatttatactttatacatttgcataaaatttttgaataagacgaatggtcaaatatgtgagaaaaagtcaacagcgtcatctattaaaaaacggaggtagtagtattttaagcttcttccaatgttt

SEQ ID NO: 84144 - DNA, 941 bp, Oryza sativa
atccgcgacttggacatccacaggaggtgtagaagggcggcgagatggggagcgtcgcatcctcgtctacggcgacggcagcacgccccagggcgcgctccaagctgcgggcgcgctcatacgtcacccgcccgtcgcccatgacccggagtctccagcccaacgttggctggacgatgtggccaaattggtcatgactgcacggcagcgcctagatgctggtgggcggtcctccgccaccaaggcctctggtgctgctaccaccggctccgcgtcgtcaagacggagggcgcggcgagcggcagccgctgttcgccattcggccgccactccttcgtcaacgcctccgacccgggaagatctgcgtggggaaccggatgctcgcatcagtatcgagcgccggcgtaatggccgacgtgctccccacgcaacggagggcgcctcctcgtccggagtgtcgcatcaccacggacgcggggatcagccctccgtgcccccggttggtggtgtcggctgtagagcctttgtggcgagccttcggaatgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaaaggacaggcgcggggttggctaatgaacttgccacccgcgtctgtccactcttgggaggatttgtgccaacagttcaccatgaacttctaaggcacatatccgcgcccaggtgaggaagcggacttgcacgcagtacagcgaagggatgatgagtcacttcgctcgtacattcagcggttctgtcaagtccgcaacaccataccatgcatccctgcacacgcggtgatttacgcgctcagggggg

SEQ ID NO: 84145 - DNA, 629 bp, Oryza sativa
tattaaaggtttaccaaagtcagagagattcaattgcattcttgtggtggttgacaaattttctaagtttgctcatttcattcctttagcacaccctttcactacggcaacagtagcataagctttcatgagaaatgtatatcgtttacatggcatgccaaaggtaatcatctctgatcgtgacagaattttcactagtcagttctgggagtgtttattcactatggcgggtatcaagttacatatgagttcttcatatcacccgcaatctgatggacaaaccgaaagggttaatcaatgcttggaaattttcttacgttgttttattcatgccactcctcgcaaatgggctgcatggctgtacttggcagagttttggtactattcgtcttatcagtcgactgtgcacaaaacaccctttgaagtggtctatggttatcaacctagtcattttggtataagtatggaagattgtgtagttccggatctagctgaatggctctctgacagaaaattcatgcaccatttgattcaacaacatctgcatcgtgctcagcaacagatgaaattctatgctgacaaaaaccgcagttttagggagtttcagttacaagactgggtttatctca

SEQ ID NO: 84146 - DNA, 592 bp, Oryza sativa
atcacaagccacggcgtcacgttgggttgggatatgcccgtatttttttttcattccgtctacccaagggtgatgccgccttcagtttgaactttgaaccgtatcgaagcactatcgaacaaaacagtcaacttctttgcgctcacatcacaaagccaaatcaaccaaaagaattttaaaaatggcagccttttcattcgctatccatgttcgacgcttctagggatcacgtattttattttatttagataatgatcacatattccatattttaattaatagcggaatcaaacaatttaagcgcatgtgattaatcaattaacagtaaatcaaagcgtggtttgcatctgctaagctcgtacgtaccttggcgaggccgagggcgtcgaggagcgcgacgaggtcgccgacgacgtggaaggcggagtaggactcgatctccggcggcgcgtcggtgtcgccgtacccgcggaggtcgggggcgaggcaacggaatccccggccggggaggtgctccatctggtgccgccacaagtaccagaactccgggaatccgtgcaggaacagcaccggcgcgccatcgccgccctcg

SEQ ID NO: 84147 - DNA, 687 bp, Oryza sativa
ggcaactccagctggtaagcaacttctccgcgtcgagcagtgatacggaagggacccacataccgaggtgcgagcttcccttttgtctgaaacctgtgcacacctcgcaatggcgtgacccgaagatacacaaaatcatccactgcgaattccagatcacggcgacggttatctgcataacttttctgccgggactgtgccacctttagattttcccgaatgattctgactttagcttcggcttctcttaggatgtcagtcccgaacacttggctttccccaacttggtcccacaatagcggtgtccggcatttgcgcccgtacaacgcttcataaggtgccatttgtatgctggcttgatagctgttattgtaggagaactcggcataggggagactcttatcccaagtcttcccgaaatctaggacacatgcgcggagcatatcttctagaatctgattcagacgctcggtctgtccatctgtctgcgggtgatatgcggtgctgaaattcaaccgagtacccagctcttcttggagcttcttccaaaagtgagaggtgaattggcttcccctatcagacacgattttcttgggaacaccgtggagactcacgatcctagcgaagtagagctccgctagtttattccctccataggtggtcttcacaggaatgaatcgagccacc

SEQ ID NO: 84148 - DNA, 713 bp, Oryza sativa
aaaaccacaacaaacttatccaagtattccatgaacactttattcattaagttcatgaagaaggcaggagcattggtcaagccgaacgacatcaccgtgaattcatatagtccatatcgcgtagtgaatgcggtcttcggaatatcttcttcacgaatacgtaattggtgatatccggaacgaagatcaatcttggagaatacagtggcacctttaagctgatcgaacaaatcatctatccggggaagagggtacttgtttttgatggtgacttcattgagagctctgtagtcaacgcacatccttttcgttttgtctttcttctctacaaaaatcacaggagcaccccatggggaagtactcggacgtatataccccttttctttcaattcttccaactgtttcttaacttcggctagctcatttgctgccatacggtagggtcgcttgtgcagaggagtggttcctggagcaagatctatccggaactcaatctctcgcttgggcggcataccaggtagttcttccggaaacacgtctccgaactctctgactatggggatttctgacagacctacctgatgcagttctgaacttctgacagaggttggaggtgcaaagaaaacaaccggttgttttggtcctcggtacagggtgacagtgcgtctcgcgcaatccacgactccttggaattgtgccagccaattcatccc

SEQ ID NO: 84149 - DNA, 536 bp, Oryza sativa
atggccagagtggtttgtttgcatggtgttcctaagaagatagggcagatagaggtagccagtttacttcaaagttttggcagaaattacaatcagaattggatacccgtttgaatttcagtactgcttatcaccctcaaacagatggtcagacggaaagagtaaaccaaattttagaagatatgttgagagcctgagttttagattttggtggaagttgggataagaatttgccgtacgcggaattctcatataacaatagttatcaagctagtttgcaaatgtcttcgaatgaagcattatatggtcggaagtgccgtacgccgcttctttgggatcaaaccggtgaacgtcaagtttttgggacagacatattgcgagaggcggaagaaaaagtgaagattatccaagaaaggttgcgcgttgctcagtcgcgtcagaagagctatgccgacaatcgtcgcagagatttggcttttaaagaaggagattatgtataccttcgggttacgccgttaagaggagttcatcgtttc

SEQ ID NO: 84150 - DNA, 2774 bp, Oryza sativa
aatagattaaaacttcggaaaatcataactaaataaccgtagatccgttttaggtggttcaagtttctaaatttttctaaaatcaagatctacatgttaaaaatatccacatgtactgtttatgcttgtttttgtactgttttgttgatttttgtttatttgcttagtttccgacgttccggaggagagcgtttccgttgaggaaggttccgaagcgtttgcggaagcccaaggcaagtcacacagatcccaaacaaccctttgagcatgttgaacccatttaaagctattattttatttcaactatgcattattttcgaatgtcatcgggtggtgaacctttcccagttaattaatggccggagatgactttattttcctatgggttataatttgattagcatgaaccttatatattggattggttcagctaaatgccttatgtaagtttgcttatccatgcctagaaacatagctaactaaaggggttaattataaactatattatgtaattattaattagggttatattcaatggtagctcacgatggtaaatcgtgtgatgataattaattgataattaaaacctgattaaggtgggttgtgagcatatggttttgatggttgtgctcatgacaattaaggaccggttcgcgagctactgttgtgaaacatttatcgtgccaaccacaagccagcgtgggcaacggctttatcttttgtatagcgtgattcattatggtgcgccagactgagaagtggcgagaagtccatgggggtcgctggggagtccatgccttgtttataagggggtgattatgatccaggtacggtgcactgtggtgaattgtgttatgcgaggggtattgtcacgactcctttccgaggtaccgtggtggtactgaggcacatggtgacatgatgtggggttgtgtcttgtgggtacggtggtacacctctgatcagagtttaaactattcgaatagccgtacccgcggttatgggtgagttgagcaatgtttttcgtgattagtctcacactactcttcaatggtaataatgtggtaattaatttaattcctggtttggaatggctaattcctggtttggaggtttaatttgttcaactggggttggttgtacaaatgtggttgggcctatgcaacacgggtgtgttgtatggtgtttatttaatattgattaattatacaactgttttactattctcttaaatatttattaaatgctgtttgctgcaaatgaactgtattatgccatcctttgttatcctgtgcacttgcatatttgctgtgtggcttgttgagtatgttatatgctcattcttgcaatattcattcatcagaagaggagtacctcagtgaaggtgatgatctggaggattaggcttgttcttggttaagttgcctgtggagtggagtcgccatagctgttccgtagtttgttttagttttgttttccgctgcgtagaatgttatttgttttgagaggaactatctacctctgtaataattttaatttgcgaatatttgatagttaattatttgtactctattatcaaattgtcattgtgtgcctcggttgattcctggacgagggttaacacacatgtaagcgtttggaattttggatagaaattccgggcgtgacaccgtcaacttctcctggatcgtcccgtctaatcttgtatcgtagtgctttgcaaacagggcatgcttctaggttctcatactcctcaccgtgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcctccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaacgccggtcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaatattaactttcactagagttttccttctcaactattttataaaaccatgtttagcaaatgaactaaatttctatatattctttcttccccacacacattttctctctcatcaacttaca

SEQ ID NO: 84151 - DNA, 758 bp, Oryza sativa
cggttatggtacgattctagattggtttctgcttggcggacgaatttaaattcgatagtagatgaataagcattgatctcggcaccaaagtcgatagtgcaacatcctgtgccgttgcaatgctgcataggagacaccatacccgtgctctctcctttaggacaggttgctgtgcagttgggagttgctttgttgattgatggacgatttaaccaataaacatcaaagtcacagccggagaaacgtagtccccacagcgtcaggtaaaaagcatcaagagaatgttcaagcaattttggagataacgaccagctcacaacggatgcatttctcatggagatggtatgagaaaagcgggtgctaacactgttatctgtgtccataaactctgtagaaacgatgttaatactaccagcaatttgggtgataccatcgtggaagaggagtctcggagggcttgtggtggagtcgcaggtgagctcgaagtcgggacttcggaagcagccggagccgatgccgaaggggtacacgaaggtcagatcgccgcatgagctctggcaaccggcgagggtggccgttgatggaaccacccggccatgcccttcttgccttcttggcgcagccaaatccttcgccgatgtcagtagcgtcgtcgtcgccagcaggaagacaagcaaaagttgcagggaattcgcggcgtgtggtgagcggatcatctcgctcttgcctcatgcctcttggggtgtttggagtagaat

SEQ ID NO: 84152 - DNA, 607 bp, Oryza sativa
aaacctacccccttaaacagaatctcgtcctcgagattcggaagaactggcgaacagatgcggatgagctgacttcaattcatcttctcgttcccaagttgattcttcttccgagtgattactccattgaactttgcaaaaacggataactcgattcctggttcttctctcatttgtttccaagatacggattggtttctcaacataggtcaaatcctcttggacttctatctgttcaagattagcttcttcggtaggtacccttaaacacttcttcaactgcgacacatggaacacattatggactcctgccaaagattgaggtaactccaactgataagcaacctctcctcttctactgacaatcttataaggtcccacaaaacgcggtgccaattttcctttggtgtggaaacgatgaacccctcgaagaggcgtgacacgaagatacacataatcttcttcttcaaaactcaaatctctacggcgattgtcggcataactcttatgtcgagactgagccacacgtaatctttcttggatgatctttaccttttcttctgcttcccttaggatatccgtcccgaaaacctgacgttctcccgtt

SEQ ID NO: 84153 - DNA, 705 bp, Oryza sativa
ttaaataatgctgatgtatattatttttagagaaattatggtaccgtagtacggataatccagactaaaatgaacacgctcttacacccatataagcaagcaagcaagcaagcagagagcaaaacagagcagagcaggttgtgagccagcactgcatcagcatgatgagcagtcgtcttctcaaacgcgcctgcctcctcctcctcgtctcgtcatggctatgctccctctccgacgccaagaggaagacgccaccctggccgccgccgccgccctcctcctttggcctccccgtccgggcggtgtgcctcggtggctggctcgtcacggagggctggatcctcccctccctcttggacgccatccctaacaaggacctcctggtatggccgtctcgccgccgccgccgccgccatgtccacgaatgagtccgaccatgacctctgtttcgttctttggtggtgccaccgcgccgctccggcataacgccgaacacattgattgcaggacggcgcgcagctgcagctcaagaccgtggcggcgggcgcgtacctcaccgccgccgaccagggcggcgccgcggcggtcgtcgccaaccggacgcagaaggcaccctccgcctcggagaccttcaaggttagcctcgccaccgccgccgccgccgccgccgctggctcgccggagtacggcgtgtgagtgactttt

SEQ ID NO: 84154 - DNA, 2392 bp, Oryza sativa
attccagaaatattagaggatgagtggttcaaaaagggctacaaacgcccagagtttgacgaaaaatatgacacaacattggatgatgtttatgctgtcttcaatgactctgaagtgagtaaactgcaatatgcacttgaatttctgtttcacatgacatgaagataaaagcatgccagttgctaaatggtttgaccactgtgatttgacctcctccaggagcaccatgtgacagaaaagaaagaagaaccagaagctctcaatgcatttgaactgatttcaatgtcagcaggcctcaatcttgggaatttgtttgattcagagcaggtacgtgatctccctatttaatcaatattgaccaacaaccttttgaacctattctccctgtattatttttatgaacgaacctgtaacttaaagttaagcgtcattgtttttggttcaacttatacctccctaaatcaagctggaaacatgtaaactggctcactggcactttgtcaatttactcaatcatatggttggagaatgctgcatgtcacaagtcccagaatatatgtagtagttcattggtcagaatgtcttttgatttttgcacctcataattctgccataactttgttatagttttgcaacttattctgctgtactttaattttgttcacactatttcaggaattcaaaagagaaacaaggttcacatcaaaatgtccaccaaaagaaattgtccgcaagattgaggaagccgcaaaacctctaggatttgatgttcagaagaaaaattacaaggtatgctccccttgcctaacaactatctgcatgaatatccgttttaaagtaatgggttctagggacaatttatagcaaattcaaatatatattttctacgtgctgaatttttttttattgattgaccagttaaggttggaaaaggtaaaagcagggagaaaaggaaatctcaatgttgctactgaggtaatatgaagaactgctatactgcaatctggtttgtgtaagcttcttcaatctaacatttattgtgcactattattcagatactgcaggttgcaccctctcttcatatggttgaagtacgaaaagcaaaaggcgacaccctcgaatttcataaggtagatcatgccaattaaaagttgatgctcatgaattatcattggaaaattgagtcagtgctttgatgattggatcaactactcacagaattatgactatgttttttttttcttttgcaacatttggttgaatggcttgtactgaatcacttcaaacttgtaatgtgttgcagttctacaagaacctctccagaaccttaaaggatgttgtttggaaatcagatgatcttcaaaatcaactttcctagagtaacttgggagaggaggaatgggtgaactattttagcatcccattcttttgaatcagcattcccatttctagaggctggaaaagcagaaagcatgttcattgcatctgtaattagatgtgagtggccctgtaaactatgtttggtctccactagtgttgtaaatgctgctcttatttgtcagagaacccttgtgatagctcaagtgaagctgatcactcaatgggttttgtgtgtcaagttttgtatgtaaatcagaatcttgtgaggaacaagtatattaattggccagcattattcattttcatttacactgtgtagttgtttgattttcttgtttgcatagccccagaacaagtgtaaccagaaattgaggtgacaaaaaaaaaactctgaactatacaatcctcatcagaacagttgcaaacctgaaactacatctttttcagaggatggtacatgaggaattcgggccgcagcagccggatttcttgtggagttacttgaccgatggcctccacttccatgtccctccatcatattctgccttcgcctgcatatgatagcaccaaagttgttcagataaatatgattatctgatgacgaatgcactacattatgtacagttcagcagaagcaacatttgcagattaaataggaagaagaaatataatgataatctagaaaagatttgtaattccagtgctagtaataatctacatggagaaaagaaaaagaaaaagaaatcaagaaagcagaaaagaaatgaatgggaggaaggaagaagagagagactgactttgccatcatgaccttgaggaactcgttgtagttgatctggccgtcgccgtcggagtcggcctcgtggagcatgtcggcgagctcgtcgtcggagagggggtcgctgaggttggccatgacgtggcggagctcgtcgggggtgatgaagccgttctggtccttgtcgaagacgcggaaggcgtcgcggatgtcgtcctcggcgccggtgtcgcg

SEQ ID NO: 84155 - DNA, 20466 bp, Oryza sativa
atacaaacttcaatacaacggcagtaaaagaacttgtcgtatttgctctccagaggaggaacatcaagtattgtgatatttatgtaacatggtgcggaaaagttctgaaaggagatgagatcttgagctccatacctatccacacgaatacgcatattcatgtgacacccagactgaggggtggagagtacgtaccgcgtaacttatctatgtatatgtattttatcacttcctactttagaggtgtaacaagtgttcatttgcaggttaattccaatggaatatgagcgtatggatgaacttattgaccgtgcggtccgtgacaataataatgaccttttctattatgtgaaccttcccccagaattgataaacccttataaggatacatgggtaacttttctaagtgatttctcgagatatatcatacaccaactattggtatgtgtttcccgtgatggtcaccagcggaacattacttggtatggtacttttgatctccgggacatactgattcaagcgggcatgttaggatcagcccccatatcgtcgaaaatacatacacccctattggtggtagacttgattatcttaagctagtttcaattctaaaggataaattcgtcgataatttacaaggttcttcctccccttgccatctgaacaatttactttctgtattgtgcactacttcccatgaaacttatggaagatccgatctattcattacattttttataaaccatccgtgcttgttatcatgtggagaaagagttgcacgataccttcaatatgatcatatgattacaaatcttgtgcaacgcgatcttcgcaaatttaagcaatatttgaatgatacttttggagatcctccttcttggatcgctgatatcagctgggttcctgacatgtggaagacatacaattatagtcctaataacaactcaacgttatggaccccacgatatactttggatctaaacagttgctcacattttgccaggaatttcttgaaccatttcggtcgtgaggttagtctttttttaattattattttaacttttctatatgaaccggtttaggcttttgtttgagcttagacttttaagcaactttttggctcatgtgatttatacaccaatattataggctcttatatctgccagttgtaaaaccaacactgatgaccatcattaattggtgctgctttgtaggtgacggctgccaatctagcacttatgctaggttagcagccaacacttagggtttatttactagtgcttttaagggtcctatcttcacttcacataaactaaaaattactataacttagcttttagcttaacaatataagagtagcttatggtttattggttttaaaaaagccaaatgaaaaaaaaaactaaaaaactgtttgtttgccttagattttttagattataagcaggcgtaagcctataaataaaaaaaacttatgacatatacaatgataattaataacgattcctagtcttgctaattaggaatatttgatgatatggaaggaagagaagtgaggagaggccaacgtcgttgctacagttaataattgcttaggaacgacttttaacctctatagaatgaaaactttactgcatgtgggtgtgaacaaggaatgaatagtaataaaaaaagttttattaatactttagagcctttgtagtctccaccattataaagacatagtttttaaataaatatgcattatctaagagtttatatggactctacctttaaacatacccatactgttctattcttgcataggtttctttgcaggcagctgaggctgccgtttctcagaatctagagtttctgcttccaaccatcatgatgctaatgcctgtgtacagtggacctcatcattggaacaatgacttcatggagatgtaagggaaagtgatcatctatttttccttgtttatatattatcttgattcttgagtactagacaatttcttgttgtagattgttaaacacaaactccgacagaagtaacgggcaaatctcctaatatcaagggataagaggccacgacaaattgtttatcagagcgagtacaataacaggctacaaattagctatatgcacatgtggagaagataagataagagagagaataaaagcggtctatagatttggagccaactgtaacatagactccaaagcgttatgtgtggtatgagaggtgggaccatattttaattgtgtagtatatatttatatataactattgtttagatgagttattaaatgggctatatatgatttgggtaatagttggccatactattaaacttgctctcaggtgcaacgagacacatgctttagtaattaatcgtttaattgcaagtacagtgatgtgagttaagcagggatgcagtcagcatcaatatgggttcattgggcatttttttctgtattgataatgcatagtgcccatattaccaaatttattacgctttgatacttgtggtgttaacagcacgtaccattttgctgctatcttgctttctgaggtggaagaggacggtaggtacaacagcattaaagagaaggccacatcatatggatctggaataaaaactttccggacaatttgtgcaagctttattgtatttttaccccccccctccgttttgtaaaaaataaatctattacacaacgtaatactcccttcgtttcatattataagtcgttttaattctttccctagtcaaacttctttacatttgaataagtttataaaaaaatatagtagcatttttaacacaaaacaaacatatattatcaaaatatattaaatgctagatttagtgaaactaatttgatttttaaaatattgctaattttgtttaaaatattgctaatgttcttattatattttccatatctatttcacctgactaacaaacacacattgcgggagaagtgctctttagtccctgtttgtaacctctttagtcccgggttgcaaatgggatgcccaatccaggactaaagattcctggcccctgacaagaatataaccgggatagttggtcaccaatcgggactaaaaattataaagtcccattgtgctaatgtgatttttgaatgacccgacaaagatcacttctacagtagtgaaaaggattttctagtggaatcttgtttgaataatttgttaacatcgtggaaatattgctttgccctctctctaaatggaagtattgctttccagcaacgtatcccgtttgcataaactatgcgtacaattttgaaggtacctttttcataccaaaggtttcatggagtccttttagacgaatccttcgtgcccctttttggtttttttttcttatatccaaatcaagaataatacttgaatgcatgggaaccctaaggttgcaaaccgcccaattcctttgtatggctgtaccttttttttatatataattaatggtgcgattgtaagagttttgacccaatttcccttgtactataggtcaaccctcccttttcacagtgaattgcaaaaactcactatctcaaagtagggatggatactgagttggtttggctcggtctagttcgttaggtaacgaggccgacggctcgagctagctcatttagcttgtaagccaatacacccatgactatctttccttaaaagattagcatcaaagatacagtagctgccaggaacatcctgtgcaattgaaaaaagaaatcaagcaactggcaaataacaaagtcttgacacgaaccttttgtacacatcaattcaaaatattgcatcatcaaaacaatcgaactctaattgaaaccaaccaaatgaaccatcaaacaaatcactaagccaaaactaacattccgatcaacttacagtatccaactgccgacgacgacgataacaagctctattaattatttgccactcttacggatggtgatagatgatttgtcactaaacccacatgtcatagatagtgagtgacaaaataattaattgtcacatcttaaaagtggcccaaagttaaatgtcccctaatatttgctccgtgatttggatcttggtggcgccggtggcggagttgcttgctcgtgctcgttccttctccatgatgatgatgcagaggcggagtggcacttgttgcggagtgagacggcaggatgacacaacgacgagagctcgtggcctcactcgccgctggtggtgatgggcatggagagaaaaagcgatgtaccatggactacgaagtggggggaatggatcgatctcttgggccttggctatcactggggagcagagctacagtcggtaggtggcggctagggttttctgatggggaggggatcgttctcgatcgattgagcgagaggagtgacgggaatgccgttttttttaacaaattgatccttttcaaaaacttattttaaaactagtccctacaaaaaacttcaaccaaaaataggccgtggactcagcgccatagacattggcgctaagttataacgtatcagcgccaacgacgttggcgctaaactctaatccgaggtggcatgaattcgctgagtcatcagatctcagcgtcaaggtatttggcgctgaggtccagacgatttaaatagctgcggcggcatttaaataagagtgagtagtcaagagaacagaaattattttgtaaaatacattaattctaaaagaatgctaggaggaagagaaaaggaaaaaaattgtaaagaataagagtgagtagtcaagagaacaaaaattattttgtaaaaattatttgtaaagaattgctagaaatgccgccgcagctatttaaatcgtctggacctcagcgccaaatacattggcgctgagatctgatgactcagcgaattcatgccacctcggattagagtttagcgccaacgacgttggcgctgatacgttatagcttagcgccaatgtccatggcgctgagtccacgacctatttttggttgaagttttttgcagggactagtttcaaaataagtttttaaaaaagaccaatttgtaaaaaaaaggggacgggaatgactatcggggacagctaactagggtcaggggatcgatcaattgagttgggtctttcccagatgagtttgggccgccaagctgctgcaatgtggcatgctaaggttgcagcttataaagctcgtgactcgctaacaagctatcagttcggctcgttagaaaaacacaacaagtcgagttgagtcaagctggtcaccagccatgagttttttcgtccagccctacctttgaggtgcttgaaaaaagcatggcctagtgggggtatccaagtttatttactgctatctcctttcagaaggaaacaaattattcttaccattctaccgagactcttctgccattgtatcgagggctgttcccaatattttggcggcctaggatcggacgaggtaaaattagaggcccttggttccaacaaaatgtaggataatatttattttattagttgcaaatatcttcaatatataaatgatacatcccatatatataatacgatatcaatctaatccttcattaggttgctctagacaaacaatatccaactagacaaaaatgaaattatcaagtagggaataggaaaaatgaatctaggagcaagaggaaacttttaaaaagctcagtcgtcgtacatcgagtgatccgagaagtggtcaactgaaaaatagatttgaggaactggtgcgaattaaaggtataatttagtaattagtagtagatcctttttaaaattttaatataaaaatatgttaatctagttaatgacatgattttataaaactttaaaataataatacttgaagtcatatataccaccttctaaaattcgtatggttttgtatcatttatatatcgtataatagagaatcataagaaatgtggttttataatataggccttgtttagttccaaactttttattcaaacttccaactttccatcacatcacatcacatccaaaaacttttctacacacataaactttcaactttccctaaacttccaaacttttccaccaactaaacacacccatatttacttaaaataattgcttacacccaaatttagtacctaggatcgaaataggaaaaattgccaaagtttggggctctgccgatttcctccagagagggccggtctgaccgctatatgtgggccggtcagaccgacaccagagggccggtcagaccggcgggagttcgagtcagacgccgtttttgtcgggtctcgggtttccttgctcgggaaggcatgtttcaggattccattggtttctagctcgagttggacgtggaggagggcctgtagagggcaagatcaacccctatttaagagacaaggccggttcaattgtaacccccgaacacataatatacttgaatcgctttttcttttatctttacttttagccatgttttttactttaccctagtttcagtctatctttgtcgatgtacgccgtaaatcatccgccgccgctgtgagagtgcgacacctctttgtaggtttgtcatgaaaaccttctgtttgcccacgagacaagtagttatcctcatatcgatctaaatcggcctagaggctgattttgatctctagatcagctctgttagccggtttagctctttttctataaaacccatcttgatttggccgtttggctagatcgaggtgattggcgactccatatcatcacaaggcgtttaggtactgcgatcgtgcttgtcgacttgttaaaaaagttgccaacacaatttttgacgactctgctggggaatcgatctattcgaccatattatgaccgaatttggtttaatttagttgtcttgagagtttcggccgaacggccgaaatcaatccatatgctgttagtctgaccgtctgtattactccggtctaaccgacgtaatcagtacggtctgacctcttgtacgacgccggtctaacctacttggtcggtccggtctgaccggagtagttgccgatctaaacggcagaaagctgcagcagttgtgcatcgggacagcaacaagcggccggcatcatcttgctgtacacggtctgaaaatcagaaatccaatcctattcagtttgctgtctatacgtgttctaaaaacaaaatcaggctattagagccgatttacctagaatagacaaaaccaaatcggtttctgttattgtgcattaggcaactgtcaccgagaaaaaaaatcatcaaagccattgcagcgcattggctgttattgtggaacatcaatttccaaaatttttgctagaaccacacaaaatttctgctattgttgtacacggaagatccgccgaccaaggctgctgatcttttggttttcggaatttgttacgtgcacacatcaagtataacaaggaaatcaagaccatatattaatctattcggtcatcgatttcggctatgagttatatggccgaaattaatcaaggagtttcttcgtcaaccataacgagcggaaacgagatcaacaaactcactaaggaggatttgaacgaggagtagcggcagtactttgaagaacaaatggcagtgttgaaggaggaatatcttgcataatacattaggaccgatcaaggtattctcaaaagaaacgtcccgctacctcaagtcatagtttcactaaaggtaacctccgattcgcccaacccatccgttgctattcaaaaagttaatgatcgttgtctagatgcatctgctacttctgttttgcttctatacaatatgcttataatgctatggaaggatcaatgggtgtttatacagccaattgcacaggaatcggctatatgcaaaatcgagctgacggtatgaccggtcgtgacaccggtcagaccgtgcccaccatggccggtcagaccgtgcccaccatggccggtcagaccgtgtattataccggtcagaccgtgccaaccatagccggtcagaccgtgccaaccatagccggtcagaccgtgcctatcctggctagatcgggcctcttttggccggtctgaccgcaccattgaccaccggtcagatcgggccataggccggtcagaccggatgcttggccggtcagaccgggctatttatagccggtcagaccggttccttggaaatttctctaggttttcataccacgactagcagtactgattttaactattattcatcacctgttaatactggtagtcatgctacttcacatatccctaatacttacaatgatcctaatagaggatatcttcatgacaccgggtatggccaatataatcatattgcgccgcaacaaccacctcttaggccactaaacccaccaccaaatccaccaaggcctgagactatggaggagttgattagtgtcattattagggataaatttggaattgaagcaaggaatcgtgctagggtttaccaaaagccgtatcctgattattatgacaatatcccatatcctcgtggttatagagttcccgaatttaccaggtttagtggtgaggatagtaggaccacataggagcatgtaggtcaatttttagcgcaatgtggtgaggctagtagttcggatacatataaattgcgcttattttctttacctttgtccggtactgcttttacatggtttacttctttaccggcaaattctattcatacttgggctcaattagaacaaagattccatgattatttctacactggtgaaactgagcttaggttgtctgatttaacatcggttaggcagaaacatgatgaatctgtcactgattatattgagaggtttagagatgctagaaaccgatgttttagtttgaatataactgacaaggatttggccgacattgcatataatggattgcttgattctattaaagagagattgaatggccagatatttcttgatgttgatcatgtgttgcatgaagctctggctcaagaaagccgagtggatgacaatagcttaaatgctagtttggatgataatgcaataaccaatatagccgaaccaagtgttggatcggattgtgttactagtttaagcaatgatggaatagccgaatcaagtgatggtttggattgtgctagtagtttagacaatgacaccgttgaaaatatagccgaactaagtgacggttcaaattgtattacaagagaaagtgaaatagtattgtcacctaaaaccgagtcacaaatcgatcatgtgaatgttggaaaagatagtgacaatgtcttgcgggatggtaatgaaatagaatccaaaatagctatgtatacatatcaaaggccatatcctgaacacatagattcggtcccatacccgcaaggatttgatgtgcccaacttcacaaaattcacaggtgaggatgctagaacaacaatggagcatatcggccattttgttgatcaatgtggtaaggctggtagtgctgatttgcttaagttaaaattctttcctctttctttgtcaaactttgcatctacatggtttagtttacttgctcctaattcaatttctacatggtcataaatggagcttgagtttcatgattattttaaaaatgcaagcttgatggagcaaagaccgattgatgattcatcggtcacttatgatactattttggttacacctattgctaagaccggaattgttagtaatccccttcctattgctcctattgattttgacaacaagaaagtagtgattcggcctagtcaagccgaatccacaaaagggaaaagtgttattattggggatcctcggtccgagacaattaggattaataatgctaaggccgaagatcataaagttgtaaaggatgagtcatctagttcccagaagactaaaaagccgaagcttacttttgagatgcttatggctaagtacaagaaaggattagccggtcaacgatttgataatcagactagtgattcaaaaagactaagatcatctcgtaggaagagaattggtcaaacgctaaagcaattggagccatcaactataccaacttcatacaaacctccggttgtgatgccatggtatccatatccaatgtcactatatggttatcttttttatgtattacatgccatggatggctcaatcacctatgccatttgatcaagaatggaggggatcacctaagtcaaaatcaagtcattcatttaactctagacaagaccattctcacaaaagaatcgatccgatggatcaaaggtgaaaaatgtgaagaaggtgtgggtgagaaaagaagccaaagcttcggaggtcgttactatcaaggaggagtctcaagatgttcgagtacctactggagatgcggtgaaaactatacaagcggagaagaccgaaggcgacatcgcgactgtcaacaatggtggtctgaccgggacatctagccggtctgaccggcggcttactgccggtccgaccgaacctcctggctggtctaaccgccagtctatggctggtctgaccgggcctagaggtggtatgaccgggggcaccaggggtgagtaggcaatctgagaacagtacaggagcttccacttcgactaaaaatataaagaatcatcatttagctcttggaacacaactacagccaaagtggataccttctggcttatcttctcaatagaagaggttacaacgtcttcgagccataggtcaaaaagaaaaggatgccgaagatgtggagaacaaaacatgtaacaatttagagcctcgaacacctaagcaagtgtggagaccgaaggaggcaaaagataagagactagtgatttcccatagtagtgataaatccaatttgataagagaagaatcatcggccattagagaaaattctcctccacatgatgctatggatgttaatacggtgttcatcttgcctttgaaatcgtgcaatcaagaaagccgattttgctcgggggggggggcaagacattaatatgctcatgaagaaatcaagaaagatgaacggcgatggatacaacatcacatctttgagccgccgttcgttagatgctaaggcaaggtatgtgtttattgtgttcatcattatattatatgcctatgccatgttagaacattgcttgctatctagcacatgtgtttgctcatcaaattgatattacatatacatgttgtaaatgccagttctgagtaatggaattggtaagttagcatataatttgtttgaagtatgatttggctcatgagtctttgatatttgtttaaagccaaatcatatgtgtttttatggatcaccatatgagatatagatttcataattattgcaccatgaaagttttacttcttagtaattcggcttatgtcgatggccaatgtgatgatttgttctaatattacctaaagttatcatgttttagaacagtggccttgttataatattttgcatacatgcttaaaccgattacttacattttattggaatcatgtgtgtgagacataagactttggtaattcattattaatcacacttcaagtggctaagtgttttgatgctttgatgattattgtttcaaaagccacttgaattagtattcatctatacatatcagtcggatgttatagtttttcatatgtctagaaggaaggaattttagtccaataatttgatacactaagcatctggctataatgtgaagaaaggagtatttttgatattagaaaagccggtgcttgattttagatctttggacgaaattggcaaagtcatagaccaggggcggtctgaccagtggtaacctgcggtctgaccggctttgcttggccggtctgatcgggcagatagggcagtctgaccggcattgcgtggccggtctgaccggcttcatacatgaggctggggggcacgttacatctgatttagaggccgaattaattgtaaattcggacatttgtgcccaggagttagaagaaaatatgagaatccctttgatagaatatttgaagtatcctagttttagggttgatcagaaaattcggcggtaagtattcaaatatactttgcttgatagagagttacatcaccgaaatatagatggagtgctattgaagtggttagacaatatgatcaatctaaagttgctaggggagaagtgcatgaagggatttgtggaattcatcaatcggcccgtaagatggattaatttcttaggagagcggggttctattggccgaaagtgattgatgattgtttcaagtactatagaggatgtgaagcttgtcaacggttcaataatgttcaattggcatccaccgctgtattgaatcctatcatcaaaccatggccgttacgaagttgggttttgaatttcattggtcaaatttatccttcatcattaaaagggcataggttcgtgctagttgcaatggattacttcactaagtgggccgaagccgtgccttcaagaatattacttacatggaggtaattgacttttattttgaagcatattgttcatagattcggtattccttaaactttgactacagatcaagaagcttcttttatgtccaaggaggtgagaagttttgtcgaatcttatgatattaagttgttgagttcttctccttattacgctcaggctaatggacaagccgagttgagtaataaaacattattgaaattagtcaaaaaggatattgaagaacaccaaaagaaatggcatgaggtgctttcagaagcattatgggctcatagaatatctaaacatggtgctgctaaagtcactccttttgagttggtttatgcagttgaggtaaatcttggctctcttcggtatatcaagcaagacgacttgtcggttgaagattacaagaccttggtgggaggcaattttgaaaacgtcatcgataagtgtttgaaagattgggtaatattttggaaaagatggagacacttcaagaacaacatttttagagagcaatcaatgagaaatacttgaagaaatacttccctagcgtttggcaagatgcttaggaagtactgtggccggtaattggattatcgccctaagacaacatgttctatgcttttagattcacgatgttcataaaaaggcagggggcatgtgtttacacccaaatttggcacctaggatcgaaataggaaaaattgtcaaagtttggggctctgccggtttcctctagagagggcccggtcagaccgccaccagagggccgttcagaccggcggcatgtggccggaccggcagagtctgaatcagacttcgttttcgtcgggtctcgggttttcttgctcgggaaggcatgtttcgggtttccattggtttctagcctgagttggacgtggaggagggcctgtagagggcaagaccaacctctatttaagggacaaggccggttcacttgtaacccccgaacacacaatatacttgaatcactttttcttttatctttacttttagccatgttttttactttaccctagtttcagtctatctttgtcgatttgcgtcgtaaatcgtctgccgccactgcgagagcgcgacacctctttgtagccaagggggaagtggtgtgacagcaggcatgtcactggcaagatccaccactgtttattcgccgagatccttatcgtctcacactcttgttttctctatcggtctctctcgagtcactctccaagccagcattgttgctcgcacggatccggtgccggtgcccctattgcgcggattcgccgtcggcggcgacaggaggggcggatccggtgacctcttcccctcccgcacggatcccgtcgtctctccgctcccctctcgcacagatctgccgccggcgcctgatcccgttgtccgcccccctctcgcgtggatccaccgtcggcggcgacaggagtggaggatccagcggcgggcgaccttttcccctcccgcacagatccctcgtctctctgccccccgctcgcgcggatccgccgctggcaacgacaagatggatggacctggcagcctcccctatggcgacgatggcaatggttgcacgtgggctgacctagcttcccccatctatggcggtggcggcgaagttgttgacgacggcatcacagttgttgacgacggcatcacatgcgactttctgctcaagctgctccgggcagggagcatggtgggcgccgacgcggctctgctacacgagctggagtccagggctgccgtggtatcctaactcaaagtttccttcttttttagaaaacaatctgggtatttgatgcaagtacagtatgatctaatttggtcagcattgttatataatgagctattctttgtaatgagttacaaagttatagatataatttctttgttaaaaccatagtatattttcatcacatcagataaatcagtgggcttttccattgcatgcaggaactaatgccggcttctttttcatcacatctggtaccgtacataaacattttgaatccttttttcgtttataggcttcacgacgctttttaagtatttcttgtttctttttgtcaggtatctctttgtcgtcttcgtgcactgggatccaagaacagggatgatgatccagatggcgtagcatcaacatctagcttggaagatgaagctgtacataatcattatcaaacaacaaaagcaggatgtatcttcttgaaaacaacggtgagaagcaaaacaaaaattgaataatattttttatttttgatccctcatagagatgatttttgccatgtttaccccactttatttgctgacactattaatatccttctggtaatggttagatttcctgttattcattcaatgttataaaatttgtgacacaagtacaaatgctagacccatcacctaaaagtctttaggtgaaattaaattgcaaaatttagtaccatagcttttcaggtgatataccaatatgacctgttcgattgcagattagagaggatgttagaactgcttgtgtctatgttgaatcattgacaaaggagttagttttcactacaaaggatgtaacgcaactgttggtgaaggtacatgcacctcaatattgtcgtctgaagattcgctgatatgtttctcatatgtttgtgctgttaacccatgcatttggtgatcgcctaaaagaagcaggaaatataaaccacttactttcacaacttgcgtatggttctgtttatacataacactaaagataaatgtttatttaacacataatatgaccatctttgtcctgatatagtctttattgattatctcatagactgttatgcttaagatcagtatttaagtaatgggttgtagtttgtcatgcatgcattgcctatatgactgatttcttttcgtgctctgttttccaacgtggtacaaatcgtggtggagccattcaagtgaatgatctagttatccagtcaagtactattaagcatctatctctatccagtacatatattcacttatcatgtctggaaccgttccactgcaatatggtattcacaattctttatactcttaaagatatccctttatcatccagatctgatgtgtgtgttgccaggtttttaaggagacaagagatgagatttgttgactttgatgggttggacttatggaatcgagatggttgccaaaaaatattcagggtaattttttttgttcaaaataagtttggttgcatggctaaattggaacctaccgtatttgctatgccccctttaatgctttggaatttttaagagctctatactgttgtccgctggttctgcatggaccataggtgtttattttttctattgctgcattaagcagtacttttgcgcactgagttcagagaaagataggggaaatagaaataataaactctgaaactggtttcctttaaagtagaatatttagtcaatattaatgatttgatttttcaaaccatgttggcatatgaatgtgatgaataaccacctacagtagtatatgcagaacaagctactgtaactcaaggcattaagggtattaagtatttccagtggttgattaagaccattaagggtattaagtattgccagtggttgattaagaccattagattgaatatatttatgtatctatcagggatattgtgtgtagtttatgcatgctttcagtttttaaatcagtggttgattaagacggttagattggatacattcctgtctctatcatattattatgttatgatttttttaaaaaaaatattcagggaattactgccaatatcatcttgttaatataattatttaataattatgcaaaataaataagttgtatttcttttctcctggtacatgcatttaataccacagagtttatactatttattgcatatcctgattataattgctcctaaagttacgcaaaaaaacaaatctaattgttaagggttaaagaatcaccttccgtcgtcataaatgcaacaaacgcagatgtatcacgtccaacagaaaattgcttgttttttaaaaaaagaagtttgggcgcatatgagtagcattgagaagattgctcaatatccacaccaaatattgggtgtataaatgagctcttctttgtgttttcagtttctttatataggttgagaagatgtttgtatcctacttggccatgtaattcttattgttagattctgtatgaatgtaattcttgtgttgtaattgtttagctatgtaactgtataagaatctatttgggattcaatcattcaaaaaaaaacagcggtgggaaaaaaccgggcccaccaaaaaaaattgtgacccaaaaccgtgccaaaaacgcacgcgaaaaaaccagttggatggaaaaaccggacaaaaaccgtgtaaaaaaagaatcggacgaaaaaaaccggtcagaaaaaccgcgcgttgaggaaaaaaaccgcgtgcggtaaaaaaaaacgacagacgaaaaaaaaagctaccagaagccttgcgtattttttaagtagatatagatatagatatagatttttaaaataccaacttgatggtgttcttttgggatacggcatgctcgtcggtcatctctgtcccgttccacggttccaccataggatggatagggatggcttcatcgtagaaaaacaattgattccccgcacaccccgaccacaagtccacgcctcaacgaagaaaatctcagatccctgttctcccctccccctcgattagccgaagaaaatcctcgcacaaggaagtctcatggattcagatccagccatggtgctgcttaatcgctccgtgctcttggtcaacgaggtaacagatgtaatgaaggaaaaaggctggtctcttgagctcgacgagaaggcaatttcagacgcatgcgacggtatcacggattggcaggagaaagagaaggcaaggcaaaaggccatacgagcagagatcaagaggtttcgagccaaccaagatgcggcggaggccattttgcgcaagcgcaaggcctccatgccccccagcacggtgaccaagttttgtactgacaccgacctccgtaaggttttggatggcatcgaactagatcctcaagtccatgatataccaggtttgtccttctttcgcctccggctgtcgtctgcacgacatcctcctgatttgcagggcacctccgtcgccggtgcggaccacaacatcctcgtcttctatgtcggcccctaccggcccggtttccctgcaccgggattttatctggtttacgacgcatgggccaactcactgtccgccatccaccagttgccatatttaggcggcggcagtattggctctgaggttgccgtgctgcgccatgctccggccagcgactatatcctcgccgagctcctcctcactggcgaactccccaaggcaagtctctggacgtggtgttcgtctggtccgtccgctcgccaatggatccacaagacagtcatcctccctcctgaagtgtgcacgcccacctacatctttcatgccgataccactttctctcttgggaagtttgcgctctgttgggtagacctcctcgttggcatcttgatgacctgcgatacccttgccccagaacctgttttccagttcatcccgttgccggaggggtgctatatggagccgcccgaccctcaagatggacgccaggtaccacaggaataccggtctatgtgttgcggcaatgacggtatcatcagattcatctccatcgacggctatcatcaagacctctctatcaacgatatgaggaatatgttcctcaggacatggtctcttactcttaaccccaaggagtggaagcaagaagcggcactatgcattggagacctctgatctgacacaacccaccagaagctgccagcactaatgccgacctggcctgtccatagcattcttcatgctgatgttgtcttcttgtacttgtccggccctaatactgggaataatactggggagacagagcggtacatggtcagcatcaacgtgcagcacagggaggctatttcaatctccaagttatctcctgatgatagttcccctcctccacgctactttcccagcagcttcaattcgtacataaacaaggtaactagctcattttgcaagcaagcagcaggaaatataggtagaaatagttcaaaaagtaagcataaaaatgtagaggctaacagagggtgttacgtacaaggaaatcccatataccaagtactttattttattagggcatgaggcattcactactacacgagcacatcagcgcccccatcataaatgccggtttgacaaaatgttaaactggcactgatgatgattttcccgccctaaccctcgaccaaattatcacaaaaaagtacatggaattaggagtgtgtggttcatggattgcaatttcggaatacttcgaccaaattatcacaaaaaagtacagatttacagtgtatcacaaaactacagatttagtaccaaatctatctatttatctattatattattaaaacaactttgaaagaaggcaccacgttcgctgtggaggctagaaattcccacattaatcggaggaaacgaaaaatatctacatcgttagatcacagtaagactatattataacggcggagatcgatcatatataaatagatattagagttgtgaagataatacatctggtccaaacataaatatttgtttcagatatgcaacgggatcaaatttctatttgaaagggattaggagtgttgtgtaaaggtctcgggcagcttgatgtatcggaataaaaaaaggaaaaagagagcgccatctagcgtttcatacaggacaataatttagaaaaaaatagccttatacaactgcacacattggtgcatgcacttcggcagcgatgcgcacatacgagatggcaggttattgcaaagttaacagtccaaaagtacgagttatctgacaaatcaatttcttaggactacatatttctagcatattatattatagagatagctcaaaagtcaactattaccttcacgatcaatcaaggattagaaaatcttatagtaattataaaaaatgattttaaccgttagatcatagcgagtttaaattataacagatcgatgggagttatatagaaaatataaattgtatcagtagagaaaaacaaaagttaaatataataagatatttcacatagaacaaaaccgagtatgactaggacatggacatgacagtaggtagcgaaatcctatatggacacggatcgaattggtgagcatgcagaacatgttttgcagtcctttacagtttcagggtagcatgtagctttaaaacagaaaagcgtagaatcctacatggattaaaatttatagcagcgaagccccttagacggctaagcgagcgaaaaaattacatcaacgcagcctcacacaaccaaacccatgcacaaatcaatatgacacaacttactcgagcattaaggctattaagcagctgtgaaaccttggcttgatgtgtaggtctgggatgccgttgatctgagattaaatacgggagcgattaggctaagcacgtacttgcacatgcattgctctctgtgtttaatcatggtaacaagcaggaaaagaaaaggctaccataaaagaggaagaaatgaatgtccatatacatctatggttcactcttttatttttttttaaaaaaaaagaatctcaacataagcataatttgtcccctgcttctggaagggttgtcccttcgtactaattaatctttgtgaacgcaaatacaactatagatcaactaaggtctacacgatgaagtaacatgcgtagatgtgtgtactatatttacatttaaatgcgacacactactcatcagtgttcatgg

SEQ ID NO: 84156 - DNA, 617 bp, Oryza sativa
ctaacgaccacattactcctttaaccgctttctcatgttccatccatctttaccaaagaagtgcatgatagatgtctctaacagtttgcatccttctttcatcacatcgcgctaatcttctttaagcagcaaggaccattgtcgagcccaatacgtccccctgaaaataacctgcaagtaagagttaaaattggagccattgaagaccacatcatttctacaaatccacattacccacaacaacgccgcaatccctataaaaatttggtgctttagcctagattgcaaaccctttagccaaatcccaaacatattagcaacattgttaggcggatttatcccaaatgttataaaaagggtactccaaacaaatctagcaacatgacaatcaaagaagagatgttgtatcgtttcattgtggttacaaaaacaacacttagtgttgcccttccaatttctttttgctagattgtccttagtgagaatcactctcttttttaaagtgggggacctccacctcccccactttcccccgggggcctgcaccaccattccttccgagctagcagctccccccttctcctctccctttttccatatcatccatttttctatca

SEQ ID NO: 84157 - DNA, 664 bp, Oryza sativa
ctagtaaactggcagaccgtgtgcatgccgagagatttgggaggactggggatccttgatttggaaagattttcattggctttgtgactgagatggctatggatgcgctggcatgatcacaacaggccttggaatgagatggaactacctcgcaacgcaaaagatgtacaactattctaggcttgcactgaaattgttattggaaacgaaaagaaaatcctattctggaaagacaactggctacaaggaatgtgccctaaagatatggccccaaacctctttcaacttgcaagaaggaagaacaaaaatttaataactgaacttgatcacaaccattgggtctactcattcagagaaattgacaatggtgaagtaatccaagagcttgtgcatctcggcagccttcttactcaaacacaactaacgtcagaaaatgaagactacataatctagaagagaaatagcaaaggtatatattcagcccaaagtgcatatcaattccaattcattacctgtcaacatgatcagaccttcaaagccaactggagagcccaggcattacccaagcaaaggttcttcggctggctcatcctgcacaaaagagctctaacagctgaaaatctgctaatccaccattgggaatgtgattggatatatccccttt

SEQ ID NO: 84158 - DNA, 695 bp, Oryza sativa
atattgtaggtgaaaacatcaggatgatggccctcctgaaccatcacatccatgactttgagagcatggccgacatgatcattttggcagagaccattaacaaaagtgttatatgtcatctggtcaggctcaaacccatcggcaatctccagctacatatatccaagagcatccttcacccttcctagcttgcagtacccattaatcaaaacattaaccatcaccttcgtcagcgagcaccccatttccaacatcctggctttcaccctcagtgcagcctcgatgctcccctcctcaacaaatccttgcatcagggtggtaaacgtcgtctcgtcaggcgccacgcctctgctagacatttcctcgagcatgagaactgcagtcctgacctgatgtgctcggcataacgctttcatcagtgtgttgaatgtgacaacatcaggcttgatccccctagcacccatctccgagtacaccaactcaagcaatttcatctcgctcccctccacaagaacattgagaaggtggttgtacaccaccgtgtctgcttgaatgccaaacagtgggtcaagctgattcaggaccagatcgacggcatcgtcgaacagctgctgtcgcgcgtagcaatccaggaaggagtggactacgcccaatttcacctggtgcccctcccgccgcatctccgcgacaagcac

SEQ ID NO: 84159 - DNA, 528 bp, Oryza sativa
gtgcaactgcactttttctggaattcgcaaactttgtgttagggacaaatgtcaagacagttggctattcagaatttgaaataggtctgcacgatttctcagcacattataactctatgcaattttttgctgttttaggtcctcaatgctctgttcaatctttgcaagatcaataaaagaagacaggaacaagcagctgaaaatgggatcatccctcacttaatgaattttgtcatgtcagactcacctctcaggcaatatgctttacctctgctgtgtgatatggctcacgcttctcgcaactctagagagcagttgagggctcatggaggattggatgtgtacttgaacttattggaggatgatgcatgggcgtgtactgcgttagattcaattgctgtttgcttgtcccatgacaatgatcacagaaaagtggaacaagcctttgtggaaaaagatgccattcagaaattagtgaaggttttttaagactgccctgaacaatattttggtcatatattggatgct

SEQ ID NO: 84160 - DNA, 732 bp, Oryza sativa
atcctgcacaaaagagctctaacagctgaaaatctgctaatccaccattgggaatgtgattggatatatcccctttgtagaagcgcctgtgaagacactgaccatctttttagggagtgtgatttcattagaaccacttggagcctagtggcggtagctcagggcatgcaaactgcgataaattcaaactccaccgctgaatggatgatggctttagctcatggaaccaataaggctgaatcaaaacgaagagtgggaattctgatcaaaacctggtgacacgtttggctacaaataaatgctaaggtcttcaagcaacaagagccatatgcacaacaagcggcccagcagatcggggaagacattcaagaaaatgagtttgtttttcagcctccttgatgaagtctgctctactcctttctttctttctctattgcagtctacctcctatcgtttgtctgctttctttttgcttgctgaaagttgttccgttacgtctctaataatacgctcctaagcgatttgtaactcatactccctccggattgataataccttgtcgttttggacaaggacatggtctctaaaaaaacaactttgatcattatttaaattgttaacaaatatatgatcatattaaagtattttttaagactaatctatacatgtagtcatcatatttgaaagacaaatattttaaaaatgattcataatcaaagattgtaaagtttg

SEQ ID NO: 84161 - DNA, 677 bp, Oryza sativa
ggagtaatgggcgcccccaagtcaagcaacaagcatcgtcacttaagcatttgaattacttagagatgaattggcaccacagccgaagaggtcgggaaatctatttctccttgcatactaaaaaataatgctgtctttagttttttagccagtgatgctcttattagttttgttccttattgtttccaaatcaaaacttacctattttcttgatgataactgacatgctcctttgttttgcacatagtctgtagattatgataaggagggatctgtcttgcgtgtacgtggaaaaaatataactgagaacgatcatgtgaagattggacagtttcatactgtggagcttgagctgaagagacaatttactttgacgaaggtatgccctaaaatttgatcaaactttatttctttcgatttttaacatatacatatatataaattttgtattcatgcgtatacaaagtttgtatacatacgaataaaaaaattgtatacgtggtgtttttttcttggttttcggttttttaaatatgtatgtatttatatatataaactttgtatacgtgtatacaacaaactttatatacacgtggtgttttttttttgttttcggttttttaaatatgcatactttacatacgtaccacctattactactaggactgcctactacc

SEQ ID NO: 84162 - DNA, 2850 bp, Oryza sativa
gataaggtactcgggaagtgctggattacattgggggcattcaaatgcgaacatgcaatagaagaatctgagtcttttgtagaaatatggtctttaagtggtgttcattaactaagaaatcatatcgaactctatctttgtttatgcctaaagtttgtgttaaaaaaaatctaagtagtactagtcagatttctatttgtgttttaaatttatccaaaatcactatagaaaaactcaataaaactggcagaaaaacgtctcgtgcagcaagcaaaaatggcccaatgccccaatccgattcgtggtgcgaccttgaaaaattttgctggtgggccgtcggaaaatgttcgcacgcaaagaaacgagcgcacgcccattttctggtgtggaagtggaacagatgctgcttcctctgtgtagtgtactgtctgttgtgccaggctgctcccttcgtttgcgtaatccgttcgtaatttcatttattggcgtctaagaaaagagaacgagcttttctccttgctgttatctacgcccaatacactcatacgtatcgtaagcaggttttaccaaaccgtgtggttatcatgttttcgtggttaccatggtaaccgccgaaccgcggggtgcgtggtgaagagtcatggcagagtttgcaagttgatatcccgtgtttactgcttagtaatcagtaatcacaactatgaccaagaagctcataagagtgagatgctacttcgttggcatgctacttatcagctcatttctttcccttgtaccagatgttccgcgttaccgagcttcacctctccggggccggcgccggcgccgaacagggactcgatctgctccagcgacttgccgctcatctccggcacgaacacgtggacgaacaccacggacagcgccgagaaggcggcgaacgcggcgaagggcacccgggacggacaccggggccgcagaaggaaaggaacgacatgggcaccgggccgctggtcagcctgttcacggagaaaccgagcgccaccgcctgcgcgcgcaggcgcagcgggtagatctccgagctcagcaccatgttgatcggcccgatccccaccgagaagaacgccacgaagccgcacaccgtcaggatgggccgcccgatcgccgccgcccgcggcagcgcgccgtgcgcgagcagggagagcgacgcggcgagcgcggccaggcacgcggtgatcccggccgtgctgacgtacagcagcggctttcgcccgacgcggtcgacgaggacgatggcgatcacgatgaacaccgcttggagagccccacgccgacggtggcggcgagcagctggctctcggtggtgatgccggcgtcccggaatatcgtcgggctgtagtagaccagcgcgtcgatgccggtgatctgctggaagagctgcacgccgatgccggtcaccagcatgcggcggatcaccggggacggcctcaggagctcgcgccacacggccttgccgttgccggtggccgtgacgcgcgccgcctcctcgatctcggcgagcctctcctgcgcctcgtcctcgccatcggtgaccttgagaagcaccgcgcgcgccttggcggcccggccctgcatgacgagccaccgcggcgactccgggatcaccagcagcacgaacgcgacggagatggaagggacgatgccggcggcgagcatgactcgccagttgatgtggtcggggagaccggagaaggcgaggttggagacgtacccgaggaggatgccgaggctgatgaagatctccgggaacgaggcgtacgacccccgcagcgtggccggcgtgatctccgatatgtacaccggcgccaccatgatcccgatcccgatgccgatgccggccagcagccggcccatcatgagcacggcgaaggacggcgcgagcgtcatgacggccgcgccggcctggaacacggcagcggcgagcccgatggtccatttccgaccgacggcgtcggacgtcctcccggcggcgaggctgccgaggagggagatgaagctgaggcacccgacgagcacttcttgctgcacttcactgatgtggaggtccttctggatgaatatgatgcagccactcatcacaccaacatctgaaaattaacagccacgatgtaacacaggatttgacaatttgtgcaaagatatttcatccatttgaaagtttgatcgattgttcacgagacaaacaatgtcaatggctgtctgagagagagactcagataaagattaacaaccataacaagtatctgaaccaaattaccggtcaaaatttacatttcatctgaatctgaagcagaatgggctgtcagtgatgataacttttcaaacactttcatcttctaaaagcatattaacatgacatacaatccccatattttactagctgcaaatcttgctttaatcagaaaataaacccctgattatgtgtaatacaaccaaatctgaatcaagaacagtcaaattcaggagaggggctcaccgtagccgagcaggacatggttgagggaggcgaagacagagcaggcaaagacgtatctcccgctgccgccgccgccgcggacacgaacgacgccgccgccgccgccgccatctccctgctcatccgggagcacgtcgtccatgcgcacgtacttgctcttcctccccaagaaatccggaaggctcctcatgccgccgccgttgcccgtcgccgcctcggtggcacgaagccccattctcaccgtctttcttgtgctgtgctctggctatggttggctcatcctcttctctcctcttgcaagctccaagaatgtggcttgtgaatgggaaaaggac

SEQ ID NO: 84163 - DNA, 1410 bp, Oryza sativa
atccaaccaacatacgaaggcaattaaacaacagatttgttccttaatgttgcagttgcattgacaacagatcaatcaggatgacaaaaaagtaagggaaaaaacagatagatcacgattcaattatactatctcagtaaaatcttccgagtaaatcacaataacagtcctataattataaaggctgagtagaaaaatcataacaaccaaactaagttatgcaaaacaattccacatacagatctttatagctgaagtgtgaaaagattaggatcaagtaagagtgctgtttcccaggttacgaggcatggcaatgatacatatttcacagacaggccaatgaagtcaaagaatagaccatcctagcaagttgaaacaaattcacgcctagtgcaagaatctttcaccagtgcaaaactgtagtgctcaacaaccactcaaccaatttcacttttctatcagcaagatgtagccaaatgttgcatgctgaagcctacgctcaattactatggcaaaatgacaaaatgcattgttttccaaatagcccgttgatttgatctttagcctttttaacaatgcgggccttactgccgtactaaacatcatcaaaacaacaaacgacttcttttctgtcctactatctagacaacactaaaacgaaacataactttttccttgttgccctgaagaacaaggcagtgtgatggtttattattgtgattttttagaacatatgccagagtgccaaaagttatgatttaacagtttaacattcaatcgaaagatcacaaagttcgcacctgagatttggaccatgatagatcaagaacatcggcggcgtgacccaatagagagcatactggtttatctctgaacccaaacacacattcaggcacaactagatgatcagagccaacagacttccggctgctttgcatccttggcctcctcttcttctccacaaaacccccgtcagcacagctcaatgacaatgttgccagctccggcgatccattcccaacagctgcaagaaacgggctgcagccaccaccgttctcccttgccaccgtaccttccccgagcaattctccctttctttctccctctgatacctcccacacatggatgacacggtcctcgccagcgcttgcaaggtatcgtccatccaagctgaagttgatacaccagattgagcccgaatgggcagccaattcttgtgtcatgaacagcccggtgagctccttgcacgccttcccatactgccgcaccctgaccctccctgcattgcgcgagccgttgccgtcaaggctgtcatcggtggcggagctcaggcgccgcgcttccctctccttcttctccttctccttctccttgtccctctcatcggtgctgctgcgcccgtatgcaacg

SEQ ID NO: 84164 - DNA, 672 bp, Oryza sativa
agagcaacctatcaacgcgctaagttacttttctattggccaggcatgaagaaggatattgcctcatatgtcaaactctgcccagtttgtcagaaaaacaagtctgaacataatctgcagcctgggttacttcaccctctaccaatccctgagatggcttggacacacatttctatggacttcattgaaggcctccctaaatctgataacaaggatgtcatttgggtcattgtggacaggtttaccaaatatgctcattttgttgcacttagccatccattcacagctgaccagatagttactcaatttgtggaaaattattacaagcaccatggtcttccggcagttattgtcagtgacagagatagaattttcactagtcaaacttggaaggatgtttttgagaaagccggggtaaaactacattttagtagtgcctatcatccccaaacggatggacagactgaaagggtcaaccagtgcctggagaattatcttcgttgtatgacatttactaaacctaagaagtggaaatcactgctggcctatgctaaatggtggtacaatacatccttccacactaccttgggcatgactccttaccaggcactacatggggtcccacctcccttgctagctgaatccttcctatctccatctcttttcactgat

SEQ ID NO: 84165 - DNA, 727 bp, Oryza sativa
catgccatgctcatatggttattattaaactacccgaccaataatagcttaatcacatgaaagttgcacccgtaccaacaaaatattatatgtgtctgactgaattattctgaagaactcaacagcattagcatatatcaatttcaaatctacttgcagaggagaaatgtaaatacctcaacagcatcagcaacagttgttgccatgtcatatgtgatctcttcaaaagtttcatccaagaaaaaaacaattgttgtaagcttacggctggataaaagagcctctatctcctcccgtgcaggaattgtaaccctagggcctgccttaactgagcgtttcagtgcatttagtgtgttaagtgctagaactcgaacatcagaatcagttgtagcgccatgagcaatgtagtgaacatactcagacaagtatgctccaatatctttgcttggtggcatggatgacgcacataaatacataagctcccaagctcttattaaccaagccctgtaagtacaaataataacattcataagatggttgtatcccatcgaattgctatccatgagaaatctgcttcatacctgtcgggattgttacgtgtttgttttgaaatctgtgcaaagagctcatctctcagttcagaacgtttcaaagtatgcttgtaaagctttgcaacaagttcaattctttcatccaaacttattattgctggggaatcgatgcccat

SEQ ID NO: 84166 - DNA, 7952 bp, Oryza sativa
ctgccgccgatgacgacgacgacgacgacctggacgccacgtggaacgccatcatgcagaagacgcgcccggccaccgcgccggcaatggcggcccctccggcgcagaaggcgcctcccgcagggccgccgccgccgcgagcgcgcgacccgtcgatcggagcggaggagatgaaccggcgattcgacgatttcatcaagaagaatcgccactccttcggccggcaataagctccctccgatccactcccctccgccgtacaatacatatagaaattttcatcatctttggtttttcattgttcgccgaagagatcgccggagcggaggaagccgggctaatcgtatcatcatcttcaggtaacttacattaaaaataataaataaataaatctttcattcaatctagtaacttaccattaatataatcaaaaaaatattaattaccatttgtagctgttcgcaattatattaattacaatctcttctaatatatagacgtgcaatctttacgtatttgcgaaaaaccatttgttgttgtttttggtaaaaacacaattattttagaagcttaaaactcaaattaaacagtaatgatcagttaatccatgattaattcgttgatgcttacccggcatgacctgtcgtgtgcgcgtgctcggtcggttgccgcttaagctgttggcgttgtaactttaagtaagaaagaaaaggaaatggtcggcttcggcactcgcagtccggcccacttctttccctttcggtgccattaggatctaactcgtggatcatcacatctaaagtttgattatttccacgttgatctgacctttagttttgactgtgggtaaattttgtttctgaatttctggatcttcagtagttcactgaatacagggtaatggcaccctttatgttgaaaaagaagaactaaagaagcaccttgagttacaagcatcttccttttttttataggttctttgcttcgaataggaactgtacagatcagaaagcacatgcagttaccaatggttggatgtagactaataactccttttgattgtgtttgaaccagcataattttcagtcacttgggagttctgaaatttcaaattcgactgtttttccatgaaaacaagattcctattgtgacatgtgtcattgacaagtgggcaggaccatcaaattgacgattttgtttccatccatcttggaatttgcaggatgtggaggttccagaatgaatggatggatggtggatggtggtgctatggaagctgctagacagatgaccttaatgtgctgaagtgatggtttttgaattggtactttgttgttaggctctcctttatcagctgtggtggcctggcattttgttcttagctttctctttctcctcctttccttttcctacagctcttttactgattataacagtgctaattgtccaaagttcctatggagttaattctggtgggtagtgggtgtgcttgtgattatatctatactgtttggatgccacattgtggctgtgttgtttaaatgtcagccacaggtcaatgaccatgccaccaaattggtccactgttctaatgttgctatctatttgctcactgtttgaaatggataaccaacaactcatttgagtaacaaatcttagatgcatagggtgctaataatgaggagaaaaaaaccccacatatataatggtccatgtttgcatatatacaactcataatggtcaggaaagaattgatttttttgatgtgaacctttctcacaaactattccttgattccttcagtccttcaatatgcagcgacgaagaaatcctaagtggtgaaaaatcattgaactgcagaggaccaaagactttcttgaaatgtaaaggctgcaactctctgagatgacaccaatggaacatttctgtcgatcttgacatatgatgcccggagagcatttttttcagagtaatgtcgagattttctgttgctatcagtacctgtacttgtatatgcgtactttgctctgaaaaccgtgcagtattgctttcagtatgacataagcagaatcaattcctgatctgttgaagtagtagtaatactagtaatactggtcagtagtttaagtcatcatcttcctggagtactgattattattacctgatacctcataaagtgcatcaatgatgttaacttgacaaaatatattttgaagattataggagtatatgtatttgtatatgatgcttctcatcagctgatatatgctctctatgttagtattattgtttaaccacttctgtccacattcaatccagttacttctgaaatgaggctgatatgagtatttgttcataatggctactgaaagtggcatctgaaccacttcatcggcatggcatggttcctcgcatcgcactgccgaaagggccatgaaactgaaccatccttgctacaagaacaactgaatgattgtgatttggtaaggcagaacattgtatatattgcgttgcgtgaaaggcagctacaagttccaaattaatctgctttttactgtctcatcacattttttctttgtcacagtcatctacaatcggctagcttacacaccagatttccaggcctgaattcattctcatgaattatcctatcactcctggctagtcctcacaaactccattatccaacatgactggaacttgcacttaaatctgtaaaggctactactaatcctactacccctataccacaagatgccacacaaatcctaattgttattgcaacttcagacaccctgatcatccctggtagtaacacctgtgccatggacaagtctttgcttaaggtcagtaggcacacttagctgctgccctaggcttcaattatgatcactaaactatgcaagagcagggctttgcacttgacaaacatcagaggagcactgttatggcgaccacacaaccaccatctgataattttcagaaatttcttttacatatctttctgcatgaacagagcctagagctgagctaccagtggtcctcatgccagcactcaccaccacaactgtatacaatgtaaaatatgcagaatgcagtgtcatctgcagttcttgttgtgttcttgcgttaacctatcatgctgaaagcgacgggaggagtggaagtgcagtgaaccagcagaggcagcagatcacgaggcatttgcagggataagcagagccagtgcaggaaatgtggtagtgtgaagttgctgccgagaagcatcagctaaagcgtcgccgtcgtccccaccaccgccggcctagctagggcttgtcgccgtcgccgggaatttttagggtgatctgtagccgtcgaggcctctggtgcgttcggcagagctcctcgtgagcctgtgttgtagtgtcactcacggctcaaggtgaaattataaatggtgactcaaaaaactcatcgtatcatccatatatatcagatatgcagatgccaatctgaaaactgttcaaaaattgatgtgctaatcttcagactaaagtggacgttacactggacggtaccacaaatggcaccctgtttatcgaaactataattcggcaatatgaaaagggtaacgcacaagaaaaaagtggatgggttatgagactaagagtttagataggttcagacctaccctactcctgtttggagattgaatccgccgattgtagtattaatctgatgatcttcagtgtggttatgccctaaagggacaccctgccttccttatatagtcagaggaggcaagtttacaagataatttacatttctataactactttacaatcgtaccaaactaagaacatgtttccttgatacacaaataaatataacacccaagtcctaatcctatacatattctattcatatgatctatcccatatagtcagtcggatagtgcagccatgtgggtatatgatacccataatctctacactgttctttatagatatttttctcagggttttcttttttttgctatggattatctgctccactcttggaaaaatacgatttctcaaataactttttctactgcattgattagaccatccattcgagagtttatcgcgttggtcaaataaacaatccgcactaataatcaggagaaaaagctatctcaaaccagggtttgcaaaaccgccggtaactgtgcggttatcgcggggtacggtaaaaggaaaaccgcgataacctccttaaattcaaataaattaaagaaataatttaaaattttgataaattttacatggtttcgtacggtttgctacggttaccgcggtgcttaccgccagggagcgataaccccggacccggtggtttgggaaacactgtctcaaacaggggcctagtgatctatactgttgttagtacgcaccatagatggagtgagtgattttggatgcgtaaagacagctatacttatctgaagttctgaaactgttcgctgttgtacatgagaaagtttgggtgagttatcactgaaaaagaaatctttaggcgattttggaggaagccatgcacaggaagatactcccaccctcttaaaatataagagattttaaatagataggacactttctagcactacgaatctggactaaatctcttatattttatattttgagaggaaggaggaagtagttgcggttggagagtgagagtgtcatacattcgatcggcatagtcgttgtcaggccaggtttgtgtggctaataggccatatgattgcatactttgccatgctgatcaaacgaatcggatcactcagatggttgatttggatggccatgcactagatttttttttcctccttcagctcttgaaacagctggtgaggcgccatggtccaaaaacaaagtcatgtcagaatagtcctgcatatccaaacaaccgtttaggtgcgaacctgtataatcagatgttaatcccaacgtttttacttttacttctaaaatttattgttaattacttggaaaaaaaaagaaatgtaacataggatttggttttcatgacaacttcactcattatcgttttcacatccaactacctatacagatgatttttttatatatacggcttctatacctataagtgggaatacgcagttagaagttataggaatacttagactccatgtctcataactaaggaacaacacaataaaataacaataaaaacaaggctagaagataaaacctcaaatattcttcggtcattgctttacctagggttgccgccgctccgcctagccatctcagtgacaagtgtcatagcacggtggactctatggctgcacatcgctggaacacgcccctccaaaacgcctggctaacttgcaaccgcctccactatcaactcccttagccaccaccatatttattacaagccttgtaggaagataatttttttaggcgaattttgactgagacttgatgtccatctagtgttgatcctaggactctagccttgggctttgtttcttctagaggattaccattttgccaaagctaatcatgaaactccatccagctttggtgttttcaggtgtttagtggagctttagggtatgagattgaggtgtttgtacgatggtgttttcggtttgaacctttctagggtcgatgtgtatctcttctttatcaatgaaatagactgcacgtagcgcagatgccatggtgcagccgttgtgctctccgcgacctgcgtttgactctggccggactcgctcatccccttttttaataaattcgacattggtacttccccagtgtctagcctttttttttaaataaggcagtgcctctgtcattgtttctaaaaaacaaaaaaaaaaccttcacttcagctcttctcattgtcaatctagcttagcttttttttaaaaaaataaataaataaataaataaggcagtgcctctgtcattgttaaaaaaaaaaaccctccacttcagctcttctcattgtcaatctagctttttccctagggaaagtctatgtagcacattactaaatcaggaagagcagtatactctttaaaaaagagacagtgaaaagaaatgtatatgatatggttcacatagggatcttacagaaaccgaagcaaacttcttcttgtaaaggtgacaagcaaattgtaaccagtcataggctctatgatgatagatgtttaaacactgaagctctatgtttcactatgttgtcttcacacgatacttttgatcctatgctttagtttgtgcctatgaagctcaagttaaaatagggtgcacttaggtcgtcacaccaacactccctaaaatcacaatccatcctgttgaatcgaaaggatctagcagacgacagccaagtccaatcacaacattagctgtctaaaatagtgatcaccttctctgattacaattgttcttacctagttacctccatggctccatgttaccaaagcaaattttcatctttctccagaaacttcagcaacttcagaagtaataatcccacagcacaacagcaatataaacgaaaccatcggttgctctgcaacaaactgttaaaggtacaacacaagctactaccgatggcgatggctttaagactttcagctatgagttaaaggtagtttctatctatttcgctgttgcaatctctgatgtggactattatttggaaaaaaaaagagttactaaataataatccatagtcttgtacttttatctatgaagttaaaagtgtggggcaacacattctccaataacaaaaatgcattgccttgtaatgaggctttcagatgatggtctcaagacatgaagctgccattccacatcaggttttcttagtcagcaggctgatagcgaacccgcattcttcgctgttgttgagatcatttttgcagctgcagtccacaataggcatgatgacattcggcttaatggccttctccccacgaacaaccttcaaaagagccagcacagtagaggcataaggcaacatatatggaaatatcagcaatacaacttcaggaaaatatctatacatttcttggattttctcataaagattagccatatgtagaaaccagaaatccaatagattatgggggtgacaaaaggaattcgggttacgatcgacgtactaatttctcagactccgagcttttgtagatgatgaatatgtcccctgtctggagaccatgctgcttcacaaagccacctaaagagagcaattcatcagctccagtacaaactaagaaaaatccaaaagtatatgtttcaatgtttaaacgtacccgtgctttccaagacatacattctgctcttgttgttgggccagaacctgaaaggtatctcctatgagtaatatgtagcggattacaagccatatatgtttgtgtttctcgcatgtgacccaaataattacgaaaaattttgaaaaaaaaaagtgacaacgcagatgattgtatcacctattgcttgtttgtaaaggtcaaatttttatctacagagagagaaacagattaacaaagtcaactaaaaatgtgattgcactttccatagtctgatttgctgtactgtttctctatgcgtagatcaaattgcatatctgtgcaccgatagacaacaccattatatattctattctatgtttaagattatttataactatttggattgcatgctgaaatgaggccacatgcacttgataatgtaaaatactttctcaagataggattgaattagataatactacctccgttttttaatagatgacgccgttgactttttctcacatgtttgaccattcatcttattcgaaaaatttacgtaattataatttattttgttatgcgttcctttatcactcatagtactttaagtgtgatttatatcttatacatttgcataaaatttttgaataag

SEQ ID NO: 84167 - DNA, 2538 bp, Oryza sativa
agctataccaattcataaatatatccagttttactccctttctttccttttctttcttttttaaaaagaaaaatagaatggagcaagtacaagcatgcacctatcgatatgtatataacttgcttcctgttcagtatcatatcgatcagctagttttatactatctcacactcactcacagtactataattcatcgagtcatacttatttaaaattagttcttaatattttagtcagaacaaattaattagagggcactgtatgattaagtaaagcaaacatagggcatcaacaaaggctaatcttacgctatttggtccattcatatgattgcaaacggcgcgaataaaaattattccctgatgcgaacaataattattgacaaatatagtggaactgaagaataaaacgatcgatcagctagggtagtgttcgtctcctccggaataaattaatacctcgtttccatttttttttttaaaaaaatatcacttaaatcacagcccgttctttctgatagctcattagattatcgagacggattatttattcgttttatgatttttaaaaattattaattttctacaaaaatattttacttattttgttaagaaattccttattttttatttattaaaatatttaatttatctttataacaaatagataatgtaggataaaagtctaaatcaatcggcgtgcaaaattgcataatgtattttcctttcagaaaagaattaaaaaaatgcatagagcttctggagcaagctagctagtagtattctcttcgtctcaaattatataacatcattatctaggaatatcaaacttgatatttttttattaatgatcatactaattatatctatgctaaatattatacatgttatatcactaaattcatattttaaagtattttaatgtaatgctaatttcataggaatatgaaataaattattgatcaaagcatatcattaaaatctttttaaaaatatagaatttataatttaggatggaaggagtagtaagcattcatttttgttagaattgacctgcattcaatagtagtagtatggtactcactccgtcccaaaataaatgcagttttgcactattcacgttcaacgtttaaccgttcgtcttatttgaaaattttttatgattagtatttttattgctattagatgataaaacatgaatagtattttatatgtaactaaatatttttaattttttcacaaatttttcaaataagacggatggtcaaacgttgggcacggatatctacggctgtatttattttgggacggaggtagtagctgtaatacgcgggagatatattcaggtaaatcccatacgattaggacagtgaccgacgtaatcaattctgtcgttcgatcgcgataacgcacgtattttgagggacgagaccgccatgcttgacctgaatcggttcgagtccgacccgtcgtacatgttcggatcgcgctgacgaactggtctccatcgtttcccggatgtgaatgcaggtcgccatcaatcaatctgtttctataatctgcattcagtttcggccggccgctccgggagtgactacaacgacgcttaaattggtgaggttttctccaaattcagtctcaaaatcatagtcccaaaaagatacacatattattaatggcaaatccaaaaagaaaaactataagtcattttgacttattttcttgtttgatcaacttcatagaaaaatatagcaatatttagaacaccaaactagtttcattgaatatattttaatagtttgtttgttttgtgttaaaaatgctacttaagcttggttaaacttaaataaatttgattagaaaaaaagtcaaaataacttaaaatatgaatcgtatgaagtatgaaatatttgctcgcaatgaaaaacattttaaatccattgcacatttacacttcagaccgacgagccagggcactggatggtggatcctcccctacatattttgcatcgctgaattctaatatccgagcacaaaggccggaatgtttattctattattaaaaaaagataatgctgagttcataataattaattttaaagatgattcataataattagtagatgacacaaatgaataaagtattaattgttttaaaagttaaaaagaatgataacaaaatactttaagaaacaccgatgataatttcttataaaaaaaaccccaccatttcagcttgcaaaaacgtgccatgataatccgaaccaatgatctacaagtatagagaaaaaggttgatgatgaattgatgatcttggcatgggctgcatcgatctgcacaatctgccgctctgaactttctgaagccgacgaacgcacgcaacaaatctgaactctgaatcttttcttacgataataatgtctgaaactctgaattagccggcgacgtaatggacggcccatttcgccgtggacagatcgatggatgctgggtgatgtggagtggagatcctatgctgtaatgcacatgcggtgggtgt

SEQ ID NO: 84168 - DNA, 531 bp, Oryza sativa
ttaatcgcctttggtgattcataccgaagatcaaattcggttaaagcaaatattcactcaaaccgaaagtcattacaacctactcaaacaagccgattgcacaaggacatctgaaagccgtcttatgaatgtcttcttctgccataaagatctgattgttacctgcattgacatccataaaacataatatcttatgccctgaagcagcatcaaccaattgattggcaaccggcattgggtactcgtcctttggggtagctttgtttagatcccgaaaatcaatgcacaccctgactttgccatttttcttgataactggaactatgttggaaacccactcagcatatcggcatggacgaataaaaccggcatcatacaaacgtttaacctcagccttgacagcttcaagcatatcggatttgcatctcctcggcggttgctagtatggtctaacccccggtttgatagggagccgatgttcaacgattgatcggctgagtcctggcatctcataatattcccaagcaaagc

SEQ ID NO: 84169 - DNA, 623 bp, Oryza sativa
gcattacttgtccatttaaatatattaactcgagtaaataatcaataggtgaaaaagccactgatggtgaacagcatggaaatcataatgaaagaaattctgtggtccaaaatgcttcattaggcgaagatcgtaaatttaatgatgaaatgtctcataggaactcaagtgcagaacttaaacaagagctacgtgttcatgacacacatagtagggaatttccttcagatgccaaaatatcaagtcagccgaaggatgtggctcctaccctggatgagaaggcacatggatattcccaaaatggaaaagttccaccttcaggcaataatgttgaaaattttagcaatatggagagcagtcaagggcatttagggaagagcagcaatgaggaagattttgtaaaggagccaaaggctgttcgaagaaaagaatccgaatcttcttccaaaagatataatgatgatgataaatctagcatgtatggaaatattgataaaaagggtagcttcaaggaggaaaaaggatctgacaggagtgtgagacatggagctgatacaagggaaccccgttccagaggaaactctaagcaggatgatgcaaaaggagagagaaaagattatcaa

SEQ ID NO: 84170 - DNA, 524 bp, Oryza sativa
tggcaaaatactttcatgcctttctagaccagataagtggcgaacataatcaagttgtccagatacatgccgagagggtggttctttctccaacaggctcagtaggggacgaatttgatcattttgaccactactatgcccatttgatactagctctatatgctttggtgatctatctgttgatgtccttcctgcagaaacactaagccgttgtggcctaatgggatcattatcatttctctccatgtgaccagcagccgccatatcggtgaatctaggcgatgctgaaggatccattatgatatgatgcctatctgcatctgcttgtaaagattgcagtgaaccagatgaatggtgatgatccagcctcgttttggaaatttctagcattggcggatctaattgaccagaccttcgcctgggggtggagccattctgtgttactgaagcaccagacccggagatggaagcaaaccttgttgcttcattcaagctatgaagagtattgaccagcctaagaagta

SEQ ID NO: 84171 - DNA, 1528 bp, Oryza sativa
tgattggtgaacacgtcggcgtcggcgagtcgaaaatgatcatcaacatcagtcacctctgcagacggtgcaaggatgcaaccaggggcatagaattctgatggtaccttgttctcagctagtcaagcgattatctgctttctcctttggtgtcctctcttcctgtatttcctccaggtcgtcgtcttcactacgcttgccagcttgctccttccaataagcaattaacttcttcaacctcatgatttcctttggggcaacatgcttgctcgtatcattgacaatgcaacgcactcgtgaagcatacctgcaagatggaggaaaaaaaatgccagtcaatactcaacaggtgtacacgagcaccaggggcataacacaaaaagacttgtatactggagcaatagaaattcatacatgagtgaattgtaagtctcctccaggttggactctgctggtgagacattcacaaacatcaaggttttcgcattgcctccaagagaatcactcatcagcattgtcaacttatggttccgataaggtatatgttgtccatcagaagataaagccccaatcacatcagccaatgcagaaagagacttattgatgctttgagcttctttcagttgttttcctgctgagccggactttttcaccctctcagaaccagcaaggtccacgaaacttagctgttcacacggaaaattttgacagcttagaatagcatctcacagcctagcttaacatatagtgtgttctgtgcagagtttatttattcttaattaattatagcaaataaacaacacaagaaaaataaaacttagaacatagtttgatgtagatgcctaaatcaaatatgcaagtgctacagcaatgcgtcggttttatgaaatatatattccgacaagcattctgcgatagatactcccagtcaaaactcaaaacaaaaggctgtcaaattacgaaaataactagatgcaaagagttattatgggcaaacaagtgtcatacataagaaggcaaaacttatcaacttgaggtaaggtatggtaatcaatcttcataatacgtccactgaaatatggacatatatggtagatgtttagtttgatatctgaggaacgtaccatgcaaaggtatatgtaaataggtattttgtaaaagcggcaaatttaaacaatatacaggtaagtgatagagacggttaaatggagacaataagaatactcaaatatagtttttttataaaaaaaattgtgaaacaaattggttatgcgacacagcaaggctagcatgaggtttccagttacaacccaccatacctttcctcttgcataagattgagtctggaggttggtactttcaataatgattgaaagaattaaatgagaccttgagctctcaacattcatatttgttccagcggtgtgtcttctctcggaacctcttaaaattatagccctcagttcttcaaaacttgaaatgttcacaactgtcacattttcaacagtaacaaccccctaaaaggaaa

SEQ ID NO: 84172 - DNA, 719 bp, Oryza sativa
gcacgcctgcaggtcgactctagaggatccccacctgctccacctgctgcacgctgcacaggctccacggcctcgccggagatccctccggccgtatctcctcagcgtcggcgggtacaatggccgccttgttcagaaagctcagctgcaacgtgagttatcgtatacacttgctagtacttaatttattttcgttttacataatttactatatattatcaataaaaaaatcaagcatacaatttttctcttatatatgtgaatgatggggggataagtgtcatttatcaagagagttgttggttcgaggatatttgaactaaaatgaaaacttgaaggactaatatggatagattggaatatcaaggactaaactgagccttagatgaaacttggaggaccactttggctattcacccatgtttttggatttcccccactaaaaaaaaatctttcagtcttctactagtagagtagataaaaaataataatggaactgtcaagcaattaaacaagaactattaggttctaaacattatgaaactgtatgcattacaagagaacattggaagctttcctacccgcaagtccaggataggttcaatgtttaaagttttacaaatcacaacacacaaacaggccattaataagaagtttggcacaaaagcccagaagtattttccacgggcacactaattactagaatatttctacaggtg

SEQ ID NO: 84173 - DNA, 1690 bp, Oryza sativa
ttgcctattgtgcatttggctttgaaaaggtttgtataaatctatatatttcctgcatgtcaacattttttgccagtagcagtttcagcttccaaataaaaagctatcttcctctttctggaatatgaaaattttgcatgatgtaccgcccatccttctgttattcgatgaacttaacatctgaattttgggtttgattcccaaatcaattggatgagattaaaatattgggaagaattgacgcaagaagctaagttgtgtgataagtgatctgataggttaaaattttgtctttttttatttaattacaactaggtccaagatatatggattggaggattgcttactctccattgatgaaacctcaactgaacccaagcaacttgtgaatctgtatttgttttttccggataaaaactatgataattttgatagaatattgtccatatattccccacttggttgtaggtcatgccagagaaatcattttttgggcgtcgaccgccagtgcctctttggaacaaggagatacatatcatcgttggagagccagtggagtttgatctgccaagcttgaagcaggcagcaagaacagtacctcaggattcatcttttgaaaggaagggttggccaagcatcatgccagacggactagatgaagcggctcagagatggctttaccagaagatatcagataagatccaatcagttatggagacattgcggaagagacttctcgacctgaagcaacattgatatttggctgtttacttgcaatccaaggaggcacctcctttttttgaacaataccttcttgaaatggtagaatatatagcttcattgaacagtttcagatgatgcaaagacgattgagagtaggcagtggacgctacatctgttgaggtgaaaatttgagacgacggtgagagatagaactcagcatgttagattacgaggcatttctttttcagtaggtcaagaatatttgtcaagcgcctacttttctttttattgtttggaatggtttgccatgtttacgaggcatgaataaagtcatcgcctattcaacttgttagatgttctattcttggcttgtttgttatttctgtcttccccggcactatgtgcagctttggtttaaaacctctttgcaccccagagaagataggtgccaaaaggcccaaaaccgtggctcgcacacatgatctgttagtatagactgtagtagtgcttctgcatagtgtgttgcaagctgtgcccttttttattctgaacctgtggatgaccgttttactttccagatcccagtagtgttggtgttggttgttggatactaccggctcaaggaccaaagatccagaagggacaagttcgagcccagacggacccgatgtgcgatggctttttctgaacattattcggctgaaccgcacgaataacaggtatgtactactagtatatcgaggacgaaaaatgcaatcccacggaccactggatcacatgacgcaacaactgtgcgggcgagcaccgtttgctgtacgcattcgctgttttcttttcctcttttcgaaagtgacccaacatgccgccggccagccagccagccatccagccatggtggaaaccgtcatttttctgttattctgtataggcagaagcagctgtctccacgggcaacagcaggagcagg

SEQ ID NO: 84174 - DNA, 546 bp, Oryza sativa
ttattttctaaattttgaaaaaagaaaaggtgcagcatgaagaagcatcgtcaagccaatgatttgtagaataacaaagtagatgaaactaaatttttatgctaacatatagagcagatagaaggaagtacaaaccaacaccaaactgattaacctatgggacttcttgactaaatgatttgcgaatgttttgagtgctgttgaattgaataataagagcagtggattaaagttgatacttgccttgttgcccatataacccattgcacctacaccgacagttgatactctcaaattctgaatgtgcttccgcaagtctctccgaacccatattgaaagatatattcccaccatttgcttgcttactattcgcagaaagcatggccttttacttttaatcactccattgtcactgttaacttgatgggataaatcatcatttggaaaattcactgttgatttcaaagatgctggagttgctagagccttcagtgaagtgctagcccgaagacactgagccatcatatccaatggctgttcaggcca

SEQ ID NO: 84175 - DNA, 572 bp, Oryza sativa
acaatagcattcaggccagcatgtggatgcaagtactggacttcagcctgaaaccaaacacacggaggaaattatacaggactcaaaattgagattcagcatattgtacaagctagaaaagaaatggcatgtacctttgcagacttctggtagggaaaaggaatggatagaattcccttcaggcctggagtgcccagatcatgaactgtgaatgtagttatcaactggcaaaagagataattaatcagtcactgctacagaaatggcggccttaatttcatgctatgcataatcagcaaaggcatggtaataaaaaagttatggaagagagagaagagaagaagaaaagaacgtgcttttgagtctgaagttgctttcacatccacggacacattgttgttcttcacctggctctggatttcagagaagatggactcatttttcttcgtgccagcaacagtgattgcctagaaaaagcagggaaaaaacatacctcattataatcttgggaaagtttcatatgcaatgctacagatactaagtttagccaaaggagattgacaacaaaacgt

SEQ ID NO: 84176 - DNA, 735 bp, Oryza sativa
ggcctttatgccgccgttgttgggcgtctacgttttcaccgaccggcttgccttcgccgccaccgactggtgtatccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtctccgcctgcacggctggcctttatgccgccgttgttgggcgtctacgtcttcaccgaccggcttgcctccccccctccgactggtgtctccgcctgcacggctggcctttatgccgccgttgttgggcgtctacgtcttcaccgaccggctgcctcgaccgccgccgactggtgtttccgcctgcacggctggcttattatgctgccgttgttgggcgtctacgtcttcaccgaccggccgccgcatccgccgctgactggtgtcaccgcctgcacggctggcctgttataacgccaactgatgctatcttcttcacggctggctacatcgctgtcactactaataggcatcagtatcttcaacacaagctgcctacgtttgccatggctgccgactagtttcttcacttccatggctgcatgattctgccagtgttgattggcctattatgccgctgttgttgggcatctacatcttcatcg

SEQ ID NO: 84177 - DNA, 565 bp, Oryza sativa
ccgccggcctgcctccgtcgccgccgagtggtgcctccgcctacacggctggcctattatgccgccgctgttgggcgtctacgacttcaccgccggcttgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgactggtgcctccgcctacacggctggcctattatgccgccgctgttgggcgtctacgacttcaccgccggcctgcctccgtcgccgccgactggtgccctcgcctatatggttggttggtcacaccaccgttcatgggcgtccacgtctttaccgaccggctggccttcgtcgccgccgactggtgcctccgcctgcacggctggcctattatgccgccgctgttgggcgtctacgacttcaccgccggcctgcctccgtcgccgccgagtg

SEQ ID NO: 84178 - DNA, 661 bp, Oryza sativa
ttcctgcagccctgaacaatgaaaaaatgtacacatcaatttcttccccaggttttgcaggtgtgccgctgtcattaacaacatgacgaatgagattagtgttgtaggtctgagcattgtcaggtgttgctccggtctccttagctgcccctttgtttggccaccctgtctcggtgaccatgatcttcagagtcttaaagttcagagccatcagtgcaaagaaaatggaatcgatctgcgcatcgaacatgtttgtgtaaaccagtccggtgttggggtcaatcacatcctgagactgcggcgagaacagcgcgtagttcagcgagacattgcttggtgagttctggtacgcatagtaggggtacaaatccaccatgaacggtgcctggttctccacgaggaactccagcatcggcttcaggaagtaggcgtagctgctgttgaacgcccccgcggacggcggaaacgaccgggacagtatcccgagcgagtgcgtgctcgagatggtgatcttcttgtgcaggccggccttcttgagggcagtatgcacattgcgcatggcaggcacgacgagggcggacacgttgacggggctctcggtgacctcggcgccgacggtgatgtaggtgatcatggtggccgggtagtaggggaggatgct

SEQ ID NO: 84179 - DNA, 717 bp, Oryza sativa
tttcagttgcataaattttgtaggctgcaagagatacagaagctctcaaggtagagaaagggaaacttgaggagcatatagaagaattatcaagccgtttgtgtttggaaaagaaactgagggtaaatactgctccttgaattatgacttatttagagaagaagatttacttcatccatcccaaattaagttaatctactacgggatatgacatatccttgtactatgaatctggacaagtgtctatctagattcgtagtacaaggatatgtgacatcccatattagattaacttaatatgggacggaggaagtagtaggtcatattgttgggtgacattatgacacatatctttttcagagtgacttagagaatagcaaagcaacggaaatttccaaattacagaccactcttcatgagatggagcgtagagtagaagaagccagagcaacacaagaaagagaatcagccaaaaaggttgtggaagaagctctagttctagaaagagagaagatagctttattgactaaagaagttgaggagctgaaggtactttttcctcaatctgagcttattgaatatcctttccatatgtttcttaagaaataaatctctgatatagaagtaacttattcagataaggcatgatatttgatggttatagataaatgtgacttcgacaggtactactgctaaaagaacaagaagaaaaaaatg

SEQ ID NO: 84180 - DNA, 647 bp, Oryza sativa
ttatactcccagggtacatgatcaccctctgatataacaagtccagagaagtcctcatttgcccaatcagtggccattacatcaccttcctcatcggatgatgcgtcgtcgtccacttcctcattatccgaatcttccctctccatttcatcaacaattataccgactctctccccctcatccgccatgcccatagcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcatcagtgctgtccatcggcattagttcccaaaaataaccttctgttgcacgactcactacaactgacactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcc

SEQ ID NO: 84181 - DNA, 687 bp, Oryza sativa
cctagtagccactagcagggattcaggaacatatatagttgcccatccctattttgtttttcaacaacttttgaaccacaaaatgttcaaatactaacaaaaaatagtattaatacatgaaaatggctagtgattagagttgatcactcacagtaaggactgggccaatggtcaagtcttcaagcttccttctttcagaaagacttttcattttatcaagaagcccactagacgaccaattctgcaagttaagaaaattaaacaacagattaagatatgaaaagtaacacaagctcaactagcttccaaagctcaaataaaaaagaaagacaaattgtattttccttttctcaggagcactggacctattgtcttgaaatcagtaggatcgatattataagacagtcggtcttaaacctagtgttgatcattggataagttactactgtagtcataaataaccttgtccataagtaaatggctcaaaccatcaagataaaaaagaagcatgtaacataagttatatgtcaagagtcatgatcacagtcaaagactcaagcaaagaaggaacataatactaatcttcactattaccttgtgcatgaatagaatagactgagcagagcacttctgaccactgcaagcataagcatcctggtcgcaaacccatgcaatgtaatcaacctg

SEQ ID NO: 84182 - DNA, 605 bp, Oryza sativa
cgctgcgcttcttctataccaatgccttcttcattggaaatcgtttgaaacagcaaaaacaagtgtctttgacagtatcctacaagagataaactcagcaatagaggtttgtggctcatttctttgaatatttaaaccttcttgttctgtagctgtactctagtagcacatatcctgcaccttgtaacatgatacgagacatctttatgcagccacctggaatccagaatcattacattgttataatattaactgacattcctcttacttcaaggctcaacatgatacgagaagcctggcctattggttatccaacctgtcaacattgtcagttctcctgcaactctcatttaaaaccaccagggcagcaatctcaaccccacatagacggagattttcctacgagaggatttttcaagctagtcaaacttcaaatagcggacttgcttatttcagtgctcaaccggtggatgggcctagtggattgcaacaaattgatgcaaaatatccagctttgctcttcaagcagcagcttgtggatctgattgagaaggtgtatggaatgataagtgacaaggtgaagaaggagcttaacccgttacttg

SEQ ID NO: 84183 - DNA, 509 bp, Oryza sativa
accacgaaatagttgcttaagtcgtttcaaggttatagagcatgaagaaacaaattcaaacctgttcactgaatcctcaagcaaattgattttcctgtctgaatcctcaaaactttttgttaactctcggtttctactttcagcttcaactagtgcttttgttgtcgaatcatgactttgctttgtctttagcagcaaagactcccttgctgtcgcatgtttctcaagtctaaatttattgaacaaaagtaaataagttagctcataatgctgagaagatagcagtggcgctctaagttacagaacacatatactgcactgtttgaatgaagtagcgcaagaacctttgtgcattctccagaagcttatttattcttttctccgcttcatcaactttctgaagcaattcccagtttctttcctgagatttagaaagtgattgctttgtttcatcgtgctcttgcctttcagctaaatacagggcgtcccttgtggttacattttcttca

SEQ ID NO: 84184 - DNA, 537 bp, Oryza sativa
tgtgatggcattttgcatacatgtttactagggatgcactgatgaaatcaacaagtagcccaagtttaagagctaaagagtgaatctgctttcccttgacatgtcttcaagtcctgtacaggcatttattagattagcaacacagtgctgatctaatggttctccagagtttcttaactctaaaaaataaccaaatgctctttcatattgtaggttcttgacacagcctgccatgactgcagtccatgatatgacatctcgggattgcatagttttaaagattgattccgcgtgaatcaacgatccaatttcagagtatatcgatataagagaattgcaaacattagtataagataaatccccagttctgaaagtataagcatgcatctgttgaacttcctctttggtctgacagatatttatcacagtaaccaaatccccttcccttaaattgagacccgaataaagaagaacctctgcgagtttcacagcttcaccctgacaaccatttgagtgataacctgagattgccaaaga

SEQ ID NO: 84185 - DNA, 542 bp, Oryza sativa
cccgggcgggttcgagtatctgtatgtcgctatcgacaagttcactaagtggcccgaggcttatccggtcatcaagatcgataagcactccgcgcttaaattcatcaggggcatcactgctcggtttggggtgcctaaccgtatcattacggataacggcacccagttcactagtgagctcttcggtggctactgcgaagacatgggcatcaagctctgcttcgcctcacccgcccatcccagaagcaacggccaagtggagcgcgccaacgcggaaatccttaagggcctcaaaaccaagaccttcaacatcctcaagaagcacggcgactcgtggatcgaggagttgccagtggtgctctgggcaaaccgaaccacgccaagccgagcaactggggaaacgcctttcttcctcatctacggcgcggaggcggttctcccatctgagctcaccctgaggtcccctcgggtcaccatgtattgcgaggctgatcaagatcagcttcgcagagatgacctcgactatttggaagagcgaaggc

SEQ ID NO: 84186 - DNA, 762 bp, Oryza sativa
tcctgcacccccccgctgcctcgacccggcctgcgtcggcttctcccagtgcctcctcaacttcaagggcttcctcgccatccaggcgcaccgcgtgtcgcacgtcctctgggcgcagcagcgacgcccccttgccctcgccctccagtcccgcgtcgccgacgtcttcgccgtcgacatccaccccgcggccgtcgtcggcaagggcatcctcctcgaccacgccaccggcgtcgtcatcggcgagaccgccgtcgtcggcgacaacgtctccatcctccaccacgttacactgggtggcacaggcaaggctgtcggtgaccggcaccccaagattggggatggtgttctgattggcgccggggcgacgattcttggcaacgtcaagattggagccggggccaagattggtgccgggtcagtggtgctgatagatgtgccggcgaggaacacggcggtggggaatccagccaggttgattggcaggaagaacggtgaggttgagaaggatgaggacatgcccggggaatccatggatcacacatccttcattcgacagtggtcggactacaccatttgagggcgacgcgccgaggtctatttctcttcctctctgtataatccgtagtgttgatatgccaaaaactgatgtacttgtcgtgctttgggtaatctgtactgtagtgttgtatcatcagccgttttatcagtcgaatgcccatgctcatgtactgataactggtgattgatgaaatgatgagt

SEQ ID NO: 84187 - DNA, 557 bp, Oryza sativa
accctgtatgtacttgcctagttacttatttctgaatattcacattgtctttggtgatactctcctgttatattcactggttatgttaattgctcaggtatgtggctgttggcaatgagccttttctaaagagctacaatggcagcctaatcaatgtaacctttcctgcgctcaagaacatgcaaagagctctagacaaacttggtttaggtgatcatgtaaaggcagttgtcccactcaatgctgatgtctacaactcccctgagaataaaccagtgccatcagctgggagcttccgcaaggatatcaatgccctcatggttgacattgtcaatttcctcaatatgaataatgcaccctttgttgttaacatctacccatttctcagcctataccagaatccaaacttcccactcaatttttccttctttgatggtggtagcaagccagtttatgacaaaggtgtggtctacaccaatgtgtttgatgccaactttgacacccttgtttggtcactaaggaaggctggtgtgcctgacatgaaaatcattgttggt

SEQ ID NO: 84188 - DNA, 677 bp, Oryza sativa
ggggaggcaagccggtcggtgaagacgtagacgcccaacaacggcggcataaaggccagccgtgcaggcggagacaccagtcggcggcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggatacaccagtcggtggcggcgaaggcaagccggtcggtgaaaacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggatacaccagtcggcggcggcgaaggcaagccggtcggtgaagacgtagacgcccaacaacggcggcataaaggccagccgtgcaggcggaaacaccagtcggcggcggcgaaggcaggccggcggtgaagacgtggacgcccatgaacggtggtgtgaccaaccaaccatataggcgagggcaccagtcggcggcgacggaggcaagccggcggtgaagtcgtaaacgcccaacagcggcggcataatag

SEQ ID NO: 84189 - DNA, 1405 bp, Oryza sativa
ccatgtctcccttgtgctaattcacttgtttggttaagagggtatttggcttggattacacatacaacaccaaattattacagagatcattcttaaatttattctaaactacaaaaattcgaaaaaataaaatatttttttaaaaaatgacaaagtagaaaaccatgaaatgacaacagaaattcaaggaacttcaaaaatatggcccaaaaatctgaaaatattccaaaatgttcacaaaataattataaaattctagtaaaatatgctgagtagaattataaaattttagatggttatataattattttataattataaaacatcatttactcatgggagcaattgcgcgatgtctttgtccttaactttcgaggcacctacgaggagccgaagacacagcagcatctactaggcattcgccagaggccggggaaatcgataagggggtacatgcgtcgcttctcgcaaacccggtgtcaagtacaagacataatcgaggcgtctgtcatcaacgccgcttcgcctgagctactcgagggcgaactcacaagaaaaatcgccaacaaagagccgcagacgcttgaacacctgcttcgcatcattgacgggtatgcaaggggtgaagaggattccaagcgacggcaagcaatttaggctgagtatgataaagcctccgtcgccgctgcccatgcccaagtacaagctcaggtcgccgaaccacctcctctcgctgttcgccagcctcagccggcgaaccaaggacaaccgccaaggcaaggccaagctcccatgacttagaggaaattcagaaccgaccgtgcgggcaaggttgtgatggctgtcgaagaagttcaagccctccgcaaggagttcgatgcccagcaagcaagcaaccatcagcagcccgttcgcaagaaggtccgaaaagacctttactgcaccttccacagacgctatttgcacaccacagggggcagctgtcgaagcacctcgcgaagccgttcaagaacaagcacccccagccgaacagtgccaagatgtgcagcgcagagtaatccaagtgattataagggccgacctgacgaatcagctgtcgaaatggcaaaagaagatgcagctccgaatggtgcataacatcactttggcgggcgaaggggccccgcaatatctaagccagcaaatctctttcgggccggaagatgccgaaggagtaatgttcccgcatcaagaccctctggtgatctcggccgagttagctggcttcgaggtccggcgaatcttagtcgacggagggagttcggccgatgtcatcttcgccggagggagttcggccgatgtcatcttctccgccgaacttactgccaagataaccacgaaaccacgaaaccacgaagcgagtttt

SEQ ID NO: 84190 - DNA, 547 bp, Oryza sativa
atgttgacaatgctaatgatgtctgacctttcatttgtaggcttctcatggacaatcaatgtcatctttgaaaacagatccaatgcagtccaagcattactacttttaacatgggctgaaacaatagagttccatgagataacatcatcaatacccctctgagttatttcatcaaagatcatgctggcttcctccaaagaaccacaacgggaatacattgccaccaacgcattacatatgaagacattggactcaaagccattgcagcatatcaatccatggaatgcactaccacaacggtatgaaggtagctctccacatgcttttaatacatgtggtagagtaaaatggtccagcctagttccagcacgcagcatgcggcaagagacattaattgcactgtcaaggcggccttgtttgatgtgttctcggataagtagattccaccacacagctggtgacggcgtcacacgttccaacacccacagagcatagtccgtagcaccacaagcaagatacgagcttccacaccagtacctagagatct

SEQ ID NO: 84191 - DNA, 642 bp, Oryza sativa
ggtccgtgaaatttccaagcagttatgttgtaataagttccttcttgttcttgatgatgcttggcatacggatgggtatgagtggggacaattcatggtgcatctacaggataggtcaattggaagtaggattttgctaactactcgtgatcgaaaggttgcagaagtagtcaaatccaaacaaatacatgagttggtgttcttaacagagtctgagagttggagcttgttcctaaagtgttctgggtgggtggaggatgatttgggatcagaatttatacagcttggaaaagagattctgaagaaatgtggtggggtacctctagcaatcagaactattgcaggtgtcctctgtgaaaagagggagataagtacttggagagccataagagggagtgacttatggaacgttgggagtgtaaacgacagggtgtttgcatccttaaagttgagctacattcacctggcagataaactaaagcagtgctttacattctgctccatatttccaaaaggctatgtgatcaataaagacagattggttgcacaatggatagcccatggattcatcacgccgatgaaggaagagcagccaaagatattgcaagtgaatattttgattctcttgtgaaagctggcttc

SEQ ID NO: 84192 - DNA, 570 bp, Oryza sativa
tacctaagaccactggtagaagatcttaaacagttgtggaagaaggaaggtgtccccatgtgggacgaggacaaacaggaggagtttaacctacgagcgctgatgttcgtaaccatcaacgattggcctgcacttagcaacctatccggacagtccaacaaggggtacaaggtttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctggaagccagcatatagagagcgaagatggtcatgcggcgatgtggaaaaagaactctatattttgggagttaccatattaggaattcttggacgtacgccacgcaatcgacgcgatgcacctcactaagaacctttgcgtaaaccttcttggcttcctaggtgtatacggaaag

SEQ ID NO: 84193 - DNA, 986 bp, Oryza sativa
  unsure (1)..(986): unsure at all n locations
cgcggtgaanatcaantactatatggcgaannccagctcggtacccgaggtcattgcaaacgtcgtaagatataacatgcatgagagttttgatcatttacattacataaaatggacgtgaagattattttgcacaaacaaagggcttacaaccaagccccattttactgtacagaaacagataaagcattcagcactgttccaggcatggagattatacttcacatgatagaacttgctgaacataaattgcaccaaactgaagatcctttgtaacagtatttgccatccaatttgccgccctttaagaaattaccatttgatctataagcctttcaattttaccatcaggactgcgaatttcttcattccgtgccacttcctttcggttcgagcgcatcgtctgtctaagtttgtccgtccgtccgtctgcctgctgacacgttcatctgttcaccccatcgctggtgttgccgttcagcccgctggccccttgcctcgggcatcccaacagtagcaccgcacgaagaccgtgaagcagctcttgggggtcgtcgtccgtctgcagctctagcctccagcgacagcttcttctgccagtggacaggcacccactgccgtcagatggcacggtaactatatcgaatgcccttcctcagccgttctgctgtgggctccgcacgactgctttcatggtggcagtggctgttcccggcgttccacagctgcgctcgccagcgctggcttctagggtactcgagagctcgtccatcgtcgccacatgcaccatgctcactggccttagccattgtgtgaatcggttcagcggcatggcaatggcgatggctcttgctcccacaaggaatcccctctccctttctttgggatcttttagaacaaaaaaacaagcggaaagtcatgcgaaagtcaagcgaaatttcgtggggatggagtttggtttctggtccccttgccgccgatggaac

SEQ ID NO: 84194 - DNA, 1433 bp, Oryza sativa
aagagggcacgcgggcaacgaggtgcagcgaagaagcttgagggccggcacatcataacggaagtgcaagaagatggacgtcctagtgccccggccgaagccgccaagaactatgtacgtcacagcggttgggttgtgcgggataacgtgcctgtcagtacagtgtactggcgaagaacaagggcacgcggagatcatgagagctttgtcccagattcacccttcctcgaggaccacaatgctcgagacattcacccttcctgcgggtacagaggacaaagtgaaaaggtggactctgaagaaaatggcagaatagtttcagagcttcaagggagatctgtaccagaagtatatactgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgatcgaagttctggtactatgctcacggtggaacgctcaacccagctgatggctcactggtcttcggcgatcagatacgagaggctgcgcgacgactaacagatgcagtgcaagcctcctctcagggcacgttccgaccagacagagatagggacgagctgacactcgccctgcagactccagagcatccaggacgaacacgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatacaaacacaggacgaatcgacctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactcgaaggtcgaagttgagttggtccccaaggcgcgtacgaggacctcgagctggattaccctggaggagacggtgagacgcatctacgagac

SEQ ID NO: 84195 - DNA, 1629 bp, Oryza sativa
tttttcggagagcatggccgagttttggtagctcaagtcgtgtgtgacagacaaaccgggcggtccagaggattcggcttcgtgagcatggccacattgagggaaccagacgatgtcatcgcttccctcaacggacaggtgaggcgccacaactagatcagtgcatattattaccctgcttatttacaatttgttatggtcttttgtacaaatatttcccttactatattatttgaagagataattattatttttctaattgtaatccaccttcatgttaaatcatgcagatcatggatggccgtcccatgagagtgagctttgcaaagtggcaaccacggcttggttactaagacactatttaggagagcttttagttccaattctctctagattaacaatgctagattctcgctggctatcattgctaattacttcttacgatctctagctccctgaatatggctcatcaggagccagaatacgaaatgtaaatggaatgggggcattattcactagtgttgcaattcacgcagaacaaactaaatggatttcttatcaaagaataacaaatttcttattactggtaacaaaagatttcgttcactcctgctttgctagcctctcagagatcaaattcgttttaactcaaaaggaaaaagaatcaattcgtttatgcttgtctatcttattcttgttttgggaggagctcgtctatctgttgatcaacacgtaagcaaacacacagccacggggagggcccaattataaaacagcccactcgccttcatgtaatctttcgcgaaggaaaggcccagacgtccgatgaaattccatgtgggccgagaaaacgggcttttctctttttgttcatttttcttttttggagggatggctacgatctcggacttgatgtgtctaatacatatattgtatatagaacatggttgcacaaagcatctgaatccctacccacaaaacaacgtaacatggcaaactatatcttacgtgaaatctccatcaacttggatagtttcaatttctatcggctatgatatgatgcagccgtcgccgccttcgctccaccactgggctaccgcgcgaggaagcagctccaccacctccgacgtggcgtcgccgaagctgtacctcaacacgcggcaccgctcacgccccgccgccgtcgcccacgccacctgtggacgaagtaggcgcacccgctgccgcggcccacgcccagctgcgcggcgtccatggcgaggctgaccgggcgccccaggaacagcgcgcggtcgtccatgctccggccgtccttcctcacccacacccagctgccgccgccctccgcctccagcgcgtacaccgacaccgacaacgcgctcgccagcggcctgccggcgacacggcagccccggacgtcgctgcagtagccgctgtcggcgaggacgaacgcccagagcagctcgccgcgatattcgaggaggtggctggattggatctccttgcctggctcttttggccaccaccgactccacttgccttcgccggcggtggtggctgctccggtcgtcacgacgcaccaataattcttaccattggcagtagcatcttgccgtcgtcggtatatag

SEQ ID NO: 84196 - DNA, 1164 bp, Oryza sativa
gccgtcatacacgcagcccgcttgctcacgctgttgtcacccgcgcgacaagcaccgatgtcgtggtgaacgccgacggcccacgctggcgcctggcagcggagttggtgtttgagtgcaagacgtgcaacaagaggttcccgtcgttccaggcactgggtgggtacatgacgagccacacgcggctacaggcgaagctgctgagcgaccccgccgctgcggcggccgagaaggacagggcacacgtccacgagtgcgccgtgtgcggggtcgagttctccaccatcaccgctctcactgtcattctatggtctggagagcacgaggaagagagggagaggtggaggaggaggaggctggtggaagaagatgaatccctgataggtgaggcctatatgggttccacttttttttacgctgagtgccacgtaggacgaagacctagtcaatataccatgtggacatgacaagctaaaaccgacagtatatttactccggttttcggatttggggaggtgttatacctggttttatggctgagggatgcgaagcgacgaaggcaagaatgagggagaaaaaatagacttattgcatacatatatagagtagctagcagctgttgggtaacggtaacgcaacgcaggcccagagagcaagaattgaagcaaccgcatgtatcccttcccaccacatccttgatcaaggaacggaagcactcaaatctttgctcctacgcatgcacccatcaattcatatactctattgatccaatgctgtgttgatttgcccgatgcttaatcgatcagagacaatgaagcaacacgcgggctagctagtattagatcgacaaggaggaaaatgaacaagtgcaggtctagcagtagcagtagcaatagcagggccttgtatgctctcctcctcacttctcttatactaacagtaataatattgtacctcccgccttcacctgatcctgtttcccaatcccaattcgaattcgaccaactaaagcttgacgatcatccgccgccaccgcagctgcaccgccgcaggacgaagcggtgcgccgagcacctcaggtgggcggcttccttcgcctttaaacacaatgccaccctcttgctcaccgtcgatcgcaaccaggccgccggttgcgccaacttc

SEQ ID NO: 84197 - DNA, 1716 bp, Oryza sativa
cgtacaatacaaacctcaattcagcttcattcattttattcgttgcatgtcaacacccacacatgtcaaaatgctgtttctgcatctcctagctacgcctcgccaggtgatgctgcaaccactagcttattgcaattcaattgccggcacgaatcagtttgctactacatcacacaattcacaacccaactgactgacaatcgttctggtcagcccaggaattacaaaacacaccaatccccccttcttctcctcccactagtgtccatgtgagccattccaaatttgacctaccggagcagtcctcccagatctgcaacacataatacatggcataagcatgactgccctctctgttttttttttaatctcattaacacaaaatccatttaaaagtcagcatgcctataatattcaccataatgcaagcaacgtcttaagacaatacagataaaccttttctatccccagttactaccaacacctggatctaagcaaagaaatttacaaagggaaagtttcaactaaaccacacacgtagtaagaggtttcacccacagcaaatctgcgcctggaaggagtttttcacaagtaagaaagcatatctctttttgtgattggaatgagtttttcattaacataaacaaaggaaagcagcagttattgccagcacattttggaaaacagagatcgatagcaaaaggtcatatatcaaatatcgagagcataaccgccaaagtctcggtgcaaaattaattagccatgcatttcccacattcatattattgttaatgaatctagatatctagattcatttacatcaatatgaatgtggaaaatgctagaatgacttatattgttaaacggagggagtaattaatttatgatgcctacttctccttatgattcatgccatccaaaaaccgaaaaaatgttgcctgtggactaaacagatcttgcaacaactcaacataacctcaaacatggctaacatgtatgtatcgaaatgccttctaagatactgaaaagtccagatatttaggcctattaaagtttgaatcttttcattcagagtaacacaattactagaaatcatcctgagctacaaatgttactctgaaactgctgtccaaaaacatactgtactacctatagcagttgccttaaaaaaagccaacttatttatgccaatgtatcagcggagaaattggatgtggtattaacagtaaatcgatgtccaaaacccctcactctcccagcattttccattgtccaagaatattagtgacccagtagaaattagtgaaattggtgcttgggattgaagcgatgtgaggaaatgcatacatgttgtgatcaatactaggagaatatctgaggcaccgtaaggaacacataaaaaaaaaagtaccttcctactccaaagtggaggtagagataaccctggcaccaactctatcgagctgagcaacagtagctgttgctttgagattgccggcattggcgaatgcctccaccatcctccggccaacctcctcgcccttctcctccccgtcaatgacagccacagcagttggccctgctccactgatggtgcagcccaatgccccagcttccaacgccgcggccttgaccgcagccatgccaggaatcagcggcgccctggttggctccacgatgccgtcggaggacattgcggagccgatgagggtggcg

SEQ ID NO: 84198 - DNA, 664 bp, Oryza sativa
cctgcagcccaactctgtgatgcttgccgaaggtaaggcggggacgcgaacctagcaggctgtgtttggttgctacaggtaagttcacgcatgttatgtttcataacatttcaatttcttgctaacatgttggaagctaacgtatgtgacgcaggtttggatgtggatgaggcttccagttggtcggcccatgtggaggacccatcaggcttggccgcaccaggatgcagaccgacgtcccactgtagctcacctgtgggaatcggccccatctccagtagtaggccgcaggaatttggcgtactaccactacacaaacgagatggactacctacagccagaacatgtaagctattcggggttctatcacacatgaagatggtttcttactatatagtactaaatgtgcttcaatgtgttttatttttgttgctgcaggtggtgtggatgccatatcaggcacaggaagtgctcgagctagaactgaatcccatgtgccatatagaggatgcgttgaagaccctacggtgcccactgatctgcttctatgcagtggagttccagatgtgccaccgcgtgatgcggcaattcgggaggcttcaaacaatcccgcaccgtttcttcacgagtatcgacctacacaagttagtaatttcacttaaca

SEQ ID NO: 84199 - DNA, 614 bp, Oryza sativa
ctaagttgctcatgcgtatggcaagtgaaatcttcaactccatgggtggtggaatcaaattgggggactgcaatgatgatgtgatggtgctgtcaaagccagaactttctgttggtggtggggagtaattttgctcctgatggttatatggtttttggcttattctagaaaatctttgagatgaactgatctacgtctgctggttcctttgccaacatgtttctctgggagttcctaaatgtgtttctggtagcatggcatggaactggattttgttcaaaactaattgtttctgacaaaagagatgggggaggttgaggtttttcctctctgtttcaaaaaacaaatgttacgcacatgctaaatgcctaaccacaatcaactgcataacaggaagctcacaccagcataccttgacccaatttcagtattgcagcagttatgaatatgctcaaaacctgtttaaatactcctgcatcaaagatatcacttggtgtaccaccattccaagcaattataatcatggcctgcatgaaacataaaaacagcaaacatttatattttctaataagccatacaaccaagaaaacatgagcaatagaaggcatggattg

SEQ ID NO: 84200 - DNA, 532 bp, Oryza sativa
gccccgtttagttcctaaaaatttttcccaaaaacatcgcgatcaaatctttggacacatacatggagcattaaatatagattaaaagaaaaactaattgcacagttaggggagaaatcgcgagacgaatcttttgagcctaattaattcatgattagccataacgtgttacagtaacccacatgtgctaatgacggattaattaggctcaaaagattcgtctcgtggtttccagacgagtaatgaaattagttttttcattcgtgtccgaaaaccccttccgacatccggtcaaacatccgatgtgacacacaaaaattttcatttcgtcgaactaaagatgccctaacaaggtcctaaattaaggttaggttaggttggaattccgtctttccttcatgaaaagttggcgtagatttgcagcaacgccattccatccatctgttatctcccgttctgtcttttacgtagttttgtttctttttgttgttgagaatatagaaaaatgaaactgctactagtccatatatat

SEQ ID NO: 84201 - DNA, 532 bp, Oryza sativa
tagacatacatattgagatgcaatcatctaatgtgatcgatgattataatagacgcaggaaataattaatagatagatgtgctgcgtatatatacactgttgatgggtggtaaaaacagcgatccgatgagaaagatggatcatgcatatacaaccaaatcggagtacgtagctagggaggtgtgttgtggtgggcggtggcggtggcggtggagaaatcgtgcagcgtgggcaggtcgacctccccgcacctccggcagcggccggggagagggaggaataatgtactagtcccgacggtggcgcggcaggaggggcaggtggcgtgggtccccagccacgtatcgatgcaggagacgtggaaggcgtggccgcagtgcggcagcaagcgtagctcctcccccccggcgaactcagccaggcagatggcgcactccgcctgctgctgctgctgcttgagtgcgaaggacacggtggggagcgcgtcgatggctttcttcttcaggcctttgggtgcaggggatgtagcagc

SEQ ID NO: 84202 - DNA, 1866 bp, Oryza sativa
cgcgcggggcatggaataaaatagagtatgaggaggagaggcggtgcattggagtatggcgggtacaagaggtacgtgtggcgcgtgctgaagcaggtgcaccctgacttgggcgcctccgcccaaaccatggacgttctcgacatgatgatggccgacatgttcgagcgcctcgccgacgaggcctctcgcctcttcaagctctccggccgccttaccctcaccttccgtgaggttcagtccgccgtccgcctcgtcctccccgccgacctcgccaaccacgccatctccgagggcaccaaggccatctctaactacctttcctaagctagctagtctctgtttcccttcttttaattgcttcagtttgcttagctcaacagagtatgtacgtaggatcgattaagtgcaggggatttgaagctttagttgtagcctctgtacagagctactagtagatcagtctgtaatctcccttgctagctaatgtgattgtgatgtccagtcagtactagtacctgtttgctgcttaattaccgtcctaacaatatataatttggattatttttcagcaaattaattaattaaatcactgcacgtacacacatgcttgtacagtgatggattccgtgctagcttaacactacagttgcaaccagggtggatatgtttgtataggaactagctagaagggacgacgtactcttaatttggcgactagtaattagatagagagtccgtacgtccagctaattaatttagttgctgggttgggtcagtccggaagaagaaatggtgttgatcctgcgggagtggaggaaggacttgtggttgccctctgcggaggcgaggtaggcaaggaacgcggccatgtcggtgtccatgtaccgccgcggcctgccccgctgctcgtccaccagctccgccggcggcccgatcacacgctccgccgccaggctgtgcagcgacgccaccgacacgcgcgcccgccgaccgttcacgcgcacacggtgcagcacgctccggtacagcccgttgctcagtatctccaggtggtcgcccacgttcaccaccaccgcgccgggaagcggttccaccaccgcccacccgccgccgtcgccgtagctcacctccagccctctcacctcgtcctgcaggaggatggttagcaggccgtagtcggagtgcggcggcatgcccagcgtcagctccggctccgggcacgccgggaagcagttgaccatcatcatctgcgacccggcgtcgcactcctccagcagctggcggcggcaccgcacgatgcccagcgcatccagcgccgcctccatgagctcccggaacagcctctggcacgccgtggcgtacgccgcggcggccggcctgaggtcgtcgggggcgtcgggccaggaggggaggacgtcggcgaggcggcgcgtgtcgcggatgagtagcttgaggaagtcgcgccaggagaggacggcgtcgttgagctggttgaagctggtgccgtagcggacggcggcgcggatgtcggcggacatgtagcgcttacgggcgggcaggggaaggtcgaagaagaagcggcgagcggcgtacagcatggcgtcggggggcacgccgtggttgagaagctggaagaagccgtagtcccggcaggcggcgtggagcgcggcgagctgacaggggtctcgagcacggagggcggcaaggtcgacgacggggagcagagcaggtggtgtgacgtagcgggcggggcggtcggcgggcgggaggacgtagcgggcgggcagggtggtgatgccgctgtcgcacagctgccggacgcccagctcccactccgacgagcctgagccttcgccgatgttg

SEQ ID NO: 84203 - DNA, 730 bp, Oryza sativa
  unsure (1)..(730): unsure at all n locations
tttaccatcaggactgcgaatttcttcattccgtgccacttcctttcggttcgagcgcatcgtctgtctaagtttgtccgtccgtccgtctgcctgctgacacgtccatctgttcaccccatcgctggtgttgccgttcagcccgctggccccttgcctcgggcatcccaacagtagcaccgcacgaggaccgtgaagcagctcttgggggtcgtcgtccgtctgcagctctagcctccagcgacagctcctcctgccagtggacaggcacccactgccgtcagatggcacggtaactatatcgaatgcccttcctcagccgttctggtgtgggctccgcacgactgcttccatggtggcagtggctgttcccggcgttccacagctgcgctcgccagcgctggctcctagggtactcgagagctcgtacatcgtcgccacatgcaccatgctcactggcctcagccattgggtgaatcggttcagcgccatggcaatggcgatggctctgcttccaacaaggatccccttctccttttctttggattcttttagatcaaaaaaacagcggccaagtcaagcgaaagtcaagcgaaattcggtggggatgagtttgatttctgctccttgcccngcgattgacgccactggcnccgtacattttntttgtgccttggtggntctagcatgctcttcattttcgggcttttcttttggagaatggaggata

SEQ ID NO: 84204 - DNA, 1007 bp, Oryza sativa
aggccagggagcaggctgaggagggaggagaccggcgagggtgcggggaggccgggagagtcgtcggagtcatcccccagccgccgccgtcgtcgtcgttcgagccgctcccgccggagtacgatgagcccagccatactcgttgctgcgacgaccacctctggcccgacgacgaccgccgtgccccgctacccttccccgacacctgctcgctcgaattttgcgcggcggcggagagaagcgccgcccgcctcctccctctcggcgcgctcgccgcatcccctccgcgggcgcttgccggcattgcagctcgtctcgacagcctcccctccgctgtcccctcctcccgccgcctcgagctccggcgggcgcggtggggagggcgagacgggcggcgggcgccgaggacattaaagatgacaacggcgagctcgggcatgcgcgccgacctcccgatggcccgagagagaggggtgagagggggccacttcgtcgccctcgccacttcgctgccctccgccgcgacaggggagcacggcgccatcacgcctgccccaccatgcccgccgcctgccccggccccaccactccccgctgcgcccgccgccgcgctcgccgcccgtccgcgtgccgctgccgccgcccactgcccgttgacgcacgcttgagagagagaagtggaggggagggagaagagagagagggagggagaagagagagatagggaggggtggggatctgacagtgggtcccactaattattttaagagagggtggatgaggtggaggccgacatgtggggccagtgccacgtgtgcggccacgtaggactgccacgtcagcaagtctatcccaaaaccacctaaaacagtgctagggggtaatttgcccagttttaatagttgagggtgtagaatgtctggttttgagttcgggggtataattcggtcgacctcgatagttcaggggtgtaattcgtacttttttcttataaaaattaaagatga

SEQ ID NO: 84205 - DNA, 677 bp, Oryza sativa
gcaattttcttttgagtggtatttctcattctgattatgatcatgttgcacatcttgaaactgctcatgagatttggaatgctttgaagaattttcatcaaggaacaaataacattaaagagcttcgtcgagatctttttaaaaaggagtacattaaatttgagatgaaatctggagaggctttggatgactatctttctagatttaataaaattttgagtgatcttagatctgttgattcttcttatgatgctaattatccacaatctgagatttctcgtcactttttgaatggtctcgacatgtctatttgggagatgaaagttacatctattcaggagtctgttaatatgtctactttgactttggattcactttatactaaattgaaaactcatgagatgaatgttctctctcgcaaagttgattctaaatcgagtgctttggtttcttcttcttcctctttggttgttgatgcttcttcatctatgccctcttttcttgctgcttttaatgccacatctgatgatcaactcgaacaaatcgaggatgaggatttggctttggttgctaaccgaattgctcgagctatgaataatgccaggaacaggaaaagaggtggtccaaatcgttgctttgagtgtggttcaattgatcatcttcgttcgcattgtcct

SEQ ID NO: 84206 - DNA, 678 bp, Oryza sativa
gaaaataaaatccgattctgtgtaaagaaaagggcgaaaaaaacaaaaaaaccaatctgtcctattaaaaaaaggaatcgggaaaaaaaatccgatccaaaaagaccggacgaaaataaccgggtgaaaaaaagaaaaaccaaatctgtccgatcaaaaaaaggcgaaaaaagggaaaggaaaaatgaatccgactacgtcaattctgtaaaaaaagagcgaaaaaataaaaaaaaatctaaccaggcgaaaagaagaaaaaccaaatctgtccgataaaaaaaaggggcgaaaaaaaggaaaaaaaacgaatccgactgcgtcaacgcagtaaagaagggcgaaaaaaataaaaaaaatctgtccgattcaaagaaaaatgaattacatgggacgcttatatctctatatctctactacttttaaaaaataagagatgtttccttcgtccgtgtgaaaaaatcaggcgaaaaaaatcaccaacaaaaaagcgaaaaaacgggagaaaaaaagttgggaaaaaaccgggcgaaaaaagaatccgattctgtgtaaagaaaagggcgaaaaaaacaaaaaatcaatctgtcctattaaaaaaaggaatcgggaaaaaaaatccgatccaaaaagaccagacgaaaataaccgggtgaaaaaaagaagaaccaaatctgt

SEQ ID NO: 84207 - DNA, 632 bp, Oryza sativa
cttacccattcaaagaagatagatcttatctttcttcacgagagttggtgggtgtttggtcgaccagcaacagtctccaagcgaactactccaaatgcaaaaacgtcggctttttcagtcagatggcctctcattgcatactcgggtgccagatagccacttgaaaaggtcaggtgagaataaaaatattaggttatgtttggaacataaactcggaataagagcatggtataaaatgttcatacagcgtgccggctatttttgtgctgatatgggtcttcttctcatcatagagctttgcaagtccaaagtcagagatcttgggggtgagatcagtgtcaagtaagacattgctggctttgatgtctctatgcacgatgcgaacgctagactgttcgtgaagataagttaggcctctagcgacgcccaaaacgatctcaaagcgtgttggccagtctagattaaagcttttgcttcttgaacatgtagaaataaggtcttgataattaagatgatggtctaatgtagagaagataattctcgagagtgcatgaagcaaggagcttaccaggtgctagtgatgagcaaaatggaacttaccaaagagtgctctgtctaggcttccattttcg

SEQ ID NO: 84208 - DNA, 688 bp, Oryza sativa
ttaaggaagtatttcgacacgaatggcttatatattacgttaactgcagttaaagattttccaccaactgcttaccttatatcaaaattcttttctttcagaacaccctatgcaaatgtaagtgaacattttcatataaagaaaaaaaattaggtgaccaaattaatgcgcattgtgatatgtatctacctgcacatatatgtcaaaaattcgccttcctgtgctctcccaagtctttgaatctggataagcaaactctgcaaattgaagcttgacactataatttccattctcaagtcctagaccatagtatcttatggatgatggtgacatcctcgcggattggaataattctgaatccaatgtgtttcgaaactgttgggaactatatattacatagttgcgacttgaggcattattgaatattccaacattgctgacaccccattgtgtatttctggtaacatactatgatgcgactacgagatttgcagcatctacttcatatgtagtattatctgagcctttcctagattgattactgccacagtctaccgcaaaagacaagtctgcactatacatgtacaaatttatggtcattactgatattcccgaatgcttgcaactgatacagatgagtaagtattcaataacgtacatactggagaacctatctaacatggagtgt

SEQ ID NO: 84209 - DNA, 638 bp, Oryza sativa
ttcgatcactgctttagttttattttctcttagcattcatcagttgttactttctgtttctctaatcagtaatcgcataatgttgaaaaaaaaattactagggcggtgtccctcaatccgttatctggacctcttccgaaggagatcgggaatcttaaaaatcttctatcattgtaagagatatcttagttaaatttcttcagagttgaagtttacattacagactattttttctactcggagttgaagtttatactacggactatctgaagtaaattagttacacaggagacacaaatgtgtaactgtaacttattaagaattttataaaaatttatcatttctacatgagtttcttatgcttgcatcagatccaaacagtaataaatagttcttatctgctatccaaaataacaaaattgtagattcttaagcagtggtttgtaacatgcttaattcttacagaggccaatttatgctattttctgtctgtacataaacaaaatcgtagccaacatgtttctttgggattttaggggcattatttcaaacaattttactggtgaactccctgcagaactgggcaatttggaaaaacttcagcaaatgtaatcccttgtccattttgggctttcaaa

SEQ ID NO: 84210 - DNA, 631 bp, Oryza sativa
caggtcgactctagaggatcccctgatattattaaagctcaagtccctatggggcatacgtttagcaatattacttaagtaaacacacataaaactacgagaaataataaccaatagcaatagaacgtggtactatgtcaagaaaaacttacaacaaggttaatcttccaagcttagagaaatttactgttctgagattatcggatatcttgcagttcctcaatattctgaaagaacaaaagatccaaacttagaaacaagttttcaatgtataaaactgtaagatgtttaataaaactttaaaacatgtcacatacaggatattcaaagacgtcaggttactgataaaggccagcgaagagctcccgtttacaatatcaccaattcgtctgcatatgtgtatttagaacacaaattatcatgacaagcttggccttgccaaccatcagggggaaaatgtcacctaagaaagaagtacttacaagcttgtcaagttggacaaattagacaaacttgctggaatcgggccttgaaaagaatttccttggaacctcctacaagtttacactttaagaaaaggtaggaatatgctaaataaattaacataagaagtatgctctgcatttcaaag

SEQ ID NO: 84211 - DNA, 587 bp, Oryza sativa
catcaagttcaaaccaactctggccccttgattcaatggctctgaagactgacaagtgctctccagtcaaaaaccaaaatacaggagcaattatcagcgagagaagattgttgtagagcacgaaaccccatgtattcaggcccaactttgtaaccatgtgcttgatgtacaccatctcagttgttatagtcaccagataagcgactgcccatgagtaggctgtgaggctgaaccccgaatctgtcatcacgtaaccaacagcgcctcccaaaatagtgacaagggacacaaatgtgagcttggaaggacatggctgcttcctgaaggcagtatcagcgatggcgaccaaaagcggggtcaacgatctgaacactatgaaggtatccacattggcatgcttcaggagatgggtgttggtgaagatggcaaggtagaacacaagtgcagccggcgcaaacttctttgcggtctggaggttgaagggatcatggtagaggagtccgagctttccgagggtccagacaccagccactgatgtcaagtactgcagggcagtgaggaggccagggtagctgaacttggtgatg

SEQ ID NO: 84212 - DNA, 528 bp, Oryza sativa
ccttttgaatcctatgagaagtcatgcgagcattatccggacataactcgccaaatgcaactcttacctcctcactcctttgtttataccaatcaaaaagttccaagaaatttcccttatttagggaggaaggagattcatcatgaccacgaaaagcatgaccttgcgaaatgagatatcttgcaatatccaaagaagcagtcaaacggatttcatacaacttttctgactctttgctaacagtgtcaactttatgtgagatacttgccctttgattcttaaaatcatcggcacatctccttgctttattatggcaaccggaaaccccaccaacatgagtagggaatgctctatatgcatgcttccaattatcatatccagtttttgagaaaacaacgtggccaaatttttcatgatcggcttcctgcctaaagagaaagcaattgaagcaataagccgcatcttttgacacactatattccaaccaatcatagttagcataccactctgctcgaaaatatctgctat

SEQ ID NO: 84213 - DNA, 971 bp, Oryza sativa
ctttactccaatatttcccttgggatgtaggattgttagatgttactggggaaagttcctcattataattaacaaagtcacgatgccgctttgcgttttctaggtaactgcttcctctgtacacaaaatgtatgccccctcttgtccaaacaactaagcctcctgttttaatctaatgaaaagagaattaaaaaaataaatatcaaaggttttgaattgataataatgatttggacttaaataattcaaggtaaagagggtgtcgttaaaatagtttctctgtttaaccatagtttaactaagccaaacataattcatcagctaagccaacctaacaatttcagccaataaaaatcttgaatcaagcaccagcagtccaccaacgggtgtagcaccacctgcatcaattcaatcattttatctgccagaaaatgctggtcacatttgcaacttcctagcagaattgtggttcatgatgccaaaaatgaacccaccctagctacattgctctacatttttttttgaagaaagagagacaagatcgtccccctttccattttcgaaactaagttacttagctacattgctgtacatgaagctaaagatgaactccaaagtttcacaaagatgcaacaaatgcttttgcatcaccacaacaagaagctcatcgtccaggaaatcaagtagcagcagatagcaatgtgaagcaatcacctcaagaatctcccttgcccggtccatgcatcgccggagcggctccacgatcctcacgccggcgagctcctggcccttcgcccactgcccccgcaccttcttcaccacctcgtcggtgatcccggccttcttggcccgcgcccaccgttccttcccccgcgccgcccgccgaagccggtccagctcgccggccttcagctccgtctccgcgcgcgtcggcacccgcgtcttcttctcccgccgcagcaccaccttgg

SEQ ID NO: 84214 - DNA, 646 bp, Oryza sativa
ttgagatttagcacccgttggaccagtatcttgaagtcctcgggagcccaatcccatctgactccctggtgggtccgcatgtagtcttcggacccggtgtactcccaggcgccccgagcgcgccgctggagcggcgcaatccgacgacggaggtagtcgccgtacaccatggccccggtgagcccctgggatcgcaggcccgcgaggcggtcgaggacggcgtcatagccatcccccagatctaccggcgcccgccagctggaggcctgcgccgggggttggctcggaagtcggaggcgcgcttcgtcggcgaggggggtgtagaaccagtcgctcttccagtcatcccacttcttgcggaggacgcaggggatgtagcggttcagcaccggcccccgcggcaggaaatagcagccggcgaccaccgacggtggcgataccgactgcacggtgaagaaccaccggaacagccgaagagatgggcgcaccccaatgaacatctcgcacaggtgtgcgaagatgcccaatgtcatcactgcgttgggggtaaggtgcgccatctggagatcgtagaactccaggacatccatgaagaaagagaaaatggccgaaccagccctgcaatttgcaagggaagaaagaagac

SEQ ID NO: 84215 - DNA, 941 bp, Oryza sativa
gacgcgggagtccattgagtctaataacatgcccggtggagaagtatcatcgacaaaaggtttaaaaataaaggtatatcatgtactcgttgtggatttttcagctgataaacaatacaaatgattcaataagtagcaataagtgactaattatttaatttcctctcaatattgattttgtagatttgggcagctttttgacgaaaagtagtgctagcacatgttcccctcatccaagtccaagtacccacggtgatgatgcgcctgtagaatccatcgccgaggaagtgcttgaagagcctgttcagtgtcttgagactgtgatcgaaaatacacaagaacaaccagaacttgaaggtattgaacttattagggaatttgactcagaagttcatgttgttgttgatccgactcttcgaatcccaatagagaaattccatccggacattagatcagaagttagaagagcttatttgttgaagggacctacccaacctaaaattacatttccccgtaaataatatgggtctgataggagatattttcgagcagagtggtatgctaactatgattggttggaatatagtgtgtcaaaagatgcggcttattgcttctattgctttctctttaggcaggaagccgatcatgaaaaatttggccacgttgttttctcaaaaactggatatgataattggaagcatgcatatagagcattccctactcatgttggtggggtttccggttgccataataaagcaaggagatgtgccgatgattttaagaatcaaagggcaagtatctcacataaagttgacactgttagcaaagagtcagaaaagttgtatgaaatccgtttgactgcttctttggatattgcaagatatctcatttcgcaaggtcatgcttttcgtggtcatgatgaatctccttcctccctaaat

SEQ ID NO: 84216 - DNA, 2499 bp, Oryza sativa
atacttccttagctcaaataaatcccagaaaaatctaggaattatagaattaagcaaagtatttaatgaaattttatctggccccattttatattggaatttattaattaaaattagatcttcttttctaggcttttaaaaataaattctaaaaattccatttaaacaataatttacatattttgaattctcagggtgtgacaaacctaccccccttgaacagaatctcgtcctcgagattcagaagaactggcgaacagatgcggatgagctgacttcaattcatcttctcgttcccaagttgattcttcttccgagtgattactccactggactttgcaaaagcggataactcgattcctggtccttctctcatctatttccaaaatacggattggtttctcaacataggtcagatcctcttggacttctatctgttcaagattagcttcttcggtaggtacccttaaacactttttcaattgcgacacatggaacacattatggactcctgccaaagattgaggtaactctaactgataagcaacctctcctcttctactgacaatcttataaggtcccacaaaacgcggtgccaattttcctttggtgtggaaacgatgaactcctcgaagaggcgtgacacgaagatacacataatctccttcttcaaaactcaaatctctgcggcgattgtcggcataactcttatgtcgagactgggccactcgcaatctttcttgaatgattttcaccttttcttctgcttcccttaggatatccgtcccgaaaacctgacgttctcccgtttgatcccacaaaagcggagtgcggcacttccgaccatacagtgcttcgtaaggagccatctgaagactagcttgataactgttgttatacggaaattctgcataaggtagattcttatcccaacttccaccgaaatctaaagcacaagctctcaacatgtcttccaaaatctgattcaccctttcagtttgtccatctgtttgcggatgataagcagtactaaagttcagcttagaacccatctcttcctgaagcttcttccaaaaatttgaagtaaactgactgcctcgatcagacactatcttcttaggaacgccatgcaaacacacaatccttgccatatacaattccgccaaccgacttccggaatatgttgtcttcactgggatgaaatgagccactttggtaagtctgtcgactatcacccaaatagagtcatggcctgatgacgttctgggtagaccagtgataaaatccataccgatttcttcccatttccattcaggaatcttcaaaggctgcaacaaaccggcaggtttttgatgttctgccttgactcgctgacagacatcacatactgctacgtattctgcgatttcacgcttcatacttgcccaccaaaatctttccttgagatcctggtacatcttagtactaccagggtgaatggaatataaagtatcatgagcttctttcagaattgcatcttttaaatctttgttgtcggggacacagattctctcgcccaaccatacagttccttgctcatcctccatgaaaccgatagcttttcctcttctcatattcttcttgatctcttgaatatcaggatcattaatttgggcttctctaacttgatcaattagagtgggcttcgcttctaaggctgcaacgaaacctctagctgacaattccccaaatttaatctttcaaattccttgcataattccaatggcacctgtcgtccttccgtagcattgcaatagcctttcctgctaagagcatctgctacaacattagcctttcccgggtgataatgaattcccatgtcataatccttaattaattccaaccatctcctctgtctcatgttcagatccggctgagtaaagatatactttaaactcttgtgatcggtatacacctctgtacgagtaccgaaaagataatgacgccaaatcttcaacgcatgaactactgcagctaactcaagatcatgagtagggtagttcttctcatgcggacgtaactgacgagatgcataggcaaccaccttcccatcttgcatcagaacacaacctaacccaagtttggatgcatcgcaatactcttgaaaacccttctttggatcaggtaaaatcaagataggagctgatatcaagcgattcttcaactcttgaaaactctgctcacattattccgaccacttgtacttcacatctttctgaagcagtcgtgtcatgggcttagcaatcttggaaaaattctctataaacctccgataataacctgcgaggcttaagaaactgcggatctctgaaactgtcttcggttgtttccagttggttacggattccacattactaggtcaacggcaactcctcctgctgagatgacgtgaccaaggaacttcacttcagacaaccaaaattcacacttgctaaacttagcatacagttgatgttctcg

SEQ ID NO: 84217 - DNA, 1467 bp, Oryza sativa
tctcatttgcatcacaccagttgcatggccctgcctctgaatggtgggatcacttccgcctgaataggactactgctgaacctatcacttggcttgaattcaccgctgctttccggaagacgcatataccatcgggagtggtgtctctcaagaagaaggagttcaggtcgctcacccagggatctcgctctgttacggagtatttgcacgagttcaatcgtctggctcgttatgctccggaagatgttcgcaatgatgaagagcgccaggagaagttcttggaaggacttaatgatgagctttcttacccactcatgactggagattattctgatttccagaagttggtggataaggctattcgtcaggaggacaaatacaatcgcatggagcagaagaaacgccggattgctcaattcaagacacaacaggggaataatcagaagccgcgtcttactttaggaccccagtctgtgccacaggggggttcttcgtctgttgttcgtccgcagcgtcagttcttcaacaacaatgctggcaacaacatccgcaatcaagctccacgtcctgttgcagctccaacacagcaacagcctgccaagagggagcaaggcaacaagcccgtggtgtgtttcaactgtggagacccaggacattatgctgacaagtgtccgaagccccgacgtgtgaaggttgtccctgtccagagcagctctaccgcactagcattaaaggcccgtgtcaatcatgttgctgctgcagaagctcaagatgctccagatgtgattttgggtacgtttcctgttaacttagttcctgcaacagtgcttttcgattctggtgctacacattcattcttatctatgagttttgcgggaaatcatgggatggaagtagaagatcttagacgtcctttgatggttagtaccccaagtaatcaagcactctccttgcaacgtagcccctctgtcagaatagaaattcaaggagtaccatttctggccaatcttatactgttagaatccaaagaccttgatgtcatcctagggatggactggttagccagacataaaggtgtgatagactgtgccaacagaaaagtaactctcaccagcaatgatggtcgagttgtaactgttcatgtattgtcttctgagtctttaaggtcaagactgaaccaaataactttggaagagattcctatagtccgggagtatcccgatgtgttcccagatgatttacctggtatgccgccgaaaagggatatagagttcagaatagatttggtacctggaacaactccgatccataagagaccttatagaatggcagccaatgagttggcagaagttaagaggcaagtagacgatttgcttcagaaaggatacatcagaccgagttaataaccatggggagctccagttatttttgtggaaaagaaagaccatacccagaggatgtgtgtgg

SEQ ID NO: 84218 - DNA, 1097 bp, Oryza sativa
cccgaccttaacaaggcatgtcctaaggatccttaccccttgcctcgcatagatcagattgtcgactccacagcggggtgcgaccttttgtgttttctagatgcatactctggttaccatcagattcgcatggctagggaggatgaggaaaaaactgcgttcattactcccataggaacttattgttatacgacaatgcccttcgggttaaagaatgcaggtcctacttttcaacgtactactcgaatttctttgggtagccaattaggacgtaatgttgaggcttatgtcgatgacttggttgtaaagacgcgcaaccaggaaacgttgctttcagatttagcggaaacttttgagagcctccgctccgcccgcataaaactgaaccccgataagtgtgtgtttggtgtacctgcgggcaagcttctcgggttcttggtctctgcccgaggcattgaggccaaccccgagaagatacgagctatagagcggatgcgcccccctagtaaacttagggatgtgcaatgtgtcaccggttgcatggccgccctaagtcggttcatatcaaggctgggagagaaggcgctacccttatttaagctcctcaagcgctctgggccgtttacttggacggaggaagctgaacgcgccctcgctcagttgaaagcatatctcagctctcctccggttctagtcgccccggagccaaatgaacccctgctactctacttggcggcgaccccccaagtagttagtgcagcgttggttgtggagcgcgatgaggacaatcctcattccgcgcacccccaccctgtgctgacttggcccgggagcgagcagggaggagaggcccccgagccgaacggtggcctaaggcccctgacgaccggagtcggccctctgcccgctcgtcagatggtgctgggcgcccccgaccctcaggaaggccccgaggccactgccggaaggctgcatctatcgccctctgaccccgaggctaaccctgtaccgattcgacccgggaaggagcagggagaagaggcccccgagccgaacggtggcctaaagcccctgacgaccagaagtggccctttgcc

SEQ ID NO: 84219 - DNA, 1112 bp, Oryza sativa
acccactttcactgcaaccttcgctataaggctcttttcccaaagctttagtatagcagcagccaaaccctgcagttttgtatttctacctgccagaaattagtcaagattatagttgggctacatatataaacatcttatgatgggttacttatgaatatacaataatgcttgtggaactttaaggaaataggttatgtgtgcataagatgttacaatagatagtagtgacaatcaacacttaaatcatcctataaagcatattcatttgaaactatcaataaagtgactatcgagtgcagaatatggcaggcctgcaggtcgactcacgtaggtcaacatgtgttggcaaaggccgtgcatgcttccgcaggtaggtcagctcctcatctgctagtgctggtctcacaccaggagggcattgtctaaatggagtcttgaagtcagggacaacctcaggaaggagatcagcatcaacaggcaatggtgtgttccaccaccaatcgataaatcgagggcccaaactgtccagtagtctgttgacttctctttcatatagtgttcccttgataggtttgtcgtccttatcatcagcttcatcattatcattggttaaagtttcatctttactccaatatttcccttgggatgtaggattgttagatgttactggggaaagttcctcattataattaacaaagtcacgatgccgctttgcgttttctaggtaactgcttcctctgtacacaaaatgtatgccccctcttgtccaaacaactaagcctcctgttttaatctaatgaaaagagaattaaaaaaataaatatcaaaggttttgaattgataataatgatttggacttaaataattcaaggtaaagagggtgtcgttaaaataagttctctggttaaccataggttaactaagccaaacataattcatcagctaagccaaccttacaatttcagccaattaaaatcttggatcaagcaccagcagtccaccaaccggtgtagcaacacctgcatcaattcaatcatttatctgccagaaaatgctggtcacatttgcaactttctaacagaaatgtgggtcatgatgcccaaaatgaa

SEQ ID NO: 84220 - DNA, 3842 bp, Oryza sativa
atgctatactggtaaatatttgataagctcctggtttggaatggtatattctggtttgaagatagaactgtgcagccgggatggttgtccagaatggttgggcctatgcaacagggtatgttgtatagcgttggattaatattgtttaattacttaactgttttattaaattctcaaatgtttgctaaatgctgcttttgcaaatgaaaccctactatgccatcctttgttatcctgtgcacttgcatatttgctgcgtggcttgctgagtatgtcatatactcaccttgcaatcattcatcagaggaagagttctacagtgaagctgatggtgtggaggattaggtgaagcccttgtcaagctgcctgtggagtggagccgtctgcgccgtttatcttattttccgctgcttagatatttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacattaggagaacttaagattaatatatcatgccaaaatacacaatttttttcacatgaatatatactaatttatccttgagctactaacttatcatataaaagataagctcgagctcagctcgacaaagctcgtgagcttgcagctaggctcgagttcggatcattaagagttcgaaccgcgctccaatctagtatgagcctcacgagctcgagcttttttgacagtcctaattggaagtagcaatgataggtcagcctcactgacttatttttaactggactgccacgtaggttcaaaactactccagactaagttgttgggggactgtggggtaatttgcaccattgcaatagttcaagggtgtaatttggactttttcctcttttgtatacttccttttcttttttaaaaaatacagtacaaacgcaagcctttcactcccactgggtgatcatcgctaccactgccccaaccaagtgtgttgccacactccgtctcgacgacaccataccaccgccggctaggctagtcattgtgtgatcccatgtcccgtctcctaaccacaagacatgtctcagcctcaccgccaccggcgccttcttactcactcatctcctgtcacacccaaagttttcccttcccttaggtttcaaatcactaataaatggcttcaagaatttgctttggttaccactagaaaaccctagttaacaatacatttaatagtcggaattgtcaggagaatctttttcgaaatctctttgctctaaaaatcactaacaagacttaaagagtcaatatcagatcacggaggcaatggtgctaagttaaaagtggccaagtaattcttcttcctttggcctttggtcgtgaattgtgcccaattcactcccctctcagcccgtggcttgttttgcatgaggaaccatatacgtgtcagtttgcggaaccatttcctttcctttcagtataggtagtcgagttgtctaaccgtaggtgcaaccctaggttcctaccggccaatcgtttgccgtaccggggctttaccgtgaatcgtgtctagcccgccggtttagctgcagtcgttgttgtgtcgttcactcgttcatttgaacgaggtgttccctgtggttcgttcgttcgtccgtcccgagtcgtcctttaggttagagccgttcagagccgccggctcctttcaccggtttcgattgatcatttgggtgatcctgtgtcacgtagaattgactcgttgagtcggtatcacgtgaggcacgcttgccaatcaatctatcctttgatcctatgttctttcgggcttaaatccctgtcaattgattaaggtttttctgttaatagtaatagcacagagcatcttctaaaattcataacttaataatctgagctccgttttaacccattcaaattgcagtgaattcgttaaatgtcaagaatccattaaaattggtttcttttgttgtttcagtagctttttagcatgtatttattgtgtaccttgtttgtcgtttagactccggcacttctgacgctccggtttattttgaagtggtcgccgaggtcccgtcaattgaagagcaaggcaagtcatacagatatcattgatcatattgagcctatttgcaaaaacccctgcttttctctcaaaattgcattacttttataatgtcatgtgggatggtttctacccatactcagcctttgtttaccttaattcattgatattctgggataaaaatttgactagatgattggtctaggattgcttagccaagcttagatcaactagctcacaatgggattcactataatttagtccttaatttgattatgctatgccttcttggcatatggttaattaattaaaatatgctttacttggtgggtcgtgggcacatgcatgatgatttatttggtggttgtgcccatgacaattaaggaccggttctcgggaatccctggaagatatactcgtactaatcataagccatatgggctctaggctgaatcttaagtataatattttctagctagcacaccattggcgaggatagatgtgatggagtatggatggacctggattttggtctatgctgcttccggatttacctaggcacgagcggaggctgcctgctcctggattttggagtgggggcgaaactggaggtgggcatgctggttaggggtggttatatggagggttttgtcacgatttccccctttgcagtatcgtggcggtacttggggcatggtttcatgtgtggaatcgtgtcttgtgggtaaagttgtacacctctaatcagagtaaaactattcgaatagccgtgcccacggttattgggcggtcaaccagctcaccatgattagtctcaccttaataatttgccttaatgaactagtgtagttcaggtggttttggtttgggcctgtcgcaacgtggtttagcgttggacagtgatgatgttaatactacttaattatatattgttttactgctttcaacttatgatttacaaatgatgtttttactgcaaaatatcctatgagccaatcctttgttttatccttgcatcataccttccccttggtatgacttgttgagtacggtggttgtactcagtcttacttctttttcccaatcccctagaagcagaagttggttcagatggtgagttctatgaagtttaggattgtgccagccgtcaagagtttgcctgtggagttatggaggaagcttcgcgttgctgtgaagattaaatttagttctctagttttttcgctgcgtatgagtttattttgttatttttgtaaaacgtggaactatatcaaattgtcatctgtgtactatagttgatgtctggacagaggttaaatgcacagatagccggtgattcgggttattaaatccttgggtgagacatctccaccgcccctaattgttcttccatcgccctagtcatcactataaagccgccctgaaccccctcccccccccccctccctagtaacctccaaccttgaaaccctaatccggtaaagcctatcggagttcgttagggtgttagtgatgaggcttgccaaggaggttgtggtcgccattgtcgtgactgccaccatcattgtccttcacgctcgctgtttgatctgatgacattcatcatagtctattgagatttttgggaaatgtaagtaaaccaatgaaagatacaattactttggtaactctgtgaacat

SEQ ID NO: 84221 - DNA, 531 bp, Oryza sativa
actatagggcgaattcgagctcggtaccccccgaatttgccgaccaattcttcgtggcgaatccctttggtgaatgcggcgatgatgacgtcgtcggtgatgtcggagatcttgttacgttgttcagaaaatcgccggatgtaatctcgaagagattctccggacttctgaatgacgttgtaaagatcatattgtgtgccgggacgctcgaaggtgccttggaagttggcgatgaagtggtcgcgtagttcggcccaagatccaattgtaccacggggcaatccatggagccaagatcgggcggaatctgctaaagccaccggtaaatagttcgccatggccttgttatctcctcctgctgcgcggattgcgagaccgtagacggtaagccacgattctggattagtggtaccgtcgtacttctctattccagtcggtttgaagccggctggccaatccactcgacgcaggtcgtcggtgaaggctgcaactccgtcaaggtcgtcgtcgcggcgatccggcgagtgatgg

SEQ ID NO: 84222 - DNA, 1206 bp, Oryza sativa
ataatcttgactaatttctggcaggtagaaatacaaaactgcagggtttggctgctgctatactaaagctttgggaaaagagccttatagcgaaggttgcagtgaaagtgggtatccaaaataccaatcatgaacagatggccagaaatcttaaggtgtgtattgttctcatgaaatatattagagtcattaggatttctttgatatccatatgttcaatcttcatctgtgacactgaatcttctcagtgcagcgtcttacaggaggaactgtcatattgaggaacaaggattatattattatatatagaggcaaagattttcttcccggtggcgttgctgaatcagttattgaacgggagtctcaggtacatgaccagcaggcgaaagaagaggaggctcgattaaagatggctgactcacttcaaatgattgttggactatcatcggagagaagttatgtgggaactttcagagagtatcaggatttccatgatagccatgcacgtagaacaactgaaaacaacttcagaattcaactagaggcaaagaagcatcgattggaaaaggaactgaaagaccaggaatggagactttccatggtatgctttgatctaactcgtcttgtaccttcttttgaattcccgaacttccaatggtaatgtaaaaatggtacgtactgcagcttaccaagaagattgaaagatcaaaccaagtgctggcaaagcttcatagttcttggagcccttcaaagaaagatggagacagagaactcttgacagaggaggaaaggaggatattccgaaaaattggcctaaaaatggatgaacatgtgctgcttggtatagccttttgtatcaaactgcaatattccatgcctatatgtgtctctatccttgaaaccaagaaaagctatttaccatcctatgatgaaaggtattcatccatggttttcccttgcagggagacgtggtgtctttgaaggcgtaattgaagagattcatcaacactggaaacataaagaggttgtgaaagtaattaccaagcagaaccaagccagccagatcacgtacacatatatgatgcttgaggttgagacaggaggcacattaatagcaatagagaggttcactaccagccatgccataatactttaccgaggaaagaattatcgtcggccaacaaaatcagcacccagtaatctcct

SEQ ID NO: 84223 - DNA, 621 bp, Oryza sativa
ccctcaggcccagaagatgctttacgctattctgatggcctcgaggaaactgcgccattatttccaggcgcatcgggtcactgtggttacgtcttaccccctcggtcaaatcttgcataatcgggagggtacaggacgggtggttaaatgggcaatcgagctttctgagttcgatttacactttgaaccacgccacgctatcaagagccatgccctcgccgattttgtggcatagtggaccccggctccagagaccgtttcagtctctgaatccagctcatacccctctgaactgcctcacgccgtccactgggtgatgcaattcgacagctccctgtctcttcatggcgccggcgcgggggtcacgttaacctctccgaatggagacgtcttcaaatacttggtctggctcgacttagagcgaccaataatatggcagagtacgagggactccttgccggactaagagtggcagccggactggggatcccgcgtctcttggtgttaggcgactcccagctagtcgttaaccaagtctgtaagagagtaccggtgctctgacccgcagatggacgcttacgtacgccaagttcggcgtatggagcgccattttgacgggat

SEQ ID NO: 84224 - DNA, 1154 bp, Oryza sativa
attcctgcagccccggatggaatttgctgggattgctttgaattcgtgcacgacgccgtcgatctcgatgaggctgcaggcagggaccttgtcgatctcgcttctcctcatctgcctcctcaccttgaccgcctcaccatgccggccattcaacgcgaacgcgtacgtgttcgacatgcgtcagcgtcggccacgcgccgtcgcatcacccgctcggcgcgctcgacgtcgccatgcgcgcggcaggcggcgagcagcgcgatgagctcctctgcctcgtctagtctcccggcgcggctgagcatatcggcgacgcagccgtagtgctcgatgcgaggttccggcatggcgttgagttgctggagcccctcctcgacgagtccggcgtgacagcaccggtgcgtacaaccctaaacacgccgcaggcctgaccggcgcccggccgccacccagccggggcaccgcgccgccgcacctagcctcgtcgccgcgccgacccctttcccctacgccgcagggccacctccaggccgccgccgccccagccagggcaccacggagccgtcgcctcggcccggtcgctggccgtgccgccgcacctcgcctcgccccggttgccgactgcgccgtcgaatggctgccctcggaatggcgaaggaaacaaacttcatcaaatggcatcttcagcttaagggcaactaagtcatttggttgcgccgttatctaccgttaccacaaaaaataccgttaccacaaaaaacagacggaatgatgtggagggcgcgataaagttcgacgatggcataaagagatgctcgaactttttagtggtatagagacaggcaccatattttttaatagcacataggaaaaaacctccaaggcacatggacatcaacatgacaacatcgaccagaaattttggcatgctagtatatatgcaccaccgctggttttacgtaccgaaagggagtgattaattgttggcttttgcatttgtccaccatctctccacgctatgggcaagagcagtgcatgtcatgacacaagctagccagacctcaagtgccatatagacttcaggttctaattaaatactccgtccgtttcgaaatgtttgacgccgttgactttttagcagggctgcaggaatt

SEQ ID NO: 84225 - DNA, 711 bp, Oryza sativa
ctgcaccccacatgagcctatgcttcaaactccatatcattgaatcagttgcaacctgtacaaactgattgcattcctgaggtatcagtaagcacagctggaacggcgactgagaatgagaaaagcggtcagcaagctcaacagagttcaaaagatgttcaaagcaagactcaggttgcttcgacgaggagttgtacaaaggtatagtattgttttcttgatggtcatgacaatgtgcatgtcttttctgttgcacaattttcttttacttaagaattactgaatgtttgttgtctagattatgctagctgttgagaacaaactatccagtcatatcagagtgaattgattctggtggtgttaaagcacatattgttcttttattcagcacatgaagttttttcttctcgtagttgacatgctgaagttctcgttttgtaaatttcttgcaaaatctcagttttatcccctttgtggtatggtaaacccaattttgctatttcttgtcccaaaaaaaaatcatgagcaatattattcagtgcagcatgagtgtgtcaagtttgactattggtctgcactatgtaataacatcatgtcattgattcttcatgcaggtccataagcaaggcgttgcacttggcagatctgtggatctttcaaagttcagtaactatgatgaactcaaagctgagctagacaagatgtttgaat

SEQ ID NO: 84226 - DNA, 722 bp, Oryza sativa
tgggggttaagtggacttggagagggggagcccagctgggccggcccacgcggagaaaggagggaaggaggaaagggagaatgggccgagcccaaagacaaagaggggaagtttattttgttttctttttatttaaattggttaaatgatcttcgtgactttaaaactatttctcgagctccgaaaattcacggaaaaatccggagagtattttagggcacaaagaatattacaaaatattcccggccaatgatttttaagggaaaatttcaaattctcccattattccacttgattaaattgatttaacttttatttaatttctagaaaatgtattattaattgatttttaaacccgaacgaaaatcggggcgttacaaatctacccgaacgaaaatccagtggctcggattcgccggagggagctcgacagcggcggattgcggcagcggcaaccggcggagagaaaagaggaaaacgacgacgaggtcacgaggggccgattcccggtggcgagagcatctacgcggctacgggaatccgtcccttgtgccggattaggaggaaacgcatcgagggaggccggcgacgagaggcgcttccgagcttgggcggcgacggcggcgagcacacggcgagcggcggcaacggtcggggcggcgctggctagctacgggaaggctactcgtgctactacccgagtctaaggggaggaggtggaa

SEQ ID NO: 84227 - DNA, 789 bp, Oryza sativa
  unsure (1)..(789): unsure at all n locations
ccatacttctctgcaatctaagttgctgtaaccattntgttatcccttntaggtggacatgcatgcaagctttcaagagtaactatctgccagctatcactcttagtattcttggacagcaagcatacccaaggacagcttgcccaatcacattttgccctaaccctcttcaagtcatctttgatgaagtttataaccttcctctcagctagagcatacttagtgacagctttcttaaactgcttctttgagctaaacttcatgcccaattcaaaacaaggagtccctaccttttttttgtatcttgggaacttattttccttagtgctaacctcaccatctgtgccaatctcctccattgattcatcctctgggctctcagcagcaatgccatcaccttccccaccagcttcattattcatgttttgccatccttgtcctccaagatatacatcatctaaattatccagctgtcctgccttcacctttctcttcatatccttgtagtgcttctctatctatatgatctcctcatcatcatctgaccctgcatcatctccaggaatgtactcactatagactcactctctgaaggtgcctggcttgccaatggatcattgtcacaattataaaccacaagtcggttctcaggaatttcagaactaatggctttgcccttcctaacttcatttgtcttggtcctaatttcacctccttcaagagctactgcattttcagtaccctccatacgggctgcaggaatacgatggcagctcactcactctccgt

SEQ ID NO: 84228 - DNA, 1083 bp, Oryza sativa
ttggtgaatgatgctgatcttaaaatgttggtgaattcagtgcatctttcaatcaatgtttcaccttgggctcatcctcagcctcaggtgagtcttcagtccgaatacagagttggaattcaaacagtgcacggcttgtcaacagatacctcaagcagggctagtcaatggtaaacacgccataccatacaatgagggaacacgaagtattacatcatgtatacgagttatttttcagtaatatcacatagcacaagtaaatgtgtaagaacgcaatcaagagaagtgctatgtacagtgacgatgttaataagttttactagattgtgattgtgttcttgcactgaaagaaatatccaaacttacaaaatagtgactaaatgtcaaacgtgccaaaaaataagtatggaagtaaacagtcacatgtttgcaagttaaattacagtctttggcttcacagatacagcttcataattgtaaattgcatgcctgaagacatagttgcgcagaggttccaagtcatcccgcaccgcaaaaaagccgaagattttggcacgtccaggctgagtatggcgatagccggagattttcaggtcaatgaactggagcaaattcttcgaaaggcacctacacccatttaagcaatcaacggccccagcgctgtcgacactgactacaaaattgataacgaaagaatgagaaatatgtgtggttccacagtcaaatatagacaatgatgtgataaatgatagcacaagaaaatttaaaggagtttatttaaagaaggcatttactttcagattcatcatcgagtcggtaataagaaccaaaccaatgcctgcgtttatcagtgagaggatcattgaatgcacggaaaagactgagcggtgacgggcctccaaggcgaagatgtggaatatcaaagagtgcatcagtctgcacagaatggtcactactaagcctgggaaaatcatcaactgtaaaagggcggtgctttcctacataaaaaatcataggataatcaaatcaactcaaacaatttccatggctctggagtttgatgtaccaccatctaatcatatg

SEQ ID NO: 84229 - DNA, 2931 bp, Oryza sativa
tgtcagttttgtagtggcatctacaatgctgctatgtacatatgcatggtagcagatgttgtttctagaggagccccctaattgagcaggctttataagttttgtcaatcagaatattgaagtttgtcagatatcgccgttgttggccgatgggatcgcggcctcctacgccgagccgactggtctcttcttcaacgagctcgacgccctggccgcggagtttggtccggctgtgccttcgccgcccagggtatcgcctgtgccgccgtccgcctccggtgcaggcacttctctgccgaggactgcctgcacaccgcctactggtggggagtggctgaggcctgagtcgccgcttcctcagcaggctccaactttggtggttgatgtgcctgacggcgtcctctacgatgtgccgatggttgtccttgacctcgatggccgcccactggcgcactcgcttccatcttctgtggcagacaacgccgctcttcgcgccttcctcaccagctgctccaggcctctccctcctgcgctcctatcgccgcctttgccgctgccgcctctcgctgccaaggcggtgggagttgtgccgaagcgcagtgagcgtatcgctgctaagatggcacttgaggcgcttgaggggccgatccacgcagtgtcgcgcgcccagcgcaacctgatgcggaagctcggcctagttccggagaggggcccggtcacggccgaggcggtcgcggcttacaacgccctcttctccaagccactttcccaggagcacatcatcgcgctctcctcgctcttctctagctccttgcccccggccaaggctgcggaggagttggtcgtgtgcggctgatcggtttcttctcttctgctctcggtgtggtccccctcaatgggatcatgcaacgagaacattttggtgtggaacgtgcgaggtctgaactcgcgcgcccgccgggatgctgtgcgtgatgtagtccgtgatgagcatgtctctcttctctgtcttcaggagactattatggatgtaatcccctctcgtactattctggaaatgctaggcctcgactttgattattctttcttgcctgcggtcggtcggagtgggggggtgttgcttgcctggcggacgaccgtctggtctgtctcagatgttcaccttgcggaattctctcttaccgcgttggttcgacactcttctgatgtcgccccctggtggctctccgtcgtctatgggccacaggaggagccggacaagcttcgtttcttagatgagcttcgttcgctgcgctcctctcgcacggggccgtgggccgtcgtaggcgatttcaacctcattctcgaagctcaggataaaaacaaccttaatctcaatcgtcgtatgatgggtcgttttcgtcggctcgtcgacgagttggaactccgggagctgccgcttcacggacgtcgcttcacttggagcaatgagcgtgagtcgcccacgcttgttaagctcgaccgcgttctcttctccgcggattgggaggagcttttcccctcttgcctcctccaagcggcctcttctatcgcctctgatcactgtgctcttctccttcatacctgcgtcacctccccgaaagcgcttcgttttcgttttgaggccttttggcccaagttcgacggctttcttcaagtcgtgcaggacgcctggcatccccctgccaacctaccccctcttgccgctcttgcctggtgcttctctaccacggccaagcgcttacagagctggagtgaccgtcacattggcagtgttcgtctacagcttcagatggcgaaggaacttgtcttccggcttgatgttgcgcaggagagtcggtctctttcctccttggagacctggctgcggcgagatttaaagttgaagtgtcttggtcttgcctcgcttgagcgtactatcgcgcgtcagcgttcgcgtttggtctggcttaaggagggtgacgccaataccaagttcttccacctgcacgccagagctcgtaggcggaagaacttcatcacacgcctttgtgatggtgaccagcttgccgtctcccatgatgcgctgcaagagcttgcctcctctcacttttgcgccatcttggggacgagcgtcgagcgtgaactcgccctagacctccactctcttggcctccgccctgcgcagcttgaggggctggactgtcccttcacagaggatgaggtctgggcggtgatcaagtccttgccctctgataaggcgcccggtcctgacgattttacgggccgtttctacaagtcttgctggccggtgatcaaggtcgaaattctggcggctcttaactccttgttcctgaccaacggccaaggtttcgcttccctcaacgacgccctaatctccctcttgccgaagaaggacgaggctgttgacgttaaggatttcaggccgattagccttattcacagctttgggaagctgttctccaagatcttggcctctcgtctctcccctcgcctggacgagcttgtggcgcctaatcagagcgctttcatcaagggccgctctctccatgacaacttccgctatgtccagcttgcggcaagggcgctccacgccaaacgcgttccccgacttcttctcaaggtggatatcgcgaaggcctttgacacggtcagctggcctttcttgcttgaggtgctagcccagcttggcttcagtcaacgttggcgtgattggatctccctcattctcagtgcctcctcttcccgggtgctggttaatggggtgccaggtccacggttcccccatcggagaggtcttcgccaaggagatcctctttcccccatgcttttcattctagtcatggatgtgctcaatgcgatgctccgcaaagccctgactcgggtggttttcttcccctcaatgatcatgct

SEQ ID NO: 84230 - DNA, 1175 bp, Oryza sativa
cggcctcgcgggtgtggaggcgaacaggcgtggcggccatgtgcggcgagagaggggaagagcgccgggaggatgcaggacatgcggaggttcccactgaggtagcaaggcacgacgatggtaagcacgagccgtcaatgcgcattgcgaggcataggatgtcgcgtggacggataggcgtgccagtggcttcgtgctatgcaggaggagcccaatgatgttgttgagcatcgcgctgtcagagaagctcccatgtctaccgtacgtcaattaacatgtatccaatttgttttgatggagagagagtcgattgatgtagataaatatgcaatagcgaaagtaatgataatgaatgagcataaataccagttgtggccgaggaagccttgtactcggcctcctaggtcgacgaagccatctttgccaccgtcgtggtcaccagtcggtcgagcggcgagagtgcaccagattgaacgacgatgtacatatgtcgttcatttgaaaaaaaagtgttaactagagtaggcgcttacatgtggatcctacggtaaaccgcttcccaaaccacctatggagttgatcgatttgaaccagttttcaaaaattgaagaggtattatacccgtttttatggttgagggatgctattcaatcaaggatgagtttagggatgtaaatacacttattccatctgaaaaataccaagcgtggcattcttgctgcggatggactaatccgaattcagcgtagaccattttgggccaatcccgttccgagcccacgttagaaaccagcgtaactagacaggccgtgatgtcgtgggcccagaacaggattgccgcctacgtgctgaatgggcctacgcatttagggcccataattgagtatgcgcaaaatggggaataagttcactctgggtctctctatttgtcgcccagtccgattttcgtcccttgatcacaaaaccggatacaacgggtcccccaacttacaaaaccgtgtaaaagagatctctcggcagtattgtgcctggttttagatgacgtagcgcctacgtggctccctttaactaggtcgtcgacccacgggcatttacgtagcgcttacttggcatttggatcccgggaaaataataaaaaacagtgggacccacatgtcagctagggctgcaggaat

SEQ ID NO: 84231 - DNA, 1415 bp, Oryza sativa
gaacgggtatttgaatttcagaaatgtgtttagccacaagctagtactccattccaaaatagacttattcagatttatcgtagtaatattatatatcacatcccatattaaatttctttattttggaacggatggagtacgtgcttaagtcttagtactagtttggatgaactttcatatgagtaaatgggtaatagctcgaagtacagaataagttaatgtgatgcagtgttctctcacgctatattcaatgaaaagtcacaattatgcgctattttcccttcaaaaaaatgtaatacaggtcccctagttcatagttcatacatatccatcaaaatcacttctgaataaaggaaatggaatacgatgtcaccattctgcttcggaacaaatcctttccttctgtttacagtaagtaagatgatgttgatgtatagtaggacaagtgtaggaaatgtggactctggtcaatgttgagatgcgttgagcagaagtaatcaagtttattgatgatgcagctgatgcaacgctgtacaattgggctaatggaattattaccaaatactaatgattcctttccagaaacaaaaaggtaatcaatctggttgaagccactggatgcagccaagagcccaacatggctgcagatccggccaccaaccaaccattgcaacagagcaagaactaaacaaagcaagaaaaagtcaaagtctaaaagctgacttggacttctgacttttccccattatttatttttgtcctacgtagtctttttctgttataaagaaatcacaactcgcaaacaattctttgcacctgactggttctgcgctttctgctgtttagtctacgattattcagagacgcagcatcaaatgataactaaacatctgaaacagaacacctgaaaagtcctgctctatcaatagaacttcgcaccgtctcgttaagaaaaagaacacctgaaaaggctgaagctgaatccagatttcagaatgcgataaggccctgaggaacacaaatgaaatcacgggttgccaagaaggcaacatacaattcacaaagctaagtacaaacaatcctaatgaaacacacgcgcggtccatcgtgatcggttgccgtgtctcgtgtgaagaagctcgcccagcaagaacctaagggacgggaaagcgaggcgctaaccgacattggcagttcggtcggtacaccgggcctcagccacgcacgggctttcaccggccggccggaagaggccgggtcttggcggggcggaagcagccgaagaaccagcccagcacgctcttcagcacgactcctctctgcggcacgtagcgcgggtgcgtcgccggtgccggtgctgcagcgccgcgagctttgccgccgaacgagctccgcattgtaagctggtgatgcct

SEQ ID NO: 84232 - DNA, 896 bp, Oryza sativa
attgctgagaattatgatacacgtgtcgaggatatcataaaagctatgagaaaggacactgatgtgaagttcacctttgttgtggatggaaagaaaatgattgtcccagtaactccagctcaaaatttaactgatgttaatggaatatacatcatagaaattacagatggtaacttgaggctctgtttagtagctgataagtatcagaattggttcagaggatttattactgataaagggaacagatttgagattgatcacgacactcttccaaacataatgaagaactctcagtcacttcataccaacgggatgtatcctagtttacttggatgcgaagtgtcagagctgaagattgggtaccatcaacttcttgcagcattccatactttggctagatatggtgagggtaggagagatctgaagaaagctaaagaagcggtcgccattttccttatcctgctctttgaaggccctcggcttctacctgtggaacaaaaaatgatgaattcgttgacccaaaatctggtggcagtggttggaactgataaggagttgataaacaattggtgtggcatgagcaggaacttctatgatgagaacggttatgagatggaggtgattatctcagaagaaacctcagagatagtgaagaatgctgtgaaaacttttgggatcatgtgccggtcaaggtgggatgaatgggtgggtgagcagactgaagctgcgcatggacgacaagctcggaaacaatcaagaggccagggcagcagcagcagcagcagcaagaagcattgaggagtctggatgctattcttgagtcaaaacaactaatcagggtgctaggaaattccagtgctcactcacatacatgctctgaaattttgaatgttact

SEQ ID NO: 84233 - DNA, 580 bp, Oryza sativa
acatcggaactcgtcaggaatggttataggccttgaatccccatttgaatccaataccctggaagccataggaggccccatgtcagggttctgtgtttgcacaaaatccttaatcttcttcagtagcattgacattctctcaatgtgttctcctgggtcctgaccaccgccggatgcgaccatctcatgtaaggcgagtgattcttgcgtgagatcggtgattgtcatcaagtgtagcttttctgacaatcttccaagaatagccagttctgcacttgggtcatagttcttgtcatatacagatagtagatcattgtagaattcatcgtcaggcatatcaatccgttcttttgctcttttgagctgtgcgtgcactaactcaacctggacaggatttggataattatctccaatgctggatttaagtgcttaatgataatagcaagaggaattcttttcagtgtgctgtcatcgttacctgctctctaacttcatctgatatatccaattcattgtacggaatgtcgcacagagcttgttccagctgcaaaattactccctgaaactttttcattacgct

SEQ ID NO: 84234 - DNA, 15585 bp, Oryza sativa
ctaagttctccaaactgtgaaaatgctgatagaatcatgtagaaccttactaagtgtattactacttccttcattgtgctttcggtacgcaatcgccttcggcatttgcaaccgctggttcagggcaaggaagttgaacaggccttcaaggcagcctgggctctgtgtatcgaaccgcttgctctccgccatcattccagacaaacctgacgacaatgtataggtaaattaagtccttgaaccctgcagctagtctgaacctgagaatattattgggcattccagcccattacacataagaagttatgagactagagattatgtcaataaccgtaaatgctctaaaacgcgtctaatagggtgtatattaggttgcatacaaggaacaggcggctgttaccaacttacagtataattgatgactacaccgtatgctcactaccatcagggtgattagtgaatactgaataatgcttatcgatttttagaaccatgatatccattatttactgatttttagaaccatgatatccattatgtttccaagacttagatgcatgaattcaaatgtcaatctttaagtttctcaaaaataaaaatgttaacctttagttttaacatagcaaggcaatatatattccatggaaatcatgcagcacagcatgcaccaatatacattttctcctggaacaaaagcagtgaatcttggggtttcatcttagattatagatatacatttattatgagtaatttgtggggaaagaataattctgcagcttccaatatcacccaagcgttgatccatccataaaccagattctaaactttcaaggatgagacaccacaggaccaaatgcaatcgaaacatcacacaatccctaaccggttagcactaaagattcaaggccagaaatcacatggcaagaacaagaacaaagatttgggcccctattacaccaagaaaaaaaagggagggagagccacaggaacagatcgtaccaggggagagagaaagattgctctcttcttggaatgcgcaggggaacaaaaggggaaatggagctcctcctcccctcctcctccatgagctaatgcctctctctctctctctctctctctctctctcgtttctctctcctccctctcgtgaaacggactaaactgcgagtgcgaggagagacgaagagagaaatccgctcctcctctctctctcttcctctatctgtctgtgttctatctctctgggccgattgggccacatgttttgggccagaatctgaaaaatgctactctctatgtcccatataacaacctcctactggattcttaataccgggatatattttatccaatactttctccgtttcacaatgcaaatcattctagtattttccacattcatattgatgttaatgaatatacatagatatatatgtctagattcattaacatcaataaaaatatggaaaatgttagaatgacttacattataaaatggagggagtactatattcagtggcggatctagaaatttttttagcctggacaaacctaacaatggataacaaattaacaagaaaacacaaatacctataacattttatcatggatagaagtaaaattgggctgctgtctaatgactaagtatgataattaataccaatctaatgatgcatgtgcagctaggctaatggctaagcaccatatttagttctaatgcatggatgtatgcagcatagccggggcgcttgcccatactggctgggccttggctccgccgctgattatattatattttagaacagaggaagtataattgtttctaaatgtaaacaattgtatcaatgcacataaatcccttccaataaagtttgggtaaaaaagctccaatctctttgtcatgccttcacaagcattttacaaatctaagacttcaggtatgataatacatacttactctattccaaaatataagtattattagactctgacacggttttccgagatgctactttgaccaacaatatctataaaagtaaaatgttttcaataaaaagagtatatattatgatagtttgtttaatgataaatctagtaacatcaattttacatgagtgatctttttttttatttttcctactaatactcaaagttgaaaatgtttgacttgtcattatgctaaaaatatttgtattttaggacggagggagtattagagttccaacgatggattatgaatgaaactgagtttatgacaattactcgaggacacaaaaacgaacgatgtaagtattagaaagttaaaagatcgatttaagaaagttttctaaaaaaaaataccaatgacaaaagcttttttttcccttttgagaaaactgtactatttaaagcatagggataatcgtgtccgcgataatccataattcgtaagagaaaattaaggattttttctttcccaaaattatcatcaccatacatgtagaactgcctcatctttctgcatcaattctttgtgttgtatgctgtaaccaacttaaccattaatttagaacaaccaatttaaccatggagcatcctttagacctttagccttgcccataacaaaatttgacatgttacatcggatttacggacacacatttaaaatattaaacgtagactagtaacaaaacaaattacagatccacctgtaaactgcgagacgaatttattaggcctaattaatccgttattagcaaatgtttactgtagcattatattatcaaatcatagagcaattaggctcaagagattcgtatcacaatttacatgcaatctgtgtaattagtttttttatctatatttaatacttcatgcatgtgtcaaatattcgatgtgacaggatgaaaagttttggtttggaaactaaacagtgccttagcttctctctctcaaaaaaagaagaaaaatggaaaaaagagaagaaacatctttcggtttcttcagatactacttgcgtttcttcagtcatcagctcgccgccggctatgaagaagacagcagcaacaacgccgccgccgccgccgacgacgacgactccatcctcccatggcgaccgaagctgaacgggtgatcctccatctccgcatcgttcacccgcttcgccccgcggcggcgcgtcaggaacggctcggactccaccgcggccgccggctcgccgtcgccgccgctgcccttcttcgcgggccagcgccagaattcaggcctgctcacccgcagctcgtcgcaggcgaagatggattccggcgaactcgtcgtcgtcgtcttcggatcctcttcacgtgccacgaggaacagcgctgcttccgaggcaggtccaggattcgattcccagctcgtctcgtcgccgtcgggctcctccgtgctcacgagctcgtagcgtgagccgctcctcacagctccgccgccgccgccggcgacctcctccgccgtgatcctgatcaagaaacacggtgatcgaggtagtagaaaagattcagaaacgagcaaagctaagctagctatcactcacagctccgccgcgccgccggtgagcgccagccacgccgcgtgcagccaccggccgccgccgccgcgccttgcagcagcagcagagctcatccttgactgaatcagcagagcaagtagagatcgattcgattctgcttgatctgaatcgatgattaaactggaggcgatggagctagcgggattggactttgatgagatgatttgatttcatccatggcgtggcgcgcaagtggagtgcgggtgggaaagcacttcgttcgcgcgcgatttgagctgcacatttttaatatatatatttttttctagtggtcaaaagtctcgcagaattaggcagagacaaaaggaattaaactgaagttcagaacaaaattaggcaggaattaatctgatcttttcttaatttttctgtgtgcctatatgtttaattttattttcgttgaaaacataatctttgattctccatgagaattaagaaactttggtccacttgttatatccctgattatattagtagtaggttttttttttttggatattatccatgggccatagaacttggcaaagtgcaggaaaagtgaagtgaaaatagatgggttaggtcatggcacaatatgaaatgagagattgacctaactcgttagtgcattggactattggtacagtggccatagaacttgcagacattgacatttctcaaaataagaaatggccttttctttagtacttaataaatgagcttaagttcaaatcatcacaagtgataaagaaagatcatccttccatgtcagtccaggtagggcacccatataacagaaacatttacagttaagcttagggagaattaatttgcatatgcattttacaactctgccattacatgggctccacctaataggcccaggccaaggtgggcccaatttcttgtaaatctgtgtgggccacattgtgtggcccagaaatgctgcgatgtctgctcttggccagtgatgtcctcaaaattttctgcagctttccttggaaaccaccagctgcagctttcttattcagaggcctctgtgatcatgcaggccacagttatcttggcagaaatgccaggatcagtacagtggttctgattctcgaagggacatgaaacaatattatgattggtggattgcatgatagtagtgactagtgagtattagtctttcatatcctaatcacatttcacaaatttgatcagtttgtgtcaattttgcgttttctccctgttctgatatgagttatgtgttgcattttttcccttatgttatactgtacagtgtacattgaaccaggatactgcatgagtacaaagtacacactatgctcgattataactaatcgagaaaagtaaaaaaaaatagataccgtgtagcttcagcaattcagaaatggaagataaaaaaaagaagaagaggagaacatgtttgagcttcttcaggtacttttcttttcttcagacttctatcagcagctagcagggtttctcttaccgcgcggttaccgggcttaccgcgggggtacggtaatataaatatcgcggtaacctccttaaatttaaatacatttaaaaaataatttaaatttttgataaattttacacgattttgtatggtttttcagggttaccgcggttaccgcgcggtaaccgtgcttaccgccggggcacggtaacccccaccccggcggtttgggaaaccctggcagctagctaccgtcgactgacgatcaaatcgaagctcatcgatggatgatttatccgtgacctgaatattctgatatttcctccgcctccatgaattcagacgcgctgttgctgttcatcaaattcacaaggccagctacagaatccagacaaggtggtaaccgtttctgttcatgaacagttcatcacttgtgagaaaagtcttcagtcgaatccaatccaccatcgtaattttggcccctacttcccttaaaagaactctgcaaattgcaataaggaaaaagggagaaaagtgcattggatttggtcaggttgtactaatggctagtactgtactagtatacgcgtatgcattggtatggttggcaatttgagtttgccaaaagtttatagcctgagagtttgccttcttctttactgtcgccgtgtttagttccaaaataattcttcaaacttctaacattttcatcacattaaaacttttctacacacacaaatttttaacttttccgtcacatcgtttcaatttcaaccaaactttcaattttgatgtgaactaaacacagccacagggattgctgctcgtgtactaattctttctgtgtctcttttcctaatatgaaatagcagagctcctgcctgcttcctctaaacaaaattctatttctacgattttctttgttcctatatttttataatcctgagtttcgaagaaatccttggctgataatcctattaattaagcactaaactatcacaaatgaacataattttactgaactttttccatgttttatgatgtactagtacaacgtatatatatactatactagtagctagcacacgtgcatgtgagtacaaagtacgtactatactcggttgtcggtgtgattaattcagagttgagcatgcatgccccactgaacgtgaagatctctgtccagatccttcacttggaatttactattcagcaccctagaaatgttaaatgtatatcgcccagaggctgagataatcaccaagaatagtacaacactggccactcgatcggccaagcttcagaaatcagtatatttttcatgtgaggaatatctgaatcgtaccatgcatcgatccatccaaagctaaaactttcaaatttggacttgagttgtctaattaacgtgtgaaggtgtattgtccaattaactttaaaccctgttattttcggctatttaatttgccggccgattattgttgtggattagttatttgcatactcaatgtctaaaaatatatttactcagaatgtttaacttgttctaagctatttgttaagtttatttttcaaatatttaatttcttcctggataatatgctataataatcagtgtattttttttcaaattatatactcatgcatgtgtaacaaaattattttctacaacagtattttcttttttaaaaaaggcaaacatatactgtggcctctatccaaaacggtggtagtagtaattaatacggtgtgtgcaaataatatactccctccgtcctaaattataagagattttaaacggatgggacacttcctagaatagtccagattcatcgtactagaaaatatcccatctgtccaaaatcccttacattttaggacggagggagtactattttcgccgtttctccatctaaccaacatatggatatataatccatgtactcccaccgtcccattataattgcagccataagtttctgtgtccaacgttcttatttgaaaaatttatgcataaaacactattcatattttatcatctaataacagtaaaaatgctaatcataaaatatttcaaataaaacagatggttaaatttggaccctgaaaccgacagatacgcttattatgggaccatctatttaaaacccaaaacattttacagtctgaaatttcagagatgtcactgacagagactgacagtcatctgcatgcataggatgcacttatggaatttacatgcgcgcatgcatgcatattgtcggcgacgtggtacgaaaactgtgcgttgccgttacgttggagacgacgacgcgaaagatacgcgtcgatcacgccctcgctccacgacgagcgatctcgatccgtccatcgatcggacggccacgcatgcacgctagctagcccatatatgtgcagcaactacgacaagtacttaacgtacaagacaaagacaggaaggatccaatgcattattgcattgcatggcgacatgtacatatactaggcactagcttatagcttcatgcatgcatgctttttgcttttgaatttcctctcttccatggcatgcatgtgtgtgtgtgtgtgtgtgtgtgtgtgtatatatatatatatatatatatgcatgtattacaggtcacactcatgcccctgacaaagttccttttttttgtgtgtagtagtgtgttttggagatggattttattaatcatacacctccatgttaattacctcctttcgtgttttacatgccattttaatagacataaaaaaaacttaacaacatagattaatataaaatatatctcgactattataaaaattgaagatgtttttgccggtattttggtacgtcatatgtgtatgagtcggtttttaacttcgtttgcttttggaaatatatatccgtatttgagtcaatgtttaacttcgtttgcttttgaaaatataggcgaatttccacagtgtatttcaccttaacgaaattaccgtataataacaataagattaaaataacgtttacccattgcaaagcacgggcattttttctagtcacttaaaaaaatgcaaggtggaattcgacttctataaagtattaaaaaaataaactgaaaatagttaacatgcacttatatttgtatttttataacttgtggaaattaaatttgagtgatatattttatattaatatatcatattaattgtttttaaattatttaagttattttataactagtaagaatcgagaggatatcccctccagtaaagaaaacactttcccatgtgttttgtagctagcgtggcatgcaatgcatatataggatcagctcggctgggttagatctagatgacatgcatgtatatatatatatatatgccaagtgaattttactagctagctttgttcaatgaaatggtagtagcatgattgacattgagatcatcttgttactcggctgttttcttcaatgatatgagaatagagttagattccagacaagaggttcacaaattcagaatgcaattattccctcgattctcttttagtacttggcactgttgactagtgtgatttttttactatagtaaaaacttttaaattatgatgttttgatgaatgtatgcagtatatagttatatttagcatgaaaattactttgataatatgatatttttaagtatttgtatattgtcaacgggggatacccgtgcaccggataaatagggtattgggtatattggtacgaggatctacacgatacaacatcaagacaaatagagagagtacacagatattattatactggttcaagccccttataaggtaatagtactaatccagtttatatgatattgatatggataccacagagtacacagagaacagatgaatccggcgttaccggcgagatcctagtcgagatggttcgacgagattccccggcgagtaggcttcgcgtcctccggcttcgtaaactatggtgggtgtgttggcgctatgatttgatgatatgatccccttaaggggtgtgccttttataccgtgagttgccttagttttcaagtagaactcggagacaatgaaccatgcacgacatagaataaacccaaccctctccgagtaagactctgttaatcacagcccgtgaggatattttccataatatcttgtagatttccttatcgcatacggaaatatatcgtatacacgaaggtataccatatccgtatattccgttttataggatagaaggtatgtcttatccatagacatatattttattatttttttataaaaagacaagctgctagagtgtgttaaggaatagtatagtgacatgtaaataagaacagaatgtccttgtatgtgagaggggggggggcgtaaaattcaacaatcaaatgctggattctcttttgtaaatttgaatcaagtttatcaaaatttagaatttcttaaaaatatttcaatccttaaagtcctaaaggcaagtgactttgtataaagtaattttgcaacggcacatgtgcatatcttaactaatccctctcttacaaaaggagataaagatatagctagtacactccaatcttgcaaaaccaacatatagagagatatatatatatgtaatcatttaggccctaaaaggtaagtcactttgcacaaggtaatctacaagttgcaacccatatgtgcatcatatctcttaagttcctagtactcctaactaataattcctcttttttacaagagatagaaaagtaatccaaatatatccaaactctatatatccaagtcgatctccatatatttgtaaccgacttaacttcctccctctccctttataaaaccctaaccgccacgaccccttctccctcctcgccgatcgaatcttcgccgccgccgccgcggacctcgccgccggcgccaagcaaggtatggacacccgagtctgcggcgacgaccaagcggccgaagcggcgccggtgcgcggcggcggcgaggacgcagtcgtcgtcgtcgtctccggcgagggggcggcgtcggaagctggtgctgcctctactacggccgtcgccggcgatggcgtcgtcgaagcttctgcctctgtagacctcaccggcgagaggggacgacgccgcgatgatgaagcgcccaccacggcggcggcggtggcggaggaggaagcttctgccccgccggccgtcgtcgtcgccggcgccggcgacggcgacgacgacgacgaagacgggtacgtgacaccgacgtcgccgcgccaacggctgcagccgccgacggtgtgcccgccggcgccgaaggcggcgcgttcggcgccaacgcggctgcctgcgaggaggtttgagggagctctcgtgatggcggcgtcggcgtcgccgccggggcggaagagggttcaggcgaaccccgactccgagtccgacgaggtcgtcgtcgcgttcattcgcagcctgcggcagcggctgcttccaccggaggacgagaagaagaaccccatgtagactttttaaaaatattttggtttggtttgattaaaggtagattgttttttttttaaaaaaatgaatttagtttatctgaatttcaatttttttggggctaaattcagataaatttgaaactgttggcgggatgcccatcctagctgggacccagctagacctgaaatttccaaagtttgaaatttggatttgagattgtgaatctgtagctcgttgttagatccgaattgtgaatcctgacttctgagcagggtttgaaaattttcgttttgaaaatttacactgggggactcttgaaatttcggaatttttcggaaccaattcttggaaatctcagaatttttgggatcgagtttttttggatatttcaacaaatgttgaccaagtttgactatatttacaacaaaaatgaaaaacttgaaaatttcgggtgacagtgttgtgcagggaattttggaccgaaattgcaacactgatcattttgtaaattatttgaaattcaaaccaaatttgagtgaattttgagcaaattcaccaaaaatgactttttttaaaaaaaatcaggtgaaatagttttatgccaagagtcggaaatttcggaaatttcaaacactgatcctgagtaacggtgaaaaaatagctgccatagacttttcgaaaaagagcatctatgctggcacgtacattaaaaaccttacataaattttgcacgaaaagttaactaccgtatcaatgtggttaaattaagaaggattattgaactcactgatgaactcttgtatgccaaggtttttaaaatgagaatgtagtatcgtctgagacttcgtatttaattcaaattattactacgtgacttaattaagtcaattgtactagtgaaaagtgacatgagttgtacccaagatcctaagttcaaatatctatttaagtgattttcagccaaggtcctacgttcaaatatctgtaaaagcaaattttagattgtattgtttgagagaataaattcccaatttaaaaaggctgtatatacgtagagaccgagtaaaatatacccttctcaaaataattaaaaaaaagttaattgtactcaacatattggcttgatattgacatgaactacaactattacacattatgtaaacagaatgaactacaactataatccgatttggaaatcactttggagcacgcacgcttaattaacaaccgatttggaaatcacttgggattggagcacgcacgcttaattagcaatcgcggaatcactcgagacgatcaatcgatcatatcgatcgccgcgctctcgagttgatcaagctcgctctcgactcgacgtcgttcatggacaatctcgccgcgctcgcagcagcagcccgcgcgccgccggccgttccgccgccgcggcgcgacatcgacgccagcttcgcgctgagccgccgcgcagctcccggtcccgggtacgcgcgcgcgctgcgccaccatgggcatgggcacggcgccatggcgagccagatggggcgggaggtcgtggagcaggcggcggagcggctggtcgacgccgggatgatccagttcaccgcgctgccggagccacgggcgccaccgccggcggcggcggcggcgacggcgagggggcggtggcggtgccgcgtgtgccaggtggagtgcggcggggtggtggggttccgggagcactgcatgtcggacgaacactacgccggcctccagctcttcgccctccactcccacctcttcactgaccaccccaacctctagaccgacctggctgtgagcacaatttctttttaaaacttagattcatgtttgaagctcaaattcaaacaaattttacgacagtttattagacagagagctgattcagttagtgtgtcttatgaatcctatatatttatatagttcatccccactaagtgtagttaatgctatttctctcttctttcattaaaccatatcaactcaattattttagtctttagatgacagatctatggttcaaattatctcttctttcttctctcttaaaaacatgcaatctcaattatttttaggctcaaaactatatcaaattgttttagttttgataatcaaattacatattatttctacatattacgcaacttaattttctgcagcaacgcggcgaggtatttatctagttaatcatattttcccccattttccctagcttgtaataataggagtaagttatacttttactagtacaaatcaagattgactcaacccagaagtactaactaatttgagggtctgcacttctttcgcttcaagtactgtttacatccaaattcagtttattgatctagctgattaagaataatttacatccaaattcaagataaaattaaagcacttgaacacacccttatctattacctaccgccaacgacgtcaaacaatgtcgagacaacaatccgtgaaggtgactgctcactgtcatgaactgcatgactcatgcaaatttaggacgacaagttcagaccatcggattcttctccattgtcctgtcccttggagaaagaaaagaaaaaagatccataggattctgatctgcagattattgactctacacgaacaggggctttggtcgcttctgcctgatacatatacactcttttatatgctgtcctttttctgtcatgaaatcggcctaacctcgttcgcgacgtgcgattttattttaaaaaaagaactatttcaacctgtttgtttttaaatttagaaatgaaccacattaaaatttatttttagatctaaatctttttgccacaccagactatgtgcatcacggcggcatacatttttcaataggctctcaatcctctctctcttttttcttttttctttcttttttttttttgcataatctcaaattggtcctccggcccggagcgagctcctctgtccctccgactttacgttagaggagtctcgtccctctagcccttcctacctggtatcccgtttagggctggataacaagccagctcggctcgttaatgttaacgagctaaaagactagctcggctcagctcacaagctggttcattaagcttgttaggctcgttaacaaactatatctcattaatattatattaataattttaaatttaacattttattatgtattaacataataataaaaactaactaatataatactcactacatatgaatagttttgatgtaattaaaagacttagtactagtcaagaaacatgaacatatgatgatattttatactaacgagctaaatgagcagctcgcgagctagaaggttagctcgactcgactcattaagactgcgagttcgaatcgatccgagccaagcttgctacgagccgatccgagccgcgagtttcgagttttttgtccacccctaatcccgttggttctttaaatttattgtacaaaccctttctcttttaataaacatggaatgatttatcatcttagctagtcaaaagttttgttgtaaattcgatgttaaatatgtagttttatggtacaccacctaaaatctgtagttttgtaattgtttggtcaaagtatatttagttacctaaaatttactaaatttctctcgatcttagtcaaattatatgggacattggatcctgccaatacattcgtgctagctatcggttgctatccatcttttagccttttcactagcatgatcaattactcccttgctacgttatttttgtctagtttcttttttcagtttgtgtgcataaacctttttatgtggattaaagtactacaactttattttttctagagtactaataaaattacattgtaaggtttaaaatgtacatcgtaagatttggaacttataatgtaaatgtataaatctttacagtgtgaaatatgaattttaatgtaaataatttttttaaattaccatttttattaaaaaaaatggcgctacaaataaatatagtactagtactctcatttgacgcttggtgcgctccaatactaagtgagaagtcggagtacgtatcgaatcgtatggatgggccggaatttcgctaggcctatctaaacgaggcctactaacatgatggccctattattccacggcccataaaccactaattagccccctgcagggcccactttgtttttcttagtatccttatttatgtgattatcttggtaatttgtctgctccatttgaccttgacttttgactgattcatggtaatctgcagataattaagagtaagtcctcttaaaatcagatactacaattgaataattcataccgtcattaatttatctgctatagctaaagtcttcagctgatcgtcctttatcttcggtcctaatcttcttcttttttcttagggttagtcctaatcttcttgagcatgcacagtaattaacaatttgtacagaaaccactttgtggcagccccccccccccccccctttcccactaagaatttgagatcgtgctaaataaaaaaaagagtgaagtgcaccagcggtccctaaacttgtacgggtatgtcatctaggtccctgaactctcaaaattcatttttaggtccctaaacttgtcttgggtgtcatatagatccaaatgggctccgagccgctccatccgctgacgtggcatgccacggtggcatatacgtgtcgatggagccatatgtgggtcccacatgtcggtatctctctctcctccttattctttcctctcccttctcgattcctcctctcctttgctgggctttcttgttcccctctcacatgtgcgcgcgccggagagggagaaggctggcgcgcgacggcgcgggtggcggccgggcgatgtcggcgcagcacagcggcgcgggagaggcggcggtggggatggaaagggaggcgcggcgaccggggcgacgtcggcgcagcgcaacggcgcggccgaggcgatggttgcgcggcggcgcacacgcgggtcgaagcggggcgctgcgttacacggccccgtcgg

SEQ ID NO: 84235 - DNA, 1175 bp, Oryza sativa
ccagctccccggctacgccgtcgtgcagtccaagtgggcgcgcggcgcggcgcggccgccgtcggggaggtcgtcgagtttcctgtccatacccttctcggggtcgccgtcgacatccagtggcgccgccgagaagggaggccggccggagcagggcgcctcgccggtgggcgtcgccaacgtcaactccggcgtgttcgccggcgggccgccggtgcccgtcggcgcgcagaagctgctcaagttcgtggacacgtcgcaggtgaccatgggaccgcaggatagccccggttactggctcgtcaccggcgcaaggctggacgtcgacaaggggaagatcatgctgcatgtcaagttctcactgctagcccaagtttcttgacgacgagtcgacgagggtgtcaagatgttcatgaccatcccgtgatccagagtttgtacagttttcagctgccaaatgcagatatgctaacaactgaaaaaacagaatattccaaaaaaatttgatttttgattttttttttttggtttggaccctgaagatgttgcaacgatctgtaaatgaaaaaagatagtaggaaccagaggtatcattctaacactgcaagaaaaaaaggattcgttgatctcagatcacacattcatatatgggactcgcatacgattcacagcaacttgtcttacattactactactgcagttcgtcttacgcaaaaggcgggaacaataccaaatttcattacaataaaccgaaggcaccaagtgaacgactgaatccaaaggtttgtggaaacacatatatacatcacaagctagatagcagttcgcccgcattcagtaagcattcaagcaccagaatagacatgttcaatgcaaaagttcagatatatgtataagagcaaacatgctggccacactcaaattctcaagttgtggagagagaacaactcgggctgcatcttcctgacgaacttcctcctttgcttaatgcgcaaaagcttctcatagatacaccatggaaagctgataaagtgtggtcgctcatatccttcattgtagcaaccccagaattcagggtggtaagtgacatggtaccaggcggatgccttggcttcggaggcatcatggccatgcccacttatcatctaagctcatctcactgaaccttgaccttg

SEQ ID NO: 84236 - DNA, 1533 bp, Oryza sativa
tatttattaaaacccaacgggaataatacttttttatttttaatgatcgaagatgtcacgacttgactgcgtgtatttgaggataatattttctttttgataacggaggtttgaccatatcttatattatggaatagagggaggactagctaattatatgagtttgctcatcgtgtgcagggtgtgacggtgatatactccaagaggggagggaacacgacggtgagcagccactcggagtggctcctgaccgtgccggcgatgcccgacgtgatcaacgtcaagctcgtccccatcacctccctcatcaggggcgtgcctggcactggcttcctctctcacgccatcaacctctacctcagatgtaacaacagaacagagcttaatgatttttcttttttagacgagtttatttactgttgattagtttaaaataacaaattaagcatgtgattggattgttacagataagcctcctgtcgctgacctgaggtacttcctggatttccagcatcactgcgtgtgggccccggtgctcggcgagctgcctctgggcccttgctcacaccggcaaggctccagcccggcgctgcatttcagcctgctgggctccaagctctatgtcagctcaactgaggtcagactctgaaacagcctctcactctgtcactgaaccagataaattccattctgtggttcactttccatggcgtgtgtgatccttcaaaataaaaaaattgcaggtggttgttccgaagctgccggttactggcatgaggctgcatctagagggcaagaaaaacaaccggtaagatttcacaggtttatttaaatataattaaatacacatgaaaacttgaaaataggtttttcttttttatagatgcacacccacgcactgagacacacatactactacacatgcacacctcacaaaatgtggctccccacgcgctcaatgaaattagtttgggggagcttatgtcagctctgcagctgcaagaaactcctcgaaacaaactagatgatcttcattcagataccaagaagttttagttgtagaatccagaaaataaactaaaagctagaagctagatttcccagattctttagattctcactagctaacttttcaccagctgcttctcagaattttaagtttccaaaatagaacataaaaccagcgacaactcagttatcagtccatcatgacataggcacctctgcattatctacaaacattttattattgtccaaggcatcaaacatcttccaggaaaaaacattttattatttgtcacccttatctcaatgacacgtgggtccatatgtgtcataacatttgggcccactaataaatggttaattgccacatttaatagtggcgaatagttaaatttctaaaaaaaaacaaagactacgatgaaaaagaaaaccttaaaactaacttttaagtaagttttaaactttgattggggccgatcagaaagagcatagaatgaaattgcatgttaacaagtttaggtatgcaca

SEQ ID NO: 84237 - DNA, 989 bp, Oryza sativa
tcaatctccatccacatgtcgcagccatgccaaatggcatactctatatttgtacctttcgatatgaaatggtcagatgtgtggcttcgaacagccacccttgtgaattgtccatccttactgatcagcttaaacttttgggttgaactgaataaagctggtgcatgcatgcgacgctttgatttttcagctgcccattgtttttgtctacttgtctctggttgggacctgacatttctagcgagtgttgcgttgttgttgcctatcaagatcatgatcctaacacgagcgcgcatttgcagcactcaaatcgcagcagggccaatcgaccactcttgggtcagtcaaggccactcagaattcagaaaagggacagtcaagaccactcagaattcagaaaagggagcaatttgcaggtagctttcagatgcatgcatgcgcttgtaaagttgcaatgcaattatttgtgtacgtgcaacaagctagctacaccattcgtcacataaaaagcttaattctaactataaatcatgcgtgttcaaactaatagctagaattagacttttttttaaagaaaggagtactcacaagctagccactaaccttgcgatggcagaggggtcccaggcgggtggcacgtcggcgaggacacctgcatcgagggcgaggtggcggtggtcgagacggaggtcaaagagggagatgaagtacccgtccatagcgaggcacctggtgtgcggcgcgtcgtgggcccacgacccgctgtccaggtcgaatgacgcgttgaactgccccgacgggatcttcccttccaccgaactcctctggttgaacagctccgacatctgcgtgcatgcgtgaatgcgtcaaatttggttaaacttttttaaaaagaaacaatgctatttgattttattattgttgaactgatcacattcaggaaggctgaaattttggcaagattctgttcagtgatggggcgcaggaat

SEQ ID NO: 84238 - DNA, 651 bp, Oryza sativa
ttttttaaagtatacggacacacatttgaagtattaaacgtagactaatccaaaataaattacagattcgcatgtaaactgcaaaacaaatttattaagcctaattaattcttcattagcaaatgtttactgtagcaccacattatcaaatcatggcgtaattaggcttaaaagattcgtctcgtaatttacatgcaaactgtgtaattgatttttttcgttcatatttaatactccatgcatgtgtctaaacatttgatgtgacggaatttttagaaatttaaagggaactatacactaaacacagccacggtgttggaaaaaaaaaagtaaagatgagatatatgtattgaagactgtgccattgactcgttgtccaaaccaacgaagaaaaagaaacagatatagtagaaatttatgtcacaagcaatgcaaagtttatctcataattgatcgaaagattcaagagttgagaatgccacaacccttagccatttttgttctagaaaatagagtacagtgattcagttaattacctccttgcttgatacaagagtggtgatcccgtgaagcctctgctgagctacttgtgcatcgaacacgttgaaggcctccggtatctatcacaattcaccacacagacactgaatt

SEQ ID NO: 84239 - DNA, 673 bp, Oryza sativa
atcccatcagagaacacatgctgtgtaccattttttatatctgagatttcttccacctcatacttctgaacctttaatgtttcggttgaggaactaaaagactgaccaagtcttgcagcatattttgctacatttctgatgttacggaaatcccccatccatgtcctaatgtcgctagcagctaatccctggcgagaagcaaacatccatgcagagttatctcggagctggcttgaagaaaaagcaagaaactcaaagttcttgccaccaatagtgatgccatctgaaaggactgacagaactctcttatacagagcagttctgtttgcatcatgtcctgaagcagaacggggggataaatcagttgcacggagcttctcgcagtcctcgtcaacaaatgaaatgcgaaggaaattctctatgtcagaagaaaaattccgcaccacacgattggagacattaatctcaggtccataaaaatacactgtagacataaaccaatccatcatccagagatatgttaggtgatggttggacgtagcgtgatctccggaattttgagtattgttcagatagccaacttgttggattcaagcaggtctttttcaaatatgacatcatttcaagtgcacgctttatatggtcaataggtacaaaagcgggctgcaggaat

SEQ ID NO: 84240 - DNA, 1725 bp, Oryza sativa
tcaccggtaactgcgcggttgtcgggcttaccacgggatacggtaatataaataccacggtagcctccttaaattcataaatttaaaaaataatttgaatttttgataaattttgtacgattttttacgattacggcgcgtggtaaccgtaattaccgccagggcacggtaaccccggccctggaggtttgggaaatcctaatctggtggttacgggtactaatttgtatattcctctggtccactagccattaatatctctaaaatgtatgcacagtttttccactttattcttttttaacttgcgagcacaaggatattttacttctactatcataaagttagttgctcgactgccctttcaataataaataaaaaaaatgtgtctacaggatacgttgatggcatatgcatgcgcatgcaacatatgcaatgtcgacctactgtccttatatatatactaatcgttgttgtttggttgtaccttttgttttctaaccttgagtgacagactcttaggaattttctagagcatgacggaaaacatattaatagcaattagcataggcaaatgttgatgaaataaaataacattatttactgtggtgggccagttaattagtaggatggctcctcctggtcacatgatcgagccttgggtccactagcgtactatggtttgatcatttgatatatactctctctgtcaaaaaaaaaaaaaagaagacaaaccttggtttccgtgtctaacattcgaccgtctatcttataaaaaatgaaaaagacaagtcacgcataaaatattaatcatgttttatcatctaacaacaatgaaaatacgaaatataaaaaagtttcatataagacggacagtcaaaattggacacgaaaacctagagtttgcctttttttttttggacggatggagtactttgatgtaaactctagctgctgcggccacctcaattcaacatcttttgagattgagatagtacacatctcatcgggttagactctatttagatgggactaaaacttttaagtccctatcacatcgaatgtttggacactaatgatttatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagagactaaagttaagtcgctgatgtaaacaccaccttcaacttgcacactcttctctcgctcgcagctagctagtttgtcctctcctgtacgcgtctcttgcagctcactgtctcaggcaagtcacaagcgagttcagttaactcgttagctagctagctaccgctgcgagctctctgcacaagacgatgtcgagtgtggttgatttgcatgcatatatatagcctactgcttcgtgggaaccccgtgttggctccgctattacgtgcgtgactcgtttgctgagtaaaactgaaaaaactgggcacgcccggactccgattctacggtctctacaagggaaaaattcacgcggccttagccgtgcatgagccgtgtgtaacatatacaccaacacacatcgatcacggccactag

SEQ ID NO: 84241 - DNA, 635 bp, Oryza sativa
tcagtgaactattttttatcatgacttttatataaagatattttattctggagagatttatcaaaatatttgttctcaaattcttgagtaaagcacactgggtgtccaaaaaatagctgtacattggaatttaaaacaccataggcattgttccatattgttcatatttatcttctgctttgacagaattcgtcaatttcgatgaaaatggtagatgcactccaaagtgccagtgaatcacttggttctgataatgttaaagtaaaaccagcagcttcatcaaatcctggtgttccaccatcttcattaatgtcgttcctaggaaaggtaaaacctcaaatatccataaacataaccatttgcttgatagtattgcactcaatatgcaacacattaatttagtgatgttccatctttttttttcttttttcattagaaacattgatttttccaaacaaatatttctctttgaaatctgagtgccatgacctgttcactgttaacccatcaataatgcagaattcatcaactcctggacttgtcttggaggattttgattcccaattttctaatagattttaccacagcactttggatggccctggtaagttcaccatgcagagggctgcaggaat

SEQ ID NO: 84242 - DNA, 1455 bp, Oryza sativa
ccatgaaaagagcatgggctttgctcacatgattagcaaagccaagaatgaaaaatggtaggttaaaacaagaatcacctgaggatgtgaagataataataaattacagacacagctatagacaaccatggattcttcatgatcttcttttagcggcaaagctttgataaacaccggaagtacctaagaatcaagcacagaatgcgtattagaccagcactctgaagtttgaaatctgaaattatgcaaaatattatgtactgcagagtgccaacctggttgagtggaattgactgaggctgcaccattatcatcctagcaatggcaccggcagcattatctctaactgcgtcatcaggttcagaatcagcaaacaaacgatgcagaccatggagtatatccccgtagtatctgcacaaagatgaataagaaccagcaaacagtacacgttaacaaaaacaatgaactgaatttacagcatgggaagtcactctaagctccatagaaagagcaatgcaatgttaaaaccaattcattatcaactagacagcagactattcagtacgcttcagaattcttagtcacatacattagcaattcagttgacgaggtgggttcagtttaaggataatgctcttggcatattatcactggaagaaacaatagcttgatttcttggtctttcgagcagaattttgaaaatacagttgtccaagttggactatgaaagaaaaaatggatccagagtaccctagtcactgacaggggactgataaatacaccgtaataattaactccatctgattgtgtcatcaagtattacacacatcacaaggaaatgcatataaaccatgggggcaaaatgggataagcagcatttggacttgtgaagtgccaaaatcttgggctcgaacccgtgaacccaccgaatcaaactaacacaacccacttttgcttgtgtacatggtttggttcggtttactccaccccgttcaacccatgagtcgcctccttctccagcagggccatctcaggtggcggccaagcccccggacggctgtgccccttacccgtgaggccgcgatgagtcccccaccagttatcgccccccatgcggcgaggtcaccggcgactgtgcgcccgcccacgacgagcaccctggcggctgcatccccatgcacttgacaaacaccaacggcggccatgaccccaacccttcgatgggcctatgctgcggctgcgtccccgcgtcggccatggccatgcccatggcaacataccctggcaaacggcaattcatctagtgctcgacacgccacgtctctgcggccagctgcgtcactgcgtggtcgacgactcagtcatcaacgtgatttatgcaacttagctctgcctccccgtgcttcttgggcagttccgccatgaaatctggtgctgccgacctcacaaggaacg

SEQ ID NO: 84243 - DNA, 687 bp, Oryza sativa
aacgaattcagaaatattttctcggaaacggaatcggaaatgataagcgcagtttccgtcggaactcggaatcggtcgaaaacttttcggaaattttctcggaatttccggaaattgtctcggaatatcagaaattttgtgattgaaataccctagattctttttttaagcactaaatagtgaataccatggtgtttggcagttattttttaaaaaaatatttgttatacaaatctaaaattacataagaatattttttgtcctacattgggatttattaacaacattactcttttaaacatagataatttattcaattggatttatcagtttgaggggttttttattccgataaattttcgttaccgtattcgcgccggttcgttttcgctccgttttcggtttcgataatattcgattccgttttcgtttccggtgtttccgattccgattccgattccgattccgaaaaaaatatgaaaacgaaaacgataaagatggattccgtccgtttccgtaccgttttcacccctaactccctccatcctaaaataagtgcagttttgcactatttacgttcaacgtttgaccgttcgtcttatttaaatttttttattattagtattttaattgctattagatgataaaacataaatagtactttatgtgtgactaaatattttcaaa

SEQ ID NO: 84244 - DNA, 609 bp, Oryza sativa
  unsure (1)..(609): unsure at all n locations
agctccgtaaatggttaatggaattcgtgtgtacaatgtattcttgcaggttgaccctggtaagtacagggacatttcatctggatttggtgtcctgctccaagagcaaggtcttggtggattcttcaagggctggatggccacgctggttgggtacagcagccagggggcttgcaaatttgggttctacgagttctttaagaagtgctactnnnnnnnnnnnnnnnnnnnnnnnnnnnngaagtggaagaccttcatctaccttgcagcgtcggcatcggctgagatgattgcagatgtagctctctgccccatggaggctgtgaaggttcgagtccaaactcagccaggatttgctcggtgcctgacggatgggtttccgaagattgtccaatctgaaggtgcctttgggtatagatactgcatttcttgtatacaattgtgacttctgttcaaagtttatttggggacatcctatatacaatgtgcgaatttcaggctttataaaggactacttcctctctggggtcgccaagttccttgtaagtcaaatgtctcgttagcagttatctttcactagagtattatatttgcatgtcacgtttttgg

SEQ ID NO: 84245 - DNA, 2134 bp, Oryza sativa
ctctgagacaacacctaatgatgttacagcagcctcacgatacttgggattaatatgacgaaagctcacagaagcaaactcaagaactggtgggaaacatgtctcggtaaattgatagccattgtatcaatgacttctgcagcagaacgatctgctgctagatcagaatctccatcttcatcagctgtttctgtaagcaaggggcacataacttgtagaataggtattaccagcttatgttttttcaagaaagatgctttaaattttacaagccatgagattatctgtatagcctgaaaaaatgagtgcacatttgaaatattagcagtttgtaaaatcagacggatgtataaaggatgtggctgactgatcaaacctgttgcctaatatttatttccagttcttggtttgagcaaacttcaagcgaaaattgtacaattgatctcacagagtccccaagaagtggggcaggggattcaattagttcatcaaatatttcaaaagcgatggaagcaacatcttcctctccattagcaaggcactgccttgatacattcaagatactaggaacaaaatcccgaaatatttttacctacaattacccagtactaattagttaaacagtatactctgcaacaaacacaaaatcaaaatttatggaaagggctagaggcaagattaaagagcacaatgtgaaaacagctgacacttatgatagtggcctagtgggcagtgactcttgaaaatagttagctgcacatgatgactaagctatactctggcatcttgctgcatgtccagttctacattttcttttctggggcacacagctattgttttattttcttttacacaggagaataagaaatagctcagtgaaaccacaaggatcaaaatgagattaggtggattatcttcaacgaatccctccctgtaccttgagctgaatgtatggtagaagtttgatttgcttttgtagatctattccccatgtgggtatgtctagagatagcagggtattatatctcagactaagatgatgctaaggaaaacaactgctctaaaaacttacaaagttaacaaattcaagagataaaccactacagtaatgagcaaacaaaacaagcaacccaagatgagctgaagcctgaagtgtcactttccaaaagaaaagggcttttactggaaatacataacaaccaggaggttaaaaattcatgcagaacaatagcacatttttcccatagaaagaaaacataaacacagaaatatctgtggcggcaggaaactagaaaaacttacaacatcacccccatcattaacatactctatgaaagatccaacagccctgttccacagaagacaaaactcttactcacagctaagaatatcaaaccagaatggtcagaatagcatgattaaacttagcatactttagggcagcaattctgacacgagagctagcctcgtcttgcaggcatttcagtaaaataggttgcaaatcattcagatgagattgaaaagtagttccgatagtttcagtaagggaactgaacagtatcaaagctacctgttaagaaaaaagtgagcgagtaagcattgacattatccaccaaaaaatgctgcaggttatagaactaggaaattggtccggatcatcagacttgtcaatatcaaatattgtactattagtatgttgctaaccaaaaaaaaatacaacttttatattcttatagcataaatcaagttcataaatttataaaaacagacaatgaaaatgtaaagcacaaaaggctcttcttatgtttaacaacaatatgattcaaattgccaattctcaggttgattctatggtcctagacaattacgtagtataagcatgcataactaaacataatatcggaagtaacacaagtttgataagaacactgaaactcgggatagacttacttctctatgatcttcctgtggactttggctgcattggaaaataaaaggtaacaactcaggccattctcctgcagggacagcgtacttagctataatactcacaacatttgcgctagctcgtcttacaagatggctgcataaaagtaagattcagtctctaacagaagtacatgtcaaaatacga

SEQ ID NO: 84246 - DNA, 3194 bp, Oryza sativa
ggtgaaagattaccttaaattagaccttggctgtaaaaataaggaggagcaatatctcaggccagagggataatacagaagaagtgctaccatcaattttatcattctgaactgtctaaccagcaatcacaatacttttattggggtacttctgttgatactcacagttggggtaaatgtagcgcatttctgctctccacaattacattgactaagtagggtcttaattggtctactgacacatcttaatgccaacagcccaacgatacctgtagcatgttccaagttattgctgaatttacgcaattaaccaatttctgaaatgtatacaagtcactggtacagtcagatttctggccagtcaggtgcataaaaacttgctatgagatgagaagagacatcttatgagaaaaatttttgtatgcttcagaatttccatagaatacaaaaccagcagaacagagtcagaaaaggattttttttagccatctcatatttgaactaaaatgcggtcatgcctgtcatctcaatcaataatcatgataatctggcaccgacacctaaacttggaagaattgtcaatagttgcattattgtacctgtgtattcactttttttttatactcaagctcatgttggttcacaacttcagacattagaagccctgggggcagctctagtagtatgttcagtgatccttgactgttgttactacagtaccaatttgtttcctcactgtttctcaccatcatcatgattgcatttctttcttggttagtaatgatctggaggaaaacatggggatctaccaaatgaataatatgttccactcctttcgtccatggaatgtaactgtgttcaacttcaattcctgatcgcatgttatgttctaactttgttgtctgcacaatgggttatcttggtaggttttatttggccaagtcgtctcatgaacccattcaaccacaatgacacaattagaaaacgggtcgatataggaagcctctacttgactattaagcatgaatgaacataaatgccatggtaaaggccagtttttttgtgttatagcattagctcttaggtgcgttgatatgaatttgtacataagttttaaagagtcagcacaatcagctattcatggcaggcataattatggacaataagagaacaaggttcttcataaatcctctatctgataattgggtcaacagaacagtgtttgtttattgtttgcctcatgggtgatgattttatctcttgtagattgagctactggtttattagagttgctttatgatgttgtgctgggcattctcttatttcttagcaggccagtacaacaaatgataaaggaaagggcttgcatatagaggatgatgcaggagaaactgacaatccgaaggatgcagtggacagtgtaacaaagcagataagtggcattgctatttctgaatctctggttgtcgcaacctcctccactgatgctaccgacaactcaaaatcggagtcatctgctccagacatagataagaaaattcgagcactgaagaagaaggttgtcttcctctctccctccctccctcactctctctccagttcatagtttttctgggggacctgagcctggtaggttatcccgaagttcccaagtaatttttgtctggtttctggcataaggcttccaaaatttcaagccatttttcattttctgcatagtactcaataattaagttgtatgcctggaaactaagttacacaatcaatcttaattagttattacttggtctaacttaagataagcacttgtactcaattttatcctacattgtaattttataagcacttgtaatcagtttttcttcttgtaagtttaacttattcatggtaactgccaagaatctaatgtagtagtaaccaatcattgattttatgttcttaggacatctcaggtattcagtccatgctttcaacctctaggagcaggcgagcagccatagtatatgttaacagtgctattttgatctgccaccatgggactaaattagatctgacctggataaatttgtcttgatttatcacagatacgcttagcagaagcgcaagtgcaaggagatccagaaaatttgaagcctgaacaactcgagaaaatgaagaagatagaaggttggaaagaggagctgaagcttttggagaataagagctctcctgctgcttcctagacaatgtcgacctcagcactgatgttgagtagagccatcatatatcgaatgcctgcctgctgtgatgttttgctgatccaaagtccaatcagtcattgtcttgcttgtcttattcccctcggcctctggaaaaagcaatccaattgatgtggggtttcacacagagtggtagctttttgccacaaattgttgtctcgtgtacgtcctccagttcgaagattcgtattgcaaaatctgtttgtcgtagacatcgtgcaatgagacaaccgattggagttggggtatgtgacggtgccattgtagctttgtatattatgccaacattggcaattcctcttgacactggatttacttctctgctgatccagtaataaccgtacaaatttaaaggccacaggcctcattgcatcgacaaagatgacaggcgagtccaatatcctgatccatctttgaacattcagcttatatggtcatcgtggttttcttctggtcatcgtggtttgcaaagcaataggaaactggcttgttttgggttatatagctagtatggcaagtctgcctgtttggttctttgtacttctgatgaaaagcttaagttggaaatgcattttatgctgtgattgatttcgtattctggactaaatattcacctatgggcattgtgcaacgaaacaaaattttattccatgccttttttagcgaaaaaatatcactccattgatgttccttttctccttttattcgttgtttttttcttggaaatatctgctcatgtgatagttaagaggcaacacttcacgacagatgttcaagaaacatgaactaccgttttaagggttgaatagtaaaagccgttccgctttatactaagagcacccgcaatggtaaagtaaggtgctatctataaaatatatacatctcaacaataggctagattaatagtaaacaacttcaatggtatgtctacatggg

SEQ ID NO: 84247 - DNA, 3751 bp, Oryza sativa
atagacagagacatgtaaatatttttttcccactattttttttgtgaattattttctgtccctcttcttttgtgaattacacgcaagtcaaacaacgcgtaaaaactgagaagtgatcgtcaagacgccaaatgccaatcgcgacgtggctgtaaacgccaaactgccaactggagaacaacaaccaaccaatcgtagcttttcctttggaatacccgtaccactgcataggaatcgttgatgagctgccgtacaccctttgttctaacaagaagacatgcacggcaattccaacctaagctactgtcatcggaagttccaaagtttggcaaagcacggcatatgatggcaaagacaaataaatcaccaccacgaacatgcatatttacatcgtcagttcctacttacactcatgcgcttgaatgcacatttaacctattctccgggctgaatattagccgctgactaaaccacgacatatcccctcgcagcaaactatgagaaagaatcaacaaatgaaacgcaatggttggggttgacgactgtgctgttgacaatattgcttcccggtaacgaatcgtcctccccggccagctccacatgattagcagaactaatatctgcaagagagaatatgcacgccagtcaaaagtcagattaaccacgcgctcaatgtcaacctagtgcgccacaaccgggcagctgacggtaacaactttgtattatatttgatatggacgaatctgtgttccggcgatgatgtgtgaaaatcgtttgcccaacttttcttacgaagcaaaacaattgtgtaggaacagtttaaatatttactatttttgcatgagtggaaagcaagttaaagaagactaacttaccattccaccgatattctgaagccgtcctcaattctatccatttatgccgcgtaccgatgaatttgagcgcgaagatgtcctcatagaccttatcgaccgcattgacctattaacgaaaggatgctccagcagctttgctgcagagggtctgtcttgcggattgggttttacgcactggcttataaaatcacgagcatccctagaaaggcaatttggaattgctggtggttcccccttcccaatcctgtataaagcttgtgtctgcagaacaagttgagaaaatggggtaaatgcaaaaaggaaacaaagtaatatgcatactggataattatcaaacttggaaccaacaccataactgaatttggaggagctaaattagattcctgatgaacaataactcacccattccagaccaggatagggaagttgacgtgtcaacatctctaggactgtgcagcccagactccatatatcagcttcaggtccatatgttgtcttgggattgacaacctgaaatttcatcattatcttaggaggcaactacaacattatctaacatcaatgcattataaacacatttttggctttttacctcctacctattagtttgttattctagataaaccatcaaaataaaagaaggtaaacaaatactacctctgtttcaagttataagattttctagtattgcctacattcatatatatgttaatgaatctagatatatatgtgtgcctagattcattaacatctatatgaatgtgggcaatgctagaaaatcttataatatgaaacggaggaagtaaaacccaagcatgtccaaatctaatctaatagaaatattgtgccatacctcaggtgccatccaataaacagttcctttgcacgatttaagcacgttgaatttggtaatctgagagatttgacagaaatcaatcatataaatgagataaattttaaaataataactgaaacattcaaagattaaaaaggaacataaagatttcgcgagagtaagcagacctccttagcaagaccaaagtcagcaagtttcacggatccattggcatgcaccaatatattggcacatttgatatccctgcaagacgagatttgaactgttattcacttattcagaataaatgtacagtaccagttccttaagaatcttcaagctaacgataaaaatcagtgagcaggcattaattagaataactgtcagctgaagtgaaaaaaaaaaacaataagcctccttagaaggctaaacagcagatatgctgattcaactaatgttattacctatgaacaatgtttcgctcatgcaggtaagtcaacccattaagaatctgtcttgtatatgctgaaacatgagtatctcgcagtctgtacttctgatacaaagatgcaagagatccttgggtgactaattcaaggaagatgtacagttttgagtcctcctgcagtagtcacaagaatggttcaatatgagccttaaaagaaaaaaagtacaagaaaactagaaatttacatacagcccaatagcaaatggtgcttcaacaaaatgatgaatggtcgatcaataacttactttgtcggtaccatagtactgcacaatattttcatgttcaaactgactcaaaagtgcgatttcctaaaatatgaaaagaagttaggacagatcacatttacaatacaacagaaccagtaagatattatagccctgggccctggcattattgacaaacaaaaaggaaacaccaacctgctcaagctgaaaaatgcactgctgtgcattgctcccttgatcacacaagcagacctctttgacagcaaagaagacaccttcgctgtaaaacatcaaatcataagatgtcgatatcaactattccggcatgtaagagacatgtgttatgcaaacattacagcagcctatactaagaataactgttgcaattgaacaccacataaaaggaacaacaggtattacaatgattcatttaggacagccagttcatgtgcatcttctagaagctaagtttcacatgtttcagaacccttagtgattaaacatatgtttacatcatgtcatattgaacacaacaaatcaaataaataaagtactattacattcaacattctgactctagcggaattctgattgtctacagcgtagggttatgctattcaagtaactgaaaatgaaatcatgttgatgattcaattaccacttactagtaccctacacgccatctagcaactgtacttaaagagatataattggagacatacagtgtacaatcaatcagagaatcaattttcctaaattcgggttaacaatggcttccaagatatgccttatgctatcttagggcaggttaaattgttgggtctcacaaattctcgaccacaaagtgaacaatcagcatatagaaatcataagcacaaagtgaacaatcaacatatagaaatcataagcacaaagtgagcgatcagcatatagaaatcataaaatttactctttagagcacttactcgctgatcccctcgaagactgtcccaaacgagccacttcccaggagcatcccccggttccacgaccggatcttcctcctaaacctcccattcggcgagatgtagaacatggactcggtggttgtgctcgacgtctcgtcatcgttcgtcgtcgacagcgaagacgtgcccgtgaattcctcggacgtctcccctagcctgagctcctccagcgtcaacaccgcggccgcatcatcctcctcctcacccgcgtcctggcatgcggaatcaccaccagatctgctcgccggggcgtgagcatggctatcctcctccggcgcgaacgaccgcaagatatcccacgt

SEQ ID NO: 84248 - DNA, 617 bp, Oryza sativa
acttgtttgttttggatatattttctggtggaatttaggaaactataccattagttgttccctccttagagttcaaaagcatacctaacatgtttaattatgcctccgatattaatatttctaggtgttccacgaaagggaagcttccctctagggagattgttggacataattatttcttcactctcatatctaactattatttgcgtatctctttgttatttgatgattttaggatggtgggaaaatatatcttgtattagagtactgtcgaggtggtgacttacactcataccttcagcagcataaaagggtttctgaaacagttgctaagcatttcatccagcagctaggcaagcactttctcagaccctcagtgtcttgcactatttattgctttatctctccccagagccaaaatcacattctcttctttatgcagcatctggtctgcagatgctgcgtgaaaacaacgtggttcatcgagatctaaaaccacaggttaaattatttaatttactgttattgagcggatatttccattatatcttcatatttaatgaccaagaattgatgaaagaaaccggattttcctgacattttggtttggtttctat

SEQ ID NO: 84249 - DNA, 662 bp, Oryza sativa
aaggtgagaggtttaaaaaaaggtgaaaagttcatgtgtgtagaaaattttttgatgtgatataataggatggaaggtgggaaaagggagaagctaaacacatactcctacgactgcctactcctgccaaaagaaataaaggtggtgtttggatcagagacttaatttgagtctctgtatttatatattaatttagagcattaaatatagactactgacgaagctaattacataaatgaaagctaatttgtgagataaattttttaagcctaattacttcataattagataatgtttactgtagcatcacataggctaatcatagattaattaggctcaatagatttgtctcgcgaattagtccaaggttatggatgtgttttattaatagtctacgtttaatatttataattagtatccaaacatccgatgcgatagggatttaaaagttttagggcccctttgatttggaggaaaaacataggaatttcagaggatttcaatcctataggaaaattttctatgaagccctttgaaacaaaggattgaatcctaatcctttgaaattcctatggaatagacaaccctatagagattttggaggaaatttaacaagagcttcaacctcttgctaactttcctttgagtctatatctctcatc

SEQ ID NO: 84250 - DNA, 586 bp, Oryza sativa
gggtcccttacaaaaaacaatcgccattaagcccacaagattagcactgaactacgaactgttccaggggaagagagggatggaccaaccgtaagggtcgacaagggacgccgcggcggccgggttgtgctgctgctgcatcctctcggcggctctcttctgccggatctcctccagctgccagacaaacgcgcacacaaaccccaacacaaatttgagcctcaaatcccagatacaaacgagacgcggatctgaaacgcctcgcgtcacagagaagcaggagggagaggagaggagaggcatacggtgcggcgcccccgcgaggcgtgattggcttccatctccggcgaccggccgacgaaccggtcggctttctggaagctcgggatccggaggcgcgacgcgaaggaggatggccgatggcgggggctcctccggtatcgcctcgatcctgtgatgcccggagaagagaaggggaagaaacccaaactcgtgggcctagccaacgtgttggccttctagagttcacaagccggcccgtacgagcccgatcgggcaggttattcagtacccccatgcgttccaa

SEQ ID NO: 84251 - DNA, 574 bp, Oryza sativa
agattaaacatttcctctggttagctctcaaagatagaattcaggctgctgagcaactgaaaaagagaggttgggatggatcagagttctgccagctctgtgatgttttggaaacaactaatcacattctttttaactgtgatatggctagatttgtttagtgtttttgccgagatgtcctcaattggaataccattcctagaaactttgatgatttcttttctctttgcaatggggtttcagaccatactcaacttagaatcatttttagtctgttagctgctatttgttggaatctctggattacaagaaataacatggtgtttagagagaaactggtctattctccactaactattccttttcaaattatttctaatcttttgcagtggagaaaactctttcgttctgaggaagaatgcaagctggacgcgctggtggaaaggatccgccagcgcgtctgggccaacgacggcgagatccgccagcgcgtcgaccaggacgcggacatcgccgccgaggccggcgccaacgcgcgctggaccatcctatcgctcgtacgtcccctaccaca

SEQ ID NO: 84252 - DNA, 566 bp, Oryza sativa
tgtcattctgagaccccgcggtaccaaagaaagcatgccatatacgaagattttttgatgccactgcttcaaggatcatagtaggaacaccttgtttaccacttgtaaactgacccgcccaacctttcggacaattcttccatggccaatgcatgtaatcgatgcttcccatgcacccaggaaaaccacgagcctcattttcttgtaagatttattcaagttcatcgcttcttggaggccgtagatattcgtcaccaaatgtttcaatcacaccttcagcgaattttcccaaaatctccaaacaagtgcttgcagctattttcaagacctcatcaagttgatcagccgaggttccataagctaacatcttgatggccgctgtacacttttgaagtggtgaatgactatttctaccaatagcatcgactctttgggtgaaataaggggaccaatcgctaagtgcatgcacgatacgcaggaacaatggcttattcatcctaaatctcctacggaacatgtcatcggtgtagataggatttgcggaaaaataattagcagatttgcgg

SEQ ID NO: 84253 - DNA, 682 bp, Oryza sativa
tgctgctgcaatcaagactgcgagtgaaaggggtatgtccagaattgagctagaaccagactcaatgatgctccggtatgcgattcagaataattcctttaacctttcatccttagaaggagtgattcttgagattaaacatataattttgagctgttttcattccttctctgttagctactcgccccggagttgtaataaggtggcacatgagcttgccgcgtatggttgtaatctccagaccgtgtcttcctgggcaggctgcccgcctggtctggaacggctggtatccagcgattctgctggtttggtaatataaatctctcggtttccctcaaaaaaaaacgcctgcatatttcattcctcacttttcagagaagccacaaccacaaaccagcagcgtgaataatgtttattacggagtaatcactatttccatcagctgacaactttcgatactgaattactgatactcgttcagtctcctgcatacacattacagataagtactgtagtatttttgcatctatgtcatttctcaattactcctagtgccctccattgctgagcggtggaaccttttttttttttttagagaactctgagcggccaatctatccatcgttgtcctctgcgccagatttgggtgccactcgacttttgggtggtggatctatcacga

SEQ ID NO: 84254 - DNA, 567 bp, Oryza sativa
atgtaaaggcaaccatcttaattgcaaggaaatctttttgtaattgtgctgttggctataagaaactatttgaagctaatggataaactttaggcaatgcaagagggggaaaaaatgcagaaacagagcaacattatagacaaaaccgaagttgatttgcagaagcagacaagtgtagtagtaacaaaattacatttgcttcagctgaaggggtggcattcccagctgcaaagaaagctccacccagcacaactatcctcttaaccttgcttgcaaaggaggagtctttcttcatggcctgagaaagaaataaagcaaaagtgttactgccagaaataaggttttggtcctagtaagtagagtattaattaagaggcgttagagaaagcacatattacataccaatgcgatattagtgagagggcccaaggcgagtacagagatctctcctggagattctgataccttatcaaccagaaactctgcagctgactgctcaactttgttggtggtggtaggatcaggaaaggacgtgttaccaagttcatccgatccatgaacaaaatc

SEQ ID NO: 84255 - DNA, 612 bp, Oryza sativa
cctgcagcccggagactaaaccggggtcggccagagtaatggactgtttgtaaaccaaatttgaaaaatcaagtttccttcttatgtctggctggaagatcaaagaacagcaaatcatcaattgattcatttgccagctagtactccagttgaaccatcagttatcctaattcattcccttttttctaatgttcagagtacaaaaattcatttctggtaatgagatgggatcgctgtctcccctctccgctatggcatctcatctactccgatcctcaccgagcataactttgactaattaatcagagtatcatccgcaaccgaaagtaaacatgaggaagagagtcttcctcccctttctctaatttgacagaaaaaaaaagaagagaaagaagcaattagtcactaacagaatttgagcatcagtcttgtcgatcgatcagcattatctgctggtgtcgccgccgggcgccggtgatggtgacgatgaggaggaatactcccatggcgtcatgtccatggggtagctgccgagcacccggaggaaggaggtgaactcctgtatctccgacagcgcgttctgcgccctgacctccctcatggacgcctgga

SEQ ID NO: 84256 - DNA, 1122 bp, Oryza sativa
tccctcatcccccacggtatcctccccctctgcagcgatccagatcgcgcctccatcttgaccattatgacggcggtcggggcctcagaggagcaggctcctaagggccatgacgacgcaggcgggagccgccgaggggatcaatctacccccggagggggtcgtgcttctgggccccgcgtcgggggctcggggagcagccgccctaccgactcccgggggaagaggaagctgggaggaacacctcccccatctcctccccgagggggcggggcggtgcgcgccagcagcaggcgcccggagggggccgcgccagcatcgcagcccgagggggagcgcaagaagaagcggctgcgcaagatgggggagacagaaccatcccggggaaacctaatttcccctccaaggtggtcatttaccgaccccctcgcaggttcgtcccacgctcattgcgaccgtcttttcttctatcccaaaagcaagttttctcttacccatcttgtttgccttctggtttttctttctgcttcagtgatatctcatcgcgttcctcccaccatcccaagtccggccagtccgaggccgaagatccggcggccgcagaggcacggaggcgggaatctgaccggcgagaggccgcagaccgcctacgggaagctgaagaggccgcccgggaggccgcccgggctcgccaggctgaggataccgctcgggaggaggccgcccgggctcgccaagccgaagaagccgctcgggaggaggccgcccgggttcgccaggctgaggcgatggcggcttccgaggcagttcgcgacgaggccgcgggcgcctcgcttgggtccaccccttcgggcgacgcccaggaccaaacaggtccgggggcggctcgcgacgaggccgcgggtgcgtcgcttgggcccactccttcgggcgacgcccaggaccaaacaggtccgggggtggcccgcgataaggccggcgcgtctattggcgggccgagccgcgcggcatcttctccaaggcagcccttccccacgccttccgtcgccccgctgagcgcagagccccttctgcaggccttagccgccgcaaataccgcggtgttggatgggttaaatgccc

SEQ ID NO: 84257 - DNA, 10518 bp, Oryza sativa
  unsure (1)..(10518): unsure at all n locations
ctcgctaacaaataaagaagtaaataaagtatgtgctagttattcaataacaaaaaaaataatcaaggcatacaatattttgtacaaatgccaaaaaatgtataacattaaatttcaaatcctcgacttactgcaatatgtttgctctgcttatccatccaatacatgagcgcgcctcttattcgagcaacagcatcataccaaagtgacaatgcaggttctacacccagaggaggccaatgatgtttgcctccctcagcaagcggggccagtatacttgagagcatgttgcacaaagcatgttgcagttcactctttcttttgttgggaggacgatttagaggatttgcttttgcaatgaaagaaaccgaggcattcagtccaccctctgtcttcacctgaaaaagtaaattcttaagtatgtaataactacaattcaaactgaatggcattgttatgtacattggttcaaagatgatggagtgaatagagtatcagttaagttacttcttgtgtatgtagatatgtttttcttaacaaaattaaaattctgcaaatcaaaaggtacttttgggattctatgtacagtggtacacaagtaaaaactttggatgattcagattcatcaaagtgctaatatcagagcatgttttggccagtgaaagtggacttgtaactgaagcatggtagtggtaccatactacctgatagaacatttggaattttgtaagacagcatgccaagataaatcagattgtcattgccatgcactttaaatacttgtcaactcactatgaactggcacagaaaattaaaataataaagcgatctttgtatcgtacccccaatttaaggtagcgcatcccattaataatgctgagtgaatcacttctagaaagaggcgcatcattacgccgactattaagctccatgaaaaacctttccgtcacagaactaaacctgtatgaatcatcagaattttaagtaacatagacaaagaggtcatataacagtgcagcagcttttacatggcctccttccctccctaatttgaagtaacatggacaaagaggtcacatatgtcttttatttaaacctttccttcaatatattatatataattaaactgcaggggcctcccctgcagtttccttgtcaagaaaaaaaaaggccacataatattgcgacagtttttacatggcctccctccttcgcacacaccccttatccatgttccatgtaaatatagagcatacctgatacgagataaagctcccaaaagttgggcaacaagatctaagaggagacctcgcaaatcaaccaacgagggatactctacttggctaacaaccctgcagaaagtaaagaagttggtaagaaactcaacttctaaagaatataaagtctttttttcctggcaatcaagaaacaaaatctaacataatgacaaggttcgcaaaatttggcacaagctgaaagaaacaagaaagcaaatatttattgcacatgatgtgctgttttgatgatatgcaaagccaaagataaacaaatttaagatgcaccacaggcgtggatgtgttttatttatcatgtgagaaaacctaagtaaaaaaaaggcagtaatgcctcacctgtctgcattaattagccaatcaaatacaaaattttccaggccaatccaaagtttctctagataaaataaaacagctagttagccaacccatcagaaagtagccgtgcaaataagtcaaaatataatattataacaacctgttattccctcttgtgggcaatactcagcaaaacgaatgcaggctgaacagaatatgcactcgacagcaagctggataaggggtcagaaaacagacatgaggatttttagacgagagtacgcaaatgaaaatactatgggagtaaaagttttgagagatcagggatcaaataccctgctggcaactatttgcaactatgaaataatagagaaattatatgtgcaagaatgcctgtctgatgctgcttaatagttagttacaatcgaaaatgaagtggttcttgaaaaggagagggcaagggcaatcaacgacaaaccttcttttggaacgttgatgcgtcatgtgcgccttttggtgattcactgtgcgacagtgaagaacagtagttcagtaataaataagggagtgcagagaactcattgcatatttgcattgttcaataatgatttcggggaagcattaagggatagggctagagctttcaaagtcaaggtgaataagcatacctttccctccaccgaagaagagcttccaaaagaggcaaaggtgtgtgcctagcaaccatggcaagtgaatccaatacttgctcatagcttggatcagatggacggaggtattgcccatcctatgcattttcaaaaataaagaaatttagtgtcagatgtattttctgtaatagtaataacatttgccctgatgatataagctagtaatcaattttgaagttgttcatctggcaggtaaaataataatgcctcaagaaaacaagagaatgtctaggtagaaaggttcctccatgcagttgagctaagtagtattgagagaaacatcatcgtgctcttggaaacatgacccagtattataggtggagcacacatgtgaaagtaacgagaccatcaaaggtggagtacgattttgagcatttttcaacaatgtgggcatgtcgcagcacaagcaaatcaaattcaaatggacacgcatgaggaggcagtttcatagagaaggaagtagcagtaataacaatggtgggatggcaatgatttggagcactgatagaagcggcagcatagagcaattgtactttgaacatagggtatgggggaaatccctaggcctaagcggttggaagaggtggtgcacctgcaatcgatccaattcgaggagtgaattggggctccagtgagatgaagagggtgaaggaaagaaataaaacaaatcagagtgtggagccggaaccggaagggcgatctggaaggggggtgaaccctaggaaggaaggaggtgagtccgtcccgatcccgttgtttatccgtgagggagggaagaggcaggccccaatctggtgatggaattccgggcgaggcgaggcgagaggagagaggagaggagttacctgtgcctgcgcggtctcgatgcggcggcgggcgagcgggaggaagcgggcgaggagcgagtcgacgatctgcttggcggcgccgccggcgcccatgtcgggcgccgtgggcgccgcactgggcggagtggggggcaggggcggtgggtaggagacggagacccccgcggctgcaagcgccgcggaggtgctgaggtggtgggaggagcgtggggtatccagcttgtgctcgcgccggagccagcctcccgccgatgctgctgccgcctcttcctccttctgcctccttctgcctcgcctctcctgtcctctcctcgagtgctacctgtggtgtggtgtccccttcctcttctttcttcttcttcttcctcctctttaccaggcaccaagcaccaactgtttaggcgtcatcaacaggttacctgcttattatttactgcattttccttcccttctcattctcctactttaatacatgcaatgttttttctcaaatgtccctaactatgtttcttttattttaattttaacttgcaggtggcattattaatgcattccataaaaacaactacttttacataaaattgccattttagactttagccattttcaactgaatggtggattatctgattttttatatatatatcaacaaatgtattaactattgtactaagttgaagagttatttttaaaaaaagtactctagaaaatttacacataaagatttttttttaaaaaaaacatgatctataatcgggataaaaggagtgctccttctaatttcgacttgaggccatttgttcaaatagatcctccaagctcattctttcaatcaaaatagtcatcgagatcgtgttatatgggggcaaacacgcccaatacccatcgttgccatcaaaattattttggttttctcaaaaagaaaaggtattactatgcccaccctctttcaaacataaaaaaagaaaggaaaggaaaaatattctctttttatttttgaaaaatctactatgatactatgaatttggtttagcttatgtagcagctgtctgggtacaactttcgctagccttttagtccttccatgacatatttgagggtataatntcattnttatatataatctccatatttgatgttgagcatttatttttttgcctttgaaacaaatgacaaatacggtgaaaatgctaatgcgcgtcgtgcctttctatttttgcctaatttgttttcgaatcgggtcaacattccattttacacctcacatcgtgtggtttttttactaaatccaaatagttgcatgcgtgcttgcggcccaaaatatgctccttttgccttctgacctttttcatttaaatatttctatgtaaaaatatttacactttaatattatttatgtataaagtttatatatatttcatgtatatgtatatgtatatagtttccctacaggtataaagtttttatataaaagttttatgcatacaaaaattctatatgtggtgtttaaaactgatgaaaacgaatatgaagtttgcgcacgtaaaacgagaagccactagcacatgattaattaagttttaattattataaacttgacaaatgtatatatttgatattttaaagtaacttctgtttataaagttatcacacgaaacgtaccgtttagtagtttgaaaagtgtgctaatcggaactgagataaaatctgaatcttaataagaaaatagtaaggtgttaggttgatgagttgcatgtagctcataaaccaaaaacttgggttgaaaggagaaatgcgcacgtgcgtacgtgtctacacgggctatgcgcgcacacacttgcattagagcggtactagatacgaagggtgtgtttgatataacatgaactaaagcggtgaattttttatacttatgaatcacgtgatatcataggcatgttttttaagctcttacaataattttgtaaaaactttcttcattagcatttcttaacccatcaactttatcgtctatgttctcgaataattgccataagctcgatttcatcaatcacgcatcatcaagaatgcactctttactggaacccaagtgaccaaaatagatattctctcgaataattatattaacttgaataattatatcaagagacgtactccgtatcaagtagtaatactcaatttgatttataaaaatagttatcactacatttcaaagctaaggccgtgtttagttgcaaaatttttctttaaacttccaacttttccatcccatcaaaactttcctacacacacaagcttccaacttttccgtcacatcattttaatttcaaccaaactacttttgtgaactaaacacgacctaaatagacatagcacagtgtacaaggcatagcaccataaatggagccagtgctcagtgtagaatactactccactaataattgtgtgctgtggagtactactaaattgttgccacttattcggcatcaatgctcccttttaatactaggaagatggttgagggtaaaatagagagaaatttgaataagagatgattgatggggtaattagtactctagaattgctattattttgggacaaaatttgaatcctagaaatacaattattttgggacggaggtagtatgtttttttgaataaaaggtttacccgcagctttaatagaatagtttgtctggctgcttttaataatcttacttccaactgtatatatatagataacacgtgcctaacaatttagaattattagattttctaattataggattctaatgaaactatctaatctaaacttataaagtaagagaagtattggtccagatccagtgttttgtcagcaagagccgaggacaaggaaggcagagagaagtgaaaaataatagtaaacgggcctgaagggcctattcttcgtgcatcgatgacgggccgacatgtgcctagtgggccgattttcacacagtggactgcctgctgcttactgtgcagtcgagttttggctgacggtgacgggcaccgttaccatacatactactactactagctgtgtggttgtagtagagtgctccctccgtcccaaaatataccagccttgtactggatgagacatatcctagtacaacgaatctggatatactcctattcaaatttattgtactacgatgtgtcccattcaataaaaaatgttatattttatgatagagagagtagtaaatttaaatctaacatagattattttatttgatactttgctcatagtatatctttaccaattgatttattttagcagccacaatgataaatcttacttcctccgtttcacgatgtaagactttctagcattgtccacatacatgtgtctagattcatgtatatgggcaatgctggaaagtcttacattgtgaaacagaggaagtattaagctttcagagttaaaccacccccaaacacacacatctaggagcaccctttcctacatatccatacaagacaatccatcccatcaaaagcctagcttgtacattaatcagcaatcatttgttacttgggatccgttggtagaactcctaaatttaactccaaaaattatgtctaaaataaagttgtgaagctacctaaacctaactttacatatttagttcattttatgagagagcttcacttccatttataggtgaagctaaaactgtctagctgggctctagctctagaagaagtggagctggagctcgaggtgtgtcaaacagtcacttactatacctatgcacgactttcatctatccggcagccaatgaattttgtatcttccccttttatgtactctttgtgatagtttctaatgcagtgaatatggataaaaattacaaggtagcattacgtggacgtagagccaactatagtctgttgattgttgtacttccgctaatacttctgcaggtaaataaccaaacgatactattaggatgaaatcttttgaaagctggtgggctgagagcaggtacaatagcaaattattagccagctacgaaaatattttaatgagataaaagatgagagagaataacaacgggctacatatttgtagccagctgcagcacagactccaagacgcaatgtgtatataacaggtgggaccatatactaatagtgtagtaaacaattattatatgattggttattagattaactataaataaattggagctaataatcggctatactattaggcaacatatcctatgcacacgctacctatgatgcactcatgcactcagcctccatagaccctccgatttctatccaacggatacaaatcttaggtgagcatttttgcagaaaaccgcccgcatcctacacctaaatttacaggtaaccccctcgcttgcttttctcctctcttgttcattcttctccccagatcgatccccaatcctcttcgtgctgggcgacggtggcatctccaatcgccctcgcctacatgcgcgtcctcctatcgaggctggtgagcaagcggtggccgtccggcgccctgtccaagcgctgtatctcgcagccacatggttgttctctgctcgtggcctggttttgccagctatataggcgtggtggtggtggtcgtcacaacggcggggctcgcgctgacggcatgcagcgcatttagggtgtttctcttcaggtcattagcacacgatgtttgattgggtcaaggatgatcaattaggatgaatcgatggcttatggttctctttttcttctttgctgttaactgaatgcaaaagattttgttttgatttctccattcaagtcttatacataatttgaggtgcggcgttttgtgttaactggctgcgaacagtcgttttgtgctattgtcatggattcagatgtcaatatagcatctggtgtaaaatatattgatattgttagactgttccctctcttacagaaattgcaaaacactggtgacagtgaaatattgctgaaaattgaattgtgatctggatcaatttctcttcttgtttttgtcatcgattggacactggtctcctcctccatcggcaaggtcactgcttggaggtcagccgggccgtgaccctgcttgagctaggccatctcaacattcagctgtgtgtggatggatacgcaaccgtcggtggccatgatgcaggcacctcaacaagaaggcagcgcgtgcatcaacggggcgattggggatgctgccgtcgcccagtcctacctcgagagaattggggatcgatctggggagaaggttgaactagagaagaggaaagcaagcgaggggtttacctgtaaatttgggtgaataatgcgggcggttttctgcaaaaatgccgcacctagatttgtatctgttggattggaatcgaagggtctacggtggctgagtgcatgagtgcatcatagattcataggtagtgtgtgcataggatacgttgtcatactattggctaaccttgctcggaggtgaaaataaactcacgagaagaatctcctactccagcaccgagtgcaggggaggggatggggtggtggtggtggtggtcggtcaatactccactgggagtactggagacctggagtggagcacaggaggacagaagcacagaaattaatgccaggctttggagaaccccgaggaaacgagtatgcaggcatatctttgactatggagtagtagtatattccactgtagtcactccgtattatactattatactagcactccctctcttccataatatagtaatataaataaataatattatataaataaataatattatagaacggatggagtaaatatggtacttaatataaataaaattgttactaaattgtactagtaagtaaaaaacttaaatataacttttacctatacaaatgctattcaaacgcacaagtacccactctagaaacgttggctggtatgtccatcatcacttaaaaaatagctgtaaacctgagcataaatgcgaagtctaacgcttaaaccccgttgtcgaaacagttgagctacattcctttggcatacttaggggctgttcactttgttgtcattttcaaacttatcaaatttggtaaaattgttaaaaaaaagtgactacatttagtttgctgtcaaattttagtaactatataagaagttaccaaaattttggtaatgctaaaatttggtaaagttgaaaatggcataaagtgaacatgcccttaagtagaagctgattcatttattcttgttgcacttgctctaagagtaaggataatggtagagctcacttcctattattagcccatcttaaagccaatatatataatagattagctataaggttggctacaatattttcttctcctctctctatctcttaattatgcatttaatgtatttgtcttggatcttgtgataagctagctcttgcataagagccaacacccttgatttttcactacctctctcctccctaagtttatagtaggcttatagctcactattatacttgctctaaggccattcctaacccaatgattaggatggtgtccataacattaaataagttgccacctagaatgaaaattgatatggcaagtgaataaatgagaaaatagaaggaaaccatattttgcatgagacatggtttgtacacaacatccaagacatcatatgagataagtagcattaaatttaagtatgtaatagtgatgtttgtattggaagagtagtgtctagtactagtttcttaatgatgtggagcttatggaaactatgtctaatgtcttggattggaaatggcctaaattgttaaatcatacaagtcatcgtgttagtaagtttgtcgtaaaaagatacttctgcaatttcaaaatgtagctaactagtataggatgggatattacctagtgatataaatctggacatcccatcatgtactaggtatctatattttgggacggaggaagtactattttataagtaatatagttatagtgttaattttttttagaaaatataattaaaaaggagatagtacagtagtaaagacacataataaacataacagtgtgtgttggttagtaaatcgatgtcctgtgttctgttgtgggacttttagtaaacagagcagccaggggaagggcccaggcccaactaacaattaaaggcccagttacctgcatcttttcccttcttccctagtcttctcctctcctcggtgctcagttccttcacgtgctccagagcagcgtggccatggcgaccgcaacgcgagctccagcatttaaacccgcacccgtcccccgcttccctttgttagtt

SEQ ID NO: 84258 - DNA, 724 bp, Oryza sativa
gtccctcaattgctgctgtaagtagaatatcgcctgtgacctgttcctgaattttttttccctggagggtaataatttactctgcctacgctaactatatatcgttttgcaggttgtagcctcccaagattggcctgaggtgacaaagtatgctgggttggtttctgctcaagcccaccgacaagagctgatagaagatctatataaaatctggcaggatccacagagaggaacagttagtggtggcatgatccggtatgctactcagtattttttagtagttctttccttaagaacttcacagatagttcttcatttttaaaataacatgatattaaagcccattttatatttatattgccaaaaaatgcagtgagctgcttatatccttcaaaagatcaactggtgagaagccccagcgaataatattttacaggtatctaccctttaggaggaacaattagactttctatgatttatagatttggaaatattatatgtgctatatccatgatttctgttggatcttttgaaacatagcaacatgttgaatttgctagaggggacatctcttccactgaacaggaaacaatcataattccactaaagccggatcttgttttcttttgtcagggatggcgttagtgaaggccaattttaccaagttctactttatgaattgaatgcaatccgaaaagtaaaagtttgccagatcctgtatcct

SEQ ID NO: 84259 - DNA, 743 bp, Oryza sativa
attcctgcagcccgtggcccacaaaagttaaggacatgttggaggagcagcagagacgaaccttggggcaaagagcagcatgttttgatttcccttcgatgaagtatgaggtcagcgagcaaggcggagtcacggcggctggggttcaatggggtggacgtcactacgtcgtggttgcgagagataacacatgtagttgtcagttccctcagctccatcacttgccatgctcccacatgataaccgtttgtaagttgcgaggtttggatgtggaggtggccccccgaatgtgttatgaagcttccaataaggctgtgcaggactcgtactcccctaggtttgaaccttacctagatccatcgcagtggccaagttatgatggagagttcttcgtgcccgacttgtcattaaagaacaacacacgaggaagaagaaggacaagaaggttcaagaacgatatggacaaagcatacaaaggctcagccaaccgacggtcacaaaagccgaacaatacaaattcagagccggtcatgcaaaatagatgctcgctatgccacgaactaggccataagaaaactaggtgcccgaagcgagacaagtctaaggatcgaccgaaaaagcgccgtaagactgtgggagggggtgagggtagcacacaggtgggattggatgacattcatttgctaagaccatattgttgcatcaatgtttactttctgttgtcctcctttccgttctcattg

SEQ ID NO: 84260 - DNA, 644 bp, Oryza sativa
ctgtcacgccgccctgcctgagcggcggatccgggggcggccgaagctgccacaccggaaccggaggggttccaagtccaggcctcctccttgcgagccactcggtccgcgagctgaaaaagctctgcggtagtctggggctctttggaggcgatcttttcgagcatgcggttgtgccgcacgccccccctgaacgcgtagattaccgcgtgtgcagggatgcatggtatggtattgcggacttgacagaaccgctgaatgtacgatcgaagcgactcatcgtcccttcgctgtacggcgtgcaagtccgcttcctcaccggggcgcggatacgtgccttggaagttcatggtgaactgctggcacaaatcctcccaggagtggacagacgcgggtggcaagttcattagccaaccccgcgcttgccccttcagggccatgggaaagaaattcgccatgaccctgtcgtcacccccggcggcctcaatcccggtcgtgtagacctggagaaactcggcggggttgacgctgccatcatatttttcggcgatggcgggcccgaaccttgggggccaacggacattccgaagactcgccacaaatgctctacagccgacaccaccaaccgggggcacggagggctg

SEQ ID NO: 84261 - DNA, 665 bp, Oryza sativa
gttgttgggcgtttacgtcttcaccgaccggccgcttcgtccgccgccgactggtgtttccgccagcacggctggcctattatgccgccgttgttgggggtctacgtcttcaccgaccggccgcctcgtccgccgccgactggtgtttccgcctgcacggctggccttttatgccgccgttgttgggcgtctacgtcttcaccgaccggcttgccttcgccgccgccgactggtgtttccgcctgcacggctggcctttatgccgctgttgttgggcgtccacgtcttcaccgaccggcttgccttcgccgccgccgactggtgtttccgccagcacggctggcctattatgccgccgttgttgggcgtctacgtcttcaccgaccggccgcctcgtccgccgccgactggtgtttccgcctgcacggctggcctttatgccgctgttgttgggcgtctacgtcttcaccgaccggcttgccttcgccgcctccgactggtgtttccgcctgcacggctggcctttatgccgccgttggtgggcgtctacgtcttcaccgaccggcttgccttcgccgccaccgactggtgtttccgcctgcaccgctggcctttatgccgccgttgttgggcgtctacgtcttcaccgaccggccgcctcgtcc

SEQ ID NO: 84262 - DNA, 1428 bp, Oryza sativa
caccgtgtgggaaaaactcatgccattgaaacgtccgtattggctccttcattatatcttttgttggtcgcacaagtggcttgatctgcaggtcagacataggacaccgagtaataaacttcagatgaattaacaaagaaagaagtaacgatgacaatttcaccaggaacctttacaggcaagaatatcctaaaagtcatccggaacagtacaagttttactcttaacactggggctttaagggcaaaacttacccagaaatggctggtagctcatagctgcaccgtaaggcctaaaagccacctaaatttcccatggtcttagaacttaaatttgggggtgccaagattagcacaagtgactaacttatacacattcttaactttttacagatttgatgtcttaaagatcacattgcataaggtccttcaacttgcaaaggatatggaaacataatgtactgttctctcaagttcaaggatccaggtagaaatatatattttatgaacctagcaaacaacatacgcatacaattatatgagtttatcaattgacacagcggcagagccacctcccaggctccgtcactggtgtttctactgtcctttcctaggcaacacatgtaaaaaattgccggttgctagtaaacgttcttcgtcgccccagttagacgatgccgctggctccgccactgaactaacacttagggtcctacaaatcctttggtataccattcactctatgaatttgaatgcacaaacatactggggcaacatatcttataaaagagaggtgaaacaagttgaaaacaatacctccacgtagtagcttactatcaattttgttgctaagagaaggacccagaacattgtgtacctagaagaataacagtcctcagagagagaatggtgcaagcataaacaacaaaagaatgttttatagaagtgaacatacttgaaaagggagaatgctccttcatgcattcctctaccaacaaacaagcgaggctgtaggaaaagtatgtttggtatcttacacctaaatggtatcaagaatcaacaataagaataaagctgacaaaggaaaactacctgcgaccaccacatcatgaatgttacaactttaagatttgatcgctcaagagctcttctaaggactgggaaaagaaataacacagccgacagcatgtttggtgctaaatatatcacaacagccaagatgtataatgatggttgattctgaccatcaccgagccaacttttaattgttcttgcaagacctgtaggattctcccaggtgtatgcataattactggtaaaatcacaacccatgcagcagctgatatcaacttcaagatgtagcgcagcttgccagcaagagacatgcttcttcttgctttccagctcaggatgatgtccagaattgctg

SEQ ID NO: 84263 - DNA, 520 bp, Oryza sativa
atctgatagacaacaggtgtggcatctgatatctgcccttagatatggattgacttattttgccttcttgccaaactgttgtttattttctatttgggcagagagaaggatctgttacttgtgccatactgcaaagatcgtgacatggatataatccagtggccaccattcttgcttgctagcaaggtatatgctttctattcagctcctattttccatgcttcctattttggtgaaatgaggtacctatgtttcattttgtttatttggctgaattttcagatcccgatagcgttggatatggctgcagacagtgaaggaaaagatcgtgatcttaagaagagggtgaaatcagacccatattttacttatgctatcaaggaatgctatgcttcattcaagaacatcatatatactttggtggttggtgcaaaagagagagagtatgttctacattctcacacttaaaaatcagattcaaactcagttttttcatgagtaactttatggcacataaatt

SEQ ID NO: 84264 - DNA, 1097 bp, Oryza sativa
tataccgtactatcaaataagcacgcccaagcaatacactgcgagagtttgatctatccttttttcccctatgactcctttctacactagatgatgccttattcatcggtttggatggtcaggtcctgtatgcccaaatcttgatataatccatgcacatagtcgagcacggactggcaatcaccaccattcttcacctatacacacaacacaaccaaaacgcgaactcagtcactaggggctaggggcttgtttagattgtagccaaaataaaccttaccaagttttggtaataccaaaattttggtggcaagatgacaatattgccaaatttttagcaggatttttttatgtatttactaaatttggtaacaaattaaacgtagacattttttttggcaactttaaccaaaaatggtatggttgaaaatgacatcaaagtgaataggccctagggtaaccacaacaagctgtctgttagtgttaggaggcttggcgtaaaagatgtacccggatgtcgagagatccaacagcgtgaccaggtacaagctcccaaaatcgaccttgacatacttcagaaacatcctcgcacgcagttatctggtgagcaaatacaatacatacggaaatgtctcaaagaagctttgggcttgccaaaatgaactgaataatatgcaaaaccaaaccgtgtacctacctgtctgaagcacttggtaagagctgaaggtggcacattgcctggtgcaatttgcagaaggatattaccagtagccttaaagagtggcaaaacaagcatgaacactgccactgaaacaattcccaggcacaacacttccgcattttcaacccttaaaagcagtaggcataaagtcattttaggattaagtgccaagctaaaagtgaccgtaacattagaggggcacagaaaattcgtcagaatagatttaccccaatgaaagaaaccaggaagctagtatcaagcctgcactgatggaggatttacacatgtcaactaaaaataactaacttcgtgactacagaaagagcaaatattataagggaagaggcacagtgacatgagagtatctcatacctcc

SEQ ID NO: 84265 - DNA, 642 bp, Oryza sativa
atatactgtcaaattctcaaaataatcaattatcattcagtttcagcaaaatatgaaattaatggttaaaaagcttaccatcatagaagaactaaaatctctctaaatacaatgtgtttagtgctttttcttcttgcggggaaagcaaaatcaatccccaatgacacaaaccgcacaaatttcataaagtgcatgcagttttctaattttcatcttacctgcaggaattttctcaaaacatataatagtttttttgcctaaatacttgcttgcatatgggtttgtctaaatttagaaatagggatatgacgcgtgggcctgggtgcatgtgatttcaccataggattgctaggcaaaactcctcctttttatattagtatagatatattttgaccacctccatccatatgcttcttctttgttctagacagctcttcctgctcttcctgtctttctccttggctgttgaagcactacatgcatttatgcaagatgagtctgagcataagtaaatgccttttcctttttgtttagtgtaatataatcccatcgttttggctaatattattattcttttaaaactaaaatatatatatatactttcaggcattatttcattgtttttgctgtccccaacctttt

SEQ ID NO: 84266 - DNA, 772 bp, Oryza sativa
ttcctgcagccctgtcagctacaccactccgccagaacacttttcgagttagcttccgcacttcggaaaattttcccaggaaaaaaggttggtttcaaagtccttgatttcaaaacagcttatatggctttactcggacaaccggttttacccaagtcatggccgtcccgcactacacctacttgatgataaaaatgcctggtcctcaagggatcttataattccggaccgacttcaaccaacccgtaccttgtaacaaaaaaggtggcaaaatggttaaaaccacaaaacccttttgcccaccaagaaaatccactggcttgcaacaccgcaagccaaggaaaagtggctggcacccaagctgacaaagaccgaaaaaagtgatgcccagacgaaaaagattcccttagatcccttcgatcctgacaagactactgtaataggcgctgagttagattgtaaataggaaagcgcgctcatcacctttcttcaaaataataaagatatttttgcgtggaaaccatccgatatgcctggtatccccagagaagggattgagcactctttacatgttaaggaagacgccaaacccatcaagcaacgacttcgccgttttgcacaagacatgaaggatgcaattaaggaggaattaaccagctattagcagcaggcttcattaaggaagtccttcatcccgactggctgggctaacccagtcctgggtcggaaaaagaccgggcaatggcgcatgtgtgtcgattataccgacctc

SEQ ID NO: 84267 - DNA, 514 bp, Oryza sativa
ccctcgcccccaccggagccatcaccttccgctggctcgccacccgccccatgcgccgcctcgccctcctcatcgctctcaacgtcgcctactccgccaccgagctcgccatcggcctcctcactgcccgcgtaggtcggtaatactaatactactgctactgctactgctactcattactcatctcaatcacactcttctccattcgtttcaggcctagtctccgatgctttccatctcacctttggttgtggaatcctcactttctccttgtttgccatggctgcctccagaaccaaacctgatcacctctacacctacgggtgcctccctccctcaatttactcctcttttctttaatcttccactcccactgattcattgctgcctttattcagctataaaagattggaggtccttgctgcctttacaaatgccgtaagcttttcaacatgtcattgccatgcccatccctctacatttctctactactatatatgagtttattgtgttt

SEQ ID NO: 84268 - DNA, 606 bp, Oryza sativa
caccaatcggcggcgacggaggcaggccggcggtgaagtcgtagacgcccaacagcggcggcataataggccagccgtgtaggcgaggacaccagtcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcgaggacaccagtcggcggcgacggaggcaggccggcggtgaagtcgtagacgcccaacagcggcggcataataggccaaccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacgaggcaggccggcggtgaagtcgtagacgcccaacagcggcggtataataggcca

SEQ ID NO: 84269 - DNA, 893 bp, Oryza sativa
ataaaatagttgataagtccagcaaaccaaagaaaaattgtgcagatttggtattcaactgtatatgagtatcttgtgtcctgttttgattataattgttcttgttcaaatctttgcacggtcatttgaatagtcattcttcttctgaacaaaatacatatatacgtcgcacaagtttgtgtgcatccatagaaatgcttcaatgcatagctctctttggcaaattccatcttcaagatttgatgttctaattaacatctgacttgctgtctctttaattggaaaacttgtgcactgcagtgtcttgactccttactacaaagaagatgtccttttctcttcccaagcattagaagaccagaatgaagatggggtttctattcttttttacttgcaaaaaatctatccaggttctctcgaaatgtcaaaatatcgaggtttacatgactcaataattcccttgaaatcctcctggatatcaaaatattttttgtttctcggtttccttgtagatgaatggaaacatttccttcaaagggtggattgcaatactgaagaggaactccgtgagacagagcagttggaagatgagcttcgcctttgggcatcatacaggggccaaactttgacgagaactggtattttctcctcaattctctgtcatagcttttacattttattctcttgagaacaactttcagatagtaatgtgtttaggagtttgattcattgacagctgttgcacttccttacagtcagagggatgatgtactacagacaagctttggtgcttcaggcttttcttgatatggctagagatgaaggtatttcttagtggctgagcctgtttcttgattctgaaggctgtacacttaattcattggttttgcttg

SEQ ID NO: 84270 - DNA, 620 bp, Oryza sativa
aaacttcttttaatattgcttatttttaattccgaattttagctatttttatattgtattcctacttggactctcctttccttttctaattttggattttattttatttttatttcgaattttgattaatctcgtattgggttcttatatggaaacttctttcgatattgcttatttttaattccgaatttcagctatttttagattgtattcctacttagactctcctttcctttttctaattttggattttatcttatttttatttctggaaacttctttcaatattgcttatttttaattccgaatttcagctatttttagattgtatttctacttggactctctttttcttttttctttttctcctattaatatgggaatttctagcctccacagcgaacgtggtgcctccttttcgagctgtcttaataatataatagatatggatggcccaggtatgcatgcaattgttagttgaaaacttaaattaccacgagaatcttaggtgtggcattcaggccctgctgcttgattctttgcagcagttcgtcttccagagctctaacttggtccaggatgtagacaacctgaccaccggtgtctggcataccgaggac

SEQ ID NO: 84271 - DNA, 3061 bp, Oryza sativa
tagtagaggtgataagttaaaaagattgttactgtacttgcctttgcctaatgaaaccaatttctttgggtcatactactgccttgtctaaaaggaaaggaaaagagaggtttacccatagcaaccgagggtgatgacagtgcggacgatgccgtcgaggcggaggcggccgcggcgcctggcaacgtcgagggagacgagcaccggggtgtcatcgtccttggtaccggtaaggttggtggaggagaggatgaggattcccatggtggcggcgcgcgcccgagagtgagtggaggagaggtcgccaaggccgaggcgctccagtgtggtggcgtactcgaggtggtgaaccgacgcgtcccgccggtacaccaccgcgccctcccacggagaaccctcctcgtcttcttctttctcctcctctgggtcgtagtcgacggtgaagaagtcgtcgtcggcggcggcggcgcatggggagtgggagagactaggagagggttgtggtcggaagaagaaggagcaggtgtggtggagtggggtcatcgccatcggcgggggaggggtgcaggtgcgagtgcggcggaggaccaagggcaaggctcctgcgacgcccccaatgccaaacccaatcatcatcatcttctccaccccccaagcttcttcttcctcctcttggtgccatcggccatcccatcctctcccgcgtgttgtagggcccatgggctgaatcatttagtaaggcccaagggatgcgccgtggtgcgcggaagtaacagcccatcgctgctcatggaaatgccagtttctccaaaagacgctatgtttataacaagtaaaaaaacaccagtaacaaaaaaaaaagcatgtactagtatctatctatctatctatctatctatctattatattattaaaatagctttgaataaagacaccacgttcgctgtcgaggctagttaatcgaagaaaagagaaaaaagctacaccgttagattacaatgaatataaattaaagggtgtaggtttatcagaaaaaaaaattttatcagtacgaaacaaagtctatccaatacataataggaaagttactctattatattattaaaacagctttgaataaaggcaccacgttcgctgtcgaggctagaaattctcacattaatcgaagaaaagagaaaaaagctacaccgttagattacaatgaatataaattaaagggtgtaggtttatctgaaaaaaaatttttatcagtacgaaacaaagtctatccaatacataataggaaagttactctaatctttcacgtacgtgcatacatgcatgttggattcctaatagtatttggacaaggatgctttccgattgggtgtggaaaaaaaggaaaaacaaaagatgcacagtccatggaagagtacatctagactcaaatcacttaattagccagataatcttgctgtcacgcaaaaaccaggcgcattaattcatctttgatatcaacacgtacacctacacgatagattgttggtaataattttgtagcttactaaaagttttttttctacttaaatacatatttaaggagtctgttcactatattggaactagaaaaaaaatatatgcacaattacatttgttgtttaattacgaagggtttaaatttactccattgatcatacttgaaaaaaaacatttactccaataatcatatttgaaaaattctacaccactaatattggttgatttaatttataataagttataacaaaacatatatagtatataagttaattgtataaggaaaaaatatttcttggcataatagaccaccttaacaaataataattatagacaagctagctcgaacgggaaggaaaaaaaacacagtccctgtcttcataagaatctagcactttgtgaaccctttagttgcatgccataagaaaataaagataactcacctatgtcgtaggttatagacttatagtacttaaaagaacaattttcacggaaaaccctgaacaatttccattgtgtgtattatatttagtttcctatggaggctacaaaatcccacattaatccaagaaaaagaggagaagagttcgagtaaaaatacatctagaaattattgaaattcggaataaaaaaatatggaaagaagagtccatgtagaacacaattaaagattaattaaaatttggaataaaaaatagaataaattccaaaattataaaaataagaataataagagttcaagtaagattacaattttcaaacaatagaaattggaaataaaaagaataagaaatattgaaagatttcccactatacagcacaatacaagattaatgaaaattagaaataaaaactaaaattaattcagaaattagaaaaataaaaataagagttcaactaggaatatggtttataaataactaaatttagaataaaaataaagactattgaaagaagagaccgtctagaacacattaggaagttaatgaaaatttggaataaaaaataaagtaaattctaaaaaatagaaaaataattataagtgttcaagtaggaatataatttataaatatcaaaatattggaatgaaaatatgattttttttaaaaaaaatagtccatatagaatacaacgatgagaaattgcaacaaagagaagagaagcaagcccgtaaaggagtagggtggtggcagttgatggggcataaaaaaactataaacaaaattctaaatagaatcccaatgatgattaagaggagggataacggcaagccattaagtaaccggtcacgacagttggcgggacttctacaaagtaaaaaaaaataaaccacaacgacaatcattttcgatatttaaaatctcaatgataataaaattgagaggcaccatgcgggtcgcataggaatacagtggttgagccaccaacagttggcgggtcttatagaaagtaaaaaataaactccaatgataattatgtttgattttcagaatcccaattacaataaagaggaaggcactgaacgggccgtagaagagtacaataa

SEQ ID NO: 84272 - DNA, 1473 bp, Oryza sativa
cagttatccatcacttcgggttgcctatattgatgaagttgaagagccaagcaaagacaggaacaagaagatagaaaaggtttactactcagcgttggtgaaggcagctgtaaccaagcctgacgatcctggtcagaaacttgatcaggtgcttcgaaaatggattttaatttaatcattttttatgattatggcttcatgtgattgcattagtacgtctttattagtcacttcgttagattacaaccctattcgtaggttgtagttggactggttatgaaggttaagaaagttttgaatttgatgaatctacaagagaaactcacttgagtacccttccaattaagtgttctacaaatacgaaagataatgacttgtgttggtggtaaactggtaatgcggtaaacataggagagaatagcttaagagctaaggatttaaatctgcacacacaccttatattttggagaactggcattaactaaaatgtcttacataaagtaccaaatggagtattaatttataacgaatcgatgaatttatgaaattcctaatcatggatacaatgtttggagcagatgcattttctgatctggtggtgatacctactaatataaacttttctttgcgggaaaagggaacatataaaacttacttgaattgcatcatttgctgtgtaggacatatacagaataaagctaccaggtaatgcaatgctaggtgaaggaaagccagaaaatcagaaccatgcgataatatttactcgaggtgaaggccttcaaactatagacatgaatcaggtaaacagcactgatgcttctagttttgcaacattttctattctgtttgcttatgtaggcaagcataataggaacattacatggaggagactttgaaaatgagaaatctgctgcaagagtttctgaagaaacatgatggtgtgaggtatccatcaatacttggtgtgagagagcacatattcactggcaggtatagctgtgaacttgcgcttccccataaatttgtgactatgtatactacttctcatttaaattaccctatgatcgcatgtttgcttttgcagtgtttcttctcttgcgtggttcatgtcaaatcaagagacaagttttgtcactattggacaacgggtacttgccaatcctttgaggtgattcatcttactatggatatattttttttttagaatacgcaggagatctgcgtatcatttcattaagagaggaagacggtggaggaaaccccccaccaaggtcttacagagacaacaccaaacacaaagctcacgcagcaaaaagctcacatagagaaacacacacaaacgaaatttggcttttatgtttgtatggatttggctttaatatgcccatgttagtatgtgtatttttttgattcatatgtttgttattccttcatttagtaacagaatttggataattgcattgtaactaagca

SEQ ID NO: 84273 - DNA, 605 bp, Oryza sativa
cacgcagtcgttcaggtacggcttcgcctgcatatgcacgcgccacggcaccaatgtcaatgtccctggccgaacacctggccgccacaagcgcgccgccgtgcgcgtgttgtgcgatgcgcgacgcgacggcggcgatggcgtatgaatgtgctacgtacgtacccaggcgaggaggctcttgtgggagccgtccaccggcttcctcccggagatgagctcgaggaggaagacgccgaaggcgaacacgtccgtcttctcgtccacgatgccgtgcgtgaagtactccggcgccaagcacctgcacatcaatgtcgtcggctcagcgtcgtctcgtctccctgtttttactgccatggccatggtccatggagaacgtatgtgtgctcacccgaaggtgccctcgatgggcgcgatggcgtggtgcgtccactccgacggcagccaccgggcgaggccgaagtccgaaatctgaggcgaattcaattctttctcggtgagcaaccggacgaacagatagcgagcagaggagaggtagaggaggaggaagaacctggggctcgtagtcggcggtgaggaggacgttggacgccttgatgtcgcgg

SEQ ID NO: 84274 - DNA, 728 bp, Oryza sativa
tcctgcagccctgcaggcctcaccaatgcataaacctgcaaaacttttcctttcattgagagctttgggagcacctgcaaatgtgattatgttagcagttcagggaatatttcgtggattcaaggatactaagactcctgtattttttataggtaacttccaagaactactcttcataaccacatgattacattggtttgcattagttatattccttttagcagtcctagcaaatattttgtggaatcacaataatgtttccaatatcttttttttccattttccacaataaagggcatactttacgtccagtttcatttgattccagactcttctctgatatcaaatatctctcatattacactatatgatgtctgtaccatgttcttttaaaacatgtaggtttgggaaatctttcagctgtagtgcttcttcctttacttatttacgtctttcggcttggcataactggagctgcaatttctacagttgcatcacagtaagttctatattgatacctagccccatggaatccaagtaaaacaacaaaggtaaaaaaagggaatattttatatgaatatagcagcaaataactcagtttggttccaaataccaactgtttttacttatagacatgtttctaaaataatgaaatgcagcagaaaataaactttagctttccttttggttttcatttatcagcaattcagcccacacatttaaattac

SEQ ID NO: 84275 - DNA, 600 bp, Oryza sativa
cggtgaagtcgtagacgcccaacagcggcggcataataggccagccgtgtaggcggaggcaccaatcggcggcgacggaggcaggccggcggtgaaagcgtagacgcccaacagcggcggcataataggccagccgtgtaggcggaggcaccactcggcggcgacggaggcaggccggcggtgaaagcgtagacgcccaacagcagcagcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccaatcggcggcgcggaggcaggccggcggtgaagtcgttgttgttatcagcaatggcggtggcgaagacaagccggcagagtggactcgcggccgatcgaccggaaagctgagacgcctcgagtccatgaccagcatcaatcgcctcaatagtgccgcgtaattatatgcgaacaacacaaa

SEQ ID NO: 84276 - DNA, 647 bp, Oryza sativa
ctagacttgcatgtatacaggatgaatattctcaatgggtagtagctagccaaagaagccttcttgaagttatggctgcattcccttcagctaagcccccactgggagtattctttgcagctgttgcacctcgcctacaaccgcgttactactccatatcatcatctccaaagtaagtatattctgacctcttagttattatttatttaaaaggacacagatggtatccttgtgcttggcaaggaacatccacttcattttgtggggttcaaaacagcaagaagcttacacaaatttttattaggagtgcctttcatgccttggtcagcatgaattcttcaactgctagattgctgcattatagtgtaatgaagtcattttcgatttcagacactgctgcattgttgcatcatggtgtcatgttagattttggacactgtctgataatgtattttttgtggtcattttgaggatatgacttgctgttctatttgttctcttgctgcaagatctgactccttgaatatgtccctacaggatggctccttccagaattcatgtaacatgtgcgttagtttatggacctacaccaacgggaaggattcaccaaggagtttgttcgacatggatgaaggtgagtttcttgt

SEQ ID NO: 84277 - DNA, 1207 bp, Oryza sativa
tcctgcagccccaattgtatgaagagctctgtgtacgtctcttgccatacccttggcatcaccgcacacatatatgtaaccaccttgtgagacgatgttccaaatttctgtggcctgatatcagcagaaaacctcattgagtatagccatgtgtggggaaattctgtatagaagttcaagaaaagcagcatagtgcggtagaaatgtggagcgtgtatcgaactaaccttctctgtcatcttatgctgcacgtattctttggctggtccttcacgagagaaggcaacaatcagctcagaaagtgcaccctcctgaatgaagttttgcaactcgtcttcatatatgtagtcctgcaggttggtcattcagatgaggtccagtaagagcaacatgatcataatatgtatctcatgaactatcttttgatgcataccatattacggttcctgcatccaaagaagagaactgaattgcccagttcaactccagattgttttagagctaatctttcctgagcaagcataaataacagataaagttactagggccatctcaaatccaaagtaaacagaaatgaagatttgggaaaacaaacctgcaagaagcctctaaatggtgctaaccctgtaccaggaccaatcatgataattggagtggtcggatctgcaggcaacttaaaatttgactgcctcacataaattggtgcccagctacactcttcactatattctgatgggattgcgttctacaaagtagatattgtggaggaggaataagtcaaactgctgtaggaaaccttctcattgtcattgcaggcaatgcaatatagagatatatagagagagagttataatttgtacaagaaactcaccttcatccatgtcgaacaaactccttggtgaatccttcccgttggtgtaggtccataaactaacgcacatgttacatgaattctggaaggagccatcctgtagggacatattcaaggaccagatcttgcagcaagagaacaaatagaacagcaagtcatatcctcaaaatgaccacaaaaaatacattatcagacagtgtccaaaatctaacatgacaccatgatgcaacaatgcagcagtgtctgaaatcgaaaatgacttcattacactataatgcagcaatctagcagttgaagaattcatgctgaccaaggcatgaaaggcactcctaataa

SEQ ID NO: 84278 - DNA, 725 bp, Oryza sativa
ctgaaggaaaggccgcccctttcatcctccgaccccgaggtcatcggcacagaagacaagtgcgccccgaaaggccacttgaacgaagaacgccccggggatacggcccctagcagagaggatcggccccaccgaaaggtgcagtggcctgtctactttgttagtgaggccctccgggacgctaagacccgataccctcaggcccagaagatgctttacgctattctgatggcctcgaggaaactgcgccattattttcaggcacatagggtcactgtggttacgtcttaccccctcggtcaaatcttgcataatcgagagggtacaggacgggtggtaaaatgggcaatcgagctttctgaattcgatctgcactttgaaccacgccacgctatcaagagccaggccctcgccgattttgtggcagagtggaccccggctccagagaccgtctcaatccccgaggccagcacgaacccctcgcagctgcctcacaccacccactgggtgatgcagttcgatggttctctgtccctccagggtgccggtgcgggggtcacgttgacctccccgacaggagacgtccttagatatctggtccgccttgactttcgagcgaccaataatatggcagagtatgagggactccttgccggactcagggtggcagccggactggggatccgccgtctcctggtgttaggcgattcccagctggtcgttaa

SEQ ID NO: 84279 - DNA, 740 bp, Oryza sativa
ttcctgcagccctttttgtacgaaaatgcccaatgtccgctaatcaagtaaaaaaaaacaactgtacctaaaaaaccaggcaaaaaaaggtgttcccacgcgaaaatcgacgagccagaaaattcggatagaaaaaaccgaagcgtgtgtaggagtaaatcaattcatctgtcttcctccaaacctagttacatcgcacaaacatgctttaaactcatagggtaatcaacatgattcactttgttttgtgaaaaggcgtcatggttatgactgtgattagactgagaaatgggtgcttaatagtacatcaaagtgcccttgcgtaaaggaacagatcaaaggccctacagaattatttcccataccttaaaggctgaggcgtcacaaaaacccactcaagagacagtgagaccaaacaatatactacctccgttttttaacagataacgccgttgactttttcttacatgtttgatcattcgtcttattcaaaaaatttatgcaaatatataagatataaatcacacttaaagtactatgagtgataaaacaactcgtaacaaataaattataattatgtaaaatttttaaataagatgaatggtcaaacatatgagaaaaagtcaacagcgtcatctattaaaaaacggagggagtattagtttatgacaagctgggagtaagtggtaattagggtcagctcttgattttaattgtaataattcgtacagtattaacat

SEQ ID NO: 84280 - DNA, 1451 bp, Oryza sativa
gtccagcgatctagccagaacgttcgtgtcgcgagtcaccgacaagtctcagctccgtcatggcatgggctgttcagtgggttggctggatggtctgcctaactgggccaaggattttagaccgtggaaaggaaggaatctctttttgtctctctctctctcttttgactcacgccactgcgtccctcgtgttgtgtcgccccttgggagagagctgaggagaatcggatgtaacattttctgtagatgtccgtggatatatcatttgcctgattccgagtccgtatgagaaagttacgcctattttaagaaatgacacccgaatgacgcctaggcatgtcggataagttcactttaggtccctctatgtgtcacccagtctgattttcgtcccttgatcgcaaaaccgggtacaacaggtcccccaacttacgaaaccgtttaaataagttccctcggaagaatttgaccccggttttggctgaggtggcacctacgtggctaatttgactcggtcttcatctacgtgggcattgacgtgacgcttatgtggcaatttgatccgaaaaatattaaaaactaggggatccacatgacagtttcacacacaataattaaaaaaaatggtggggcccacgtggaccccacctgtcatcctcactaccctctctctctatatcctctctccttcctctctctctctctcctcttctccgccaccttcttctccgtcgcttcgccactatccgtgtcgccgccgccgaccacccagacaccctccgcgcaccgggacggcatcgccgagtgcctctacgccgcgctcgtcgtcctccagccgccgctccacaagctacctgccgcctctcaagtctcagctccgtcgccgcccctgtgcgccttccgtcgccactcaccattctcagggagagagaggggggatagagagaagaggaaggagagaggatagagagagagggatagagagaaggggatagcgagaactgcgccggagaagaaggtggcggcgggccgcggcagcgcccggggcggacccaacaaggaagtcttcctcctcgtcgtcgctggactgcacgaaagcgaggcgacgaggccgaatatggcgagcatctcggcaagcagcgccttgggcctccccatggcggcctacacgaatgccaccgccgcggtgctgttcgacgacgcggcgtccctctaccccactgcagcgtccgccgccgctgagacggcgtccccggcggcggcgaaggtggccgccacggccctctcgacggctgctctgatggcgcagaggaggaggcagctgaggtagcccgggagctggaccagcatgagcaggagcacgacagccatggcggcgcccttgaacaccaccgcggacgagtaggcgatcccggctcagccctgtgatgaacagcttcgccatggccatt

SEQ ID NO: 84281 - DNA, 725 bp, Oryza sativa
tttcttggcattgaggtaaacaagacacacaatggcattgttcttactcaggataagtatgctactgatttactaaagaaggtagggatgttgaattgtaaacctgctaccactcctttatctgttagtgagaagttgtctttacatgagggatctctcttaggacctaatgatgcaacacagtatataagtatagttggtgcattacagtatttaactctcactaggccagatatagctttctctgttaataaggtgtgttagttccttcatgctcctacaacagtgcattggacagcagtaaaaagaatattgagatatataaaacagtgtactagtatggggcttaatatagacaggtctgggtccacacttgtgagtggattctcagatgcagattgggctggcagtgtagatgacagaaagtccactggaggttttgctgtgttcataggctcaaatctagtgtcatggaatgctagaaaacaagccactgtctcaaggtcaagtacagagtcagagtacaaagccatagcaaatgcaacagcagaaataatgtgggtacaaaccttattagcagagttggggatcaagagtcctcgagcagcaaagatttgatgtgataatcttggagccaaatacttgtcagcaaattcagtttttcatgctagaacaaagcatatagaggttgattatcactttgtcagagaacgggtgagtcagaa

SEQ ID NO: 84282 - DNA, 1074 bp, Oryza sativa
tttcttctccaaaattggcattgttcatcatgtgtcttgccctcacactcaccaacaaaatgggtctgctgagcgcaaatatagacatattgtagaagttggtctctccttattatctcatgccacaatgccattaaaattttgggatgaagcctttcaagcagcaacctatttgattaatagggttcctagcagagttatacaaaatatcagtcctttggaaaaattattccaacaaaaacctgattattcctctttgcgtatttttgggtgtgcttgttggcccaatttacgtccctataataagcacaagttggaattcatgtctaaacggtgtgttttccttggttttagcaatatgcacaaaggattcaaatgcctataaatttctttaggtcggatctatatttctcgggatgttgtttttgatgaaacggtattccctttctctgagcttcatgcaaatgcaggcgctcggcttcggtctgaaatactcttgtttccgtctttgtttactagtggggatgacaatgtattacaccatttgactaatcctataaatcctgctgctaatgagtttgctgatgcaaatattgagattgatacagcacattccgtggccacagaagatcccgcagggattgattttgatgcagattcggcagaacaggagcctgacaccttcctgtcgccagggtctgttcacacgcattcgcctggacctcaccattcaggcgctgacacgcggcagcatcaggagacacatgctggcgacagaattattcttccaggaacagctcgtcaggaggcacagggggagcagcggtcatctccctccgccgatctgtcctctgctgatccatcatcatcgctgtcaggtactgatgaatattactccctccgtccataataggtgacgtttttgactttttatttgcaacgtttgatcattcgttttatttgaacaattagtataaatataaaaaaagataagtcatatgtaaagtacttttgataatagagcaaatgacaaacaaaataaataataattccaaaattttttaaataagacga

SEQ ID NO: 84283 - DNA, 1034 bp, Oryza sativa
cccgcgggacctcaacgtcttctacgaccgcttctccgagtccatgccctcgccctacacccgctcccagctctccgagaagctccgccgcctcaagaacaagttccgcggcatgtccgcccgcgtcgcacggggcctcgaccccgcccgcctcgcgccgcacgaccgcgacgtgctccacctctgctcccgcctctgggacccgccaacgccgccacctcgcccttcgccgccgccggtgacgcctcctcggggaacaagcgccgccgcgccgccccgcgcgccgggccgctcatgcccccggatccctcaggggacagcaattcccatgattacaacggcggtattagcgccggtacgcccggcgcatttggggatgggcacggtggtgaggaaatgatgtatcttgagcaggaaagtgggcactttggttatcatggagatgtcgcgattgcggctgacggaagccttgatgggattgtgaaggtgcagcctgagactcttcctgccctccccagtatcggggacattgcggttcacagtgagaatggcaacggcaaggccgtggtgccacgtagcaatgagcatcacatggcaaatgccgtgctggatatatttgaggagtgcttgcgagaggtgaaggccaatggcattacctacggtgctaatgtgaatgggggcagtgaacttgcaaggcgatggagagcacagaggattgatgagcttgatgtgttgagccggaggctaaggttgcttgttgaggatgctgcaacggctggtcgctaaacggacatactggtggttttggtgacgtgcttccgcccttcaccccatgtgtataaaatattaaaatctagattattatgctatatgcttttgtagttcctcactcagcttgggccttgccttagtcagcctaatatgcctattatttatgcctatgtacatcgtctacggatattgccttttagtttaattatttcatcagcataatatatatggttccagcattgttatctatacagctgcctgct

SEQ ID NO: 84284 - DNA, 1046 bp, Oryza sativa
gatcggttttttacttctttttttttttggttcctgtagggtgtttgtgcggagttgcagatggggcgaagggagggaggaagacgaaagggccggtgatcggcatcgacctcgggacgacctactcgtgcgtgggggtgtaccggaacggccacgtggacatcgtcgccaacgaccagggcaaccggatcacgccgtcgtgggtggcgttcaccgacgacgagcgcctcgtcggcgaggccgccaagaaccaggcggcgctcaacccggaccgcaccatcttcgacatcaagcgcctcatcggccgtaggtaaatgttcctcactagcttttcttcttcttcctgagctctctcgatgcaaatggagaagctagccgtggttgattgattgatttgggtggatttttccggcctgtcgccggcaggttcgacgacgaggaggtgcagcgagacgtgaagtatctcccgtacaaggtggtggacaagggcgggaagccgtacgtcgaggtgcgggtcaaggccggcgaggtgaaggtgttcagccccgaggagatcagcgccatgatcctcgccaagatgaaggagacagccgagtcctacctcggccagcgcgtcaccgacgccgtcgtcaccgtgcctggtttgtaatgcgaaagcttctggccgccgctccagaggttgacgacgacgacgacttatgctaagtgtgctctgcttgatttgcagcgtacttcaacgacgcgcagaggcaggcgaccaaggacgccggcacgatcgccgggctgaacgtgccgcggatcatcaacgagccgacggcggcggcgatcgcgtacggctcgacaggaagggggcgggggagatgacgaacgtgtggtgtacgacctcggcggcgggacgttcgacgtgagcgtgctgagcctcgaccacggcgtgttcgaggtgctcgccaccagcggcgacacgcacctcggcggcgaggacttcgaccgccgcgtcatggaccacttcatccgcctcgtcaagcggcagcacggcagggctgcag

SEQ ID NO: 84285 - DNA, 876 bp, Oryza sativa
  unsure (1)..(876): unsure at all n locations
tcctgcagcccctcgacgtgacgttgtgacgctcggcatcgagaccgccggcggcgtgatgaccaagctgatcccccggaacacgaggatcccggtgaagaagtcgcaggtcttcacgacctacgaggatcaccagaccacggtctcgatcaaggtaagcacatttcagctcgtgcattgacctgataacattgattcttcagttcttgagactgacgaagctctgaatttctttttcaggttttcgagggcgagcggagcttgacgaaggactgccgcgagctggggcggttcgacctgtccgggattgcgnnnnnnnnnnnnnnnnnnnnnnnnnnnnnnnnnnnnnnnnnnnnnnnnnnnnnnnnnnnnnnnnnnnngacggccnnnnnnnnnnnnnnnnnnngacggcgtcggacaaggcggcggggcggtccaagtcgatcaccatcaccaacgacaagggccggctcagccaggaggagatcgaccggatggtgcgcgaggccgaggagttcgcggaggaggaccgccgcgtccgggagcgcgtcgacgcgcgcaaccgcctcgagaactacgtgtaccgcatgcggagcgccgtgcgggacggcggcatggccggcaagatcggcgacgacgacagggagaggatggagtccgccctgacggaggctctggagtggctggaggacaacgacggcggcgcacggacggcggagaaggaggactacgaggagaagctgaaggaggtggagcaggtgtgcggcccgatcatcaagcaggtctacaagaagagcggcgacgcgtcggccggcgccggagacgacgacgacgtgaatgagctgtagagcattttcgctgctccatgtatagtgt

SEQ ID NO: 84286 - DNA, 500 bp, Oryza sativa
agaaatcactaatctgtctgcaaaccattaagaaaccaagcattgaaaaagaggggatttgttttgagtttgactgcaaaagaaaacagtgtcgaagtcaagaaagatagtcaaataaggaacactgaacaagtatgtaactcacttatttcaggtgcccggtagaagcggctcacaagatacggtgtgatctcattatttccagcagacatagcactaccgaagtcacacagcttcagcaaattgttatctttatttacctacaaaatgacaaacatcaaaaaagctatgctaaataattcttctaccatatatacaaaagaaaagggggtgtaagtcatttttagccttttcctttctcggtcatcaagtacataaaactagtcataatttgtccaggaaaacaataagagtagactatgatactcagcaagattacatacccgtatattgtctggtttaatgtcacagtggagaacaccacagtgtcttagatgctt

SEQ ID NO: 84287 - DNA, 988 bp, Oryza sativa
ggtgtgatgttcctttaaaaaagttctcttggttgccagatccttaagaaagaaataatcacggtgaagttcaagaaaagcagaattatcatcaactaaacggtgtacagatataagattccttttggcttgtggaacatatagaacatttttaagatggatatcacgattactaggggtatgaacaatagtattgccaatatgacttagatccatacctgcttcgctggcggtgtggatctgttctcccccattatacttgtcattcacagtgagtttctccagttctcctgtgatgtgatcagtggctctagtgttgatataccagttggtatcaacgccataggagcttgttgctactgcagcaatattcttactgtcaggaatataatccttgtcatacctgtaccagcaatctacggcggtgtgtcccctcttgaagcaaacttgacagatcggtctgcgatccgccccactttgcgcgcgtcctcgaccgcgcgctccattgcttgtgccgcggctaggaaaggcacgaccgccgcgtggagctcctccgccgcggccaggaaagctgccgcggccacctcctttgttggcgacgttgacggtgttttcttgagtcccccgatagagagacctgcgggcctcaaaattgaggacttgattgtagaggtcacccaccgtcatgggttctagccgtgcgcacacggcggagatcacttcgctttagtcttcgcccaacccagtgatgatgtactggattagttcctcatcgtcaaccgcttgccggatgcggtggccatctcatctcctagagctctcatcttcccgaagaactccgggagcgagagattgcctttcttggtgttggagagcgcgaatcttgtgttgatgcaacgcgccctcgtttgcgtcgagaacatttgctcgatgattgtccatgcttctgccgcagtttcacacgtcgcgacttgcatgagaacatttt

SEQ ID NO: 84288 - DNA, 1041 bp, Oryza sativa
tccaaagcaagtcagttagtagttggcgagtgacatgcacgcacagaagaagtctcccatcgtttagccaaacaacatatttacaaacaaaaaataatttataaataaaaattttatatacatgttcttagcaatctaaaagcaaatgctgaaaaataaactttaatgagaaaacctcaaaatcaactctaaatttaagtttaaaaatttaaagtatagctaataagtaaaagcataagcataagcgaaaaaataaggctgcttagttctgtacaaaatcttcatagtgtttttatgatgtatgggcatgcagagggtgcagtatgctgtagtacaatagaacatccacttaattaagggggtatttagatataaggttgtaaagtttgggcgtgtcacatcgggtattatatagggtgtcgcatggggtgttcggacaataataaaaaaactaattacagaatccgtcagtaaaccgtaagacaaatttattaagcctaattaattcgtcattagcacatgtttactatagcaccacattatcaaatcatggagcaattaggcttaaaagattcatctcgcaaattaatcacaatctgtgtaattagttattttattagcctatatataatactttatacatgtattaaacgttcaatgtgataaggtgtaaaattttgaggcgggatctagacatgccctaactaacaattacaaaaatcgaatatatgtactagtactatgtagtggcagtggcaagtggtgtaccactaccagcttgcaaccagtcaattaaatgtgcattagtattgaattggcaacctccataatcactcaattaatggaagtttcgtttccagccgagatgatacaaatacaatacccgctatcctaaaactaaagacctatctcaggtgcaaagtgcataagatacatccaaacattcatggctaaactctaaacttgaagggtgtacttacatttggggaaatttaacttttcgtaaatttaagatgtagcaattaattattgagtaaattg

SEQ ID NO: 84289 - DNA, 569 bp, Oryza sativa
attggggttgagttgaactcgacacaggtagctgcaggcaaaaatgccatgttcaggtttctgcagcataagaaatacttgattgtactagatgacatatggacgacagaaacttggcttgaattaagcgaagctttccccaaatctacgaatggaagcaaaatcttgctgaccactcgctccaaggaaattgcggtttctgctgacccatcttcccttccctatgagctagatccactgagtgaagaattgagctttcagctattcattaccaaagtttttgggttgaatcatgttgacacaacaagttgtccaccacagctcaaggatgtagggcaccaactttcaagaaatgcggagggttgcctcttgctcttgtggaattgggaggactattatctgggaaggaaaagcaattcgaagtttggaggaatatattgaagagcatgaagtggagcaactacgaagctgggaatcagtgcttggagatactggccttaagctacagctgcttgccttaacatatgaagctgtgtttcatgtaactaggtgctttcaaagaagaaact

SEQ ID NO: 84290 - DNA, 3168 bp, Oryza sativa
cagcagcgagcaagcaaagcaagaagcaacttgtccgagatacaacgtacggccaacgagcggtggcttggggagtttgatcggccaagagcaggtacagtagatgaattttaccggcgatactgtatgcatgcagcctaatattctgagttggcatcgaaatttgaggagagagagggtgagccggcgactaattagtcgccgactccacgcgtgtgccgaggcaagaaaagcaacagcatgcgttttcttactggaccatgcagttgtggggtccacgtgatttgtagtctgtagatgagaagataacacgtgtagacatgacactataaaaaaaaaagaaaagaaaggttttggtattgagtggaggcagcttgtagactattgttgtacagattagctatttggtgaaatagtattttattatacttgttaggttttggagctgacagcttactcctctattaaacttgctcttaagcgcggttgttgtagtattcatctttttttttttttgagcgggaggggtcaggggtctctgtccacgtgggttgcgaatgttgaaaaggaggggaaactggggaaagagtcaaagcgttggcaaagaattatctaaaaaaagcgttggcaaagaggtggttcatggtcatggatgggggtaagtagcttttgaatgggaaattgtctggtataactagtggagttgggggtggacgacaggttctggagcaagaaatatactaatggttttttctcgctaatatgaattaattttcaaatatgctctgctagctggttttgatttactgatttcgacaactctattgattataccataactcgttaggtgattatgtgttgttaaattttgatgcggttaaaacgattattttggtataggtctacttttggacacatagaatacattggcaatacttgtcaaccttgagggagtacttaatatgaatgtttttttatcccgcatgcgctcagttgtttgcttgaccattactatttttttaagtgcccgtatcccgccggtacatagtcccagggatttttttagttaaaggtaactctggtggggtgtgcccatatcacccaaatcataatatattctaacttttaacatttttaaaaatctcatcaaacttgaaggcatttactttctttttttttaattagtgagagcgatctccatgaaaatggcaagctggctaataagctcaaaagggaaacaagaaaaggacagcgacctgcactgcaaaactgacagtctcgcacaccatttgccctctgcaacgagtattcacaagacgagattatcatctgccacttcatgagacaagtcagacccgcgcgaaaatcaccggccttccgggatgacggagttcaagaacaatgacgagccttgctgctccgaggccgatcccggcgccgagctcgactgcccgctgactccgctgttggcgaagctggtgttgccacccttgatctgccactcggtgatgtagctcggctttgtcagcacatcgggcacctcgacatcgccggcgagcatcgacacgaccctcgacattggcggccgctggtgaggcgagccctgggtgcagaggagggcgacgcggatggcacggagcacctcctcccggttgaattccttgagctttgggtctacgaggcccagagggttgttgttctcgtacagctcccaggcctgaatgtattgagacggtaagtattcagatgatcagaacataggggcataactagatttttttttgcatgtttagataaaattggatgatggcacttgtgtttaatgttatcaatctttactagaaaatttcagagtatatgctgccaataacacaaagaccagattataatttgtccttccttgggtgagagttcataagtgagctgctgagcttacccattcgaaaatataaattttgtcttcttcaagcgtatcatcatagtttggccgtccggctaaagtctccaataagaccacgccaaatgcaaagacgtcaactttctcggtcatatggcctctcatggcgtactcaggtgcaagataaccgctggacaaaggagagccaaaaaagccaccgccaacataagtatgaaaaattgtaaacataaaggtgggaaagaaggaatgtacttacaatgtgccagcaaccttcgtgctgacatgcgtcttcttgtcatcataaagtttggctagcccaaaatcagagatcttaggattgagattggcgtcaattaagacattgctggccttgatgtccctgtgcacaacacagatgctggactcttcatgaagataagccagacctcttgcaatgcctaggcatatctcaaaacgtgctggccaatctatggtcaatttctcagttcctgcaaatgaagggttaagcttttacgttgtagactatgataaacctgaattatgaaaatatcagttgcatcaaactgaaattgctcgtaccaaacaatgctttatcaaggcttccgttttccatgtactcataaaccagcagtggattattgccttcaaggcagcaaccatacaacttcacgagattacgatgttgcactcgggatatagtttctatctccgtcgcaaattgttttttcccttgatgagatgtttgagatagctgcttcactgccactacccttccatcagttaacttgccctgcaaggtggcattcaccaaacagcaagttcaagggatcgcaatgtcaaagccgaacatatttggtaatggatacattggaatgtttttttttttctgatttattaatatgcatcatttatgtgcaaaatatagaaagcacaaagaatctaaccaattatccataaaagaaatgaattcatacaatcatatgtattttttagctgtacactacttgtctagacgttaataagttaattcgtaggtaaaattccataacaagttcgaaacttcgaatatatatatgtacttacagatgaactaaccttataaactgtcccatatcctccttcaccaaggcggttgctggaactaaaattttcagttgcagaccttagttcactataactgaatacattaggtcttccgacaatactgtatagctctgcaaacataaaaatatacatcaatttattaactt

SEQ ID NO: 84291 - DNA, 742 bp, Oryza sativa
gatagcatcatctacttccgcgacggcgtcagtgacggtcagttcgacatggtgctgaacgaggagctggcggacatggagaataagatcatggtgggtgactacccgaagatcaccgtgatcgttgccaagaagaggcaccacacgcggctgttccccaaggacaggaaccagcggcagaccaagaacggcaacgtgctccccggcacggtggtggacaccgacgtggtcgacccgacggcgtacgacttctacctgtgcagccacaagggggaggtcgggacgagccggccgacgcactactacagccttctggacgagcacggcttcgcctccgacgacctgcagaagctggtgtacaacctctgcttcgtcttcgcccgctgcaccaagccggtgtcgctggccactcccgtctactacgccgacctcgccgcctaccgcggcaggctctactacgagggcatgatgatgttgcagccggcggcgtcagcggcatctgcctccgaggccatgatgccggcggcacagccccaggcggctgcggctgcggctgcggcagcgtcgccgtcgtcgtcagcggcatcctcatctgagggcatgacggcgtcccagccccaggcgccggcggcggaggcggcatcctccttcgcgggagctgccgacttcagggagtttgcttcgatgcacgaggatctggtggacaacatgttcttcatctgacgacagcctttcgtcgcat

SEQ ID NO: 84292 - DNA, 1104 bp, Oryza sativa
tatagggcgaattcgagctcggtacccctcctatgtgaacttgacctgtttttgtttctaacggttcttcattttccttcagagcgcattgcttctactgaggttgtaagagtacaaccacctgcacccccagttgctgtgtctcgtagtggcacgcgtgtgccaatgcgaagacctgatggtggaggctcagtatcgaaagccaaggtcaaattgttggtgaaccattttatagttaagtaccgacaggcatcaactgtttttcactatgacatagacatcaagcttgatataagttcccccaaggcttcagacaaggagctatccaagggagattttcttactgtcaaggacgagctcttcaaggatgagagctttcggcggctttcatcagctgttgcttatgatggaaaaagaaatttatttacttgtgctgagctaccagatggtttgtttcgtgtcaaagtccgttcacggacttacattgtatctgtggagttcaagaagaagcttcctttgagccaactctcggaactgcctgtgcccagagaggtcttgcaggggcttgatgtcattgtgcgtgaggcctctagctggcgcaagattatcattggtcagggattttactcgcagggccgcagtgtgcccattgggccggatgttgtagctctcaaaggaacccagcagaccctgaaatgcactcagaaaggactgatcctttgtgtggactattcggttatgccgtttcgcaaagctggacctgtgttggatcttgttcagaagtctgtgagataccttgactacaggacaacactaaacaaacaccaattggacactttgaagaatgaactcaaaggccagcgtgtcactgtaaatcataggaggacaaagcagaagtacattgttaaaggtttgactgataaacctgcaagtcagataacttttgtagattctgaatcaggacagaccaagaagcttcttgattactattcgcagcagtatggcaaggttattgagtatcaaatgcttgcatgcttggatttgagcaagagcaaagacaagctaaactatgtgccgattgaattgtgtgatcttcttgaaggg

SEQ ID NO: 84293 - DNA, 718 bp, Oryza sativa
gtgtcactgtaaatcataggaggacaaagcagaagttcattgataaaggtttgactgatatacctgcaagtcacataactattgtagattctgaatcaggacagaccaagaaactttttgattactattagcagcagtatggcaaggttattgagtatcaaatgcttccatgcttggatttgagcaagagcaaggacaagcaaaactatgtgccgattgaattgtgtgatcttcttgaacggcagagatacccaaaagcaagcttaaataggaattctgataaaacactgaaagaaatggctttgatccctgcctcaagtagaaaggacgagattctggagttggtgaatgctgacgatgggccttgcaggtaactgtttcaacttttgagttccaactatttccactgtttgcaaacgcctaattgatcttgaaacttaacatgttgctatgattaattagtagtagtggtggtagtacaactatagattcgtggattcaatggaaatacttctctgcgtgaacgacctagtaccacaaaacttgggttaatatatgtgtgcgaaacaacaagagacttaactacctcaaatattgtatgggtcaaatggttgactcattgttctccttgtcacatttgtctttctgatatttaactgttattactcatttttttccttgctaagggagaacataaacttaactgatctttgtcatt

SEQ ID NO: 84294 - DNA, 2464 bp, Oryza sativa
aaataaaaaaacatatgtgtccacattcatcctacaattagatttattttgggatttgcaatgaacggagtcctcgcactcgccagcttgctccttcttccttcctgtagccttgacgatttagcacgtcagtcctcgatccgccgccggccgacctcgctgtctccgacggccggttctggctgaagtacgcggtgagactgtacattgggtatattccctccgtacttttttttaaaaaagacaaaccctaaatttccatgtcctacgtttgactgtccgtcttattttaaaaaattataaaaaaaaatttaaaagacaagtcacgcataaagtattaatcatgttttatcatctaacaacgatgaaaatactaattataaaaaaatttcatataatacggacagtcaaacgttggacacggaaacccagagtttgtcttttttttaggatagatggagtaccaccaatgggagtgaagaaaggttagggcatggggccgactaacctcctgcctagttataccgccgcagtctatagtataattaagtggtagtagtaaatatgtgtatataatactgtatgtcgttatcggctgtcgtcatatttataattgtgtattgtacaagtattaatgttgggtgtggtttctactaacggaatctcttttacgtgtatatttcgatatcattttgaccctataaagatccaatatttcttaacaatctgcttggttggcacacctatttccttaagcacgccataatttttttctttttactagcacgcctaacatttggctggtaaaaatggagccaccccctttagctaaaggaagataacattgccacattcttctgtgccattgacatatggggcctacctaatgaggaatgaatcttgctgcaaagtgtgacaacatatagcctaacctgattaaacttatctaacattttttatggcaagatgaggcaaaagtggccccgaaactaaacatagccctgaacgcctttgactctcgtaggttgtttcttgccatctcaacaaatcacatatgcaccatatatttcaactgcacattcaaatgtataattcaaacgtatagtagggtgtagaatgctatatagtctagtgcctagtacgataatactccgtattggattatatggatactgtgtcaattttttaggccgtattcttttggaggggctgggaactcctcccttcacacgcaaaatggagcgatgaattaacgcgtgattaattaagtattagcttaaaaaattttaaaatgtatttcttataaaaacaatatcatttctatttaaccataagacctgacgcacaaaaacaacttgttccccctccggtttcttttggctaaataatctaccttcgctctaagcgaaatatgaagaaaccaaaaaaattattcatgggcggcatacctacactagataaggtcgtatacgtcaattaggctaagaaacactctctttatttgtgtttgcgaaaaacactctctttatttcagaaaaaaaaaacttttgtatattaaggtagacattggtaatgcccaaattcgtattcaaatattggtttattataggatagagggagaatccacattgacacaaatccaacctaaaattatcctaatattatgtaagatgcacattttctagttattattattattttcagaacatagtataaatgcaaacactcgtatgcacacgcacactcatcctgaacgtgcccatacacatgacacatcctactcctattgacacatccaaaaaactgagccgacatacattaagactgataaagtcactacatgacccgtacaatcgaagggtataccacctttcactaaaagaataaatagttgtaaatatgagcatctgtgtaaagtcctagtacgtgaaattggatggacaggttacataacctaaccctgggttcaaaattttggttttatcgaccccccctcccccaatgacattattttggccaaaattttaaacattttatttttttttgtgaatttgacaatattttgttcaaatttgactaaattttgtttgaaaatcaaataatttcagaccggagtttctgaaatttcggtatattggcacccctaatacaaatgccaaaaacgattgattaaactctgacctgaccaactatgcccagctcgtgtttttctattattaattagaagagattcgtaggttatcccaattctttgtcatatgtatactaagggggtgtttaaatgggtcaaactttttagcccatgtcacatcggatgtttggacactaatttagagtattaaacatagactaataaaaaaactaatttcataaatgagagctaatccccaatacgaattttttaagcctaattaatccataattatcaaaaatttactgtagcatcacattgtcaaaatcatgt

SEQ ID NO: 84295 - DNA, 550 bp, Oryza sativa
tattcccttgccgcagtcttctaaactcgttcttcttcatgcgcatcactgcagcaggtacgaagttctcgcgaaatgctgcagtgaactcctcccaggtgggttctccagcaccgtcttctcgggcttccttgtaggtatcccaccagtctccggctggtccttccaattggtttgccgcaaagatcactttatcggcctcacgtactcgaacaagagttagctttttctcaatgaccctcaaacaatcttcagcatccataggttcttcagctgtggcgaatgtgggtggcttggtcctcatgaactctccaaagcttgaccctccgcggttgccttagttgttcgcgatagcttgcagaagttgagtttgggtggccataactcccgccagagtggttaggtcaggtgtctgagtttcgtcgttgctggttgttgcccgacgacggcttgccatctgtgtagggtgatggggtaagtatcctaattttctaactagctcctatggctttatcctattaaaggagttgtgttgatatgaactttgttt

SEQ ID NO: 84296 - DNA, 958 bp, Oryza sativa
tatactttgataaattgcagggtctttcagtaagacgcagaagctgaaaatatatgataattagaggacaaacatctagagatttatatcttgtttgcgtagacaattagggaactccatatggttttgttgcctttaatttagttcttaaacaactgctagatggtcttcacggatggcctgctgattttccaccttcattcctttgtactgattcagtatagtattctctttctgtgtcatttgattccaaattattctcatggagcagggaaaactgtctctgtcgatgagaaaacaaatattgttgtccctgaggatagatatggactatacgctattgacactctggaccccgacatggtaaaacattatttcatatatttggttaaagctctaccttttactgttattaatttccaaaggttcctttaaccatcgattatattcaattctgtttaacttctgtctattaccttccactccgcgactgccatatcagtattgtttctatttagtgattccttgccggaaacattcacagaccatcctattcttgttaaaatagccactagtgatgattttgtgtattgtctttctgatggctgaacaataacttgcaagtgcttacactctttaaagccaatttattgtgaacctgtaccttcacagctcaacaaacgcaaatcatatactgcagttgcatacctgatctgcaccacttatattacaatttgaattagcagatcattggcgatgatagtgtttgctactatcacgacatgatagtgcaaatgatcaaatggggataccaagaggggaaaacattatttggatttggttatgatttccgccagagtaacaggtgaattgtgcacttctattcctgttttgcacatacagttctgtttatactttacaattctttagtgtttgctcaactgtgggggatcataat

SEQ ID NO: 84297 - DNA, 737 bp, Oryza sativa
gtcgcccgtgcgcgacgaccaagacgctccgaggagcatcaccaacctgaacaacccctccgaggaagaactcgccatgtcgctccatctgggtgaccgagagcccaagcggctccgttcggactccggatcaagccttgacctggagaaatgaagtgcaaaaagtgctggttctgaatttctgattctggttcttcagagtttattgtcattgtggacagccaaaagtagtagtagatcaaaagacctcatatgcagttcagaaaaattgaacctgcagtaagcttcggtgagcttgaatggctttggcaagcatatcatgtaacatgatgtattattattactacaattgattcagccccttgtaggatgttaggtgctagtcctgcagttttgctgtgctcatgatcgtgagacctgatatacaccattgccggatcccttcctctttgtagaagaagaagaacaatgtgcagggaattatgataatgatgatctttgatctatttccccctattattatttaccaattatcaggtttcaattatcaatcagtctgaaatcttgcatttgcatttgcattttgtcaaccagtctttatcttattaactcgggatgatctgttgcactgtcactgacatgtggggcccctaccccgcgccgcgtcgcgacatacctaaccgtattaaactagatcacctccgagtcttttgttacaaaaggaccagctaccctca

SEQ ID NO: 84298 - DNA, 660 bp, Oryza sativa
ccgttcttggtctgctgctggttcatgtccttggggaacagcctggtgtggtgccgcttcttggccacgatcacggtgatcgtcggggagtagtccttggtcttgatcgccttctccatgtccgccagctcctcgttcagcaccatgtcgaactgaccgtcgctgacgccgtcgcggaagtagatgatcctctggggcttcacgcggttccgcttctcgaacacgccgatgagctccttgcacatgtcgccgaggtgctggatcacctcgcagcggtgaggctgagcgcggattcttggcacgtacttgctggcgccttgatccaccgaggccaccactgctgcaatcgacgggctctcgacgttccccggcgatgggtgattcacgtcggcgccgatgaacatgtatggcgcgccggagatccgcgggagcgattcaccaaacagttggatgttgcttcctccaatcttgccgttgatcttcagagcaaggttggacatgtactggtcctgtccctgttgtttgttcgcgaggaagctcaagaagcactgggtctggatccccagctgcgtctcgcagataagcttcagcgtcttgtacccaggatgctgatcagacattgggcagaagaggagctgcagcttctgtttcttactggct

SEQ ID NO: 84299 - DNA, 2083 bp, Oryza sativa
ctaaacatctcttgttccacccctttccaatgtcttcctgctattcttgaggtgcggaaacttaatctccattggtgtttgaatttggtttgggacggtctaagtttttctgctaaatctttcacttagttggatcattaacagggtccaggaggtgtttggtgtgatgttgatgttgttgaattttcgtactacggtgcaccggctcaaacacctaaagagcaaatgttcagtgagcttgttgataagttatgtggcagtgacgaatgtattggttcaggctctcaggtactcgtgttctttccctctctgtgtgtgtgtgtatgtgtgtgtgtttgcaaaaataccatgtgcattaagcacagcatgccatcatctgcacaataattgtacaggacaataccatgtactagcaattgtacccttcatgttgtaaggggaccgttcaaatttgtcaagattcatcgcaagatttgctagtacaaagtggataaattttcatggcactctgaagattatgccaaaaactgaccgttggtttgttggttagtcctaacatctaagtttgaccagttgagcggtggccacagctagtttgaatgctaccaatgttcattacatcaaagcagatgatctgatcggagattggaaggagtttctccttctaaatcatatcatatcatttgagatactgcatactatatgttggttcttgtgcagattaaagcttctggattttacacaatcctcctaccgtttaccagtcaaacctttaacatgttgctgtgctctttttgtgaaatttcaacttagtaataatattttgtgacatgcactcaaactacatactccctccatcccaaaaaaatccaacctaggataggacaccaattctggacaaacactttgtccagttttgctgtgacctatcctaggttgttcttttttgggacggatggagtacttctgaagcgttcgtccttatagttctgtttcattgtttcaggttgcaagccatgaaacttttggtactttgggtgcaattgtgaaacggcgcactggcaacaagcagggtggtttcctcactaaccatcatgtcgcggttgacttggactaccctaatcagaagatgtttcatccattaccacccaatcttgggcctggcgtttatcttggagctgttgaaagagcaacttctttcatcacagatgacgtttggtatggaatctatgctggaacaaacccaggtagagcagttacaaattagctggtcagggctttatctacaattgtttgtctatttaaaaacaatgtcttaagtaacattaaaagacacttcaactcactgtataaatataaaaaataagtttcctgcttcctagttcccatcattcatattaatgccggattgcattttttactagttagaaacaaatcaacatttagttttgattgtaaaaaaaacatactatgtttgtgcttttctggtcatttaacacatttaccattttattgattattccaaatgatgtatataccagtctaattcccaaacatatatgccgccccattatggatttgcagagacatttgtacgagctgacggtgcatttatcccatttgctgatgactttgacatttccaccgtcacgactgtagttaggggagtcggtgacattggggatgtcaaggttatagatctgcagtgtccgctcaatagcctcatagggaggcaagtatgcaaagttggcagaagctctggtcacacaactgggactgtgatggcctatgcccttgagtacaatgacgagaaaggaatatgcttcttcacagacatccttgttgttggtgagaaccgccaaacatttgatttggaaggtgatagcggaagccttattatcctgactagccaagatggtgagaagccgcgtccaattggaattatatggggtggcacagcaaatcgtgggaggttgaagcttacaagtgatcatggccctgaaaactggactagtggggttgatcttggccgtctactcgaccgtctggaacttgatattatcattaccaatgaatcactcca

SEQ ID NO: 84300 - DNA, 994 bp, Oryza sativa
cagaggccgagaaacacgcggcatggcgtgccgcgatgcagtcggagatggacgcggttcaggagaaccgcacctgggagcttgctgacctccctcgtggtcaccgcgcgatcacccttaagtgggtgttcaagctgaagagggatgaagccggagccatcgtcaagcacaaggctcgcttggtggcacgcggtttcgtgcagcaggaggggatcgactacgacgatgccttcgctcccgtggcacggatggagtccgtgcgactccttcttgcgctggctgctcaggaaggctggggcgtccatcacatggacgtcaagtcggcgtttctaaacggcgacttgaaggaggaggtctacgtgcaccagccgccgggatttgtgatccccggcaaggagggcaaggtgctacgcctgcacaaggccctctacggcttgcggcaggcaccgagggcgtggaatgccaagttggattccacgctcaaggggatgggcttcgagcaaagcccgcacgaggcggccatctaccggcggggcaatggaggaaatgccttgctggtgggtgtctacgtcgacgacttagtgatcaccggcaccaaggatgcagaggtcgcggcgttcaaggaggagatgaaggccaccttccagatgagtgatctggggcctctctccttctacctggggatcgaagtgcaccaggacaactccgggatcacgcttcgacagaccgcctacgccaagcgcgtcgttgagctggctgggctcaccgattgcaacccagctctcactccgatggaggagagactgaagctgagccgcgacagcacagcggaggaggtggatgctacacagtaccgacgtcttgtggggagccttcgctacctcacccacacacgggcggacttggccttctccgtcggctacgtcagtcggttcatgcagcgaccgacgacggagcaccagcaggttgtgaagaggatcatccgctacgttgc

SEQ ID NO: 84301 - DNA, 2872 bp, Oryza sativa
catcgaagtcattcctggcaatcaccatcatcttcatcaccttatcatcatcaattccgggatcatcgctaactccctgtcggagttggtatatcacgtcaccagcttcccgtcgaagttggtatcatcatcattcagtgaaggtccgaagaacagtttgtgaatggccttcatcatcatcgtcattgtctctgaatcaatgaagagccaaagaacaatttgtgagggctttttgtactgagggctgaagaatagtttgtgaaggcgcaagatccacttcacatcatcaatgcaatagtttgttaagggtatagatgttaaggggtattttggggattttccaatctcttctgtacaacatacatttgccttttgggcctaggtcaatgcaatagttcaatccccaatttatgcttgtttcttgcgaaagaattcctttttcccaaatttgggggcggtaaaaaaaaaaacgagaataaccttacaacttagcacagaaacaaatcattttgtagcttaagtttatgtttgttcaagctagactagacaatatctaaatattgctatggaaacatgaagtataagaacccttttaattttgatactgttcattctacctaggaatttggtggcaaacaattttgtggacaatgaattaaatataggtgcgtccattttctcctcaatatcgcaagtataatcaatagattctcacagcttctagtttggattcaaaatgttgatcttttgcatctgcagtatcttaccttcaatgcagtacctgaactgccttcagagaagtacaccctgttttcttggttctccaaagagtgagcctttcaaccctcaatatcaagaatatgcttacttgagaaacaccatttacttagaacattagtaaatgctaatactaattgatgtaacttgcctgcagctgcctccttcgctgtgaactgtggtggccctctcacctcaggctcagataatttgcggtatcaaagtgatgaagtcaatcttggagatgcatcatattatattacaggagaaccaacatggggtgttagcactgttggaaggttcatggatgcatcaaatggaggttacacaatccgcagctcgcgccagtttcagaacacattagattcagaaatgttccaaaatacaaggacgtcagcatcatctttaagatactacggtattggacttgagaatggaaactatacagtcactcttcaatttgcagagtttgggtttgaagacacacagtcttggaaaagcctagggaagagggtttttgatatatatctccaggttggttcttgcgtagctagctgataagctataccttttgatttaacttgtaatcaagttgagattttcttttgtcttgtttttgttggagggtgaacgtaaggagcagaattttgacatcaggaaggcagcaggtgataaatcttacactgttgttaagaggtcatataaagttcctgtgaccaaaaacttcgttgagattcatctattctgggctggcaagggtacttgctgcattcctactcaagacaattatgggccctctatctcggctctgagtttaatccctgcaggtactcctctgaacaacaattcatggttccattttgaaaacaatgtattttcagtgatcaactattgagtttcattgtaggccttcattgtaagataacattttattctaacaaatggacttcttttcagatttcaccccgacggttagtactagcatttcaccagaaggaaacaataatactagtaaagcaggtgtgagtactagtaaagcaggtgtaattgttggagttgtagttggtgtaacaattttaggtttgatagcacttgctgcaattttgatatggaggcagaacaggagaaagagaaagttatcattggagcaacaaggtacaggaccactaggttcaaccgagtaaatgggaagctcataaagtgatgtatctttttatgtttgcagagttgtacagtattgttggaagacccaatgtaatcagttatggtgagctaaggtccgcaactgaaaattttagttccagcaaccttcttggtgaaggaggatacggggcagtctataaggtaatttcatctatagcatatagattgtgagttatgacattttttcaatgaagttattaacttataaacatctagacgagtagtatattgcaaaaaagctgcatatgactgtgtcagttccttttcttttatgtattattactgattatattcgttttccattctatttattcacataaatgatgcatattcataaaatgggaatgcatataccaccgtatccattacaaaagatgttcttttagaaacattacaaaagacgtttgacattgcagtacctgaaacttgcatttttggtgaatgccaccttgcagggtaagttaactgatggaagggtagtggcagtgaagcagctatctcaaacatctcatcaagggaaagtgcaatttgcagctgaaatacaaactatatcccgagtgcaacaccgtaatcttgtgaagttgtatggttgttgccttgaaagcaataacccacttttggtttatgagtacatggataatggaagccttgataaagcactgtttggtacaagttatttcaatttgatgcaactggtattctgagaacttggatttatcgtagtctatagagacctaaaagttcaatcctacatttgcaggaactgggaagttgaacatagattggccagcacgctttgggatatgcttaggcattgcaagaggtctggcctatcttcatgaagagtccagtatccgtgttgtgcacagggacatcaaggccagtaatgtct

SEQ ID NO: 84302 - DNA, 569 bp, Oryza sativa
cgagctcggtacccccagccgagcttcctcctatgttcaacacgctatcggcgtcccgcgagggtgaagacggctcgctggaagaggcgcaggcgacgatctttgttcatccagagagcaaagggaggcagcatgtggaagttagggcagttggagtcacccatgacggctagtcaagccagtcatacgaaaacacacggttgtcaactagctagtctgcacactccaaagcaaagtggacaatgtaaatataagacgtccctagctatgaactacgtgtaattttgctgccttgtaaataccagaactgaaaatatactgccactggatgatgatacgaatagaaaggagaaagaaaaggatgaacttgatatgttaaaattgtatcaggtgcttgaaatgttgttactggaaactgatcatcctgactcggttgatcaagcgatgagacctccgagttatcattgtcttatgcatctttctagtccttgtttaattcatcttaagcttgttggctatgtcaaatctttgtttgggcattgcagtttcttgctgcgctcgtcatctct

SEQ ID NO: 84303 - DNA, 1364 bp, Oryza sativa
cttttcttttatctagtggttatcttgcacctgagtatgctatgagaggtcgtttgaccgagaaagttgatgtctttgcatttggcgtggtcttattgaagactttagctggccgaccaaactatgatgatgctcttgaagaagacaagatttatattttcgaatgggtaagctcagtacagtagctcatgattaaatcttaaccaatgtaaagaagatataataatggtctctctgcttttttcaattgatatttgtgctattgacagaatatacttcgatattttctactaaagattggcaatactcccaccgtctcaaaatatagcaatttatagcatctaaatttatcctaaaatataatcaattctccacctacattcttttcccaaccaaaaacaacatttcactatttagtttccctacttacattgttactctcaaccaatcatatttttttcctatttaatttcaccaacttccttaatacatgcgtccaattctaaattttcttatattttaggactgaggtagcaagcattgaacacacttctcatcatatggttttatcgaaacaagcaacatttatctgattttgtccccacgatctgaatactgaccgtctcaatactttcaggcttgggagctgtacgagaacaactaccctctgggcgtcgtagacccaaggctcacagaatacgacggtgaggaggcgctccgggccatccgcgtcgccctcctctgcacccagggctcacctcaccagcggccgtccatgtcgagggtcgtaacgatgctcgccggcgacgtcgaggtgcccgaggtggtgacgaagccgagctacatcacggagtggcagatcaagggcggcaacaccagcttcatgggcagcgacgtcagctggcggtcgagctcggcgccgagggagatcatctcgccgcaggattcgtcgccgttcttgagctccgtggagtagggagaggtatggtgatttcgcgctgcgctcaggtgcttcattcatcggatttaacttgtcctgagagtggcacacgatcttattgtgtgtgcatgttcttccaaactgtgtcgcgtaaggtgcatattcgaagtactccctttattctcttttgatcatcatatttggtccatgcagcaagaccaaagagagagaaacacatatttaacttgcatgcgagaaacacatcaccatatttaactattgtatgaataagcgattagattgtctatagatgatttggagctagtagttggcagcttgcatcggcatcgaggaaagggagagagatgaggaagggagaaaagatgagagggggacaatgtgggtcccattgtaatattttttt

SEQ ID NO: 84304 - DNA, 2673 bp, Oryza sativa
cggggaggcgcgatggcggccgggcggaggggaaagaatgcggccgagcggcggagaggattttatagggggcgctaggtcagttcggccggggggagagagaggtggtgcggcagagaggcggtggagcgcggcgaggggaccgcgctggcgctccggcgctagcggccaagcgcggcagcggtgacgccggccagtcgggaaaaaggaaaaaggggagaaaaaggaggcttgcctcctagccgatttgggtaagggcgcgcgcggggagagagagagggaggcgcgcgctcggctcctaggcggcacgcgggcgcgcgagcgtcagggccgggaacggcggcaggacggaacggcgccgacgggaaccgttggggagaagagagagagagaaggacgggcaagggggactgggccgaggcggcccgagaagggagagagagagaaaaaggaggccgaagggggaaaaggtggccgcgcgggcggctgggccgagggggggaacgacttgggccgaaaggggaccggcccgagggggagagggaaaaggccgggaagaagtcggcccgagagcagagggaggtaaagtggactttaccagagaaaatgaaagagggagtttgagggctcggattcgaaatccgatttcgcggttttctccgggattgaactgaaggggagacacgagaccttggcacacgacaagactcaaccgaagagcaaactttcgcaaatagggtttttagtaattaggttttcccgctaacgccgcgacaaaacgggcgttacaattttccatgtactcaatacgtcctaaagcatcttacaatttcatctcattcaaaaaacactttgagcaattttgagaaatcaaaacatccttgtgttgtttaatctttttcgcacacaaaacattgaacaaagaacttgcacataaagcagttttatattttttcaaaatattctttgtcaacattaattcatcaacaacacgagcatgcaaagcaaatccaagagcaagagaagatttaaatctcaaattatgatcaaaattgatatctctaatttttgaaatttcatgcattaaaacttcataatttttacaattatcatcatcaggaataagtgattttaatctagcaatttcagaattaagagattcaatgataaactcttgttttttaatcatcttctcacatcttttatttttggagctaaaagtggaaattacttcttcaaaaaattctatggaaggacttacctcattatcttcaatttctgactcagattcaccatgagccatgaagcaaaaatcagagatgtactcttccttgtccttatcttcatcacttttaatatcaccattgcttgccggttcaaaagcagcatagacttgatttagcaccttcttgagagcctccttggatcttcttcccttgaatgttgtaacgggcttgttgtccttggtcttgactccattgtcatctttcttgtctctccccaacttgggacaatgtgagcgaatgtgatcaagctccccacattcaaaacatcgaattcgacctcctcttttcttcaacctaacattgttcatagctcgagacaacttgttaatagccaaagccaaatcctcctcctcgaatgattcgagttgatcatcggacaaggcattaatggaataaagagagacagagttcgatgaagaagcaccaagatccaatgaagaaaccaaagcacttgacttagaatcaaccttttgagaaagaatattcatctcatgggttttgagttttgtgtaaagagaatccaaagtcaagcaaaacatatcaactgattcttgaatcgaagttactttcatctcccaaattgacatatcaagtccattcaaaaagtggcgagaaacttcaaattgagagtaattaacatcataagaagaatccacagatcgaagattactcaaaatcttattgaatctagcaagataatcatctaaagcttcttcagatttcttctctaattttatgtaatcctttttgaaaatatctttacgtaattctttaatgttggaagtacgttgatgaaaattacgcaaagcgttccagatctcattgccatttttagatgtgacactcgatcaaaatccgagcgagaaattccactcaataaaatatttctagctttgcaattattttcaaacttagttttcaaagcagtagtgttaatttgatctggaatttcatagggttgagcaaccttaggccaaatgtcataatcttgagccataatataagattgcatcttgtcacaccaataaggaaaatcgacaccattgaaaacatgtggtttggttgaaaacttgtcagccatggcttaaaaactttagattggtaaaaatccaaagaagaagaacaaggctctgataccacttgtaagatcgaatcccaaataccaagccaaccagaggggaggtgaatggttgtaacaccaaaaaccaaaaactttaaggggaaattaaagttaccttcttttcgatgtagatcgccgccgtcgccgttgctgtcaaaacgccgccgccggtctgaccgcccgagctccccggtctgaccgcccagtcgccgccggtctgatcggtgtatattcgccggttggaccgtcgcctctcgccggttaacc

SEQ ID NO: 84305 - DNA, 636 bp, Oryza sativa
ttctcctcaccggcgtcatcctcctgccgccgctttggctgcaagcgccgagcgccagctcgcgccttgaccgttcaatgccggttcccctctcccaaaccgacattgccgtccatttaagcccaagccccccctccaaactccctcatttttcgcctccgcgccattgccgccctctgtttcgccgtcgccgatcgtcgttgcgcgtgtgggaggagccggcacgagcaaggacgcggaagaggactccggccgcaccctctccttcctcttccccggcccgaggccggagagattactcccgcgccgtcggcctctcatcacagcgcccctcctcttctcggtgatgtctctctccgttcttcctcctcgctccatctccttcccctagctttcggtagtagcttgagtagccttcccgtagttagccggcgccgccccgaccgttgccgtcgctcgccgcgtgctcgccgccgtcgccgcccgagctccgtagcacccgcttgtcgccggcctcgcttggcgtagttccgcccaatccgacgctagcatcgagttcccgaagccgcgtagatgctctcaccggcgggaatcgacctctcgtggcctcgtcgccgtttccctcttctcccgccg

SEQ ID NO: 84306 - DNA, 500 bp, Oryza sativa
attcctcgagcaatttcctcgtcactggcgctccaatcgcctcgatgggcttctcctccagatacagctgcagatcctgggcgggcacaccgttgagcgtcacctcgtagtgcagattgcactcgttgtcaatggacatccaggccatgccgacggcatgtggattctgtgcatccgtgtgctcctgtcgcttcagcagaatgggtccgccgagtcccgagcatcggccactggacggggcactaggcggccacggatcaggctcgtctcatgctcggtggccacattaacgcccagttcgccggcatacagcgactcgaggaccttgggacccaacttctccacactaccaatggcctggttgaagttgaagctcggcgtcagatcctccagcttggccttccgcttgccctgctcctcaatcaaactgatgttgggcctatcccgggtgttcacgtgctccgtttcgatgttgtaggccagagatccatcggtgttca

SEQ ID NO: 84307 - DNA, 673 bp, Oryza sativa
taagtgcctagtgctgccaataaatatggtattcgtaatacataaatgtaggagggtaaaagtgaataattggtttatatggtgcagacgaatcggtgatattgaaaatggaagctcttcttcactggcattcatcagtaacatgacatcattgagcatcctgtatgcataacttttcatccacttaattaaccaaattaatgctcagaatattgatgtaatttgaaccaagctggttagatcttataacacataacattttatttttttgcaggattttgaggaactgtaggatatctgataatcttgcatcattagacttttcaaagtttgcgagtttaagcttactgtaagcattttgtttctactataaattgtagtcaagcatcttttgtgcaatatattttaaatgtattgcgatggaccatacattgtctaatgactgctttaccatttttttttcttttggctattacagggatttgagttttaacaatatcacggggatcctctagagtcgctgttgggtctgaattcttctgaacttcttgtatggattatcttgacttaaaaaacctatttctttgagccaaagatgaaagacctatatttatgtgtcttgctaatgtttgcaagttttacatgaccagatttcttgggaataatagtcttt

SEQ ID NO: 84308 - DNA, 2641 bp, Oryza sativa
ttttcttgtcttgctttcaacaccaatcctacattctttttccttgaaaatcaacagtactgtgggcatcaatgcgttgtctggacctatccccaaggagcttggcaatcttacaaatcttgtatcgctgtaagcttcaatcttgctgttctgaacttctgataagcagtaagcttttttaatagggtaacactccaacatagttggcgaatgtagcaatgaattttatttttgttaatgtgtctttccattcgtgaaaaaaattgaaatctatatcgtggaagagggagcctgacacaataatatgcctttctcatcatatattaaccaaccttttttttaaaaaaaaaaatcagcacttccttgtgaatattttcctggagctaacctatttaaaatcttatactctcagggcattgggctcaaataattttaatggatcacttcccgatgagctgggtaaattgacaaaacttcaacagctgtaagttatccgtttggtcttgttttcattttattttatatgatcatcagtttttgtttgttgtttagaggtgataatcatctgcttgaatgaagttgtatgtctgaattgtaggtacattgatagtaacgacttcagtggtcctctaccaacgactttatcacaacttacgaacctgtccaccttataatttcgcaaagcagtgtttgggattttattgtttctcatgaaatttcaacaaataattatggacaccattgtcattgtgcatccaggtgggcattggataataatttcactgggcaaatacctgattatcttgggagtttgaccaacttaacccaactgtaagatctatctttggccaattaccgatatttaaccccttttttttctaactgttctcttggcacaaatagcaaggaaatgctgtgcatgttttgctagcatgaaatgtttatgtgaaatgcatcttgtttctcaagaagagctagaatagtccgcgttgcttatttatgaccaaacatatgtctatttttaggaggctccaagggaactcttttcaaggtcctattcctagaagcttatataatcttgtcaagttgagaagcttgtaagttcctagtgtttcagtgacaatgactgtgtttttgttgcaaacataagcttatggcagtgatagaagcattgattgtcccaatttaacagaagaataggggatatagtaaatggaagctcttcactggcgttcattggaagcatgacatctttgggtgatctgtacggcactttcacaccactttacttctcgtaacagtttaagatcttaagaatttaactttttgtctttcagtgtcttgagaaacagcaggatttctgattcacttgcatcagtggacttctccaagtttggaagtttaaatctactgtaagaattttcacctatcacaaaaatctccgacaagttttccatgccgttgtctaactcattattgttggtgcagggatttgagttttaacaatatcacaggtcaaattcctccgtcaatcgtgaatcttccttctcttacttttctgtaagtgctggtgcagggattctaccttgtttttgcaacaatgtttttctttttgctgtgtgctgatgtttgcaaatatcttattccaaaacatgtttgagtcagatttcttgggaataatagcctttcaggaagtctgccagccatgaaaagtcctctgctttcaaatttgtatgttcatattttccttgtatgttcccattttgtttcaatgatcaaaatatgtatcgatctaattctaaaatatcccatgttacttttcagagatttttcatacaaccacctctcaggaaactttccttcttggactgcccagaaagatttacaactgtatgtttcatggcttgaaacttctgtatatacctctttacgattgaatatacaaattacaaagacagaaaaatctaaaagtgatatctgatgtgcattttctaaggaatttggtggcaaatgactttgtgattgatggcactgatatgaggtacttgccagttgctaccatttttttttcttattaagaccattagctcctttaggtaaaacactatattcatttcagcttgtaagttgtaaatataatttaaaatagtgatgtattctatctgtagtggtctgccatggggattgaattgtcttcagcggaataccccctgttttctcggttctccgaagtgtaagccttcatctctgtaactttgtgcatatgcctacttcagagaattcaaaactataaaatcgtagttgcagattactaagacttttgatttgatatttttcctccagctgcctctttcgcggtggactgtggtggtagtagaaccatatcaggctcagataatgccatgtatcaggctgataacgccaatcttggtgctgcatcatactatgtggcaggcacacctacgtggggtgttagcaccactggaagattcatggatccacccaatggaagttacataatctacagttcacgccagttcgataaaacactagattctggactgttccaaacagcaaggatgtcacatcatctttgagatactatggcattggactcgagaatggaaactacactgtaaca

SEQ ID NO: 84309 - DNA, 771 bp, Oryza sativa
gaggatccccggctacatagaatctgcagcatggttgcactcttagctttgaccttaggctattacttcattagtggacaagaatgtcaaatgctgaaaaaaaaggcataaaacttctcgacaacgtcgatagtatataactcacttgggttaattgattgtttccgggaaatgcctgctgttgcatggttggaagtgaggaagcctacagtaagccacaagaagctgatgaatacgatacttcaatagaatgagatatattttttaaagtaatagatgatcacatacctgaccaaactgattcaaattgttatgaagattctctgaggtaccaagcccatagctctgaccaagtatataatgcccctgaacaaggaaatcaacacctgtaataaataactgttccacagtgatgaaaggaacatctaaaaaaaatactgtcttgaagaaaaatcaacctgcattaattgatctgggaggaactgatttggagaattccttgcttctgactgcctgttgtctggtgtcatattcagttctccatctcttgttccagtggctgcttcatcagggtgccttgtgtctagcaacaaaagaaaatttacaaatttaattttgcaattataaacagttagaacttgaaatccacaaaaaaattggagtcccaccttttcttgttttctgcattttattagttaccacagcacttttatggcgataaacttcagtcttcttctttccagtagatttctcaacttcattgctactatt

SEQ ID NO: 84310 - DNA, 3333 bp, Oryza sativa
ttcacttctcctgtgttcttgttgttgttcgtcagagacgctgatcgaatttgtgtttcgtcagagatgcttaattttgtgttcgtgtgcatggattttgtgtttcgtcagagatgctgaattttgtgtttgtgtgcatgggatgttgcaggcgtgctgaggacagagatcaacccgtcgctcgacaaggtgaccgtcgtcggcgacgtggacagcagggtgctcgtcaagaagctctccaaggtcggcaagatcgccgaggtgatggcgccgccgccgtcgtcaacggcggcgccttcggaagaaggcaagaagagcgacggcaatggcggcgagaagccgacctcgccggcggacgagaagagcgccgcgcgcaaggacgaaggcaaggacggcaaaggcgacaagtcgtcgtcggcggcggcgtgcaagcaggaatgcagcaagtgcacggccgggaaggaagccgccgacgaggctggccgcgccggtgggaagacggcgtcgtccaaggacacggtcacagccaagaacagcgacgacgtcgacggcgacaaatccgaaccggcggcggtggcggtggagtaccagtaccaccaccactacagccggccggagccggccatggtggtgccggttcacctcccgtactacgccgcgaacgcgacgccgtactatgccggaggatactacccgatcccgccgccgatgccggcgatgctccgtcaccctcctcagctccggccgcagccgtcacgcttcgacgaggactacttcaacgaggacaacaccgtcggctgccacgtcatgtgaaaccgcaaaacacgccaagctcctcctggctcccgccatgtacaaccgatcgatcaccaagaaatcagcgaccaccattcgtttcttcaatctcaacacacacacacacactcttcagaatgcatttgccgtttaatcaaatcaaccaaacaaacaaaacagcaattaactcgaattcgatcatccgtcatcttcttcctccctctctttctactccttaaaaaaaaagaaagaagaagaaagagaggagggcgtctcgggtgtgttcgctgctgatgcatggaaatatatcatctaaccatggaaaacagagcagttcattagcgtgtgattaattaagtattagctatttttttaaaaaaaatcaatatgattttttaattaaattttgtacaatttttttttataaaaaacgtaccatttagcaatttaaaaaacgtgcacccttgagtccgaacacacccgaatcaatcaaccaaccggcaaccgaccgacgaaagaacaagccagaaagccggctgttgcacgattccgtcactgctgctggcgtcctggcctactctgtacccggattcgtgcatgcgatccaggccagcaaaggacgaacggccggcgacgagcgaacgccatatggtatatgaaaaagatcgccgaatatatgatgccgcgctcgcccgcccgcacgcacgcgccgagccttttgtttattcgggggacggcgtcgccaccggctttgcgcttgcttgcgcgcggatgagactggagagttgatacgagccaaatttcgcacctcagattatcaatagcgacaaccaaaatttcaacttaaaaacagtaaatttcataaaactgtaactatagtgataaaacttgcgacctatttcagtttactgcaacgatagcgcaaaaaaatatcataaaactgtaacttttatgtgacccaaacttaaagttgacacatacatgtcttgtagtagcactggcacaccacataaaagctacaaatttgcttatcgttgcagtaaactgaaatatgttattaatgctgcagtaaactgatagtcttatacaggtttctgcaatttactcgtttaaaaacctaattttataattgatatgattttatgattttttttagcttttaagacgaaaaaaactcgtatgtggagtatattttatctataaattaattttaattgttaataagcgttacggcttatgagtgaaattataggcgaggcgagcgataaagttgggcgagggggggatcaggggtaggtagcccgctgctgccgccgcgctgctttttgccgaattctctctgttggctcattctacgctcgtactagctcgggattcctccactgaaactggccatgagcttagctgcaaaattcgacgatctctgcactccaaattcgatgatctctcgctcgcacgaatgattgaattgacccgtcgattttgctgttgcaacgaccggaataaagcgtgtggggggcggcggcaaaaaccgggaccgcacgtacgttggtacacaacacctatagcataagtctctcccagatgtactaaattttctttgagagggactaaagtcgctccttcccaaacaccacataagtttaagtatgttttagtttccaactttttcttcaaacttttaacttttccatcacatcaaaactttcttactcacaccaacttccaatttttttattcaaatttttaattttggtgtggaactaaacacaaccttaagctaagtgggcggttttctgaatttacaatgggggtggtgctctgtggagggaatgatgatgataggtttaggtaaatttaatcgggatactagcagatttgcagggagtcaaggcgtgatcgcatcaaattcgatccaaaagctggggacttgttagtgaaaaaaagagattcaaatcagagcatggaattttcgcataagaaattgcatggtgttccaggaatttctgtagtgcgattgtttaggtgaacaaaataaacgcttaagttaagtctacgcgttttataattaaaaaaaaacagtctaaggtttttcttttccaggtttggtactccttccggatggagggaattttaacagaattgttcgctgtaatggaacagattcttgtaaatgttttttgaaatttttgtattcttaaagatcccttgtttgacatacagtaatgtttgtttaaaaagacagaaattacgtaaaccatctcaattgtcatccttattttgaaatttcacctcataatccattttattttttttaagaaaacaccctccacattgcgaagctgaaattactctccacccccagctacccctgcacatgtgtagctgttttggcctattttttctagcttggatccgtgacaggccatatctatgaggtcgggctcatcgagcatagcaacatcattctttaaatagctaatatccactggatatgtaaagctcaaatgcaagtatgatatttattatcactcctaa

SEQ ID NO: 84311 - DNA, 874 bp, Oryza sativa
tggcatattcagttaaatctttaaaacatgatggaagtacctctagcaccaaacatggtggatcattgcccaaagtttttttttagaaaatatcaaagcatgcatcagcatgtcacagtgatgattttttttttcaaccagaagaggtataccgatatatcttagatgactcccaaatggcgttgtgaacagttagtataacagaaatatagaacgaaaaaaaattctagtttagatcagtacttggagtagcgctcaaagctgatattgcaggcccatagtagccttgatgaggaatgcagcaagtacccttgccagcccagaagagatgaatctcaaggaaattttttgtcacagggacaacatactgcttcttaacaacagtgaaagatttccctcctgctgcctttcttatgtcaaagttctgctccttacgctccccctatacaagatacaaaaatgaagaaaaatagttttgatcagagctaatgagctaaaagcatcaaataccagagaaattgtaagtttgcaggccacctgaatgtagatgtcaaaaatcctcctccctctgctcctccaagactgcacatcagggaaatccacctcggcaaattgaaagtggggaatgtagttcccattctcgagtccaatgccatagtatctcaaagatgatggtgacatccttgctgtttggaacagtccagaatctagtgttttatcgaactggcgtgaactgtagattatgtaacttccattgggtggatccatgaatcttccagtggtgctaacaccccacgtaggtgtgcctgccacatagtatgatgcagcaccaagattggcgttatcagccctgatacatggcattatctgagcc

SEQ ID NO: 84312 - DNA, 4186 bp, Oryza sativa
atacaactctaccatacttatgaccgtgagaaataatagatatatttatgctttgaactcgcaccttgaattgatcatctgcataaaaatcatgagatgaagcacactttaaattgagaacatatggcaacatcctcagaattgcactattcaatgatgaaggactccaaattgtgatgaatgcacaaatagcatcttcatttgttgtggtattcttgtgtactactaagacttggatttaaactcaattgaaggcaaacttttccgttgatagtgttcgttgcaattgacaatttttatgtgactaaaatcatcttttgggttgaattttcaggggtttaggctcaaacaggtttaatggctcccttccttcagaactggggaacctggacaagcttcaggaattgtacgtttctagttgggacttcgtttttcttttttttggtctacctaaccattctgattcttggactactcagctcaatgtttgctgctactcttatctctcaattgcaggtacattgacagtgctggcttaagtggtccactaccatcatcattttccaagcttacaagaatgcaaacattgtaggattacaaaaggatgtgtttcttgttgacattaattcttccgtgccattaaacattgtttcttatcctcctatttcttcaggtgggcatcagataatgattttactggacaaataccagattatatcgggaactggaatttgacagacctgtaagaatcctatatcctccgttcattaagccataataatttttgtaacagataattatttagacaataggaatgttgtgttttcatattgttttaaataatatggtcatatgggtacaattttcaataactttattcaagtcaggctttaaatcgaggaaaattgtaggtgtgaacatgagatgcattctaaagctacttggctcatgtgatttgtgaaagatagtttgtttttctcgtttctagagtatctttttacttgactgtgctgaatcaccctataggggtctctttatttaagtttggatgattgttgagcgttggtaaatgatgcatctttcttctgtcactattcatgatgagatggcttccaatcttgaaaagcattattcagctttgaatatattttacaatatttatgtattcaccgtgaaagaatctgtactttagcttcattagtttagtttcctttttttaatcaaagagttcttcctgctatcatttctagtttgatgtttcagtaaaaaagatgatttgaatgactagttacagctatgatctgtaggcggtttcaaggcaattcttttcaaggtccaattccttctgctctttctaatcttgtccaactatcaagcttgtaagtgcctaacactaccaataaatatggtattcttaatataaagaatgtagaagggaaaagtcgaataattgttttatatggtgcagacgaatcggtgatattgaaaacggaagctcttcttcactggcattcatcggtaacatgacatcgttgagcatcctgtatgcataacttttaatccacttaattactcatacggccgtactactgctcagaatattaatgtaattcaaaccaagttgattgatcttataatgcataacatatttctttgcaggattttgaggaactgtaagatatctgataatcttgcatcaatagacttttcgaagtttgcaagtttaaacttactgtaaggattttatttctacaataaattgtaatcaggcgccttttgtgaaatatatttctatgaaccgtacaatgtctgatgacctctttgccacccttttttttacttttacagggatttgagttttaacaatatcactggtcaagtaccaacagccctgttgggtctgaatttgctgaactccttgtatggattatcttgacttcaaaagcctatttcttggagccaaagacccatttatgtgtcttactaatgtttgcaagttttgcctgaccagatttcttgggaataatagtctttcaggaagccttccaagctcaaaaggaccttcactttcaactttgtatgttcatatgatccaagtttgtttgaataacatgatgaatatttgtttaatttatttctaacgatgatctggcatctccctgatctcagagatttttcttacaaccagctctcaggaaattttcctccatgggctagtgggaaaaatttacaattgtaagtaccaacttctgaaacatctatccattagctccaatgaaagggcacgtttcattccctgaaatataagggcatgtctgacctatgttaggccagcatttatgcgtgtagcatacacatgtgacgacctagcacatttggtaaatatgaaagctgtatttgatgcatctagtttatatgtcttaacaaatttttggatctatcatctatagggcacttataattaagattttttgtggaaatgagacttaccttacaacttagctcaaaattgaatatttttatagcttttttttcaagctagaccaaacaagctctaaatatgctatggaaatatgaagtgtggaaagccttttaattttagttctgctaattctacttaggaatttggtggcaaacaatttcgtgattgatagctccaataacaggtgcgtccacatttgtaatttctcatcaagtactcaagcataattattaggttctccaagcttctaattggatgcaaaatgttggtgttttgcatctgcagtatcttaccttcagggcttgcatgccttcaaagaaatacgccatgttttcttggttctccacagtgtgagtctttcaccctttgcaataccatgaatgtgcttagttgataaacaccaaatctgcaaccgcagatttacttagtcaatactaatactaattgatctaatttgtttgcagcttcctcctttgctgtggactgtggtagcaatagactcatatcagcctcagataatttgaggtatcaaactgatgatgccagccttggacctgcatcatattctgtcacaggagcaccaacctggggtgttagcaatgttggaaagtttgtggatgcaccaaatggaagttacataatctacagctcgcgccagtttcagaacaccctagattcagaactgttccagacttcaaggatgtcaccatcatctttaagatactatggtattggacttgagaatggaaactatacagtcactcttcaatttgctgagtttgggatcgaagacacgcagacttggaagagcctagggagaagggtttttgatatatatctccaggttggttcttgtctagcttataaacttttttttttgtttagcttacaaccaagtcaacattttcttattttatttttttgcagggtgaacgcaaggagaagaactttgacatcaggaagacagcaggcgataaatcttacactgttgttaagaagcaatacaaagttcctgtgaccaaaaacttccttgagattcatctcttctgggctggcaagggcacttgctgcattcctactcaaggatactatgggcccactatctcagctctgagtgtaatccctgcaggtaccccccttaactacaaatcatggtcccaagatggattttctaggatcaatttttgcatacctctgtaagatcccattttctcttttcaatctaacaagtggcctctgttcagatttcacccctacagtgggtaatacagcacataaaaacaagagtactagtaaaacaggtgtaattgttggagttgtagttggtgtgacggttttaggtttggtagcacttgttggaatctttatgtggagacagaaaaggagaaaattatcactggagcaacaaggtacatggcacactaggctcacaatatatccttgactaggcaaactagaagttaataaattgatgtatatttttatgtttgcagagctatacagtattgtcggaagacctaatgtattcagttatagtgaactaaggtctgcaactgaaaattttagttccagcaaccgccttggtgaaggaggatatgggacagtttataaggttagttcatctgtaagtacatatatatattcgaagtttcgaacttgttatggaattttacctacgaattaacttattaacgtctagacaag

SEQ ID NO: 84313 - DNA, 598 bp, Oryza sativa
agagaaggcgctacccttatttaagctcctcaaacgctccgggccgtttacttggacggaggaagctgagcgtgccctcactcagttgaaggcgtatctcagctctcccccggttctggtcgccccggagccaaatgaacccttactactctacttagcggcgaccccgcaagtggttagtgcggcgttggtcgtggagcgcgatgaggacaatcctcattccgcgcacccccaccctgtatagacttggcccgggagagagcagggaggagaggcccccgagccgaacggtggcccaaggcccccgacgaccggagttggccctctgcccgcttgtcagacggtgctaggagcccccgacccccaggaaggccctgaggccactgtgggaaggccgcacctatcgccctttgaccccgaggctaaccctgtgctgactcgacccgggaaagagcagggagaagaggcccccgagccgaacggaggtataaggcccctgacgaccggagttggccctttgaccgcttgtccgacgatgccaggagcccccgacccccaggacggccccgaagccactgtgggaaggccgcccatgtta

SEQ ID NO: 84314 - DNA, 582 bp, Oryza sativa
gccgttcccgcgaccgccgctcaccatttcctccgcgcccaccttctatcccggcggcctcccgcctcagcgtcgcgcccgtcgcaacctaccggttgccccccgcgcggaggggcgggcggcggacggtgacgcccgggggcgcacagtggacgacggcgcgtgggagcaggcggtgggcgcctgatggcgatgcacgggggcaggcgatggacggtggccctgtcgcactcattggggtggggcgaggctgcggcggctgcgacaactgcggtggaagcggcgctcaaggtcctgcaggcgtacgagctgcggtacaacgccacggtggccggggtcatcaactacgcgtcgacggcggggcagcaactgctgtggacagcggcgcgtggggaagggggcgtccaccgcactgccgatgtgtcggagctccacatctcgccgcggacgcacgtcgccgccgctgccgctgccaccggagccggccgagctcgtcgacccgccgccgccgcccaccaccggcccccgcacggcgccatgcgcgccgaccgccctgagcccggcgacccgagagagaggggg

SEQ ID NO: 84315 - DNA, 760 bp, Oryza sativa
cccaagcttcggcctgtgaaaagcgttgtcgtagttctggaagattctcccaggtgacggcgacaggatcttggcgggaccaacatacctgaacttgttccaccatcttagctcctttgcgaacaagcctgtgatgcaacacctgacaaggcgaaatatcgacaacttcatcattcggcaaaacaggtcaatgaggctgcacccgttccactggagccaaagccttcttgagttgggagacgtgaaccaccggatgaattaaactggaatctagcaatgcaagacggtaagccatagtccccaccttggccaatacctgaaagggcccataaaaacgaaaagaaagcttgcgattagtgcgagtgaccaccgactgttgcacaaaaggctgaagcttcatatagacccagtcgccaacagagaaggagtgctccgatctctttaaatcagcctgatgtttcattctcatttgagctcgtagcagatgttctcgaataagagtttgcatcttatccctttcatgcagccaatcaaccaactctggtgctgtacaagcagctgaagctgtcaaaccaaaatagcgaggtttgtgcccatacaatacctcaaatggtgtggttcccaaagaagaatgaaaggaagtattgtaccaatactcagccaaggcaagccatttgctccattgagagggacaggagtgcacaaaacaacgcaaaaaggtttcaagacactgattgactcgttccgtttgtccatcgga

SEQ ID NO: 84316 - DNA, 508 bp, Oryza sativa
cccgctatgctgaacgggacactacccttagagaacatactgcattaattaaggaatattacggctatcatgaatttggtgattttccatggtctttccgcctgaagcgtctgctatatacccgggcgtggctcagtaatgagcgaccgggtctgatgtttgattttgccactgcatggttgcttcaaaataaggtattactgcccggagcaaccacactagtacgtctcatcagtgaaattcgtgaaagggcaaatcagcggctgtggaaaaagctggccgcactgccgaacaaatggcaggcagctcaagtgatggagcttctggtcattccggaaggtcagcgtgtatcagcactggaacagttgaaaaaaggccctgttacagtcagtggacctgcgtttaatgaagcgctggaacgatatatccgattacgaagtcttgagttttcccgactgaacttttccggtctgcctgccattcaactgcgtaatctggctcgttatgc

SEQ ID NO: 84317 - DNA, 676 bp, Oryza sativa
attcaaatctctccatgttctattgttgttcttccccaaatccctcttcctctgctgctcttgttccaatctcaattccgattccttcccagctaaaccctaattcttagaagtcgtgatagtgcagtcccaacccaagtgaatttcttcccctgaaggtttagctctttagcctgtaatctgtcaattgtcgcttaaaattgttgtatcattcttctgtccagcctgttgttattcttgtcctctgccttgtagattaggttgaaatctcccaagattaaccatggaggtaaagtcacttgggccacttgctacagttcttggagaaaaaggagcttggcagcatcttcctgtggaccataaaccactgtaattttccaggatacatttgcttctctcatggtcaccatggccgttagggagagcaaacgaagatcacaatgtgtcaagttaaaaaatttctcattagctgccaaaattattccacctctagttccatccgcaggcaagaaaaagaaattattctgaaaattgactccaggtgtttggataatgcaggccttatctacctcttgcaacttagtctcttgcaggcaaaccaaagtggctttgtactgttggagaagattcctgacggcttctcttttggctggcgcatttaggcctctaacattct

SEQ ID NO: 84318 - DNA, 728 bp, Oryza sativa
gggggtaaatatagtcataacgggaataatcatatctgaatggaacgatcattattttttgtggacttgtgctccgagtggcccctttctttattgtattggtgaatttccccttaatgcaatctatgcaatgatctgcgtaggaaaaatctaagtagaggagtatttcttctttaatgatacgttcaattctccccctagaaatgtggcctaaaaaatagtgccataattttgatgatgtctcagctttatcattacagacatttgtagcattcatcacagtgtcatccaaagagaagaaatagagtttgtctcgcacgaaggcaagacccataactttattatcaaactaaatgtaacatgttctctttttaaaatgacactcataatctgtctttgcaatgaaataaggtttctcttaatagagggagcaaacacagcattattcaaaattaaattgtaaccgctagggagtctaagtgtgaggtctctaacagccgtcacatcaatctctgccctatcagctactcttaggttttgctccccttttgctaccttccgcacggtactgaatccctgtaatgagttggaaacgtgcaccatggtacctgagtcaacccaccaagtattaagggaaaattcagtgtaaaaggattcatccacattagatatttcttcagaattagtattacctttcttagctaactatgctttaaccatgagcaatt

SEQ ID NO: 84319 - DNA, 665 bp, Oryza sativa
tttttaggatgcagaccatcactgcattgttgtccagtactccatgtcatttggtatgttggcatctcaggggttttttagatggctttcaatacctataggggacatggtaccaaattttatacttcaagggataatgtgtgaaggaactgtttggtttttgaagtgggatgatgaattcaccacttgatccttgatgatgttatttggtttggggaatggaatgagtttatccatcaccacctcaatcctcaaaaggcacatgataagctatcggatgaatggagtcattcttcaaattttgtgggatggtcacatgatggatcacccgtcctagatgtgttgattcctcatacctgtaactaaacagcctgtaagtagacgagcccccatacctctaggtggtaaagtagtttttttttttaaacaataccattttacattatgcatcagtagcctttgtagtttgtattgttgaaggctcgatcaatatgaccatacgggttccgtatggtcattatgtcatgtcatgtttttgttggcaggtcaaacaccactgttcatgttttcaattcatgggagagttgttggtccaagatatcattttcgatcatggttccaatcctgcgattgataaaatagtgttacctcttcatggtgctgca

SEQ ID NO: 84320 - DNA, 666 bp, Oryza sativa
gaaggtgggttcctgggcgcaagctggatgcgcacgggtgcagtcgtcgtcttgcggggcgtagtgcggatccggactcctcgtggcgcgggaagaccctttaactgagcattctccttcttcaggcgcgctatctcgtccttcagagcgacgatcctcatgagcttcccatcattcaaggccttggacgccttgtgcaggtccgagtgcatcctatccaatcccctcatcatagcacacatgtgaccaaaggtggtgtcgttctcgccggctgtcgaacggaaagtactgacatcatcaccgctggctcgacaagggtgaaatcggtacgccgtgtcgtggaagataaagttgtggcgctcccgtagtctggccatcatcaggtatgctgcctcctgacaggcgtgatctgctgtgcctccggatgcctcaaccaccatattagctaggcaggtacccacgtagccgtggacctccaggcgaacacggtgaggaagcttgccactgagtggtggaacagtcgtgtactctggcgcgttggggtagcccaccaccagcgtcatacgtgccaactctgccacaaagtcaatcatgccttctccgcggtggttgggtgggtggccggccatctagagaagacaaaggagtaggatgggctgcaggaat

SEQ ID NO: 84321 - DNA, 723 bp, Oryza sativa
gcagcccagaacaattcatttatacaggttggtgctgacatgaattttagagactccaatggcgttacttgtgtaatggttgcagcaaatcatggctcttctgtcatcatgaagtgcttactagatgctggtgctaatccaaacattccagatgaagtgagtaatattctttcctctatagcctgtgactggatgttgttgcgacaggctgtatggtcttgagagattaggataatctactcacttattctttttatcaactgtaccaatggataagtctgcatgagaagaaggcagtgcttctatgctgctctaaaggaatgcaattgttgaaatgtcatctcaaaggaaattgctcacattccactccaaagggtggatatatggtttgattttcattactgtttgatgctgcttgatatagggatgatgagaaaatactaaggtttaccaatctacgagtgggaaaatatttagtgccccagtaagtgatcattggacaaactaatgtcctgggttgtaccctttgaaccttcatcctatcctgttttgacaaatcatgatataaaaacttgtttttgtgaaccttgggttatccttactatattatttaacctgatgtttattttacaatcttagctcagacaattttacagccttatgtttctaacatgggatcctagttggtagtgctgaagttgttaaaattatttgcaatatctg

SEQ ID NO: 84322 - DNA, 650 bp, Oryza sativa
aacttggtcagccaatccatcccaagaatgacatctaggtctttggattcgagaagaataaggttggctagaaatggtgatctttgaatttctattgttatagaagggctgaattgaaccgaagtggagctattccctggggtatgaacccgcatcagtgtgctaagttcctctcttattaacccatgcatcccgacaaacttctttgaaatgaacgaatgcgttgcaccagaatcaaaaagtactgttgcagggattgagttaacaggaaacgtacccagtacaacctctggtgctgtttgtgcctcctccgcagatacgtggttgacacgagcttggataaaccttggcccggcacgcctaggcttcgggcatttgtcagcgaaatggccaagctcgccacagttgaagcaggaccctggttttgctccagtctccttggcttgcgcggacgggcctgactgtgccggtgtcattggtgggcgtggagatacaccgcggttgggctgacctccatggtggttctgactgccactggcgccctgggaaaattgctagggttgaacgggcggtactggcggacgatcatggtggtaggtccaccctgctgtccaggagtgaagtgcggcctctggtgacttccctgatgt

SEQ ID NO: 84323 - DNA, 5008 bp, Oryza sativa
ggcctcctcctccttccgtttccgttccgttccatttcccgttcacaccctccgtttttccattacaaaggcgacacgaggctttcttcccccaaatctcacgcggcgctttctctctctcccgcgagatggacgccgcggcggcgtcctcctcctcctcctcgtcggcgacgatggcggcggcggcggcgtcggccgcggaggcgtcgttgtccggctcgcctgcttcttcgaggaacgctcgccatcggcagcgtaagggggtccggctccggatgctgcgacggcgggggcggcagcctgtggaggccgagcgcgccccgggcgatgggggcggtggcgccgtgcaggaggatctcgcgctgcctctcggaatgtccttcgccgccgtcctcgcgcaggtgcgtcatggcgggtggatttccttataggcaaaccctgaagaaagtagtagtactagtacttttttcttccttggcgctgttcgtgatcctctctgcgatgttcgtgccatcaaatgtactagcatattgcgtgtagattctgttgctagcgtctcacgaacacggtaatctgagaggttgcgtgctctggatggtagcttagaatgggaaatggaacgttagacgcggcagcttggggccgaggaaattctttgtgctatacttccctcaatggaaatgtcattgagccaaaataaaaaaaagtcattttagttcacagctatatgctcagatttttcacaaataaggggaaaaactaggatgcaaaatgatgagaacaaggaatgattatgaataagacagcagagaaattgggcttgacaatgttgtggctttatgggttatgcaagccttgtacttttgtcaaataagtagtgtggcatttaccgtcttattgcaaaattcaacttcattgctactattattcttcatttccatacttatagtggacatgaaattaaatagtcatttcgataatactaccccgtcatcctgtcattggacattaaattagtcacagttcagcatctcttcatccgaaagcttgcactatagcagcattttgaacacagatgcatatgcatgtgcaaagtctatctaatattcacctgcgtacatctggacatttgcattagtaattataaataaacatgtttgtacaccggtttagccctatgcccttattgttcaggtaacaaggagctgctttcgttgaccgcaggttataaatacaaagaatatttcaggacaaagattacatcctgatttcctctccaaggtacgtgctttctaatttgatttatgaactctgttatccataaacccacaaattgatggtctgaaattgggtttgagtgtagatctgtacatcagcagtcaaggaatctctgacaaatgtaagcccggctaccactattattcagttctcattgtctcttagtattcattgtaatatcctttaattatcgtttctgtagatatatggtgacagttccaacagtttcatcaaaaatttcgaaaaatctttcagcagcacttttaggacgcttcatcttgttaatgaaatacctgtgaatgagagaagtcatattcctgaatgttcttttaaacatgatgattctgtggctgtggacagcttgagctcatctgatttgcaaaatcagacaaacagaatagagcatgaccttgtgaacacagtggaaagtcaactagttctctttgccagtgacaatcagcagttaacgcatcttcggcatagcagatcctctcctgaagctgataatcgcattcttaatgccattgatcgctcgaacgaactcaaggaatttgaaatagggcttaccatgagaaagttgcaactcaaacagtcacagttagctcttagttcccattcacacatgttagagaagattaagctatctttcggatttcagaaagcttccttcaaaggagagaaattcaagactcgcatgcaggagacaagagacgcagaaatccttaggacgctaatagattttcttgttagtgctgtgatagttatgtcagcgtgctttggatatggaacttatatttattcgtatcaaaggataacggatgttacgtcagcttgttctgccacatcaaaggtatgtttatgtagtacatctgttatcactgagtagttttcacttatcgtgtctctttagtaatcggaagctgtttttttcccaccctgtctctttcagggatctaagtcatggtggatgccaaattcagtgtcgaacttcagttctgggtttctttttctcaggtgtcatgtaattgccgtaacacgtatgtgctttggcatactaatgatcctggcaattgcttggttagcatttcagcgttcctcaactactgggtcaaatatgcctataacattcaatctcattttgctgggaattatctgcggctttgctggaaggttttgtaccaatacactaggtggcgatggaaacacttggctcatgtactgggaggttctttgttctatccacttacttggaaatctttttccatctcttttataccacgttctacatggacctatttcagtatctcacagagagcaagttgtctggttaccatactgggttcgccggtgcttgttttatgctgcggtggggcttattcttccagccttgactggcttgctcccgtttgcctctctttctgactggaaggatcattttgtggaagagataaaatccattgttatcggtgacaagattgaagcatgaaatttcttggatgtaaggtggcgcaatacttgtcctgttgtatcttttgaagaagtgaagtttgttcagtttgagattagcctcagagtttagcttggtattgtatgaactccaaaggagattatgctcaagttggttgcacgtagactgacctgttagctgccagcctgccactttgttgtagttggagtgttattttaaacttttttctagttttattcttactttgttgtaaatactcaatagcaagagatgctgtttatctttgttgattgattgttccacctggacatgaggacaatgagtgcagtacaagaccctccaaacggattgagatccagtgcagttgttactattacttcaactttagcagatggatcaaaaaccagcggctcaggtcatcagaaaaatactgttcacgaattactgtacgaagtagcaaatttctcctgtagcgtttactgttcacgaattactgtacgaagtagcaaatttctcctgcagcgtctagtgtgcggtagggtgggagagcaaatccaagctggtggctgcattgatccaacggttataatgtgctctcactgctaaagttaccgtcgttattatgactgcattggatctcaattccctccaaacgtccatgcccagtggcggatccatgtataatttgtagggttggctgattccacggctttttaaaaaacaaccctataaaacttgattttcatgtataaataaaaataataaagaaaggggtttgttggaaccatgccactctatatttgtaaaatttgagatatgccactcgtatctcaatgacatgtaagacccacatgagtcaatgacatgtgggtcagggtgacatatcacaaattttacaaaatttgtgtgacatggttcaaattgtcccataaagaagaaatgaccccacttaaatacaaatcactccccataaagaaataaccccacttaaatacaaataactagtaattgatctcataggtttatatttctggctccaccattgtccatgccagtgatatcacgcacccaaggctcaacccttgagcaaccttgagctcagatacattgttagaaaaatttgcggtcggtacatatacgaacacgagaacaaccgcaaattctatgctgcaattcagcagtttctctatcttggattgaatgaactatgcacagatatgctaaaaacaaatgagagtaatttgtcctagtgccataaactgccaaattaaccattgacaatttctggaactatggtgatggaagtatgatttacaacattctaaaaccagggtctacttttctcacagagaacacatttgcagttcgggatcatatcagacagaaggatgtacatggaaaatacacagtacttcattatacaacaaccgcagcaagcttacttgacatatcaattcatgaccacagcttcaagtagcctcgatcattccagaaagatttccagtcatctaactcttttgcatgagaatgaggtaatcatctcctcgtcccgtgaccgctttccgtgcccgttgatgaagctgcaggagaacttaaccggctgctgtgtttctgctccattgattgaccatgcaatgtaggagcaagttaggaaacattttgatcaatggtcatatttgaagatgagaaaatgttactatctgatagtagagagctttgtcactaacctgtgttgcattctatttgcttcatcttcttagctggattggcgtcatccaattttagtcttctcttcaaaccaagggtgatttcatcgctaagtatatcagccccagttctagacagaactccatcttcggaattcttgctcttcttaagactttttccagcatacaacccaaattttcgctttgggcagacctcggttgtacaatctgaaaccaacccaaattttctctttgggcagacctctgttgtacaatctgaagccaacccgaattttcgctttgggcagacctcggttgtaaaatctgaaaccaacccaaattttcgctttggacagatctcggttgtacaatctgaaaccaacccaaatttccgctttgggcaaacattgattgtacaatctgaagagaagcatattttgcagggttagactctattttttgaaatgaacttcaatacaatgcaaaggcattcttctagaattaagtggataagatatcactgaatattcttgtgctaagaaaaaaaatgaataag

SEQ ID NO: 84324 - DNA, 745 bp, Oryza sativa
tccatcaccgcgcccacggtggcgccgaagctgatggggtcgatcccctgctcgttgcacagcaggttcacgtactgcaggcattccaggtcgttcacgccgttggccgcgcccagggcccaggcggcctcgtattccaggccgccgctggcgccccagtactgcggcttgttgaccacggtgaagtgcgtctcgtcgatcttgctgatgcgcccgcaggcgatggtgcagccaaagcacgcctggttggtcaccaggtgcttcttgccgtcgctggcgcgcggcgtggccatggcctcggcggagatgtccttggcgccttcgaactgcacgtcgcggtggttgcgcgtgggcagggcgcccacctcgttgatcacgttcatcagcacctgcgtgccgtaggtgggcaggccctggccggtgacggcgttgtcgtgcaggatcttcttgcgcgcgaaggtctcggccatgaaggccttggggtcgcggatgttgcccacgcccttggtgccgcgcacggcgatggccttgaggttcttgctgcccatgaccgcgcccacgcccgagcggcccgcggcgcggtgcaggtcattgaccacggcggcgaacagtacctggttctcgcctgcgcggccgatgccggagatgcgcgtgagcgggtcctgcagcgtggtcttgaggtgctcctcggtctcccacacgctcttgccccagatgtcggcggcgtcgcgcagctcggccacgt

SEQ ID NO: 84325 - DNA, 616 bp, Oryza sativa
gccgcagcgaaaacggtttccagtcggccgcccaggcttcccagctgtccacatggcaacgcatcagctcggtcagcgggaagacggcgaacgattcgtccacaaacccgcacatcagcaggttgtcccattcgtcgtcgctgtactcaaaccgcagctcgtccaggtcaaacaggtcgcacccgccggcggcgcatccagcaccgtcacgatctggcgccagattttgtcttcgccggtgaatccgcccgccaggcgatcgtggctcaggtccagatcgatgcggtcggccttggcccgcttcttgttgatgcgactgccgctccagaaggcataggcctggtgctgcaggctgctgggcgtgctgaagtaggtcttgcgccacttcttgtgcatcgccatgccgctggccaccttgttgagctggtcgaacgactgcgtccagaagaactcgtcgaagtagaaattgccgtggtagccctgcgccgtgcgcgcgttggtccccaaaaagtacagcgtcgccccgttgggcagcacgatggggttgcccttgagctcaatgcccagcacctctttgacaaaggccaggatgtagccgcggaagatgtgcgcctgc

SEQ ID NO: 84326 - DNA, 1257 bp, Oryza sativa
  unsure (1)..(1257): unsure at all n locations
agtgtgcaattgcacccttgatccgcgtttagagatcccttnnnnnnnnnnnnnnnnnnnnnnnnnnnnnnatgtagctcatatgtagagaaaatttatcttgcactaacaacctttttgtatggtagtgactttgaaattgattatggatccgaggaacgcgcatccatagtttacaaaacgctcgctgttgataaggaggtaagaagttatagtacactttaacatggttcttgttttcataaggagtcccaatgtttcctcttttcttcatgctagcttgttgagaaaagaactcgaatcctgtggtatttatcttgcagttgcaacctgacaaggtaaagagggagatgtctgtttctggtggcaagctcgtcgtgtcagtaaatccattcttaacaattgctatcgattgtgtttactttgattcacgatgtgtactgatacaaaattttttgaatctaattcaggcactttgaagctgtagaggctttggtttccttggcgggagggcccaattttcccggggcgtccagggcgtttgttgatcttacagtactggttaccaagcttgttgaagaatatgggcatcccaatggacganaaagcnnnntntaactanttttacccgcccgtctcttagaaaaatgttttacaacacctttgagcattcataccttcttttatatcatattatgtgtgttcttcgtttcttaggccagaaatctacaagatagaagcagctgttgtaattccagatttcttgaatcttggtatgggatttgcctctcaagagtaactctgaacatacttggttgggatagtagtcagttcttgtccaccacaaaaatcaagacaagtggtgctcattgtcggtcaaggtgtcattagagcaccattaatcaagacaagaattctaaactaatctcataggattaagacatgcattgatccaggtgttaaacccttgggcagatttaggatgtcgatgtgccgttctctgaatccttcagacagatctcgatgcaagctgacagaaatgaaaaggcagattctgaagaaggaaattcattagagtaaactagtcatggttggagagtttcacttaaacttgctgaccgatgcaaagctccaagtcaacttgcaaccaataaagtgacatttttcttatgatcttatactaacatgtgtattattgccctgatgacattggatattaagtgggttgacaatgagatggtggaatnctgtccaccc

SEQ ID NO: 84327 - DNA, 743 bp, Oryza sativa
  unsure (1)..(743): unsure at all n locations
gccgctttgaatcgnctgtttgaaaagcnnnnnnnnnnnnnnnnnnnnnnnnnnnnnnnnnnnnnnnnnnnnnntcacgtaatacggatcaaagccaaaataatccacaagtgtaaactagtatgacttacactttttcatcctgaaggagaatggttggctgcaactttggagcagattaaattgaactcctagaaatctccgccggcggctatctgaacaaatcggtgtttgggattagcagcggaaacacatgctagcatggacgcttcactatgaatattagggctattgagatcctcatcctctaagcccaatatcttagcaaactgtgctatggaaattttgtgcctaacaccctcagtcatccactttacataaggagttccctttctagtagtaccaaacaatgctgtcgcatagaattgtgcaatgacctcctcatttcaatcatactccaaggcaagaatatctcccagattcttgttgcgacaaacttgcattgcttggttgaacacttcattgttcttcttccttatgtaagtcccatccatccacttcatctcaaccattggattgtctctagctataatcactgagttatacccatccaattgggtgaaacgtctaaaacgaggatcctgtgactcctcaggctgtgtctttggatcaagcanaccggtccttttgcacttggcaagctgatgaaggtagtttggacttggtctttcaaatgtgtgcat

SEQ ID NO: 84328 - DNA, 726 bp, Oryza sativa
  unsure (1)..(726): unsure at all n locations
gcggccttgatggacctacnnnnnnnnnnnnnnnnnnnnnnnnnnnnnnnnnnnnnnnnnnnnnnnnnnnnnnnnnnagctccaatggacaggcagaagaaccgtgctgagcgctgagagatccccttataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtatgcctagtccgtaggcaggacttttcaagtctcggaaggattcttcaatctgcattcgctttgaatagatattaacaagttgtttgggtgttcgaatttcaacaggtaagttagttgctagaacccatggcttctttgccgacgcttagtagattttaggtgacgggtggtgacaatgtgtccgtggagaacgctgattctttagggctttagagcgaagaatattcaatagaatttggcctgcgattggattgtttttaagcagcctcttatagcctatagtctttgagtgactaggtgacatatgatg

SEQ ID NO: 84329 - DNA, 531 bp, Oryza sativa
aataagcccacgggggtcgctggggagtccatgccttgttttataagggggtgattatgatccaggaatggtgcgctgctttgaattgtgttatgcgaagggtattgtcacaatctctattcgggtacttgttaagtatcgcgacgcatagttgacatgatgttgaggttgtgtcttgtgggtacagtggtacacctctggccagagtaaaactattcgaatagccgtgcccgcggtcataggcgggtctaacaatgtctttcgtgattagtctcacacttctcaccataataaatgatgatataattggtaataatttatttagcttctggtttggagatagatctgtgcagccgggtatggttgttcaggatggttgggcctgtgcagtatgggtgtgctgttcagtgttgattaatattgatgattaattactctattgttttataattctcaaatgtttgctaaatgctgcttttgcaaatgagccctatattatgccatcctttggtatccatgtgcacttgcata

SEQ ID NO: 84330 - DNA, 655 bp, Oryza sativa
cgtctgtggagtttcctccaagttatctgccacaaacatctggggcgactttcttaaagaccatgtatgaagcagacgtaactttcacgtttggcaaggagaattctcggcaattaagtgcgtgctcgctgttcgatcatcagtcttcaaggcaatgttctttggtgctacgaaagcgaagccccgtaggagcaatatcaaaattaaagatatgaaagggggcgttttcagatcattcttacatttcgtatacactgacttgctgcctaatacgtcgcaaaacgtggtgatggctcagtaactacttgtcgcggcagatcggtacaatgttgagaggctgaagctggtatgagagaagaagctatcagagcacattgattccaacatggtggcaaccaatttggctctagttgacaagcacaattgtcatcaactcaaggaagcttgcttcaagttcataattgattctccatctaatattgaaagcatggtgaaaagtgatggttacgagcatctgaaaaccagttgcccatctgttcttaatgagcttgctgcgagattgcttcctcatgaaatgaaagcagcaaaacaaataactatggctcctaggtagttttcttttttctttttaacttttgagtaattccatctgtaa

SEQ ID NO: 84331 - DNA, 665 bp, Oryza sativa
tattttctttttgtggctacaacatacttgtcacttaagcttcacttccagtaatcttacattgaaatcctataaacaggtgaaattgaacctatatcttttggagggaatccatgatgatgttgatttttgttgccaacttgcgaaagaagagtcggtgattctttgcccaggtacatctaacatttttgttaataaatggatatgtatgtgcctatttaattaaagaaagttaaaaatttaatattatattattcaattcacttgttatgttcttgtaattctctaacgctataccatgacatataagtgatgctaccttatttagtttctcacaaatctaatgattactttttggctaaacatttatgcttattaattaattttgttatgaaactttgaaaattattctatgattttgttgcttaaaaaaagttaatagttaattacttttagttttgcatctctaatcactaatagataatagtttagttagaatatttaaatatatgtggttatgagttttttattgattgcatgtaaactttttatatgtgatatatgaatatgacgacattattttatttctatatatgaaagaaaatttagcaaagtgatgcaatgatattcagacaggcacattatatccctacctgttgtttttg

SEQ ID NO: 84332 - DNA, 967 bp, Oryza sativa
gcgccatcgggtctctggtcctccatgactggggcttcgggagggaggaggtggaggacatgggggagcacctagcgaagttgctccgcccgtttcaccctgaaatggatcttacttcggattccgactagatcatcttcgaaaaatcttacttcgagaatcaagcatgatccatctgttgcaatttatgtggattgtagtaatactaaatctttttttttcagagggttttcagatactgaaaattcatgctcatgtggctggctgttgtagatcaagaatgagagatctgaatctatggccctgtttagatccggagggctattaaatagccctctggaatcttactatttaagagtattaaacgtagattactgacaaaacccattccataacccctaggttattttgcgagacgaatctaacgaggtatattaatccatgatttgctacagtgatgctacagtaatcagccgctaattatagattaatatacatcattaaattcgtctcgtaaaatagcctaggggttatggaatcggttttgtcgataatctacgtttaataatcttaaatagcaagattctgaagggctatttaatagaccagaggttctaaacaaggcgtatggcatggtagaccttttttgtgttctactcatgtgcatttgagcacgggtgtaggctgtgtatgccacatgctgctgccgtgacattctgcggtgtttcaggccatgtacagatcaaccgggccctggcttctgtcaagtcaagcagttccattttcgttgtgatgtgaggtcacactccgtcggtctgtgacagtttcacatgaaactggagtactcaatttctgttaaaaataactaaaattcccgcatttcaaatataaaagccgataggctgtatatatcgggttttagccacattaggaacatggaaaattttcgccattcctatggagttat

SEQ ID NO: 84333 - DNA, 722 bp, Oryza sativa
tagtatgttgtattttaagtttttaacagttgatagagcaaaattctgatagcataccttggctcctgtgtgcttgaactaccactaaggcaccagtgaagtgctgtgtttccttcaggatcggcttcattgacatcaacatcccccatcaggagcttctttgtgacatttacatctccaacctttttgccgggtcggcggaaggacgccgaccaaatttcattaagatgaaagaagagttaccagtattacacgacattagactgtcgagccggggaagaaccccgaataaaagaagaaaaattaagaaaactgagaaagactatttacaagcaccaaagagcttaaggctactcctcgcaagagaaaaggccggctgctctccagatcaggacttcctccttaatgtctgcaactaagcgatcagccacaaccgatttattctcaaaaaccctggcattcctttctttccaaactctccagcaaaccagcatgaaaagtgaatcaaaagcagtcctgaacctcatctgaaaacagcggcgggcacaatgccaccaatctgccagttccatgccaagctgagcagggagaggaaaagtgacattcacccaagccttcaattgctccacactctgttagtgaaagggcatttgacgagcaagtgattgcagtcctccggcgccgattgacatagcagacaagtgggatcatgtggccaacct

SEQ ID NO: 84334 - DNA, 1412 bp, Oryza sativa
taatatattgtgaacaggtttcggcaaaacaaagccacctatatcacagttatcattaaatctctgcaccaacttcaaccttcggcgagcaatcaattttgaagacgacgatcacaagcgcagcttaatcggaggtgttccataggctctttcctgtggatgtaattaaccggccgcctcattgctaggcgccgggaatcagcggactacacgcaatctccagtcagcatacctttccattaagtattcctcgcgaaggcaaaaggcgaactcctgtgggagccctcatgtatttgtaaacattcatgttaatgaatcgtgattaataaaatacagggtttccctattttctgtgtgttcgttgttttgttttcatcaaacatctggcttggagtgagattgcattgcatgtgacttagcttctttttaatattccggtgcagtctgcaacacagaaatgacgcagaaggaaaatcaagagagggcaacgcaactgaatggatccaaggctgaatcgaataagttgtctttgtttccttcttttcctgtacctgagagttggttgtataccccctctgactttgcttctttttatgcagttttgtacaaaacaaactcaagcagaaagcgaaacaaggggtggaatctcaaaagagagaaacgaaggctcacttgagcaagatgcttgctggattgaagattgttgaatttcttcatgctgaagggtggattggagggattatctaagaggttttttttttcattttaaagctattctaatgcctacattgtcaactacattccccatatttagtatgcttgtccacatgtcaatggcaccgttggagcaaatccataatgtgcatccttattccttaaatagtgcggacatccttaaataatcctttgagaagaagtatcctaacctttacaatctagttagaaataaaaatgaggtagtggccaaggtaatgagtagaatcccgttaaatgtgtctttcagaagatcaatactgggaagaaacttgaagcctggtatgagctagtgtcgaaggtattaagctagtgtcgaaggttgttaatactgttttgacagattagaaagatcgcttcttttggaaaaacaataaagatggcctttccacagtaaaatctatgtacaagttgctcatgtatgaaggggtggttcctaagaagaatttcatttggaagctcaagattccacttaaaatcaaaattttcttgtggtaccttaaggaaggggtaattctcactaaggataatctagcaaagagaaggtggaagggtagtctaagttgtttttgtaactcaaaggtaacaagataacaccttttgtttgattgctcaatggctaggtatatttggagtgcgctcctttttacatttgagat

SEQ ID NO: 84335 - DNA, 709 bp, Oryza sativa
gacataaactacgtacataaattacaaaaataatgcttcctcatggttgacacgtgcatattgaacttcatcttcttcctcctcctcttctagaggtatttcttgacctatgccgtggacgtgctggttgtaatcatcctctctgcaatattgtccaatccaacaattctccttttcccttcacgaacaacatgtactttcttgttacacgggtcaactatgtagaacacttgaacaacttgtttggcgagaacgaacggttcatccttgtacgcgttgttagccaagttgacagtggtgaaaccttcattgtcaacttttatattgcgaagatcgacccatcgacaacgaaacaacgggactttgaacttcaagtaatctagctccaatatttgctcaactctaccatagtattgatcacgacgaccaccgtcactagcagcctcgatgcgtaacccactgttctgcactgtgcatttgctgtcttgcttgaccgtgtgaaaggtgtatccatttatgtcatatccttgccaggtggtggcactccattcaggaccctgtgacaaccactgaagtgtttcactaggcaagttctgcaacctggcaattcggttcttcagccactcgttgaaagaagacatgtgcttattcctgacccaactctctgatcggcctgggttctcttgtcggataactgcaaggtgttcgt

SEQ ID NO: 84336 - DNA, 5428 bp, Oryza sativa
ggcaaccccacggcggcggccatcacccacgtgctcaacaacaagcgcgagttccctctcgccgccggcgtcgaggacctcctggtcatctccatcggcagcggcgagtgcgacaaccgccccaccggtggcccgccgcctcgacatccgagatcgtcaggatcgccgccgaaggcgtcgccgacatggtacagaaaaaaacaatccatccagtgtgtctctctgtgtggtcctcttcttcctttctcgcatgcattcttgttcttcgtgctcccttggctaacgccttctccccgacgcatccttgactccaggtggatcaagcagtggccatggcgttcggacataataggacaaacaactacatccgtatacaggtcagagaactcacagccatcactataccaccatgatatctttgcgtttgctttagcttgatcaatctccatctccattggtgtctttgatcttgcaggcgatggggtcgccgcgggcgagccgaggagggatgagatgcggcggcggcggcggcggcgatggcgcggggtggggcgtggcggaggagatgctgtcgcagaagaacgtggagtcggtgctgttccgggggaagaagctggcggagcagacgaacgccgagaagctggagtggttcgcgcacgagctcgtcaaggagcgggatcgccggaggacggccggcgcgctcgcccccgccgtcgtcaagcagcagccgtcggagtcggcgccggcgacggcggccgccgccgatggccacacgccgccgccgacgtcgtactcgaacctggtcagccagatgttcaccaccatcctgtagacctgtagacgtgcgtgcgtggcaagcgaaatgtgcttccgatgtattgattctctccccttatttttggctgaattttgtaaatgcagagtaacaaaaatgtgcatgcttgccgtgatctgtacgtaggacatgcctgtttttttttttaatctccctctaaatcctaggatgcttaatggagagctggtaagttgactaaaagctgtagaatcaagttaagtactgctagtagtgatagctgcaacctgcaatcaaagaaactcaaggcaaataataatatatttaattaaaaagaagatcagatcactgaaacaaagtgctagatttaatgaaacaattctaagaaattgtacttggcctgtactgtcagaatttcaacaggcaatacaaaaggtacactcctgagctgttgcaagttgcaagcttcagactccagattccagaacagtagttgctcgcaagtcgcaagtttccaacaaaagaaaataaatagaacgtagttgctcacacatctagcgtgatgaccccgttccccgttgatgcacggagaatttcagtgtgggtagggtagaacttgtctggcaatgtaaattagtagtaacatgcataaaatctggctatttgcatttactgctatcacacaatccaatgcaaaactcattcatgatcggtcaacttcacaatgtttaccatgtgatagaactatagaaatgaatgagacgtcatggagatattgatgtctagattttcgatgcaaaatggatttctcttttcttctctgtacccagagggaacaaatgctaatcatattccagaaaagcaatagttatttcctacgcaaatgaaactgactatagaattcaaatagtactagaattcttgtatttcagaagctacgagggtgtgaaaaatggtaaatccatgattacctgtaggcccaacagaggagcagtactccctccatactaataaagaaagttatttaggacagcgaaacggtctccaaaacacaactttgatttcttatttctataaaaatatttattgaaaagtgatatatgtatatttttatgaaagtattttttaagacaaatctattcatataatttttatattttcaaactcaacaacttgagagttatttatgatttatattatcaagatttaacttaaatattgttctaaacgactttatttacgaacacggagggagtatgctaattactcctttaacgcagcggagagacaggttctgggcaggccggacccggatctgcgactgcaagaagcatgcagcttaactcactttaagtaaaaacaccaaatccgaggtgcgcgtgttgacgggctggtgatgtattctttgatccgtcgaaataggtggcactcttcatgcaacgtggaggcctggagagctgccgagctgggcatcggttatggcttgagatgctccaaatccagcaaatttgtcttcaaatgtgatttgcctcatatatatactctcctgcaagaggcgtcacaccattgattccacccatcaaaagatatagtgcaaatgaaaagatcacagaaaacagggattgtatcagaatgcatgtatatattgatgtcaggaaacacatgttcaacttgggttgaaggattggatgtcttactttgttattcatgtggtgtgggggactgagctgatcctaaatcccaagtaatgagcatttaggtcatgttaagagtagcttattaactgagtgcatgggctactgtatattttaccagacaccacagatcggacctacatatactgtccccttctatgatggagtggcctaacagcaatgttgataaaccatcatgtaaacagcaccagaccatactagtaggtaaataggcatgcataaagcataatgatctaggttacaacttacaggctacaaagtagtgctggtggtgcaaaagtagctccagggggtgataaacaggtactactcaggagtcaggacaatgcctaagacaaaggagggaatataaaatttcactccagccacaccaaccagcctttttccaaagatcaaagcagtaatttgtactgcatgctacagtgtgaagatagatcactgatgagaaaccagcacttgtgcaccagatggcatgagctcggtatcaccattcactgcaccattcaggcattcactgggaggaccagacactcccagttagtacagctgaggctttgagtactgcatgcccacactatagtcttgtccccctccctccctgctgcttgctttggattccattttcatgcatgcataggtacataggtcacacgtgtagcattactagtacataaatctgctatggcttgtttgtgtttgtaaatgcaactatgcaagtagccaagaatctctctagtctctacccagggatgaagtaatggagccatcactcatcagccatgcaacaacttgcaacttgaagagttggatctaatctcgctccttttgcacaaaaaagatgatcgaaccacgtttgcaaagcgatttcttggaaagaggagtgattaactattgtaagtagaaaaaaaccgccctgggtaaggttagttagcagttaccagcttcgtcccctctgttatagtttactctggggagtcagaatgacgggttatttaggggtctaggatctttagtcacatgtttggctacagtagtggagatttttaatgtttgttgctttgtcatagacgatcttatagtttgttttcttaatgaagttatatacatagacaaattagacctgcagtgtttgtctagggaatcctatcctgcatctctgtaacgaaattcgtcaatacagacaaaggaaaaactgttcatgctcatgcttttatttggctctctggttgttctcttccattttgtactggcctgctattttcaagtagctaagctgctgaagtatgtagttgccatagcatcaaggttataaattgtgaaatggataaaagttgcgttatagtcatcatttattaatagtcaatggatcgttccttcttttttatgattagtcgatggagaaatttcttgaagtctgaaattcaaatgacggatcgtcctaactaccaaaaataaatggtaaactctgaagaagcacaaaacacgagcaagagaataaaatgcttccatattttacatccaaaataaatacacaagatacggatattgctgcatcaaatgaatggaaaatgactgcttacttgacaggttgatagatatatatgattgggtggccacacgtacgccaccatgccaggaccatgcatctgctgtgactgttgtgagcagcgtagcgtacttcgattcagttgggaccctggatgaagctttcagaaaatgtgctgctcacctgcaagaacaatcagtctgcatagcgcacgagcaacgcatgcagactgcctatacctaactcgcagccgattagattgttttaatcaatggaagttttaaagaaaaagatatgtgttgtattgattattgtatagtactattgacgcaagcaatacttctataggtgtgcaatatatatcttatatagcatttgaattggcataaataaagatgcaaaatatagctatagccaaatgcattttcctactatgaatttgcaacctcattgacatatataacagagtcgtagatgcagttcactgcatcttcaagagaaagaggcattgttttggtaatatatgacaacaggagaggggcctgggaaacaagagtaaaaggggatttttctcatagaatgaaaaaaaaaaagaaacaggcccaggtatagatttatcaggtaagtatggcctagactaaacaaaaaaaaaagctactctgaaaagtactctgtagtagctcacagaagatgtatacgcatatttgggttattgccaatctcataatcattgaactgaaagaaatttgtgggtgcttatagtcttaagaactatatatagtttatataccctttcaatgtgacagttaataccttgaaaaaatggagaatgataaggctatattctcttacctttttcacagatgctcatgaagggtgaccaatttgcacatgaaaatttcctgtgggacaaacccaaaattcttcaacaagaaaaggaaaaggtggatgcaaggatataggaatgtaaaggctaataagatgaactcagagaatatgcaacagataattgaaatgattacatagggaacaaaccatgcaaagccttcttttaaactgaaaatcgtacctgtttctgttgaagatgtggaaccattatgtgcagcgatacaattgctttgagcatttctagctccaaatagtagtgtgaatttactaacctatttattcactcacaatagagcacatattgtaccaaaatacatcagtagacactaccaaactaaactgaaagttgctctgttgggcaaattagattaaaaacaaagctataagaatatgaagtctggttggaaaagatttctcccaacagtgcacttagacatttattatattaggtcgctgggcagcatctgatatcattgcaagggtaga

SEQ ID NO: 84337 - DNA, 633 bp, Oryza sativa
attcctgcgcccgtaaaggcaagtcaaatttcgggttgttgtttctattgctaggtggttgtggtgcttctgcgattagtggctaaccgatatggttcttcagtatgccaggacgaaattacatctttttggctggctagtggttcacttccatgatagcgatgtcacatgtgcaatattttatcaaaccaaccaactactatgatactttactctataatagcttactttaggacagcctagtggtaacgtatgaacaaaacatgcacttacatctcaacctgatctatgtccttatgcacttacctgaaatgattgatgtcagatcaatgcactttcattattcgtgtgatatttcataagctattgtgttgcaagctctacaagtttcaatgcaggaggtcacatgttttctttatttgcattaaacaggatatggaggattttcttacttaatggagcctctatggtggataggcatgatttctagtaagccacatttgattcctttttaaattatacaatattttgtacttcttgaaaatgttcctttcttttctgtcacattatgtgcacaatattttttttctatcattggatttatcagttttttcccctttgatcttaacatat

SEQ ID NO: 84338 - DNA, 2520 bp, Oryza sativa
agctagctctataagcaacatcattgccaggctacaaaataaaattctactccagtctgatgtttgctctcttttgttgtgttatattggtaaatgcaatgtactagtccatttggtctgttcagttttctaagatacgtctttcaaggtgccaggattaagaatgaacatgatgtaactacactgtatccgctattttgaaccgaagtcggattttctaagagaaaatgtgcatgagagttgatcatggagagtgcattatcttgagcagttgtgattattccacttattgttcgccttctgtattgcaatgcgtgtaaacatcagttatcaacgtccctgatagctttatattacatgcaacacctgggtaagatgaaatagagcttaggttgtaccttgctgttggcacatgtgaatgtgtttgtgaacactcattgattgtatactggtatatgtgcatcctgaatatccttttcacttatccaccacattgcccgttcagttgctctctgcatgctcacttcaaattggaattcacttcttcacccactattcccctaacccaaggaaaatgtcacactttcattcgttttcacttctcggggcttgtttgcctctataaacacctgcactattgtttcctttcttttctttcttgatgatctttagcctctgatatcaacgagaagttgtgacctaccgactctgagtgagcaagaaaaatagagtgagcatgggagccgttgggagagcaagcattaggacatcaacatatcaaagctaccgttcacttgtctttgcatgcagagagtggaaactttgggcaaagatgccttgcactagaggcaagccagctacactgtgtgactgataatgttgaagatgagacaactcatccacaccgagtagttgatcaggttgaacatgagagacggccttgctgcctccagtgtggatcatggcgaccctgatgttgcatactagaacaataggccgcagttcgattccccgcgttgcccacaaggcctgggcaacgccgatgctacatactagtcgcacgattggaagcattggctgctcgaggagtcggcgctgccctcgtacccattcttatcgacccctttaattgttctaattttggagtgttcatgcaaagtttgattctcggttggtagtgacaatcctcctgtacggtgtcctatcttgtcagatgtcttactcaaatttaatattgccatcttatatagtattggttatattggatctttgaacttttttcttgagtttaatacaaatccctttgtcaatcaatattaactaaaagccatatgcatattaatagactataaacacagttagttttcacattttaacgacctatgtcaatgtcaatcattttgcactatagaataatcttgtatataaggtaagaattcgagggtttgaaaggtatcaacctttgctagcttcctctccattgtcaatttgtcagtatcaatgctcaaaagttgacagcatccatccacagtacgacgctgcatgcctctcctcagttcttgattctaggctacctgataacaacataatcctctctctcgatctcgatgttgtggcttcaaaaaggaaagatgatttttgagaatggaaggcatcgagagaacacttgcaattatagcaaataagagatgttgtaactatgtcgttcttggactttgatactacttgtgaatggctgtggccctccatcgcacgaccattctctctacatttgttttctttgcttctcaccagctccgatatttcttaaagagttaattttgatttttttgctgtaatttatttttcatcattagcttttaaattgctatgaacacatatataaaagttctttcaaaaaattattttggtagctaataaacgatgtaggtgaaatgatagcacttgcatgtggtttgaactccaatgtcccttcaattctcatgaggctcacatgtcaaacttgtgcatctaaaacaggttcagttggccgggaacatatcttatgcacacaactaacaaatatcaccgaaaatatttagaaaatattgtgcatatacttccaatattgttacacatatgtgtaaaatcttaacctcaaatccattatattttaacctaaaaaataaatattataagtccatcagaatttatcttttttccctctttatataggatgaatttgatgatgggacttcacacttagatgtaatattattgaaagcacatgcataacatttttttaatttttagtgatattttttagtttttttaaactaaactggcatgagaactgccaattatatttcattaaacagagtaaaaacccacggtctacagaaaaagaaaaacaacctctcgacgagtagagactcgccgagtcctttatccgcggccggtacaaccatacaacacacggagctccacacaactctagccaaactatcaacgaaacaatggcgcgaatccaacaacgaatat

SEQ ID NO: 84339 - DNA, 567 bp, Oryza sativa
tatagggcgaattcgagctcggtaccccactccgcctccgcgaggatacgctcaccgagcgggagcgagccctcgaggagggcgaggccgcagcacagaggctagcggagagcgcgtccctccgcgaagctgcgcaagaggaacaagcgcgtcgcaatctggaaagtgcccgcgccgagagggccgcattgaaccagcgggccgctgaactcgaggcgcaggcaagggagctggatgcaagggcgcgtagcggcggggcggccacgggcgacagcgacttagccgcccgcctcgcagttgccgccgctgtctgcgccgaccgccgccactgtccccagccgtctcgggagtgtatagagggagagagagaggaagaggaagagggggagaaagatgaggaagaatgggtatagaggctgatgcatgggtactgctgtcatagactcaaaatagagaggatggatgaagaagctgttggagtaaataacaaatttgacttgataaatgagatggagagttggccaaatagatatttggagagtcgaatttacagagagtgttggagat

SEQ ID NO: 84340 - DNA, 600 bp, Oryza sativa
tatagggcgaattcgagctcggtacccgctcgcctgcgaggagttcggcttgggagacgttcagctcgaggagatgatcagagaagtcgacgaagacaacgtcagtaaaaaaaaaaagaacctacttttccattccattctgatcgaagctagctaatcacattgcctgaaatgcttgatctgacggaactttcgctgttctttttcgtgccttgtgtttgcaggatggtcgcatagattacaacgagttcgtggcgatgatgcagaagccgacgatggggctcccggcgaagaagtccggcgggctgcagaacagtttcagcatcggcttcagggaggccttgaggatgtcttgagaaacagccactagagtcagtcacacacttgtagaggcgacgacaacgagatcgatatgttgtcttccatagggctggtaatttcgaaacggggaaaaaaatggctggaggagatgtgcgtgtacgtacaggcgtagaggggggtgggtcactcttgggtcattggttcgattgttttcttctgacgttaaaaatacaagagaggtttttcgttcctcgccgccaccgtcgttcatgtgataat

SEQ ID NO: 84341 - DNA, 633 bp, Oryza sativa
caaattttcatcattccatgtttacgcccacccccacccccccccccaaaaaaaaaacacacacacacacacacaataagacaggtaatgcacacaacatggctcagtacagcagagtactgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaacccatggctcctttgccgacgctgagtagattttaggtgacgggtggtgacaatgagtccgtgtcgagcgctgattttttcggccttt

SEQ ID NO: 84342 - DNA, 663 bp, Oryza sativa
tgaatagtacagttaaaaacatacaaaaaatagatgatctcaatatatgaacaagtaatggaattgcatctaaggttcacatggttttggttgattggcaagcaattgaggaagggcaacttatcatcaacagctaatgaatagtacagttcaaaccatagatgatttcgatatatgaaccagtaatggaattgcatctaaacgttcacatggttttcgttgattggcaagcaattggggaagggcgacttatcgtgctctgaatccaacacatttccacaaccaaatctactttcccccacctaaatccatcattcccggagcacacgcaagcgctactccaaacccttctaaacccatcgaattcttcaaccctatcacagatccaaaactccccaacgtcccccctcaaatcccccatcctcctatcctaaatccggtcttatctgtccctccttcatccgtcccgtccgttagtacagtatccgtaaacgtataaataacatagagacgaatcgctcgcgagctcaccttctcggggtctccgtccttgtctgggtggttcttgatggcggtcttgcggtaccccttcttgaggtcatccttggaacgcatccttgggcaccccaagcacctcgtagtaccgcgtgttgtcgctcttct

SEQ ID NO: 84343 - DNA, 571 bp, Oryza sativa
caagtattcactgatgttgttggtagcccttactatgtcgcgccagaagttctgaaaaagaaatatggtcaagaggcagatgtctggagcgctggtgtgataatttacatcttgttgtgtggtgtgccgccattttgggcaggtaagaattttgctgatttttcagtcaatcacaaaacaattatactaactttcgtgacaaaatgtgatgtattttgatccgaactcttgtactaattaagctctccattgttgtgaatcagagaacgagcagggtatatttgaagaggttttgcatggtagacttgactttcagtcagaaccatggcctagcatctctgaaggtgccaaagatctcgtaaggagaatgcttgttagggacccgaagaagagattgacagctcatgaagttttaagtaagttacttgattaattttcatgatatattcctaaatgtatttttctagctattttaatagtgcagggctgcaggccatgaacagtgcagtctgatttacttggcattatcatcttttcaaggcatccatgggtccaggttggtggtttggct

SEQ ID NO: 84344 - DNA, 560 bp, Oryza sativa
gcaaccacatggtcagacaagccgttgtactaacaaaaataggcctttggtacaaacaaatgctagaaacaaggcgttctgagctccagaaggctgaagccaaggtaattctttgtttttgcctgtccaatttccctttggaaattacaccaaatttaaagcacaaatcaagggtatattctaactcccctttgagaacttgaagatttgtggaaataccattaaaggggcttcctctagtgagtttcttcttgacaaactgatacataaatacagcccataggcttatttagtactggtaaggactaacgacaaacacctcatatcctatcatgatccaacaactcctaatctcaacttaagtcgcacctcagtttttccttttttgggcgtaaacctcagactgttcttcacacggaatacttcattgattaattaagctttgtttgactacaactgtgatatatcgctataaattcaaagagacaacgttgaaatatttccgatgtgattcaggttgtcattttgggcgacaaggttaattcacatttaaaccttct

SEQ ID NO: 84345 - DNA, 594 bp, Oryza sativa
attacgacctagaaaagaaaaccaggcaaaaaatcagaacatcaggatcacaccattgccaccacaaaggaggcaagacaaaagaaaaattagcaatcgacaaagcagatgaaagcatacttgagtcgaattagtatcccacactttgacatactgatcaaaagaagctgtcacaaacagcccagtgtccacaggataccatacggccatagataccgcgaacttgtggccattttcatgctgcttgtccacaaggagaatgctcctatgcttggcaatgaacccagcttcgtattcgatcgcattctgcacatcaaatatagcggctgatccatccgatgcgcccgagagcaggtaccgccgctctatcaaatcaacctgaccatattgtcaaattacaaaacaccagcgggagcgactcaggaattgcacaccaaatacgcaagattccatctacagggtgtacaaatcaaattgatctaaaccactaaggtgagagaaggagaaggggagtgagggagtgagaagggggtgtacctggagagagttgacggcgccgttgtgcggggtggtgaactccttgcggttggagag

SEQ ID NO: 84346 - DNA, 1527 bp, Oryza sativa
ccacaaaaggaaggaggtctgcccgtgtctcgaagtcgccgggggcgaagcggggcaccgcaagcgaatactctgacgcggacgtttcgccagccgctctctttcccttcgcctcagtcagcggcgatgcaattggctgacgaggaggactgccgaaaactttcgccgcggccgtcacgatcctttccgcggaggccgaagccccagcggcagtgctaccacccgctccagtgccgccaagtggaggagcgggagcggctgagagatccaggctgcggccagcgggcgaagtcagagtcccgtcagaggactcatcgtcgctaaaaactcgagcgatatcgacaagtcctttctttttagccgccttcttgacggggcctcccttcgccgccttgccagaggagaacgcaaccagagccttcgccacgtccaagtctttttggcgaaggggggagctattcgactccaccccagtctcgttatggccaggacttggagtgggggtataaccgggagtttcggcgcgtccctcggtcacctcgaccgcggcattttcgaccgcggtctccgtctcttcttcctccccctctccctcttcgccgtcaagttcttcgccatccttgtcgtcagcgtcagaatctgatgaaacaggagccctacgcttcctaggggcaagcttaacctgaccgcgcggccgcttccgcgaaggccctgcttcgtcaccagccttatggggattcgcccgaggaggcaattcgccgttaaaaacccggttcgcccgaccagttgcctgccgtgtaagcatttggctgtactcaacgaccgatacgtcgccgatcatcttacgggcttcggcttcggcttggtcaagggttagcactgcaaaggaaaggaaaggagtcaggttaaaaggtcaagcagagagagctaaagcgcgaaagtatatggcgaaaacagcagacttactgttcattccctcagggaggaccagcttaggcaagccatcaacctcttcgctcaggttaaccgcaacctgccatgactgggagaggggaaagatgcgaagcatgcagaactcctccaccaggtcgcggcagctgaggcgggaacagactttccttagcagggcgaaccgggcctccatagcgccatccacggcgatcctgggttttcgattcggcgcaataaccctgcgccgacaccgaagagctttcgctgaatcagagccggcctcgaaggggatggtgtggtaaaaccacctcgccatccaatggcggtcccacttcgacatggcagcattcgctggccaaaggtcggaccgttcggggcgaacattgaagttcacgctcccgatcaccgtcttcttcgtcccagccggagtaatcaccgtcttggagttcacggtggcgaagaatatggcgccgaagagagcagcgctaggttcgaacccagaagtccgacaagcccaatcgaaaattgagatccgaaccagcgtcgatgggctcaattgggggagctctacctgga

SEQ ID NO: 84347 - DNA, 896 bp, Oryza sativa
ctatcatgggttataagcactgaccacatcttagaaaaaaaatactttcatctaatggatttgcatggatatatttcattacttatgtccattatatgaaacaaaccgatgagaaaacactaacattgatggtggagttgaccatgtttaaatcctggttctccacgaatattatgcacgcacggataaggttttcaataggtatgtaagtgtgatacacatgtataaccgagcgagtatgtgttttcattttaaaagaaaagaagctaatggcttaacacctatgcaaatgcatgagtatattaactttccaaatctaaaggtttactaatacgaggtgtaaaacaggcacgagtgtggtgcgggtgtacagggatgtgtatgcatcttccatgtaatcaagaatgtacactggtgtgaatgtgtcttcagtgtaatcaggaatgtacgtaagatgtgtatgcgtcatccgtataattagaaaaaaaaactagggcttaatcagattgtagccaaaataacccttatcaatttttcggtaagttgataatgttaccaaaattttggcaggattttttttatgtatttaccaaactttggcaagaagctaaatgtatacacacctttgacaattttacccaaaaaatggtatgatttgaaattgcattaatctaaacatgccctaatgaattagtctgtgtttagttccaccagtaaaaaaattttactaggtcacatcagatatatggacacacatttaaagtattaaacaaaacaaattacataatccagatgtaaactgcgagacaaatttattaagcctaattaatccatcattagcaaatatttactatatcaccatattgtcagatcatggcgcaattaggtttaaaaaa

SEQ ID NO: 84348 - DNA, 1805 bp, Oryza sativa
gaaccgtcggagcacattatccagggctgctcgacgggctcgggttcagaggttgacactggggtccattcggctacaaagtcggctagcacttgagacttgacagcagtgcgcgcaacgaaatgcaaatcaaacggggatagttctgctgcccatttactaagcctcccaaagatttccttgcctcgtagtatttcgcccaaagggtactgtgaaggcaccattattttatgggcctggaagtagtgcttgagcttgtgcgaagccatcaccaaggtgtaagcaagcttttccatctcgatgtatcttgtcttcgcctcttgcagcgcttcggagacaaaataaactggtttctggccgaactctgtttcttgaacaagggcggcgcttactgccgctggtgaggctgctaagtacagcagcagttcgcttcctggattcgggcttatgagggctggtgggctttgcaagtattgttttaggtcgtcgaacgctgcttggcattctggtgtccaactgaactttcctgcgccccggagggtcttgaagaatgggagacctctttcggccgcttttgagaggaatcggctaagcgccgcaattcggcctgcaagcttttgtacatcatgtgtgcttgatggaggcttcatttgccgaatggcatcgattttttctgggttcgcctcgattcctctttcagaaaccaggaatcccaacaacttgcccgcgcgaactccgaagacgcacttctcaggattcaattttatgcccgctgtgcgcaagttgtcaaaagtctcctgcagatcggacgcatgatcgaaaaccttacggctttttacgacaatgtcgtcaacataagcttccacatttcgccctaactgattacaaaggaccttgtacaccaatctggcgaaggttgccccagcattcctcaagccgaaaggcatcctgaggtgacagaaagtgccaaacggggtgataaaagcagttttcgggatgtccggtgggttcatatggatctgatgatagccggaatatgcgtccaggaaactcatgagttcgcagccggctgtcgaatccacgagctgatcaatccgcggcaaagggaaatcgtcttttggacatgccttattcaggtccgtgaagtctacacacattcgccatttgccgtttgacttccgcaccagtactggattcgccaaccattctgggtggacgatctcctgaatgaccccagccttgagcagcttttggacttcggctttcgccgcctcttgacgatctgcggacatcttacgcagtttctgctctcttggcttggcatccggcttgactgctaggtgatacatgatgaggtctgccgaaaccccccccccccacttcgtcagggccccaggcgaagatatcaatgttcttctttagcaccgctaggatgctctcagcttcttgtttgcccatgccgtctcccagcgatacgagctttgtggggtcggcatcgtcaacctgcacttttactatcttgccgtgaggtgtgggttttggcgcgtgttttggccggctgtggagttcggcttcgacattgtgcatggccctgttgactacggcttgatcgcctttcgacgcaggcgaaggctgaagccccttgaccactatcactcccgctgggccgggcatcttgagtttgagatagttgtggtgggaaatggcttcgaacttgttcagggtcgcacggccgaggatggcattgtagttgtacgggatgtcgacgacatcgaacagtacttgctcttcgcgtctgttttctc

SEQ ID NO: 84349 - DNA, 732 bp, Oryza sativa
cgcattttgtcgagcacctagctagcacaaagtatcattggcccaaaaacaaaaaaaaagaagaagaagaagaagaagaagaagaagaagaagaaaaaagctagtacaaagcacacctccctcgatggcagagagtgagagaggagaagaagatcagatcactgacgtttcaggacgcagctgcgccttcaccttatgtaggcgaggtggccgaaccttgccgccgggatcgaccggccgaacaccttgccggccttgccgacgagccctcttaccaccaccttcaccccccgcgcaacgccgccgccgccgcccttcgccggaacagccgcacggccggcgactccgccatcacccgccgccgccaccgccgccaccttagcgccatgaaaacaccgcagtgggagctccatctttctcctgcaagaagacgacgacgacgatctagctagctatggacaccgtgcttttatcagctacgcgaccctttctttctttatacggcgggcgctcgtcggagccggtcaaagacagcgtggcgtcgcgaagtcggcgccgccgcccgtgccgggtcgtgtcgtcggacgaacacgttgcatgcgagggcacgacggcgacagtaacctctaaaactaactacacggcaagagacctcgtcagataccaatgccttgtcaacggccggtaataagaaaaataatccaggttgatgtgatcgtcgagatcgatctg

SEQ ID NO: 84350 - DNA, 1139 bp, Oryza sativa
agctctcagacccattagcagactgctttggcatcgtgtatatgtgatttaacttgctttcatcaagtacttgatttggatttttatgtgctacaggttcctaatgtcaaatgggaggacgttggtggtcttgaggaagtgaaaaaggttattctagatactattcaggtaaaattttcttatgttcatcaatgtttattgtaacttaagaatatgaagctgctttagtaagtttgtgaatagtaatttgcctcttttctttgctatacagttacctctgttgtataagcaccttttttcttctaaattggggaagcggtcaggtgtcctgttgtatggacctcctggcacagggaaggttggtttacggtgtttttctattttatactttgtttttagttaagctttaccttttcgtttcttcccatctgtccaaagaggataagcacatagaaaagcaatgtatacgtgctcattattattatgtttcaatttgcagacattattggcaaaagctgtagcaacagagtgctctttaaactttcttagtgtaaaaggtccagaattgattaacatgtatgttggagaatcggagaagaatgtaagggacatttttgagaaggtaaattgatttacacaaccatacaattgccataagatgtgcatatatgcttacggttgcaactcttctgtcaacctcaggcaagatctgcacggccatgtgtaattttctttgatgagcttgattcccttgctcctgcacgaggatcctcctcagattccgcaggtgtgatggatagagtagtttcacaggtatggttgttttcatcactgaggcagtgtctcaatgttttttttattatctctgttcaaatattggactttgtggtctcagtttcccctttcctctctttgactctttgttagttgcttgtggagattgatgggttaagcgataacagtcaggtattatccttgttcataccaatttgttttcctacttgttttttttttcctgagatgctttgacatgaaggggaaccattttcccaattcttttctaggatcttttcattattggagctacaaataggcctgaccttcttgattctgcacttctccggcctggccgctttgat

SEQ ID NO: 84351 - DNA, 674 bp, Oryza sativa
caactccactctaaacccaactcctgaagctaaatttaggagttggagctgtaccaaacaggccctaaatgccccctatgtgattttgctgtcttctcgctcgacctcaggtcatctctgtgactccgtgtctgccaaagtaccacggcggcggccgaatcttgcagccgtgaggccgggcggtccaccggtcggacaccggcggctggccgtgtggtggcgcggcgtggcttgcgtgtgttgtgtcgtcggcgggggatttacaataatgacactgcaaatattaacttttgctataatgacactagatccatatttcatagacacatatgggcccatttatcatccactcagaatgtcaaaacagcgaagctccgatatttgccactcccaatattgcaattttctcgtcgcgggcgcggcaaccatgagaccgcggcgtggcttcgcagacgcaaacgtgggctggattttttcgacaggcggcgtgtggattgtgttgttgggctgggcggggccgcgtctgatctgctagctgacccaacgcatatgggctcccacattccactagtttgtagtacattttttggttcctaaaaagttttttttttaaaatagtctttgataaaacttgaagcagtaaattacagttttcagttctgttttgctaatcg

SEQ ID NO: 84352 - DNA, 552 bp, Oryza sativa
ttgctctgttcttgatccagaaatttagtgcatttcaaatacgctgtgctcattttgctatttatctcaaaatattttccagatgtgatctgtgatctgtccaacctttgtgtactcgggctcattccacagttaacaaaaaagatggaagattttcaagattgtgactgcaaaagccttgttgctgttcctggttctgtggttctgcacctctttaggctgtttaatcagcaggataattcctggcagaagtacacattagcctactttcttttggtcaggaatgagtacttctctagggattcaaggaagcattcagatgggaagaaccaacttcttgactgctgtgatgattcagaattagatttggatgtgctgtatgctgatttggatagtaaagaactggagcttaagttgcagaaacctgttgtcaagactcaatcaaaaggtgactcaagtgccagtggatcaaatgattgcttctttcctggccttcacgacgacctggctcaggactgccttgcttgggcgagcagatcagactacccatcg

SEQ ID NO: 84353 - DNA, 832 bp, Oryza sativa
tgatccctttgagttttcccgaacgattaaccactgcgatctgcaagcggccggatccgcaggatcaggccaaactcctcgtcgatcgtcagtcaaaacgatcggaaatcgatgctgcacacacgcacgcacgcacctcagctagcaataactctcgacgtacgacgtcgacgtgctcactcatcaactccttcaaatcaatgcgagcttagctagcttagagactaacacgaattcaacgttctcaacttaagtctgatcgatcgatcgggtcgagcagtagtgaatgcgtgagcacgacagagcccgagtcattctagctagtataggtagatgcattatgcatgtagtatggctaccactgctagtttatttactactatacgtgctcacgtacgccgatcatatcatatcgtgttcaagatgttcaatgcgatcgcctgcctaattctttctccgagagcgacccggttttaattactggttacttgcacaggttgcgcaaggatgtcatcgccttaattatggggatgaaatagtctgaaaaccacgttgttgtttgccacgtagtttggtagtagatgatgaacgaatgtttttagtcggttactgtagtttgtattcaatcatgcttaatttgttacctcgtcttatggcccatctggtgtacgctaaatatgtacctaaacttagctttgtcgtgatacaatttgagtaacttatgcctaatcacgacctgtttcggcgaatagcgatgaacacccgcaaaaacatcacatcgaatttttttcacaaaaacatcacatcgaatttttggacacatgcatgaacc

SEQ ID NO: 84354 - DNA, 922 bp, Oryza sativa
agagccacgaagtataagttaatctcaggccaactttaccgttctgggatgcttcaacctctactccgttgcgtttctttcgccgaaggtgagcaaatggcgaaggagatacaccaggggctatgtggcgctcaccaagctgcaagaacggtggcctccaaggtgtttagacaaggggtttactggccaactgtgttgaaagtctgtgcagagcagattaagaagtgcgagagctgccagcgtcatggctgaagtcaaaccgcgccccactatgacttgcagcccattgcgccaatttggcccttcgccagatggggactggacatcattggcccaatcccttcggcacgaaacgggtataagttcgccattgtggctgttgaatatttctctcggtgggtcgaagccgaactccttggtgcaattacttcggcagcagtacagaagttcgtgtggaaaaacattatctgccggttcggagtaccaaaggagttcatcaccgacaacggcaagcagttcgactctgaaaagttcagacaaatgtgcgaagggcttaacctggaaataaaattcgcatcggtcgcacacccgcagtccaacggagcggccgaacgaacaaatggcaagatcctggaagcactaaagaaaaggctcgagggggcagcgaaaggcaaatggccagaagagatgctatctgttctttgggccctgcgaacgacccccacaagaccaacgaggtttagcccgttcatgctcctctatggcgacgaggcaatgaccccagcagagctaggggctaactcaccaagggtggtgttctctgggggcgaagaaggacgcgaggtgtcgctcgaactattagaaggagtaagagtcgaagcactcgagcacatgcgcaaatatgccgtaaacacttcggcaa

SEQ ID NO: 84355 - DNA, 2338 bp, Oryza sativa
  unsure (1)..(2338): unsure at all n locations
ctccacctgaggccgcctgctatggcctccgccgccgccgccgggaacggctctccttccgcgccggaggactccacaggtggattctgcgtcgtcgattaggcttttgttctgttgcgcttcatgtgatttgctaccatgctatgcttgacatctccactagcagtaggcagtagcagtagctattccaagagttcttactctcttttgtgaaagctaatcctatttaatttgattttttaaactctggtttgtgttcggaattctcagcgttgtccaggataggagaagtcaagagggtgaccaaggagacgaatgtgcatgtgaagatcaacctggatggcactggtgttgccgattgcagcacagggatacctttcttggatcacatgctcgatgtaagtatggttttcctgtggcagcgattgtgaatgaggatttctcctatatagatagaatgtgcttgtatactgttgtgtgtagaaatgtttggtttttgacttaggggcttgtctaaagcaagaatatcagttgaaccattcgaagaggaaaagcaattgcttagtgcggaaggggaaacaatacctattaaactaacgaaaacatcttaggtcaaatccactaaatggttgaatagacgctcttaagttgcattcacttcagacgtttttgagtgccactggtgcaatcttattattgttgggagaaagtgatgtgttggggccattaaagcctgaataggtcctacttgaaaaaaatctgccgcttttcaagttccacgtgttttagctgctgttcgctaagaactgttctatcaagcaattagttcactatttgggaaatgctatttagttttgttttcctggtatgatgtgatacatgtaacttccacctattaactcatgtatggctttggttattccacgagcatgataaatgaccacttcatgtgaccaagtcctttaacctcgaatcaatatttcaagagaaatcacgcaaaattatcaacatcagttgcgtgtagcaaattgccagcgcttcattcgaaagaagtgtttttgtctagttttctgcattttgaatggttctactattgtatatgtttctcttgtaggtaccagtctttacacatgctgcataaatatgctcttttagtcaaatctggccattaattctgtgtctataacttacagcaactggcatctcatgggctctttgacgtatgtgttaaggcaaagggtgacactcacatcgatgaccatcactcaaacgaagacatcgctttggcaattggaacggtaattgttgctttcaccttatcatttctgcttctagaaatacttgtaggatcattatgaattgaaggttagggtatccataatttcatacttcttttcccccttcatttgtgcaaaattgaacgcgttatcaacacactatttacattgttgattgcatgctgaatcatcagtactgtaaatgtctgcaagctgtgtaggtaagcaaaacgtctagtatgattgcttttttatttttggtacttgtaggcactacttgaagcacttggagatcgaaaaggaattaatcggtttgggcattttacagcaccacttgatgaggcagcggttgaggttatactggtacatgctatcatcctggctttgctgntacatactgcaaatgtatatacttccctgcatttctacgtttgtattcatgtggccataattctcttatgccatgcaagcacataattgagttagagtcctgcaattagtcatgaagtttttaatgatattataattgtcatgagtatctatcgttctggtttactggcccatctgcactaatggcatttgaacacttgcactgaatggtaatgtttttgtagcacagacccatctatcacactataacgtcattagcaagaagatgactgcagtcatctggcctttgtcatatatacaccaattatttgccattttgggttcatcttagcttaattttttttgttagtgcggatatccatgtctaccacttcatcagtcaggctaattgataatgtgacttactctattatttactattcccccatatctaggatctatctggtcgtcctcatttgagttgcggcttaagtattccgactgagagagttggcacatacgatactcaggtaattcctgaaattatgtagctattatcctttttttttgggaaaaacttgtgatggtttcttttcgtcatgccagatccaatatggcttatccttaatcgtctaatgtgacatggctattgggttgtcttgcatcattcgtattcatcctctgacgttctt

SEQ ID NO: 84356 - DNA, 1938 bp, Oryza sativa
  unsure (1)..(1938): unsure at all n locations
tcatataattgtagtagtcaatgtgtcaaaaaggaaaaaaaaaagagatcatgacatgctgaaggctgactctcacccactgaaatggataagaaattcacaagttgaatgcatggcttctcattattttagaaagaaaaaaaatttgagtggngtttatggtttcccatttctcaacttgcatggacaattaataataacaattaaataatgatgccacctgtatatatttttctaggtgtagctaagcgatcaatacgcagtacaaaacatagacttctatctgcttgcaattaaaccaaacaaatttgctgatttgttcagaggtcaagttgatcaacaactggatggacagtactgtctctataccgaaccaagtggtacagattcaattaactgcagcagcatttgcaacgccgttcttccaattgatatacatcgattgatcgatcgagaccagaagcaaaaaagtaatattaataaatgaacganaagaacaattgtagcttaattagcgtacgtatgcttttgtccaaatgctgaaaacccaacattgattatggccattgccagtagtcgtatatgcagtctgcaggacaaacgtactctcgctacgctgctattaaaacgaggaattaattactactgttgcaacaagtacgtactccagagcagtgtagcttgcttctgttaattaacagaanaatgcattggcaagcagtagttgcttgtagtggagcagtattcttcagtcattgtagtaccaaaattttgcagttaattgcagagcccaattaaaacactgcagcatcatgttcagaatatcaattctgtacttgtgtgacacccataattttcgtctgaaaaaactgtgatactgaaccagaaccagtcccatttgcttaggcgttagttatctctgtacctgatgctacaatcgaactccttaattatccgatgatggatccacgtcaaactggtaatacagagtcatgagcagcactgtcgttctgcagtgtactaataaggttttagaatttatattccatgggttgcaaattctctgaaaaactatttcaaccttgtgacttgtaggtttggagaacctttgactgatcatgcctagtaggtcttttcgtccgaattaaataaattaactactattacaaggttgaaaagttgctctaaaatatgctattgcaagttctctacaaactccattaagagcgaggctaataatatagctgacttgttggctataagatttttttaagacttctctcagtccatccatataataattagctctttacgattaatataggacacttgtctctcacacagagttttttggttcttgtgtctaagccgactgtaaatttacagaccgcttctcttctcttttctcctccacctcaacatttagtcggcttataacctactattatacttttatacttgctctaagcttgtgacttgtaagcttggagaaagattgactagatgcatgcatgcacagcacccggtgctagttgatgactgtcatcatgctgatggcaaaaacatctccataattgtataatttgtgtttaatttgcatggattatgtgaggagatattcaggattagccgaaagaagagagagagagaagagtcagaagacaagttcattgctccctacaaaagcagcaagctgcgggtaggaaaagacaagtcttcaataataagcctgcacaattaatggttccatgaatgcagagtggttcctagttgaaaatttatgcacacacaggaggaagggagaggtggggtgaggtcgtttttatggatttaatgcaccccccatgcttgcaaaggaacaaaacacttgcacatttatcaacccttggtgatctaagcttccaccaaatccatttggctgcagttggagttggagga

SEQ ID NO: 84357 - DNA, 744 bp, Oryza sativa
aaggtgactatgagtactaacaaaagagtcgttgaacaagaaaagcagagaactatctcaagccagcattggactgtgaccaaaattgtaaaaaccattgtactaattttctctgccaaagacagatgaaaattaactggtacaagaatgattatcaatccaaacatataagttcagaaaatgatatacttcttaacttgtacagaaagtgggaaacttaacaagacataatttacagctttttgcacacctgagttatcagatttggcagcataaaaagtggaaatcttaagacagcaaacagtgaaagtgatgtgaacgcctttgctggtgtcaagtcacctcccagcagagagtatacaccaaatgaaaccacagtgacaataacggggatactgtttaggatgaagctattcagctgcagcagacaaggaaaaatacaaaagataatagtgagccgacaataagggatgcaacaactcattctcatatctattttaagtttgagtaactaagtaaattattgtaaacaaactttataggaccaggaagcaccagtacaatcgatactatagcatgcaactccaaaacttattgtgtaataaggagagttcatggatgcacgattaaaaaagagatcatatatagcagaatgaaattgacacaagtgaaagataacttaaatacaaaatggacataccgcagcaagcaattgagcgctgcggaaccatgaaatttcatcat

SEQ ID NO: 84358 - DNA, 673 bp, Oryza sativa
ttccccaaccaagatgtaaatgaccacaaaccggatgtaccatctaaactcatagatgtaaattctgtctcaagtgcaatcattacaagcatacaacaccaagcagcaatctcaatgatagatgaggtaacctgtagaggcagaattacgtgattgaaaaggtcaagggatgcaagaattcggtagaagtaaaattctgaacaagtgtgcttaactctacgtgctgatacacttatacttgggacatgttctcacctcaaatggagcaaggctagtctccccatccaagttcattatggaggtgccagtagcgatccgatacagtgattcagctatgcacaacaccacaagcaggccgagcatatagttgtagtatggcgaccgcaatttgtagcgctgcaccgtgtagtccctcgtcgtcctccatatccgatagaagcaaacaccgaagagtgcaaagtatgagatgcacaccaccaaggtttcagtgccacatggtgtgtatgcaccaaaagcattctctacatctgaccacaccccgccattgaccggctggcagtaccattccagtggatcaaaacccatgtcaaaccgtccccttagcaaccctcactcagttttgatcttcccctggattcattgagcaaaccgatgataaattggcaatccaatc

SEQ ID NO: 84359 - DNA, 1259 bp, Oryza sativa
ttgggtggagtatgggtaggaagggtaccttttgtgctggccgctatcgacttgagaagactttataaattggggagatcataagaaagattttttaggatcgtccgcagatacgccttagatcttcaaagatcacagcgaagtattataatgcatcaactgtagagaaagatagcaggaaaaaatattagtagtggtatgatcatagataggtagcccctgatctaggggcaagattccatgtttggtcagtaccattaagcaagccaaccaaaaccatcaatattacacgtttttgaccgtttgttcgtttctgtacgatatccaataactgcacagaataagtactacaggattgagaacatggcggcacaatttgtggtaaaataccaggatagcctaaaatacacttttgcccataccttggtatcttcctggagagtggacacaccatggagcaaatggaacttaggagaggcacctgggcttaacagtgccacgtctccaaccccacagatctaccaaggctactactactactactactaacatcatgctctagctggtacatgcttctactttaagttgcctttaggtagttacttatagtgccacctaagtttgtcaacctaagtgcagacacttttaaagcttgacagttatcataacttcagtttaaacgcaaagcaatgtgacagaaagaaccattggttcaggctctgcgatttcgtgggagagcatatgcatgggcaagtaccgctggtcactgaagttttcaccacctgtgtcagttgatcagcttggagtgaattttttctcaggtttttttacatgtcatgtgccgttggtacctggccctgtcgttgctgtcggtgagggctcgaaatctgctccaaacctgcagcagcagatgcgctagaaagctactactaccactgaattcttactcacagttaagtccactgcaggttcagttcttcggtccctttgaaggtggcggaggcattgctcccagcatgggcgcttcgtttgatgttcggaaaagtgctcgacctggcaaagaaatgctgagtaacaggtttctgaatatggcaagttggagtatatctgtacgaggcacacattaccaaatgtaaagtaattgcgtaatggaacatggaatatcatagccacctttttggcccatagcatgggcgtcagactcctaggatgctctttctccaccacagagaggccactggcgttggcgtcacttgcta

SEQ ID NO: 84360 - DNA, 923 bp, Oryza sativa
atatgaggcaggctaaaggacatatcggcaaatcccagttcactgcttccaaatgattcacagtccacattattacgcttgtaagcttcatggagctgcagcacatattccagatgccacaagacctcacccatcgatggcctgcttctcccatcatcagcaaggcacttctccgcaatttcaccaaacttcttcaaggattcagatgaaaagtcaccgtccagccgtggatccactattgcatccagcgaacgctggcgctgccatctcattgcccactctgccaagttgatttgatcctttggtagagtggggtctataactggtctgccacaagcgacttcaaagagcaccactccaaaagaatacacatcagatttttgtgtgagttgctgcctccggaagtactcaggatcaaggtacccaaagcttcccttgactgctgtactaacatgggtctggtccagtgttgggccagttttagacagaccaaaatctgctatctttgcaacaaaattctcatccaacaagatgtttgtagtcttcacatccctatggattatacctcggtctgctccagtgtggaggtagtgaagcccacgagctgcaccaatgcaggcatcaactcgttgcttccatgtcagaggtgggaggtcacttccataaagatggcttcgcaatgtccccttggccatgtattcgtagactagaatcatttccttctgctcttcacagtagccaatcattgcaacaaggtgccggtgcctaagcttggagagcatctcaatttctgtttcaaattctttcaagccctggccacataatggatttgcacgcttgattgccactgtagtaccctcatcgacctcacccttgtaaaccttgccaaaaccaccagtacccaataagcaaagcctcatcaa

SEQ ID NO: 84361 - DNA, 665 bp, Oryza sativa
gtttgcgcttgccgctagccttgcctcttcacacagtgaccttcttgcactggaggctgctgagggaaacaacatcctcaggaaaacaaaggatgcagtaatcactctacagaatgtcctcgaagggaagcacaacaccgaaattgatgatacactcgctcagtatgaggttccatctgataggtggtggtcatcgctatacaaagtcatggaaggtacgttgatcacttcattttaacacctttctcttgtgcgatgcttcagagtagcatgtattgtgtgcaatataagtttattacactagtcccagtgtaaactggctaatattgatccgtcagagattctgatgaaaccaatagttaacagtgagtaccggattggtgcttggtcgatgcaaaagtccatatgttaacatgaagagaactgctgaaatataacgatagggataagattttcttggaccaacaaacatactaacacttgacaaaagcatgtcctccacatgccattgtcatgatctctttagtattcaaatctaaccctatcaatctgaccttttgatcaaatatgtatatctattttttttcaggacttgccatgatgagccgattgggtcgcaaccgtctacagcaaccaagttataattttgaaaacaacagttctat

SEQ ID NO: 84362 - DNA, 701 bp, Oryza sativa
gaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggatgtgagcgtaacgacgctgcaataaacatgatcggaattagacatgttatgtgaagaaaaaaaaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacgaccacaacaggtacgcctcaagggagcgtcggaccgagtaatcatcagcgtcagggtgcagaaggtccgc

SEQ ID NO: 84363 - DNA, 716 bp, Oryza sativa
caagagtacaaacaaacaaaagtgtttagtccgaacactcatcacgataacattatgatacaacaccgaatagttcgcaatactactagtacaacaatagtcggaggtactcattacaacaacattgaattgaaattacacgatagaagtatttagtccgaacactcattacatcacaacagcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttatgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgcct

SEQ ID NO: 84364 - DNA, 703 bp, Oryza sativa
cactcttgtgaacatgagttcaaacagatggctagccatccgtctggaaacattgggtggcatcatgatatggttcacagcaacatttgctgtcatgcaaaaccaacgagcagaaaatcaaaaggcttttgcctccacaatgggtcttcttcttacttacaccctcaatatcaccaatttgctcacggctgttcttcgtcttgctagtctggctgaaaacagtttaaatgctgttgagcgggtaggaacatacattgagttgccttctgaggctcctcctgtcattgaggatagcaggccacctcctggttggccatcatctggtgttgtcaagtttgaagacgtcgtgcttcggtaccgaccagaacttcctcctgttcttcatggcatatctttcatcattaatggcagcgaaaaggtaggaatagttggcagaacaggagctggtaaatctagcatgctgaatgctctgttccgtattgtggaactggaacgagggagaatattggttgatgattgtgacacttctaaatttggaatttgggacctacgaaaagtactaggaataataccacaggcacctgtcctattttcaggtttgttgtgaaaatacatgatatatcttctcgtttgcttttcttacatcataaatgttttttttggtactattgtccaggttctgttcgatttgggctgcaggaat

SEQ ID NO: 84365 - DNA, 503 bp, Oryza sativa
cctgatccctgaagccctgttgcagagtagatttggagctgtaggcttttccagcaggtgttaattcctggagacatgtaaattgtcaccagcacattggcgtgcatgtcgtaagtagatttaccgtcctgactccctccctaaaggtgaataacaggggagtttttctgttcttttttgcaacagcatgaccatattcttgttgtactgccgtcctcaaggacatcgtctgttgtgcaaaatcttattagcattgtacctgaaaattgaaattttgatggtcttgtgccaatgctagtgttctcttcaaaaatccagtgaatgtgtcaattaattaatcttttaacttctggtcagcatgtatccatgtggagttgtcttcttccactgctaaacatttactgcctcttctcctgacttactccctccatcttaaaaaaacaatctaaatgatgacataatacaatatagtacaacgaatatgaatggtcctatccagatcc

SEQ ID NO: 84366 - DNA, 512 bp, Oryza sativa
aaaaaggcacggagacatcgagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttatattccagatccatctaagttaagggtgaaaaagggtcgacgccaaactagacgcatcagaaatgatatggatgagtcagaagcaggtgggaggactttacgctgcagcaagtgtgatctgcgcggccatacttacaagaaatgcccgaagaatgcagaagttccaagcgg

SEQ ID NO: 84367 - DNA, 827 bp, Oryza sativa
tatagttaagatcattaagcaaataattctttgagagttatctcttcttgatttggtagggtgtatagcattgactttattatgatctccacaaataaattattttaacaatcggtaaacatatagatagtcatgtagatatgaatatattattgagggtgtacaatcatctatataataaagtttgattaatcacttggcagtaacttttcatagcaacaagtgtgtaccttcaattacactattaaaagggacactcacttgtaatttatggttgtcccccacaataagaggttggtgatttactcccaggtagaatatgcactcacgacagttagcaatacaaatccatttagcagctgcaataatatgaactctttcacaatgctccaccttaacaacctgacaacacaaaacatataaagtataattgtcaaatgtacttagcactttagcagaacagaggtaataacagcaaatttgaagtgacaataaaaaagtgtttcttattttccacttggggccctttattctttgttaatgtacagcctatcttatattatgtttaacagtccaactcaacgcatgattaaatctatttgataggaattttccaggaaaagactgtaaaagagtagcaactagcatgtcagtttttggttcacacaacaatgtgtgacatctttcactgtctattgttattattatcatcacctcctcttctatttggacaaaatactcagcactcatgtaccattcaggtgataccaaggcatacacaattgaagtctcaaacagatccggtgcagctaaaatagtctggtggc

SEQ ID NO: 84368 - DNA, 695 bp, Oryza sativa
gatcagatcgatcccctttctactttacagtccttttccccgccttgcttccgcttcacacgattgccaccgccgcctgctttctcgacgtcttcgcatgtgggagccgccgctcctaatgcgccatcctccaggaatcattgcctggctccctcgacaccccaacatccaggagctcgccgttgagggccgccacgtcctcatggcctccgccccatcggaggcggagccctgccgccgcctcctcgccggaggcccaccgaaccccctccacctcctcacgaaccaaccgccgcctacgacctgtcccatctatggggagatgaattaaacccgcctccgtgaaatcaggtcagatatcaccaattgctccgtgacttgttcgattgcttgtagtaactctttcgtgtatttatggggttaattttattcgattttgagttcaaatcgaatccgcatccaacttcctttcctgttgaatctggtatcctccctgcctgtctttgttcaattttgtttttgtttgcctctattaaaaatcgatttgttcaattttgttttttttttggattatttgtatttgatgcggactcctacaagtcgtgcagaaagcatgcgcactgaatcggtcaaaattttggaggacggacgaaaatttctgtgtgacgaacgggaaaatttgttatttacgcgaa

SEQ ID NO: 84369 - DNA, 1105 bp, Oryza sativa
atcacatcgaaggtttaaacactaattataaatattaaatgtagactattaataaaacccatccataatcttagactaattcgcgagacgaatctattgagcctaattaatccatgattagcctatgtgatgctacagtaaacattctctaattatggattaattaggctttaaaaatttgtctcgcaaattagttttcatttatataattagttttgtaagtagtctatatttaatactctaaattagtgtctaaatacatagactaaagttaagtccctggatccaaacaccacctaagggtattgcaacgatttgtatgtattgctgctacagtaaagcatgaggcttgatttgtactatatccaatgctgacccttcaatgcttctagtacaaagctagaaataataacacatactgtataatagtacgtcattcgaactcaacaagaacacaccatttcattagctggactgcaaagagtttaatcaaacaccattcatacaatcatactacagctaatcacagtttttgaatattctactacctaaagctgtcaaaaagtcgggctacatcacaggattgcattgtatcatactaatgccatgtcaattgacgaagctcggctagaatcaacttatgctgataacgggcttcggtttctcatcgtccttgctctctgtggtgacagccgggggcctgcgttggtgctgcacaacagctagctgatcagaaaagagcaattccttcaagcagtggagttgcttcctctctttctccatcagcagctccttctgctcgaaacgacgtattttatcctggatttccttcatctgaaaataattttaaacaggagatatcaagaagtcaatataagcctcgaaattcaatgtggttatctcaggaattttcgtggcgccctacctgaacacccactatgtcagataaagactgctctatagccttccgttccttttcaagttgtacttgtgcgttggcagacgcctctttgagcaaatcattggctgaaagcccatctgtgcaagaagattctgtacaagacactaatttagtgaaaagatcttttcaaaatattgcaggtat

SEQ ID NO: 84370 - DNA, 970 bp, Oryza sativa
tcaattctatataaccaattttgccttgaagatatgtgtgcaaaagaagatcaagctgaagggaaagactttgacacaatctgctctaaggttttcctcagcagattctaaaaatattacagtggagaactatacatttgatcaagatgtagctagaagagaattgtgtgatatgatagtgctgcatgagtaccccttaagtatggttgatcatgttggctttaggagatttgtagctgcatttcagccactattcaaatttgggactaggaacacaataaggtatgacagcatggctggaatttgttgatttcggagcataaatttctgtgattttttttatttctgttaataattcatttctgtggtttttttatttgatttcagagcagaaattatggaccaatatgagtttgagaggaagaaagccattcaatacatggctggaattcaatctagggtggctatcactactgacttgtggacttcgagcaatcagaagagaggttatatggctatcacagcccactttgttgatgaatcttggaaacttagaagtattattatgaggtattttcttgtgactgacagccactaacatgtacttcattttttatggttagaattaaatctgaatacatacatggtttatatgtatgtaggttcatctatgttcctgcgctagaccgctatatgaccaatatgagtttgagaggaagaaggccagtagggactgagctagaccactatttggatgatgatttggttgacatccacacaaaaagttttgatgttttagattggtggaaggtggctggaattcggttccctgttttgaggaggatagcacgagatatatatgcaattcctgttagcacagttgcttcagaatcagcttttagcactagtgggagagtcctagtgagcatcgcagtcgactcacttcgaagttgttggaagctctaatctg

SEQ ID NO: 84371 - DNA, 896 bp, Oryza sativa
caaagccaagtgcttctccggctaacgttgttggtgcaggttcgaagcgtcgccccccccccctccaaggctaagaccactgcagctgcggctgtcaagagcagaaagcctccagtttctcctacaactactgcagctgcaggagaccgcaacattctactttcttttgggtaagcaacacaagaactcagatcttaatttaaacttcgcattggcatggttgtaatgtatttttgtgaatatgttgtgagtaaggaatagaagaacctagacatgtatttggggctgagatgctactcattgcatatttttttacatatgtttggcatattaatggatgtttgactagacgtgtaatatgtttgatgtagatttaaaaagatgtccgtagctagtgggagtggaagctatcaacgtcaatctccattatctcaagcatcacaaccaaaatcagagtctcttccactctccacatctccacaacctgaatctatcaatgactcagaacctattgaagttgatggtgacgaagatgaggccgaagaagaaagaattcaagagagtgaagtatataggcacagtcaaagcaaaatgtatgcattgctccaagaagctatcaggagccacaaagaatgggactaaacatcttcatgaccatttgaagataggcaaaattggttatatagcattgaaagttcacgtttttggttttatagcaccgaaagttactggttcactttaatagcatccaaagttcaccctgttcccatttttagcacttccgtcaattttttccgtccgtcttgatcgttactgatccagccacacacatgatatgacatctacccctcattgacatgcattatacttgtacttgtgaggggtagaaacgtcat

SEQ ID NO: 84372 - DNA, 661 bp, Oryza sativa
ttaacaaagaataaagggccccaagtggaaaataagaaacacttttttattgtcacttcaaatttgctgttattacctctgttctgctaaagtgctaagtacatttgacaattatactttatatgttttgtgttgtcaggttgttaaggtggagcattgtgaaagagttcatattattgcagctgctaaatggatttgtattgctaactgtcgtgagtgcatattctacctgggagtaaatcaccaacctcttattgtgggggacaaccataaattacaagtgagtgtcccttttaatagtgtaattgaaggtacacacttgttgctatgaaaagttactgccaagtgattaatcaaactttattatatagatgattgtacaccctcaataatatattcatatctacatgactatctatatgtttaccgattgttaaaataatttatttgtggagatcataataaagtcaatgctatacaccctaccaaatcaagaagagataactctcaaagaattatttgtttaatgatcttaactataaggttcaccttcacactttagagcaagtttaatagtagagctaactactagctataagcccatttaaaaataatattagaggtaacatgtatagtatattagctataaggttgcctcaaa

SEQ ID NO: 84373 - DNA, 1362 bp, Oryza sativa
cgtgtagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcactcacgtttatgtcatattaattttggcttgatgtctcggctttccagcatgtgtttaattcctaagttttccattttcaaaggttctaagtgccatagttgtgtgcaatcgaagcaacctcgcatgcctcacaaggctgccgaggagagaaacttggcaccactagaactcctacattcagatctttgtgaaatgaatggggtgttgacgaagggtggaaaacgatatttcatgacgttgattgatgatgctactagattttgctatgtgtacttgttgaaaacgaaagacgaggctctagactattttaaaatttataaggcagaagttgaaaatcaacttgacagaaagataaaatggcttaagtctgatcgtggtggagagtttttctcaaatgagtttgacttattctatgaggaacatggcatcatacatgagaggacgcctccctattctcccgagtctaatgggattgctgaaaggaagaaccgcacattgactgacttggtgaatgccatgttggacacggcgggactacctaaggcatggtggggggaggcattgttgacttcgaatcatgtgttaaacagagttcctaacagaaataaggacaaaacaccatatgagatatggattgggagaaaaccatcactttcttatttgcgcacatgggggtgcttggcgaaagtcaatgtaccaataacgaagaagcgcaaacttggacctaagactgtggactgtgtctttctgggatatgctcatcacagcattgcctatagatttttaatagttaaatccgaggtacctgacatgcatgttggtacaattatggagtctcgtgatgctaccttctttgagagctttttcccaatgaaggatacacatagtagttcgagccaaccctctgaagtaattcccagttcaatcacaccaccagaacaaactgaacatacacatgaacatgtcactgaggaggatgtcagtgaagctcctcgaaggagtaagagacaaagaacggctaagtcctttggtgatgatttcactatgtacctcgtggatgacactcctaagtcaatttcagaagcatatgcatctcctgatgcagactactagaa

SEQ ID NO: 84374 - DNA, 1242 bp, Oryza sativa
ttttctgggcgagacttccactgaaaaagttcctatgggcctgtttggagaactatcccagggatattttttgggctaaagattatcccaccaaaatagccccctaacaaaatagccctcttgctgtttggatccaaaggctatttagctattattgtaccatcccaatcatttgcctccactaaaagtatacagcagccggatcttctatggctaatccaatacaggcacatacaagcatacacaattccttacaagcacaaacacataatttgtctcaaatatataagcaagtatgtaaaacaatcgtgtcacataaaagatacaattccatacaataatcgtctcacataaatatacaattacataaaacaattgtctcacataaatattaaaatccatacaacaattgtctcacataaatattaaagtccatacaacaattgtctcacataaatattaaagtccacacaacaattgtctcacataaatatacaagtcctcaaaccgtaaaaaaaaattacaatccattaaacaaagcatttgccaagtcatcgcggaagaaattcatgttgctatcctcaacaagaggttcatcttctggccagtcagagtgaggtgatgtaggcattggaaaataatctgcatccgcatcacacctagcaaattccctatccctaattttgctctctcgactgaaattatgaagaaccatgcaagcaacaattattctagtttgttttttttccgaaaacgatggcatgtccaacaacatcctccacttcatcttcaacacaccaaaagaccgctctatgacattcctaatccgggaatgtgcatggttaaaggtttctttcataccttgtggcgggggcccgtttttccattgctccacatgatacctagtgcatctatacggtgaaaggtagcccgggcggtttgggtaccccgcatcaaccacatagtacttccctgcatatacaagcacacaatgaggcatataggtacaagttaaaatgatggaaagatttgaaacaaaagttgcattactttaccttgtggtggatgtggaaatttgtgagcatgagttgtcgttgcatctttgaacactctcatatcatgtgctgaaccaggccatcccgatagcacaaaggtaaacctcatgtcaaaatcacaaacagccaatacattctgtgaggtttcattgtacctattcaagtattgtattctcttcgtctttgg

SEQ ID NO: 84375 - DNA, 553 bp, Oryza sativa
gaagctacttcctgttgcatgtttaggacctttattgtgacaatggactcatcatctagctggcctttgaagactttaccaaagcttccactccctagcaggttatcatcactgaagtttcttgttgcacggacaagttcatggtatgagattaactggtaattcagcaagtctgcatctgagggtagtggcatctttcctggcttattcattttccttcttaccaacatacacaagcaaaatgctaaaataaaaaatgccacaactgcaggtaatatgaattttagtagccgttgtattgaccttgagtgagttttgctctggcatgattctattccttggctcggaaggccacatagtgccttgtttcccatcaatgacttgacagtgatgtttgagaacacacctccttctggtatctgaccctccagtctattgaaagataggttcaaattggcaagataagtgagattggccaaggactttgggatgacacccgaaagcacattggaggaaaggtctaactcctcaatacttagtaacttgccaactg

SEQ ID NO: 84376 - DNA, 556 bp, Oryza sativa
tcatctattaaaaaatggagggagtatatgtgcatggttgagtgcctgaaatgtattactttgtcaaagggtttctgattttccgttaaactatttgattttgacctttggtggtgcaggccagaatccatgcacgagtacaatctaacaccccactcactatatgctgcggtctcagttgggcttgagactagcactataatcagtgtcatgagcaagctctccaagactaaactgcctcgtgaaataattgattttatccatgcatcaactgccaattatggtaaagtgaagcttgttctgaagaagaatcgatattttgtggagtctccattccctgaggtcataccatacttccgtgattaaaaaatattcttttttgtctattattttctatttatgtgagctgcgatatctcatctccaggttttgaagacgcttctgaaagatgatatcatttgcagagcacggatatctcctgaggttattcatctgttttgtgcacttgaatagaattcttatggcaatatactagtagcaaagtcgtgccttccta

SEQ ID NO: 84377 - DNA, 2665 bp, Oryza sativa
ctttatatgtattataaaatccaagaagcattttaagctcacacagctcactagttgatactacgagtatttaagtattattagcattcatgtgatggcacagttacatggaacttaatagatgaaagaagataaccagatatccactaaataatcgaacagaaatgcacaaactggaccatataagtcattagttgattattatacacagccatccttcatgtgtaaggaaagcagccattaagacaactatacgtcctacatctattatcagtgtcactaactaatttcatcaaaatttatcattagataatcattaatcaagtgacaatcatttcacatgacatttttgcaagttagctaagttaatttgttttcgtgacaataaaccacaaggacaactttacttttttttttactgaaatgaatggctttcggtatgattatttaaacagttaaatcaaggaccgtgcactagaatctactagtgtaggcatgtaacactaacaaaacaagctcaaggattaaaaaactaaacaggagaacatgcaaaaaaaaaagaaaaagaaaaagaagaagaagaagaagatagatgagtacattttgtatactttgaactctagaaaatggtaaagatggcatataactataaggtgagctcacctcaatcattgcctggcaaggactccttagaaaccctaaaaaagctgttttcagggaataccgcagacttgcaggatgagctccttttgcaacctccaaactagggtcaaaaccaagtagcactggcagtatgcgttcgtagtaaacaggtctattctttgcaatagctgcaagactggaaagtgacaaacatttatatttccaaaagataacaacatagtttgcaaggttgtactgatagtaagataacttccaacaggaaaaagacattccgaacattaaaatcttaaagtagcaggcaaccacatggacatagtacagttgcaagctttgctcattggtaaacctcatcactgcccatgtctgttgcggccaattatataactgaagtaaagaacacaaaagcctaaataaatgttacggtacccacttcacaaagtacaacactatggggatatcactatagatgtgtgacaggtcagagacaacataagaaatagctactgtgcataaaatgaaactgaatcagaaacaacagtttataaatgacacaaatagctatccgccaatccatatatggaggcgacaactcaaaacgagcagaaggtagagggaactggtacagagtcttacgaattaatggtgccaactaggaaggatccttgatgagcacaagctgactgcagtatatccacaaggaggatgagagccctgtttgcatcagcttcgagaacagcagggttaaggctgggatggaattgagataatcttgaactatcaaacaacctcctgttccttcctgtttgtacagcgaaaatacatttcattactttgattgcaggaccacattatgcccattaattctttgcaaaaatctgccttaaaataccttcagttggctgcatccggtcacttttggattgaggtgcgaaacacaggatccatgtttcaatgaactttacagcaaacagtttagtagcaactgggacagactgttgtatatcacatgaagaatagcattagtcttggattgagcagaaacaaagaactaaaccatcaattcaagtttcaaagtagtcatttttttttttgcgaggaaagtagtcattagttacaaagctgtgtattttcagtaggatgagcaaagaagaggtagtctggctccttttcttcatatcatatcacaagggcagggatgggattactgtggaataattcccactttcgtagtgctctgtgctcaacatagtgacaaatacactccacaaaagaaagtttttccagagcactagatcatagttttacataaaataaagagaaacagtataataaaaaacctgatatatgtaggttttgtactttcattttatctgctaaatagtgcttgcaaatacacaacagaacaaccacagtatcaacgtattattgaaattacgcaacgcatgaacttgtatgctactaacctcatggatcagattatggactgcatctttaaactgcttcgtccaagcccacatctcttcaagccaagcatcaacccttccacacttattaatctacattcagcattaaaatggaaagtgagtaccaagagcaagctatcagtaatatcttagtgataacactttaagtagcatcaattcaatcaggagaaaattttgaaagggagacattacttcatagtgattctacataacgttttgcattttcagaactaaatgaaaacatatgggttttctctgaccctactgtgtaaaatactaccttaaatcttcacgggtataatcacaaaaccattgcttgtaaaatagtcaaaacaaatagctaacaaacaaatctatgagcattgtatggctcaattagtttttaactactgaaagaagcttcaagttgttcttgatcacatagagtcctattaggatagtaatattttttttataattacagtacaaatgtaagtttaatgttttaacatgtgatccagtggataacattttcctgg

SEQ ID NO: 84378 - DNA, 656 bp, Oryza sativa
catcatcatcttaactgcatatctactgtcacttaggtgggtgataactcgattgatattccagaagcaaatgtgatcatacaaatttcatctcatgctggttcacggcgtcaagaagctcaacggttgggacgtattctcagggcaaaggtaaaatggattgaatctgatgattagttcatggaacagaatgatgttaccatgatacttctctttgtatctaaaattcatcataaaatgttaatgctttttatataataaggattagtgagaaaaataaaatgcatgatggatcaaactaatattgttcttatataattctggctgaagatatcaagcatgctcacatttgcttaaatgtttttaaagcttgttggaatctgtaactatttaatttgattttagtatacaagttatatatgtaataatttattatcgtgttgtaaatacagctctggaatctgaaagaatagttttgtgtaaaattagttgcagtatgttatatgctagttatgactaaggaatcacgtgtccaatcagatgatggaagcattagatctcaaactgctgcagtcatgttctaagataatactttctattgaaatgtcattggatcttgataattactgtgacatcagggtaagcatcaagacagg

SEQ ID NO: 84379 - DNA, 1558 bp, Oryza sativa
ttaaaaaacggaggtagtacaatttacagttatgatgtttgcaacacaagtggaactagcctttcctaatttattgatttgttgcttgatcgatgagttcagtttaggtactatgcattgctatgactctttactatttattatccaggttgaccggggtgtagcttctccaccagacatatccatggatatcaccaaactaacccaaatgcttggtatcaagccaatttcatttcaagatggagtcagagctacacttgctgcagaagctagtacatgacactttgtctgttcattttgccaagagagctgcttggatttgtctgtgaaagtatgtgagataaagagccactttcagtttgttgaacagtggcaaatctgtgttgagtatatgtgaaagatgtaactttcgacggtgtgaaaaaggaaattttgcgttcacccgacatcaatatcatgtattactgtctggttttatacttccgaataaaatcatcattcattttgtactctttttcagtagcctatgattctatattaccacatattatactgttatgagttactacctccgtcccatattacttgtctttttcagtttcttgtttgtcaatgtttgattattcgtcttattaaaaaaatttggaattattatttattttatttgtcaattgctttattatcaaaagtactttacatatgacttatctttttttatatttacactaatttttcaaataaaacgaatggtcaaacgttgcaaataaaaagtcaaaaacgtcatctattatgggacggagggagtatcaagctgtacttaagactagttagagccatcacctactttagtcaagcattggatcatgtgcttaaaccttgttggactttgcagcaatactgctgggagaagcttccacaaactttgcagaaaactgtggcagcatcaaaactgtgtcaggacctagtgctacatcactcatgcaggtaaaaagcaaaactgatatcaatgaaggtttgaattcttatgcttgcagctgttaaatttaaaattttacacttgcgaagcactgtatcaggtaaattgcagccatcctgctcctgcagctgctcatggacatttattctcacaccaaagcatgaggtgtacacatagcatcactggatgtcatctataggtgagcatccatattaataagtccgtgtatggttagtagaattccagtcaatctccagctaaagcagcaattgttaatcaacagtaaattggttgcttatattaaattgctcttaaaatctgcttgcttcgtgtggcgttattaatgaaaccagcagtgctgtcacgcgctattgacagaacatacatcaactggagtaactttttttttgctgggaattggattagcaatttgacatgtcacttgcaaagatattgatgttttcctgctgaaatgcatggtgactagtcccaacattccaaagagctggatgaagtggtaaacgatcaagcttcaactgtgcattcataaacctgttcattaatgttactgtgggcacccga

SEQ ID NO: 84380 - DNA, 2690 bp, Oryza sativa
cctccgaatcgagacacgtcgccatcgtcgtcgtcttccacccgctgctcgtttcctcgtcgcgtcgcgcgggagatctctctctctccctcccttccattaaggtaatcaatcaaccatggcgccctcccgcccgctcatgcgcgggatccgcccgccgcgcgtcttccccacccgcggcggccgcacctcgcccttggccctcgccctcgccgccctcctcctcgcctccgccttgctcctcgccctcatcgccttcggcgtcttctccctcccggtctccgcccccaacgccgccaccaccgactccgccgccgccgggggagacgccgagcccgccgatccacggcccccgcgcacccgcgcccgccgcgaccttaggtaaggggccgggttcccccccctccccctgctgccataatatctccagatttgcttcctccttcgatctgccgctgctaaccgtttctctcttggtttctctggagcagcgagggccttggggaacgaggagcacaatggacggaagtcatatcatgggagcccagggctttcgtctatcacaatttcctggtaaaataatctgctctctacacttgttcattcatctgcatcctctcctcgcataccgggatggcaacaacaatggtgttcactgaatgcatgttatgagaatggaatgatagtactgatagttcacgctttgttgcctgatagtactgataattatttacttttctgcactttttgttgcctgatagttcacgctccaataactctgatagtttacaattcatttttgttaaactgtatgaattgctgatggcttatctcttttgttagtccaaggaagagtgtgattacttgattggattggccaagcctcacatggtcaaatccacggttgttgatagcactactggtaaaagcaaggacagcagggtacgcacaagttcaggcatgtttctccaaaggggacgagacaaggttattcgggccattgaaaagaggatagcagactacactttcattcctatgggtatgtcatggctcaaatgttttctcttctgctatttcttttcacaaatgagccaaattcatagtgtggccatacatgtcctttttatttcttagtcatggatagtaccccattggcacgtaagaggtttatggcattgggttgttaacaatatgcagttcaataatgcaactctcaacatttccatatttttatcatgcgaaggtttttatcatgttgttgtaatcgcaataatgatttgattcattctggtttgcagaacatggagagggactccaagttctgcactatgaagtcgggcagaagtacgagcctcactttgactattttcttgatgagtacaacaccaagaatggtggtcagagaatggctactcttctgatgtatctgtacgtatggtactcatttataatgtattggttacaagtgttgttaactggatttctaattaactccttcacaatgttatcaatggaaacagatctgatgttgaagaagggggtgagactattttccctgatgcaaatgtgaacagcagttcattaccatggtataatgaactttcagagtgtgccagaaagggccttgctgtcaaaccaaagatgggagatgcgcttcttttttggagcatgaaaccagatgccactctagaccctttaagtttgcatggtcagttcagtgacttatctgctgttcttattactttttttaaactgattgcatgacttgaagcctgctgggcacttctgttctatttgctatgtcctgtttaaaacttccatcgatgctccttcagatactttacgtgtgttttatatgctccaagcagtccctttacaaatttctttatggtctgagcagggggttgtcctgtcatcaaaggaaacaaatggtcatcaaccaagtggatgcatgtccgtgagtacaaagcttgagctttctgaagtcgtgattaccaaaggtatctagtgttcctatggatctgtactgagtaagatgtaaagctggcgatattactgcatattgctttcttaactagttttggtcctcttcaaagtgacttccactcattcaccctagcaccagaaacccaggaagcaatatggctttgaggttatctagcacctttagctttgcattcttctcttttcgtgattactcctaggataggagtcatgcattcagatagtgttctatgtaaattttcagctgaggatggttaacgtttgcttgtagtagcttgatatctgccactttgtgagatctttactatctgaagaaataatttgctcaaaacttgttttataaactgatgtgctgtatctttctttggcagatggaccctatataaagcattgactggggcactttccaggatggcagttatgtaggctttagagatccacaccggtggtattctttgctctctgagaatatatagtagaggcactaagcaagggggtttacttgtccataccgtgtttttggagatggtcttgttgaacctggcgccttttcttctttattttttctggcagactacagaggaatgaatggtccattgttggggacatagggtgaggcgtttgatttagtttgttttgtggtgtattgctatctgctaatgttagtagcttaattatgtacactg

SEQ ID NO: 84381 - DNA, 529 bp, Oryza sativa
ctggactggagtgtatcctagccatcccgagatgatccttttttctcaaaaaccatcccaagatagtcataagcaaaaaagcctcatgttagaataaacaaatgatgtactaaaattttgagccacacagctacagatttgatgtcccagcaacaaagaaatcaaatcaagagcctttctcccagtatcttcagattttaaaatggtgcagaataacaagagtcaggggaataatagactattaaattggcagtatctgtgaaaataaatggagtaagacctggttagagtgtagatcaagtattcccaagttcgatagcatgccaatatcctctggtatggatgtcaacaagttatttctggaacataaaagtacaaatagagtgaacttgtgctgtttaaaaataagagcatggtaaagaagtttgtccaaaatagataaccaaccccatataaaactctgctagagaagagcaatcttttatggaaggaggaatcagggttatttctacataacaaaagtagaaag

SEQ ID NO: 84382 - DNA, 658 bp, Oryza sativa
cgcagtccatgagagtaagataactcattaggccccggaggctaaacactttatgcgaccggctggactgtagtgaggaattgatagcggatagggatgggccacaggaagcggctatgagcgtgattacgccacgcgcgcacttggccctcactaacgggagcagggcctgcaactacgccgtgtaaggcgattgccacagaaaaatgagctattacttatgcaaccacttatgtgcatcatgcggggcataatcaaagatgataatgtggtgtacagtggcatttatcagttcaccaaaaactaagttaaattttgacctatacattgagaaaaaaaaagataaattctaatgtgaacaataccgctactattcatacgctaaatttatctttttcacatcttcatgtgtgagttgagtttggacctaaattttttttagagtggtatatatattgggtgagtggcgtcaaattcttcaagaattttatataactgttcggatggtttttaaaacgagagggggggggcatcccctcgataaatcaaaatagtttcccgcaacaaatccaattatagatgtcaacaaaaatggctggggtattcttttctaagtgctctacccttacaaaaggaatagatggaggaatgtggtcgc

SEQ ID NO: 84383 - DNA, 1792 bp, Oryza sativa
agaagaagaacaaggccgcgtccaacgccgcagatgcggatgcggccggggacgccggggccgacgacgacgccgccgaggagaagcctgatgtcaaaccccaggtacagccacagggagcgcctctctctttgttcttagggtttgggggggttcatgtttttttcttttttccttttctttttgcttgtttggtctgacctaggaaccgtggttgccgcaggtggaggtggaggtggagtacgtcccggagcaggcggacctggacgacggcctcctcgccgacttcaagagcatcttcgacaagttcaccttcaaggattcctctgccgacgccgaggtattaccgcttcctcttgtgctgctacggaagacaaaccgatcgatataagattcctctctcatgcttcaattttgcctgctctatgtggagaaattgacaagtggattggtatttttctgataggatgacgagaagaaagatgaggctggcactgatgccgcaaagaaggctgcagggtctgattcggacgacgacgagcaggggacacagcaaaagaaggaagggggcttgtccaacaagcaaaagaaagttcgttcttcgcatctccctattgttgataacatgtttcagtgcctccatcttccttctatgttaattcaccttaagcttaagtttttctttccgttttttagctacaacgaaggatgaagattgcagaactgaaacagatatgcaatagacctgatgttgtggaggtaagctacccttattagttatgctaagattaactggtagttggctgcttgatgtacatctgtttgagtgtgttgtcactatgttatgtcgtaattgctcatctagggtgtcactgccagcgctgccagatataggtgaatctgaagtgaattcacaacaatgtgttgaaatgcaccacttataagattaaagcttctcaattctcaaacgtttttgtacattcattacctgtgcaaggggtacacccttctgttgttcacagttcctaatgctgggcattcttgtattttagcttcattgaacatacatagtaatgtgctgcatgtatttttcttgattcttgagggtagaattgttacataaattccctagcaattgcagcaaatgtcttcatggtgcacacacttgtaccagtattgctatattggagtgcaaacataaatattacttttatcttattgaggaaaatgaagcaacgggaatgacaccagtaaagtagttctatgtaaacttgttgattaatctttgtttgagacatctgtattcttcttgctaggtctgggatgcaacggcatcggatccatcattacttgtctatctgaagtcctacaggaacactgtacctgtcccaaggcattggtgtcaaaagcgcaaattcttgcaggtttgtgattacctaccaacctgccatcaatgacaaccatgttgttttgcataatattaatgaagaacagtgcttctgtgcgctcctaaaaaattgcacacaaatttaaatgttgttgttagtactggagttcctattaagtagttgcgactgtcattcaaagccatcattttgcttcaaaactcacctgtagaagagttgaatagttttttgaatcattttagtggagtttgatgtggaacaatttactcaaaaagaggtgtggatggggagtgaggggacataatgttgataatttacacccctcttatacagatgcaattcttgcagggatgctgtaacaacctgggagcaagagcttcatggtg

SEQ ID NO: 84384 - DNA, 3548 bp, Oryza sativa
ctggttttgtggtaagtttctgcaataattaaattctcttttttttttgtttcataaccaggcatgtccaacactccaaacacaatagtatattaatgtcccgtgattctctgcaggttcaaccatgtgttggtgtctggagtgacaaatgccgttcaaagtatggaagaaggagaccgttcattttggctggatgcttgatgatatgctttgctgtgagttagatgaagtttgataggttatcatatgttcccattctttctgtgctctaataggaagaaattcatacgtaggtaactttaatcggattttctgcagaccttggttacattttaggagataccactgagcactgcaggtaatctttgatacttctacttcctttgatagttttcttcacatcaagtgtgccgccactaaaatgacgagtactgtttgttcagtacatataaaggttcaagatttcgagcagctattattttcgttcttgggttctggatgttggatctcgcaaacaatacagttcaagtaagcctcttcaaaagtttgcttgtcgtcatttgtatttgcaccaaatttgtcaaaatatatgccatgaattaattggattacctcaccatggatgttctctaatatcctgtttctcctttcctttttccctacatacagggtcctgctcgtgcccttttagctgacctttcaggtagttaatgttttcattttgaatgtctaccatactggacccacttaaatatcagtgactaaatgatataccttctattacgtaggtcctgatcagtgtaattctgcaaatgcaattttttgcacatggatggctgttggaaacgttcttggtttttcatccggtgctagtgggaattggcacaagtacgtacttcatgtgtcctttatgtgcttatgttcacatgaagtttgttgctcataagtatgcgctgtcctatacatgatactgttggtaaagggttgaattgacttgttctactcaacccaaatggatcattgtacaattggtaacatctgacggctggtagtcaatctgtattaataaacgatagctatatatacatttagcaatttcagtaccatttgtttcaaatactggtgatgttgtttaccctttgaatgatacaagagtagcgtatgtacaagcaaatcacggtaaaacattgtctcagcatctttctcttctgtggagagagtatcctatcacatgttgaaaagtactatacggtgattacctgtttgaaaggactactgtcttggtcctcttgtttaggcatcttgcttgatgaagtccctctagttagtaaggttttttttggcatgaaatctgagtttatttctcataattattgcaggtggtttccttttctaatgacaagagcatgctgtgaagcttgtagtaatttgaaagccgcttttctggttgcagttgtaagttctcttaaatcccgctgctgcgcctgcagtagaaatttcaagctgttttgtaacagcctgcagagctagcaggtcattcttaggaattgcatgtgatattattttgtggagtgtggactgtaatgtgtgcaagctgataagccctactatgcaggtattccttttgttttgtatgtctgttaccctgtactttgctgaagagatcccgctggaaccaacagatgcacaacgattatctgattctgcgcctctcctgaatggttctagagatgataacaatgcatcaaatgaacctcgtaatggagcacttcctaatggtcatacagatggaagcaatgtcccagctaactccaacgctgaggactccaattcaaacagagagaatgtcgaagttttcaatgatggaccaggagcagttttggtgaatattttgactagcatgaggcatctacctcctggaatgtactctgttcttctagttatggctctaacatgggtatgctaccttaagacatctatgcatgtatatcagctgcatgctgattgtctcttactgttttggaatttgtagattgatggtgttcatccatatcgtttgctttgcagttgtcgtggtttccctttttcctttttgatactgactggatgggacgtgaggtttaccatggggacccaaatggcaacttgagtgaaaggaaagcttatgacaacggtgtccgagaaggtgcatttggtttgctattgaattcagtaagaacccttgatcaatgtgtttactataatttgtagtatgtcgctatgtttagatgctgttacaccccaatcatttctagcctttctgtatttttattggatactgctagttgttgctcttactctatcaaacaactagctgaaagtcttaaaacttagttcatgtgctttcctattctttgtgccctgtagtggtttaagcatttcagttggattctagtttgaggtgataagttggtggcttcaacgtttgggtctttaatacaggttgtccttggaattgggtccttccttgttgatccactatgccgactgatgggtgctagactggtttgggcaatcagcaacttcacagtgtttatctgcatgctggctacagcaatattaagttggatctcttttgatttgtactcaagtaaacttcaccacatcattggagcaaataaaacagtgaagaattcagccttgattgttttctccctacttggactgccactctcggtaagtaccagacttcacaaaatcctgccttgttgggttggaagctttcttacacttggctcttgaatgtcacagatcacatatagcgttcctttttctgtgactgctgagctgactgctggaacaggaggtggacaaggtttgtgttgctgatgtttttttcttttacactatgctcatgtgattctcattgattgaggatattttttttatcaatctccaggtctggcaacaggagtcctgaaccttgcaatcgttgttccgcaggttagcatgttcataagaaacaaaatgtatttctatatgtgctgtcactgaagatgtcttgaccatttaatactccattattctgtgcagatagtagtgtcactaggagcaggtccatgggatgctctctttgggggagggaacgtccctgctttcgccttggcttccgttttctcactaggagctggtgtcctcgcggtccttaagctacccaagctgccaaactcttacagatctgctgggttccatggatttggctgagcagaacaccagccgcatggtgtgtaacattgagaaatgcaactccattttgccattcgtttacagtgaaatgattctttttacctactactacaacagaataagctgaaaagatagagattaggatagagagctaggtaactagtccagttaggttgatgtgcatacaaggcaattggaaggtgtaagagctgtatctacttttttgacagaaaaatgtaagctctgcccgaatgacatggcggatagattttacaatggatgtaatcatgtactatatataacacgttttggtcacagcttgc

SEQ ID NO: 84385 - DNA, 697 bp, Oryza sativa
tcctgcagcccgttacctcccagagatggcacgttagccctggtcagatatatgccaggcttcatcctaaccattacaggcaagatgttgtgtgaagaaggacgaacatatagattgctaagctgacacgtggtggacaagaatgaccgacgtgactggtctgacaccggtcatgtcgtcagtagacagccacgattccacgtcgcatctgctcccggcgaaagtggaggtagttgtggaccgtcccatcagaaggtgactcggatggcaactatacaaatctccgtccatttatgaaaagggtgcatgtggtatccccttaagataaaaaaggaggaccttgcccacttagagggaggaggagacttttccagattgggaacctagaacgagggagaggctggctcatactttgtagttccttcatacacaaatccaccaaaacacaggagtagggtattacgcttctgagcggcccgaacctgtatacatcgccggcgtcttgtgtgcttcctgtctcgcgaaccttccacagattgggagcttagagtctcacccagagtccccggccgaaccggcaaaggggggccagcgcggtctcccggtgaggagccccacgctccgtcatctggcgcgccaggtagggggtaaggatccttaggacatgccttgttaaggtcggtgtagtcgatgcaca

SEQ ID NO: 84386 - DNA, 595 bp, Oryza sativa
agcaggcctggagccactgggcggggtccccggagacctgatcggcccggaacatcgcggcgacggcggcgggcactcgggtgcggtgcttgaggagccagtccttcttcaggatcccggcgggggcctgcggcggcgcgagcgggtcgcgggccttggcggtgcgagcgaggatggaggccttggagaagtccgggagggcgagcaagttcatgggcggctgcctggagctcagcgccgccgagatcgcggggtgcagctccgggcaccccacgatggacaccagcgacagcggcggcgtccgcagctcctccgggtagtcctccatggccgccccacccgcggcgccgcggcgaggcgaggcgaacggtcgggaggcgctaggtccggtcgccgccggggtggtggccggggaggacggggagctcggatctgtggtgactgtttggttcgtttggaagaactgggtgggggcgaggacgacgacgcgcaaggagtggaaacacgtatcgctatgtgagatgtaataatgaatatagtcagggtgttttctatgaagtctgaaagaccttgttataaaatttcagaattctga

SEQ ID NO: 84387 - DNA, 1236 bp, Oryza sativa
gcctgtcgccaccgctgctgccgagcctgttgccgccgccgtcgatgagcccgccgccgtctcctgagggcgagcagggcaagtgcgcgagcagcgtcgtcacgccgttcgctcgtcccagtccgccagttttggccggatgagttggtcccggatctgagagaaatattcctctctagggaccaacccatcccacctcatcccagcaaccaaacactacctaaaattggtctcaatcgttcggatagcgcgtgctctccaggtaagtcaggcgatctctttgttatcccggctgggtttcgttcgaacgctgcaatgctgcgtacctgtcgtccactcgtcccgtgccggtcgccgtggcgtcacgctcggcgcgcatgcggacgcagtcccgatcgtgtcaagcaacagagcgcggcgacgcctggtcggcccgtgcacgcgcgcgtcgcgcgtcgcgagatctctggcacggaccgacggacggtgacagaaactccgcccgtacgcgtaccacccagtaccgttacatcagcatgcggcaagaaccgatctgtcgcgcccaggtgatcgaaacgtgaggctggccaccggccggtcgtcggccaagaccaacccaccgcgggaacatcagcttcgccgtgaatggaactactcgtggaagtgacggatcgagcccttctggtcgcgtcacatcggggctatacccgtcgccaaatgggaagactcgtcgcgtttcgagtagctctgccccatgccatgtgtcgcaacagttgcacagcgcagcgcggagcagtgcagatcagcgtacggggttaagtactgaacggtaactgcgtgtactcctacgtaccacgaggtccacgacgctggacgggtggagtagtagtaacacggagtaaacaaggattctccatcggttaacacaagtaaagtacgccgcatgtgatccagtctcacgatttcatggtgagttaaattatttacacgatgacgggcagattttgttgttcatcgtaggggggaaattaaatattttttaaaaataatctacatagaacaattgatccaaacagtacaatagacgataaataaaatccaattgatccaagcagtacaatagacgataaataaaatcttgagaaaacatactgtgtttgtattaaaaaggataaacatccaacgctccacaatgaaagataccacttaaaaagtatttgagtgggctgcaggaat

SEQ ID NO: 84388 - DNA, 1569 bp, Oryza sativa
ttaccgtacaaatattttgttagtgccaaaatataagcaagttttggcactaccaaatatttggtaaggtaaaattgcatttgatcatatttggtttgctgcaaaatgtaaaattgtagtgaagaatgttctacataatcttaaatctagattacgtattaccaatgaataggcttcaatcgaaatcaaacacaagtactattcaaattaccaaaatattggtagggcatgtttttggtagcaatccaaataggcccttagtcttacgcatacaaaaaatcaccaccataattaaacattgtaatgataagatagataagaagtgccatcgatacacggtacaaatttgtcgatcccgacgaatcaagcatgcggtaacctatcggccccttctaggtcggtcagaatgcattgcattctcgtggtccttcaatcgttgatactctacttgtgtttctgactctgttatcttctggccatgatatgatggagtgacattgtcgatccatcgagtaatccacccatccttggattgccctgtaaaaatagtaatgttattcagtttgggtagtaattttgtgcaaatcatagcggattttgtaaatggttagacatacaacgaaatcgttgtctacattggggcagacaaaatatctccttcgaaatgtttgttcagcaaaggatgtagccacctgccagcgatccctgcacccacactttggacgctcggaccatttatgtaaccctaatggattgttcctccagtctaagcttgcaatttccacccgacgttcgtactccatccaagtatgaatgaactgtatggtcggttcaggttgcgttatcggcccgccacttgaagtaactctgactgtgtcaatccattgtacgaaagtgtgttgtcgtgagcataagttgttctagcaccatatgaatgaaaagaactatgtagaggagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcgtggtgatgtgcaccgtgcaagtcgtcgtcgtagaactggctagtaggaccagtcctaccggcgtgagacgaagaggccccagtaccgaagatcccggctgcaaatcctactggacaaggaccatcagtttcatacatgtatttaatagtattaataaaaagtaaagtaccttgtgggcgagggatcgacgctccgtgagaggaagagctggcgaacgcgcccgaagaggtggcgaacgcccctgcggagctcgcggaagcgccggtcgtgcctgcgaacgcgctcgaaggcagacgaggtcctgcgatgaggagggctgcaggaat

SEQ ID NO: 84389 - DNA, 663 bp, Oryza sativa
ataaaaacctagctggtgcacatttaaacattaggtgatccacatcctcttcagcaccacagaacttgcagaggggatctccattccacttcatctttttaagccgatgagcagcttgaattctccccttaagcatcagccaaacaaagatcttaattttcagaggcacgggtgtcttccaaagttcttgcatctttatgtctctaatccccccaaaggtcatttctctatagagagatttcgtagtaaactgtcctgattttgttaatttccatctcatcctgtccctatccgtagataagtgaacatttgcaagatctgcaagtagttgttcccattcaactagctcctcggcaccaagcgatcttctaagatcaatcctccagccatcagaggaccataattgactcactgttttcccaggatcagccactatactgtaaatgtagggaaatttgattttcagaggtgtatctcctagccagacgtcatcccagaatctagtaccactgccatcccctaaatcatacagctgcccaatttcaaccaatgttttacctcatgcaaacctctccagaattgagagcatccctcagtactagactggaaaaagcctcccccgaagcagataaagattaagttgatatacgtaaaacgagaaaa

SEQ ID NO: 84390 - DNA, 679 bp, Oryza sativa
attcctgcagcccgttgggaatgcccttatattctgagcactgagggagtatattactactaatttaaaagcacaagaaataataactaattaatcaataagatcctcagaggcaatacatgcatgaatcttacttttgccttgtcgcagaatataggtagctttgtgatatcgagaccgtattttattccatatctattaatttttatactatttaattcatatatcaacttttgtactactccctccacttccatggttataagacatggttataaagtcaaactacttcaaatttagttaagtttatacataaatataataatatttataatacctaattagtttcattaattcaataattgaatatattttcataataaatttgtgttgaattgaaaatattattattattttttacaaacttggtcaaatttgaagcagtttgactttgttaaaagtcaaaacatcttataacctgaaacggagggagtactgatttatttattcaattattatattaacttttataccatgacttgttatttagctattttcttatttcggagagcgtgcagtttttcctatgtgttcattgaactcaaataactatagctaatttagccatcttactccagtaccagataacactatgcctgcctctaaatagtcaaagtct

SEQ ID NO: 84391 - DNA, 1095 bp, Oryza sativa
cctgggccttcccggccgtcgccaccgcggcgccatggccggccgcgccctcgtcgtgctgctgtggtgcgtgtccgcctccgtgttcctcccctccgcccgcgcgcagaccaccaccttcaccagcgccatcgacggcaagaaggcgaccaccttctccttccccacgttcgacaagtccctgatgcagctcggcgccaacctgaccttctccagcaacgccaccgtcagccagagcgcgctgcaagtcaccccggacagcagcaacaatcctctggactacctcgtcaaccaggccggccgcgtcttcttccccaccccgttcgtcctgtggtcctccaactcgtccaactccaccgccgatggcaagtacgtcgcctccttctccacggtgttcagggccaacctctaccgatcaaacacgaccatgaaaggagaggggctggcgtttgtcatcgcgtccaccaacgccatcaacccgccgccgggcagctacggcgagtatcttggtctcaccaacgcctccaccgacggcaacgccaccaacgggttcgcggccgtggagctggacagcgtgaagcagccctacgacatcgacgacaaccacgtcggcctcgacatcaacggcgtccgctccaacgcctccgcctccctcacccccttcggcatccagctcgcgcccagcaacaccaccactgacgacggcaactacttcgtctgggtcgactacaatggcacgtcgcggcacgtgtgggtgtacatggccaagaacgacaccagaaagccctcgaccccggtgctcgacgcgccgctggacctctccaccgtcctccgcggcaacaagggctacttcggcttctcggcgtccaccggcgagacgtacgagctcaactgcgtgctcatgtggaacatgaccgtcgagatgctccccgacgagggcgccaccaagaagaaggcggccctgcccggatggaagctcggggtggtcgtcggcgtgtcatcctgcgccgtcgccgtggtgctcgggctgttcgccgcgctgtacatccggaagaggaggaagaggatcggggacgacccgagctccgtgttcaa

SEQ ID NO: 84392 - DNA, 1015 bp, Oryza sativa
tgcaatgggctcctcttgctttacagccatatcagtcgtcccggcatgaagcagttttatgtggttaacccggctacaagacagtgggtgcaattgcctccacctccaaggcctgatattgggatcatgcacttagacaatttgtaccttgcctttgacccaccttgtcgtcacactttgaggtatttcaaatcccctatgttgatgtcttccgccatcgctctgagttgaatcctgcaatagagggaatagaatggccaccgtcaacatgcgttctgcatgttttctcaacaaggacaaggcaatgggaggagagatcatttgttcgagaaggggaggctgcaggatctttggctatcatacgacgagattttccaaattttctgcacaatgctgtctactgtcggggagtactttatgtacgctgtcaaaccaactttgtaatgaggtagtctcactgataagtattataatttatttctttattaacaaatagtatcactcaattttatcatgttttaatatttctaagttttccaatatttgcagaatatctttgtcagatggcaagtatcgaataattaaaccaccagtagagattgaacggtacgaggagtcaaatatttatatgggactatcacagaagagggtgtactgtacattctttgatgatccagacataatttatattcttgatgaatcgtacggaaaaatggagtgggtgcagaagaacgctattagctgtctggtcatacatgcatttcagcaaactgatgggccctggaccttacaagatataactatcatgaatatcctgatgcgtacggacatgacaacagtgaggcaatagaggaacaaaactttgattgggactctgacaatgataattttatcaacactacagacgaaagaaatttgcgctacggtagaattacttttctaggatttcacccttacaaggaagttgttttctcaagtcactcattgagccgaggactggcataccacttaaata

SEQ ID NO: 84393 - DNA, 616 bp, Oryza sativa
agctatccgtattcgttttcgtatccggtaaaaaaatatgaaaacgaatatggtatgagcattatccatccgtatccgctccgttttcatccctagctctaggcccgagtgcttggctggcagggaggccaggccgagcaggcccaagagaagacgacggcccacggcatcggcaccatgcgcggacacgcggcgacaagcaattcggcgcgcgcaggcacggggtccacgctgttttgcacggctcggaggcaggagccgtacgcgtgggacccacgtgcgatttagcgagcgcgcgtgggagcggctcggtgggacgcgtggaggcttcggactggatgcgtgcagatgagcgcgggattcacgcggtggagcgcgcgctctcgcgtgctgaggcgcgacgtggcggcgtgttactggcctggagcaggagcacgcggatcgtgcaagggagtgcagcgtggaggagttcggattgactacgtggcagcgatctggagctattcctttgaggagaaggaaaagcaagtggctgagattgagtccagggtgggtttcgccctacaggtatgaggtatttgagacaatgtcttacggggtattaggctataaatag

SEQ ID NO: 84394 - DNA, 682 bp, Oryza sativa
gcctcgatccggaagaaggccatcgaggtcggctcccatgtcgacgcgctccagaccggcatgatggtcgcgccgacccaccaccgcgagcagcagaagcaccaccaccacccgcacctgcaaccgcacggcgaggagcaacaccaccacgaggattggattagttctaagtatgaagacattcatacttaaaaatctcttgttgatctcttcctctcgcccctgtcttggttggattagttgccatattagagtaagcactaatccatccatacttcttgctcgatcttgatttcgcgtggttaagtaagtcgtattagcctttcaggttaaggaggttgttaaggtttttaagtaagaacctcctgtagcttacttactagtttgtgatgcttgctgtattttcttctagttcttggcttggtcttaaggagtttttgtttgattgtataagctgttttcttagataatggatcgtataagttgttggatggatcagcaagtattaggcctggtccttccttccttgtgtactactattactcccatgtagtactatgtttggttcagttaagcatttttgtgtgtaaactgtgtttgaactctgctttttgatgatgtggaattggaatttgggggagacactgagcgagagagagaacggtcgtcgccgacgccgtgt

SEQ ID NO: 84395 - DNA, 1309 bp, Oryza sativa
tcaaagggatatccaatccatgaacaatccatccaagaaacacaacttttctcagggagaaagggctcacactccaaaggatactccaccggacataaccacatgaggctacccaaacctataggatttgcccacatatctctttgtttaggacttgataatactcaccacacttggctagacaagcccaccaaatacacctacatgcatatgaactaatatggcgcaagatcatccacatgctcgcttcatagacccctcttaatagtacgacgtctatctagcaaatccggtctacaccaaacaccaagaccgggaaaagactaagaaaacattcgtagctccattatacctttgccttgcgccatccaacttggggtcaatgcttaagccaaaatcaacacttgtgaccatccggttgaaccatgtttatgccgaggtctttaccatcctttgtcaagactttattcccatcacaagtttgacttcattcttgccaacatgacgatgtccttggcttggtgaccattaacccatggtgtcattcaatagccttatcgtagtgggacctattccttttcacatctcaacaaatcggatgtagtataagatattttagataactgtgtgtccagattcatagcaaaaagttgctatattttgggacggatgtagtataagatattttagacggatgtgatacatcctagtattagtattaggatgtgtcgcatccacataaaattctaggatgagtagaatatttatattatagtaagcatagaatttctatattgtacccctccgtaaaaaaaattcaattctaacaacgaaccgttattttctttttacggaataggacatgttagctactactcactgtagagcacatgcatattagggggtgtttagatggggctaaaactttttagcccatgtcacatcggatgtttggacgctaatttggagtattaaacctagactagtaaaaaaactaatttaataaatgagagctaatccgcgagacgaattttttaagcctaattaatccataattatcaaaagtttactgtagcatcacattgtaaaaatcatggcgtaattagactcaaaagattcgtctcgcgaattagtccaaggttatggaatgggttttgtaattagtatatgtttaatacttaaaaaagtgtccaaacatccgatgtgacagggacttggaataagtctctataaaccaaacaggaccttaatccagcagccggctcttgtatagatctagcagttactccagttcttagtgtgacaggtc

SEQ ID NO: 84396 - DNA, 1222 bp, Oryza sativa
aagcccgtggcgaccgcatacatacgtacgtattgatagaattctaattaagtgtacacagggatgcgacgaccaaaagtccggcaggtgctcgcactcgtacatgtatgcatgggaatcatgtacctaattaacctgctttgaacctacacacatacacagagatatactttttgtaagtgcaacattccgtcaaacaagttgctaaaacaatcatatgtatgcttagataatcatgtatcatcatagaagaaaatgagccgggcaacctctgtaacatgttacagtatgatatttgtgaattttcaaccaaattctgaaagttttcatcttaggggtatttttgtcattagaacaaaattgtatggtactaacggaggctaacttgacggcgatggtaaattatagaagttaaacaaaaagcgatggcatagtatggaactgaacaaagtcagtggcagattgtggttccagggcaaagtcagtgatacaggatagattttctcattgttttaagacaattcaacaggaatacagagtatctcgactacttaggtactgttaatacaatataaaagcatgtatacaaaccagaaatatttagggcctgtttagatctcctggcaaaagtttcatcctgccacatcgaatgtgtagacacatgcatggagtattaaatataaataaaaaataactaattacacaaattacgtgtaaattacgagacgaatcatttaagcctaattgctacatgatttgacaatgtggtgctacaataaacaattgttaatgacagattaattggacttaataaattcatctcgtagtttacaggtggaatctgtaatttgttatattattagtctacgtttaatactttaaatgtgtatctgtatatccctggatattattaatctgttatattattagtctacgtttaatacaggcggtctatatcctatgtgacacgtcgaaacttttcatccctggataaacagggccttactatatttgttaaatagtactataaggtgtcatatttctatcctatgttggcaccatatcgacaccaggccatcagctaatgcctgttggtaccggatcttatactgattaaattacgaaattgctagaattgtatcgacacattttctcctccatcacagtcggcgttttgaagcgtccgatttcctttatcccgtgtcaatggggctgcaggaat

SEQ ID NO: 84397 - DNA, 683 bp, Oryza sativa
attcctgcagcccagtgccatggctggccaaccggaaacgaggacccaaagaactcatgcaaggggatgaggtcatgaggaccccaaggagctcatgcaaaacgtggcagcatatgcagtcatcacaagatcctaagactggctgcccaaccataaacctgtccacatgatagtaacaaattatacagcattacttacctcatcattcatgcgaacaagcacatcaccaggttccaaatgtttatgtgcaggtccttctggaacctgcaaggacagagttcagtttcataaatcatgaatggtacaatacgagtgagctaactgaaaaaataaatcaaaattaaaattcatgaatagtaataagaatcataacttaccacggaatcaacaaccagcattccagtctcgcctgatggagaaacaaggcgtaccatctgtacaaatagaaatagcaagttgcagatgttaattgcagtgcatgatgttttgacattcaatatgtacacaatggaaacacatatttaaattttcatttcttcagataaagaatcattagatgcaaaacaaatataaacacagattaacagtaattagtcacaaatagcaagtatagatcaactttaaaaaaaactctcgaacaacttaaatttatacattacaaacatattgaacatgactatttt

SEQ ID NO: 84398 - DNA, 2506 bp, Oryza sativa
atattgctcatcttgaaatattttttagaaaggtggaacaaaatgggttaatattatccaaaaagaaaatggaaatatgcaaagaaaaaattaacttccttggacatgaaataggagagggcaaaattcatttgcaagaacatattgctaagaaaattttacaatttcctgatgctatgaatgataaaaagaaattacagcaattcttaggacttgtaaattatgctagaaatcacatcaataatttagcaaagatagcaggaccgttatatgctaaattaagaaaaaatggtcagagatattttaattctgaagacattaaattagtaagattaataaaagagagggtgaaagaattaaaacctctagaattaccattagaagaaagttactttatcattgaaactgatgcatcacaacacgggtggggtgctatattaaagcaaagacctactaaatttttccgcttaatcagaagaaaaaatatgtagatatgcttctggaagttataaattaaaaactgtcaataatacagatagagagatcatggcaataatcaatgcaatcaatgcctttaggttgtacttaggatttaaagaattcacggttagaaccgattgtgaagccatttgtaggtactataatcagctaaatagcaagaaagctcaactagaagatgggttttatttgaagatattataacaggaaacggctataaagttatatttgaacatattaaggggaaagataataatttgcctgacatgctttctcgtttacctgaattgcaggtatgaaaagatcaatgaattacagcggaattgaatgcttcacatttggagatgacaacaagctcagaatattcccaccaaattcatataaatttaagccaaaagaccatataatcttagatgaagtgcaagaatgcatcttggataatttttggtaccaatacaataataaaagggaagaaaaaggatatatgttatcaatattgaatagcctctctgaatattttcacttaataaacgggttattaatgccagctaatgaagatcatgaaataatccaacggaagcctatatatgtcgtatttgatagaaagctcctaggggtctatatatcttttgaagaaattgtggcccaaaagatagatgctaaatttgatagactgatgcatgagttcgatcctgactgctgctacgtaacaacaatattacaggaaaatgcatatttgcactcaggaaaatgcatatttgcactcgggttcatatgtacctacaatctacaccgttgatgtgtttcaagattcgtgctgcaaaatgtacctaaccttaaccaaatgaacgcttactataggaagaaaatataattaggattaggttggttcacaatatgtataacatgtatgttgcattttttaccaaataaaattttcaataataatcatatatgacatttatatatctagtgcattgtatttctgtaacccttattttgtttataacatgatatttagtcaaaatgagaaaacaatatatctactatgtcaccaaattgtcatcttgcaaaaatgatatttccaaaatgatatatatctaccatcaaaaactacataaacaagataatttatataaacaaggtaaactacataaacaagttttgcatacaagaaatacaaaaattatataaacaaggtattttacacttgtaaaaaatatagtataacgtaaatatcatgcatgctacattttgttagcacctaatatacttgtcctaagattcgtgcaatatacatatattgtgggtacatgtgaactcgcgtgcaaaaaaatcaaacttatatatatatattcttctcggtaaccatgattacagtctcactatggtgctctttaccgtaagtagaaaataatctgagccgttgatctaattttatcaaagggttcaaatctcggttggcgctagtagaaacgtcgaggatataattatccaaaaaaagatcttctttccctttaaataggaagctacgtgagattttaggaaaaaaaaaagatcgatctccacctcacgacgactctagcctcgctttcgatgcatctctatggctgcccttaccggccatagccacagccgacgcaacattcacggagctgcagtcaaaggttcacaaaaccgatgaaattttacgaaaatcagtgagcttttgtgaaactgttagatgtcggtttataaaagccggtcggtattaatcggtttttgtacggcgttgataaaaaatagtcgggttttacccattttggtcggactttagtaaaccggtgaggagcaggttttatttcgaaatcgaaaaggtaaacactggctagctccagtgcccacgcacggcggtgaaaatgggttggcgtgggattgcaggggtgaatgttgccaaagtgtattgccgtggacgggaggatctcacgatcagaagcgagcgaggtgtttcctttttctttttttttat

SEQ ID NO: 84399 - DNA, 1842 bp, Oryza sativa
aacaaatgatcacaacgcgcatatactcacttttataaatacacacgtacttcttactctcgtaagtatctttgaaagtttaagccggctatcttgtgattgataaagttaacacggacatcacaccgtcgacgggtaaagaataattaggcaatcgattgatctattaacaccacggttattagctgaagagaaattgtgaggcttggccgccttcccctcccataccaccactgcatctcggcatgtacatgttggtcacggtgatcccccctgatcctgactaacgataagtaactggaggagccacggactgaaagcgctatgcccaggatcatacgcggtcggcgattgtcctcgtctgcttgactagaggtagactaacggcctttttggtttccagggacttatttcaagtccctgtcacatcggatgtttagacactaatttagagtattaaacatacactacttacaaaacccattccataaccttggactaattcgcgagacgaatcttttgagtctaattacgccatgattttgacaatgtgatgctacagtaaacttttgataattatggattaattaggcttaaaaaattcgtctcgcggattagctctcatttataaaattagtttttttactagtctatgtttaatactccaaattagcgtccaaacatccgatgtgacatgggctaaaaagttttagccccatctaaataccccctaaaatgcagacaaagcatctcaacttcacacagcttggcctacgtagggatgacagggatagcaggcgacgtcagctgagctgagccaacggcatcgcatcagctgctggttagttgcactttcttaattattagatctgctcgttaattacctcggagagaggtagtactccagtatttctgaattgttttctgatcaaggtcagattcagtattcagagggaagaagtcttcccacaagtggagcagtacatggtaaaaatggactgaaatggtacagaagcatatggacaagagggaaaaaacgcttctggattgaccacctcgtttcgacaagcaccacaagttcagattctgaattcgcagtacaaaaaaaataagatcctctcctcaccttcctaccatctactaccaacaaaaaaactttactgtgttagtaaaggctatcaccaaagctacagttttctgtagcttcttcttcagcgaacacactcacgcacgcacgcaaatcaaagtcagactataccaaagctgattgccttgcatttgcagatcatcacaatctcacaggcaagccgtagttgtggaaagacctgatcacaccgtctcgacttgcagtcacgatcaccgtgttccaagcaggcgagatcgtggagagacagtcagacagtcgtggggcatcagcggcttttgcaggtggaagcttctcctccggccatgtcggagtacccttcatgccgtcagcgaaacaccgcgctgcgggggaacggcgttccccgtggcggtgcaaaatgggtgaactgacggattcttcagtcaggctggaagaattcttcacctgctgtctttcttgatgcagcccgggccatggtaccgcggttgtcacgtccttggagaagaatttctcacaggagcgaaccgatttagcttcgcctttatgatcggcgacacttggaatgtcaaagttccagatgtagacattggaatccaatccggcagatatgagatatcttccatctgatgttaaagatggtgaagaaagagccttcaaattccaaggccctgcatcagaaggtatataaaaggagatatcagtactgaggccacaaa

SEQ ID NO: 84400 - DNA, 677 bp, Oryza sativa
attcctgcagccctctgtttagctttaggaatcaactgaaaagcctcggtatcaatcatcaatgtgattcaagaattaagcaagattccagagatggaatgagataaagaggaagctcaccgtaagctctattgggatcaaaagccttgtagtcctcgacatgtaatgtgacggggaagtacccaatcacgcacttgctgatgaacctgaggatgcgtcgtcctccaaaatgtaagatccaacaatgcggtcaggtaaaaaaacgttggcagccgaggaaatcgaggagacgaacctggcgatcttgcgccccaacctgctcatatcattgaccggcgcgaacatgaagaagagctgcgtggcgagcaccctggataatacagcgcggagaggcgagagtgagacccaagtacccaacccgtcaacggcgagcagagcgcgaggtagggaaaagaagctggaggagagatttgggtaagaggttacatggcggcgacgcggcgggggaagaggaagagcgaggcgaggaggaggaaggcgttgaagtggatggcccccagccacagcgccagcgcaaccgtggtgcgcaccggcggctgcgccgtcccccggaacaccgtggtcccgtcgtccgccatcaccgccgcctcgccggcgccggcaccgccgccgccgta

SEQ ID NO: 84401 - DNA, 1670 bp, Oryza sativa
tcctgcacccctatggattctagactcgtcttccaatatttcttatttttaattcggaaatttcattgtttgtaaattgtattactatatagactctaggctcttcttcctatattatttatttttaattctgaatttttattatttctaattgtatttctatgtggactctaaactcatctttcaatattctttaatttttaatttcgaattacagttacatctaaatggtattcttatatggattctctacttttaattttattatgtttatttcgaattttagttagttttaaattcctatatggactctatactctatttctaatattccttatttttaattccgaatttatattattttttaattgtatttctataagtatttcttatttttaattccaaatttctattatttcttaattgtatttctatatggactctatacccttcttctaatattctttattttttaattccgaatttcagttatttataaattgtatttctatatggagtctagtctcctctttcaatattccttattttttaattccgaatttcaactatttaaaaattgtatttctacatggactctgtttttctatttcttcaattaatatgataatttctaggccgtgagagcgaacatggatgctcctttttctgttcctttaataagttaatagatttaaaatgtatgtatcacggagcaaatgtagattgttattacatgagaacaacgctctacatttttagttgcttcctccatcccagaatataagaaattttagagttagacacggttattaaaaaagtagatagaagtgaatggtggagggttgtgattgaatgagtagtgaagataggtgggaaaagtgaatggtgaaggttgtgattgagtgggaagagaatattgctagaaaagttgttatattttgggacaaatccggagagctaaaagttattatattttgagacggagggagtatgtcttgctaatgttatccttgctctatgtccgaacagcaagcagatgggaaacctcacggcctcaccaaacctagtaacctaatccctccgtcccataatataatgattttgagttttttattgcactctttgaccactcatcttatttaaaaaatttatgtaaatataaaacccgaaaaattgtgcttaaaatactctggataataaagtaagtcacaaaaaataaataataaatctaaaattttttgaataagacgagcggtcaaacagttcaaacaaaaactcaaaatcctttatattatgggctggagggagtaccatggttccacccacctccttggttcaaagagaactatgatgaatatataggtcaacgaagaccttaagcaccaagggacaagcaaccagaagcgacacggcggggaaggcgagcgccacgccggcgacgcagaactcaaggagagctccgtcgatctcgggcatgtaaaccgggttcgccagacggctgaggctcgagagaactgccatcaggagcacgagcatggcggccttgaggtacacgctgtagtggttggtcccgaggaacgccgcgtacagcccggccatgagcgtgaacccggcggtggcgacaatccggaagacaaattcgatccatggccggctcccgactcctcccc

SEQ ID NO: 84402 - DNA, 697 bp, Oryza sativa
attcctgcagccccgtactggtttacgttaatacgtacgcgtgcgtgcagggttccaccactcgccaagacgatcgagccagcaacacgtacctagctacgaaaacgaactctcgccgatggttgatctgtcaggcctcgagatattcctcgccgtcgtcgcgctcatcgccgcgatctgtgccatctcctggaccgtgcgatgcttaatcggccggcggttcgaggtcgccaccggcgatcccaacggggagcgccaagggttgctgaacaaggaggaggtcgtcatcatcgacgtcgccgccgccacggaggcgaggggcgacgacgtggcgctctgcgcgatctgcaaggggaggctcgcggtcgcggtcgcggacggcgggggacagccgtgccggcggctgcggccgtgtgggcacgtctaccacgcggagtgcatcggcctgtggctgcagagggggacgacgtgcccggtgtgccgcgccgacgtcgttgcctcgcggaacgaaatcgtcggcgcgatggcgtgagagccgcgcgcacggggcgcggatgcgtgcgaccggggggcctgggtcgagcgccgcgttgcagggttgcacagggtaacatcaaaatttatgtttccatgttgtgtttctcttccggagatcttttttttgtacgtgcacaaaattggaacggagattaagctc

SEQ ID NO: 84403 - DNA, 1095 bp, Oryza sativa
agtgcgtgcaacccaccgtgtcgcgaatcatgtccgcttcgccagcggggggcgagtctggccgctggtcccaatcgtcgcaatcactccggggggcgcccatgggccagtgctggcggctgctcctgccccgggacccatcaaccaccccctatgatagcaaaagtgccaaactgcgcgtcccagttgcttgcttctgttacattggatcatggagtagtagacgaccatggacgggggtccattcggtaagttaaatcggaacaaaggcgttgctttccttcccataccaaatacgagtagtggttcagacgtcataaaggtgaaggaaaaatccgggtatccttacgaatggcagtacagaaatgtgcatgtgaaaaatactttctatcttcgtttatctttcgagaaaagaaagggcgcaatttgagttggaattggaggggattacattggactgaagctcgtatgcacagttgatcaaacactcaccattatctctcggagcaaagaatcttgacagcctaaaaaagactctgtacagcaagaaggggggaaaaattatgtttctgaacttatcctacgaggcaagttgtgattggttttcacgaagccatcatggcagggggcaccacggtggcaacggggcaaccgccgcctcgctccccgtcggcggcggaggcggctgcccaccgccggcatatccggccgagcgaggcggccttccgccgggcgcgctccgtgccgatgctcatcagctcccagatcgcccattccacgccgggcacggccatgacctgggtcaccgccggcgcgcccaggcgccggcagagcagcacgagcgccgccgtggcgttctccctggcccagtccgtgccgcgcctcatttccgccacgagacgcgccacggcgccgtcgatgttgacgatcgcctccgcaccgccgcgcttggccagcgcggcgagcaccgccgcggcggtctcctccttgctaatcgctgacagcgccacctcggcgacgcctgcgtcaacgagcttgccgacgttctccctctcgccggccagcgtcagcagcgcggccaatgcgtccttcttt

SEQ ID NO: 84404 - DNA, 877 bp, Oryza sativa
cagtggaagacgatgtcatgatcgccaatgtctcggtcacagatgacatagcgctcagcgctgccttgagaacatcctgcgagcacccaggcttcacgatgcttttcacctgcgcagcaacaacagttagaatagacaccaacatgtgccatttgtccacaggaattcagattgttcgatacgaagatcgatcaattattgggattatggaaagtaccttctccaagtattcctggagtttcttgatcctgcccatatagtcttgatcttccacgcacagtgaaataggctttgaatcagcacctgctccttcgaattggagtggtcctgggtttctgtagatgtcgtcgattaagaagctggtagaattgttcctcaatagcctgtaaacacaagtttgttattgtcaatgagattatgcatcttctttagaccaatgacagcaactgtacagcgatcgaatataagatgggattaatagattgtgtacacacttactcgaatgctttgcctttcaagtcgacagtagccatatggacagcaggtttccctatttgagtagccgcaggaccacgtgaccatctcttcacggtcatcatagactaaagggaaaagaattgtgggttaggtgttcccttcattcatatcatactcatctaattttgccaaaagggggtgcacagtagtaatctcaccgaaatcggagccgcaccacatcgccatttgttcgcaggactcttaagatttgtcacagtagccatgtaaccattcaaaccagcagctaagatgtggtagcacacgtgcccaagaacctgaagccaaacaacatacatataattaatcaacagcaaaataaattgctttgtccaagtagaaa

SEQ ID NO: 84405 - DNA, 918 bp, Oryza sativa
atgcagcatgctcacttgtgtgagggagctgtagtcagtagtacttgttgatggctgcccggcaggatacaccggcggagacgccgacgagatcaccggcgctccggccaactcttgcccttgcccgccggcgtccgccactgacaccacgtccctcgcgtgcatcgatggaggaggaggaggagcggcgaagccggcggtgatatggacttggacgtcgtccatgaggccggtggcggcgccggcctgccggtacctgcgcttgaagatctcggccctgaccgcttccagctcggcctccagcgcgttcacctgctgctgcagcatcgagatggcgcccatgcagccgtacacggggtcgcgcagccgcagattcgcctcgtacaccaggctgctcgccgcgtcggctctctccgcctcgccgacctcctgaaaccgcattgcaccgacgaagccattaatgcacaagctagcgaaaggtacaatttaaggaatgctttgacctgtaatggtatcgtaccaggagcatcttggagacgttgctggcgccgaagaccttgtggacggcggcgaacttgtggggctcgtgcggcgagaagtagggggcgaaggggcactcctgcgcgcagcgccggcggaggagcttgcacgcggcgcacggggtcacggtgttcacggcgccgccgaggccgaggcgatgggggacgcggtgctcgatcggcgtggctgtaccggtgccggtgcctgcgacggcggcgactacgacgccggcggtgtccggctctcgcttgatcttcttgccgatctcatcgagtctttccctggcggaaattggaaagggccgaagaaggtttttagggtttcttgcatggattcaggagagggaccagatgcaaaacacaatgcgggctgcaggaa

SEQ ID NO: 84406 - DNA, 1271 bp, Oryza sativa
caggagtggactgacgtgggtggcaagttcattagccaaccccgcgcctgcccctttagggccatgggaaagaaattcgccatgaccctgtcgtcacccccggcggcctcaatcccggtcgtgtagacctggagaaactcggcggggttgacgctgccatcatatttttcggcgatggtgggccggaaccttgggggccaacggacattccgaagactcgccacaaaggctctacagccgacaccaccaaccgggggcacggagggctgattcccgcgtccgtgttgaggtgacactctggacgaggaagcgccctccgttgcgtgggtagcacgtcgatcattacgccgccgctcgatgctggtgcgggcgtccggccccccacgcagatcttcccgggttgaaggagtcgacgaaggagtggtggccgaatggcgaacggcagctgccgctcgccgcgcccttcgtcttgacgacgcggagccggtggtagcagcaccagaggccttggtggcggaggaccgcccaccagcatctagacgctgccttgcagtcatgaccaatttggccacatcgtccagccaacgttgggctggagactccgggtcatgggcgacgggcgggtgacgtaggagcgcgcccgcagcttggagcgcgccctggggcgtgctgccgtcaccgtagacgaggaggcgacgctccccatctcgccgtttttctccatcgcccgcaatcggtgaagtcgcggatctttcgaccctctcgagtgcctccccccgcttaggactttggcgtggagggggcggtggagtacgagctcgacggcgtgggttcggctccccgtcgtcaccactcggcagggcggctgttccccgggcccctgtcgcgggacccagaagcacgaccccctcccggggtagattgttccccctgcggctcccgcctgcgccgtcgtggccctttggagctcgctcctctgaggccccgaccgccatcataatggtcaggatggagacgcggtctggatcgctgcagagggggaggattccttggggaatgagggacgcctccacggagttgagattcagcacccgttggaccaatatcttgaagtcctcaggagcccagtcccatctcactccctggtgggtcctcatgaagtcttcggacccggtgtactcccaggcgccccgagcgcgccgctggagcggcgcaatccgacgacggaggtagtcgccgtacaccatggcccctgtgagcccctgggatcg

SEQ ID NO: 84407 - DNA, 562 bp, Oryza sativa
cattttagcctttattagatgcaagaagagacagttcgcttgtgttgctgaaatgccaaactgcatcatgtgataatagagcccacaatgaactgtacgatgtacagaacatttgctttgtgagctctacattgtgcttctcaacaatgggtgtgtttagttcgcgctaaaattgaaagtttggttgaaattggaacgatgcgacggaaaagttggaagtttatgtgtgtaggaaagttttgatgtgatggaaaagttggaagtttgaagaaaaagtttggaactaaacaaggccaatataagaaactaaagcctaaagcctaacaattaaaaatgattgtcccatagtccataagagaatttctggagatgtaaatcctagcaagtttcttgtgctacattgctcattatatgatagttcacaatatcaactaggaaagaggttaatctagtttttacgtaaccttttcgccgctgtcattgccgacaacccggatttccagaccaacagatgctgcttcaggtgctagcgggatctcatcatacttaaggaacttgatag

SEQ ID NO: 84408 - DNA, 1079 bp, Oryza sativa
tacacggcatggattttctatggtctgacaagttaatttgatttgcaatgaagtatggagcacttcggaggaagatcggtggcacctacaaggatttcttcaagtcatatgtggatggtactacctcatatatgctttacttgcagaatcctaaaattacttctgatccaaaaagattatactagtaggagtatcgcacagtcctaactgtttctgaattctgcttgcagttgacggggaatacgtagaggaaggttgggtggataagacctgcaaagtttgcaagaaggacactagaggggaacccaggcaggtcgacaagctaggaagatatgcacatgtcgcatgcttggagaacccaaaaccgaccaacatcttcgccaaattgttcgccagatgaacttcaattgtacaatcaaagacatatttttactcatgcttagatacatagatggtgttgtagccccaagaatttgaacaatattatgtgttcagttttgccatataaaatggtatacagggagcatgtcacacattttccttcttcaattgatccatttactcacgaacaaagcaatgacttaacagacctgaacgactgaaaatgttaaatattacatcaagtattacagagcaagttaatacactaatctatctattagcttatgcccctggtctaatataagaggagctcagcacaaactcaagtcaaaagaaatgctatatagagctaactggttatatgatgctgcttacctaattctgtagctatatgacgtgttcagaagtttctttcgttgaccatggacagatacaccctgcatctgatgtcagtgcatccaatcttaaaccccggcattactgtaaacccaacactgaccttgtctccttctttggttatcttggatggaacacattccatgtgtttatcgtaattcagtaccacccttgacatagaacatctctgctcttggattcagagaacgtgctacggttagggacgcccatacatatcttgacattgtcacaaatgcctgataggatggtgttgttgcgatgaccgccattctcaacaaatg

SEQ ID NO: 84409 - DNA, 643 bp, Oryza sativa
cacacgcggtaatctacgcgttcagggggggcatgcggcacaaccgcatgctcgaaaagatcgcctccaaggagccccagactaccgcggagctttttcagctcgcggaccgagtggtcgcaaggaggaggcctggacttggaacccctccggttccggtgtggcagcttcggccgcccctggatccgccgctcagacagggcggcgtgacaggaggaggaagaagaggtcagtccattccgatgacgagggtcatgtcctcgccgtcgagggcgcttcgcgggccacccaaaaggggaggcctgcgagcgacaaaaagaaaaaggccggcgctcccagcagggagcgcccagccggcaagtggtgcaccgtccacaacacctccctccacgacctcgtggactgccgtgcggtcaaaagtttggctgagcgaacgaggaagtgggaggaggagaggaggcaggagcgccgagagggcaagtccccggcggttccttccggcaatcggcgaagtgaggccaagcagaaggcccccgccgaggacatcgatgacggcgatgatggcctaggtttccaagagcctggggccaccattgccactgtcgatgggggagcgtgtgctcacgtttctcgccggagcctc

SEQ ID NO: 84410 - DNA, 1335 bp, Oryza sativa
atctgaatgatgtgctcatacaatatcgatattaaaatataatgatacccattttaaaaataatgacattaaagtagttctcgtgacaaatatactcttataattttttgcatgacatatttgaatatttttatgtatataataatggccaaaatttctaagtctgactgtatgcattctagaatgaaatctatttgagaatagtatatgtttaattcaaattggtgatgttcatgcatcttctgaaatatcgggcatgttttagtttgatgccgaaaccagccttatcaaattttgttaatgccacaccttatttatttatttttttgggtaaggtaggtatgtggtggtacgtttagtttgaaacctcatctatttgggtgtgatgttaggtcaggaagtttattagctaccaaatattggtatggaaaggtaggtatggttggtttgttgccttgctaaaattggtaaggttagaaatggtagcaaaccaagcatgcccattatccgtgattttgtcttatagttcaattgcttttatccaatagaggttcactaattttccttttactctctctgtcattttaatgtaatcatatgtttctataggctgcatctggtaccaaaagtggctctagtggttcccctgttgttgattgtcaaggaagagctgtcgccctgaatgctggaagtaaatcttccagtgcttctgcgtttttccttccattagaacgtgtaagttgtttacaaaatgttcattgaaactagctaaatgcatgtgctttgctacggataaaagaaaacgtataatgtgttacccatcttttttgctatagggaatattcatcttactctaatttaatgtggctatccatttagatttgatattttttaatattaagaagttcagggattaacttgcaaaatttacaatgggagtaggtggggtgacagattcattgccaccaccactaccttcttttaaaggagtatagatatactacttttagcccaggaagcttatgcttttgttctaaaattgcaaggtctcttatttaataagaccaacgaagtggtcctgctagttgaaattgatacgagtcataaaagcacacatgcaattaggttaacatctatactagacatcacaagaagagagagagagagatagaaagaaaaatataatttggcattgaccgacatccgagttcatacaaaaaggaatagcattgctgtttaatattgattaattgtaaggtctcttattgacaggaacaacgaagtggtcctgctagttcaaaatgatgtcattataaagcgcagggctgcaggaat

SEQ ID NO: 84411 - DNA, 1077 bp, Oryza sativa
acttcaagggattaaagcacgtgtttttgaccggctaaaaccctatgccggcaaatgggtgcaacaattgccatcagtactttggtctttgcgaactacacccagtcgggccacaggccagtcaccttttttccttgtctatggggcagaagcaatgttgccgagtgaggttgaatttgagtctttgtgctttcgaaatttccgtgaagaacgctacgaagaggaccgagtggatgacttgcaccgattggaagaagcccgcgaagcagctttaattcagtcagctcggtacttacaagggttgcgacgttatcataatcgcaatgttcgatctcgtgcctttctagtcggcgacctggttttacggaaaatccaagccacacgagatcggcacaagttatctcctctatgggaagggccattcattatctctgaagttacccggccaggttcatatcgactcaagcgcgaagacggcactctcgttgacaactcttggaacattgaacatcttcgtcgtttctacgcttaacttcatcattgtatttccctattttgactgtcaacatcaagttttcttcttgccgttgtcagtcgggggctatcatcataataatggagtatgattttttatcaattcagtttgcttacttggtttatcattgccttgtttggtttttctacttagtttgcgaggactgaaagtttttaatagcttctttgggttttaggctcaaccaagcttagcaaaaacttttaagaaatcaaaaacttcgcaagaatcatcaagcacagcataaatacaccagtattgtacaaattgagcctccatgtattacatccaaactcaatcagagtcagtcctttcgtcatcagagtcatcattactcggctggaggtcgttgttgcgaaattgttccacaacatcactcgcaattttgtcagccgcagtttgcgcactactgataagatctagggcagcttcttcacttgtcccgtctgcaaacccatcaatggtgtcgacttcaattctcgggtacaaggattttgtcatcgccaaggccatgccagctccca

SEQ ID NO: 84412 - DNA, 1174 bp, Oryza sativa
tgatgagcacatagccacacgtttgtagcgatttttctttgtttgattgaaggatataattaattaatccagtagccttttgcaatgatgtgtatctgattatctgatacgtacatttgtggttgtggttaacgtctcaagtctctcgcaacgaccatgcttacgttgatggcgatgcatggctgcctattggggactcttgaggaatatcttcttattgttattgtatatatactcacatagttataaaaaagtttaaaaggatgtattaacatgtaatatatcactttataaatatataatttaaaatttaacttgtacatctcgcaactaaaaacaaactaacaaactatagttggatctttttttgctgagatgagctaaagcatcattttttttccttcacttttttcttcataaaaaacaaactaaagatgttactccgataatttccaacgagacatagtccccattggttggcaagagcttagcggcaaaaataattaatgaaatttttttatatatccattacttatcgacttaaaagctaaataaaaaaaaactacattgagaaaactttgaaattaaatttaaaattttatagcgataggtcaaatgatgaggccctcgtcactaagcagtgggctgcttggacgtgatgcattcttccacgaacgccctgatttcaccaacgagcttccggtgatcgtcggcgaggaactccgggaagaagtagaaggagtggatggcctccgggaactccaccacccgcgccgccttccccttccgccgcagcatggcggcgtaccgccggtcccagtcctgcagcgggtcgagccccccgacgaccaccatcgccggcgggaacgcctcgtgcagttcggcgtcgtcgtcgtcgtctccggtgacgacgtgcgccgccgggtggttccggtcggccccctccggcaggaacgccttccacgacaggtccgaccgccgcgtgttcagcaccggcgccacgccgtcgagcgcgcgctcggattccgtccgctcctcgccgctgaagcacggctgtatgagtatcacgccggccaggtggacgacggggttatcggtcgtcgtcctcctcgtcctcgccgtggccgtccatcgctgggccacctggtgcgcgatgttgccgccggcgctgtct

SEQ ID NO: 84413 - DNA, 556 bp, Oryza sativa
catgcctgccattcttcctcacaacaattgaggttttgggttaaacagttccactgcaagaaactccacaactccctgaaaactttgtcggcgatgttcactgtttgcttcatctgcattgtttactacccgtacaacttgtgttaggacatggtttgtctcctcctgctctttgtttgcatgcatcgggagcctcttaagaacatggataagcccgcgtacaactctaacctggaaaatgcatagggtatccacagacactttaccaaccagcgctccaaggcccattacaccacccatctgagcttgccatgtgctaccataacaacaatgcaacaggcgtggcaataattcctcaaatactgcaacccgcacacttggaggaggagaataaactggattcaaagatggactagaaactaacatgggggtactaggaccacctcttagcataccagtatgcttcatgcgagcaagaaagagtagtgtctcaccaaaagtatttaaagcagacagagcagcttttgcatgttgacgattttcacttgagagtact

SEQ ID NO: 84414 - DNA, 2712 bp, Oryza sativa
gcagcagaacacatggcagacacaatgagaccttcaacaccgaaattgagaagaaagcttgcatattgcgtgtcagccaaaagggaactagctcattgaactcaatcattccatttggatcataagctgcagataagcaaatgtgagtaataataatttcacgtgcattatttacaattactggtaataatcaagaagagtacctggatggaaatcattctggaagatcttgccagtatttttagcaaataatattttgttaggagccctaccaccaatctgcaacatgtacgacatgaaacaggacagagccacttggattgcaaactgtttcttgaaggtccagaggtgattcccagttggtagaatcttatgcatgtattgagagaagatattatcattaacgatatttttagtaatttcattataggcttgcaagcgtaattccaccactgcttcaggggacacctgccctgagatggcttgatttagctgttctttgaaaattgtaataggtgaatcagcttctctattatgtcgggcacagttaatttcatacacctccaggaaagtgctgtacatcaaatcatcctctaccatccgaacctggatcaagggaaattaaacataaggccaggatattaccttggaagctgaaataaaacagctaaacatgattattatcaggtatggaagaatggaaggtatttcacctgtgaccaaacaggaataatgattggggtgtgaatagcaagatggcgctgcctcgactctttatgtttgtcaaacattttgtttagtacacggaatagctgcagcattctctcatcactccgggcatttggagtcaatgatgtctgaacaataaaatggcgctgtgaaccatcagagccaataagtgtcagacgtcggaagctactaccgtgcctccggacaataggaatatcaggtccaactctgtccaacttgacagtatgatcaggtgcaacctcctgcaaaagacaagtaaaacttaaaactagcacatagagaggtgaggaaccgtgcgagaagcataaaactttcacaagactggctaaccatccatatggtaagagataatgatgagtgacatattgacttcaatactgaggataaaaggtaatcactgtgaccaacctgatctgtgaagtactgcccgggaagttctatatcaacaacatggaagtccctgagaattttactttcttcctctagctttaaaattgcagggaaccgatcctcaacattactctgaagaacattcttccagtgcttcaatctctcagtgagttcagcaagtgttgctggaaaagtagtagcactttctgggtcaagatcacgttcaaaatcttgcttgtactccttgacaaaatcaacatgcttgttaacagcatcttgtgaaaagcaagctcggcatacaccagaaagttccttcttgagagattgtggaacctcgcctgtagttgcagttggatacttgtagcagcggtgaagcaatgcattaaccacagcaagaagtctttcctcgggaagagtaacaaatcttgatccaatttcagacagtaaaacctgaaaccagcaaaaataaaaatattagcatacttagaaacacaaacaacgaaagttctagcactagattgttgtttcttcatgtagatttcttcaagattctgtaatcccaacaattcaaatcaaatagtccctccagtcccattacaaacaatattagatttgttgtcttgtttgaaaatataaggcatacatttaaatttagtgcaagcctttcccccaagtctaaaagtatcccatcctctcttggactcctttaaacatttatgcttgacaaccaacacataccaccattttcgaagcacttaatggaagggcaataaagtcattctcttatggattcctacttcactttttgtccctggccaaaatatgccttactataggaaccaaagggcactgaatatgcatggaattctgttctcttaaatgccagctttgctacaaaataaaattcctggcaagcatgctaaaaatttctattgaaaaaaaggaatgggcaaagaaagaaatggcttattctataccattgtcatacacgttggcctgtatgtatggtaagactctaatttaataaaaaagtaatggtcgtagtcatctccaatttcctaaaggtttataaaccactttgttattacttcttacctcaagctcattggctagattggtatgcttgctcctaagagcttccattatatcctttgcagcatcaaatgcacttgctgcagaagttacccagccaagtccattattgcgtcttgctggcatttgcgaaccatctgcaccagtgaactcggttgaccttgatcatggccagcgcttgtaccaccctcaacattagatctgtctgactcttgtccttggagattacccccatcatgagaaactgccgcaccacctgactgggtagcttgatgaacttggttgtcagaagtcatgttcccacccccaagattagatgtcctcgcgttcccttcagataagttattggcagcattgtttgccagcatagcctgctgcatacgctgctgagctattcttcccatttcagtttttgtagcaacatcacgacgttccatcaagtatgtccgaagccaataatacaatgcctgcaagaaaacc

SEQ ID NO: 84415 - DNA, 734 bp, Oryza sativa
atgttaactaaaacaagtcccaactccaactagattaaacatgattcaacttagcacattttatccggtgaacaagaacagtacttagggacacatgcattcagtgtttcaaaagttaaatgtagatatattcataactactttcatgattttacaaaattattgtgttgtggagatggtgtctctatccaaactgttactcttttgtgactacagcagcatgccacaaatattgcttacatgcaagcattgcatacaactatatgtaagaaacatgtgggtgaaattctagttacctgtttgacagcttcatcgaacagttctcttgcccgctctaacttgcttctctgataccttcttacaaactttgtgaggtaggtcacccaaatgtctttaacatggggatatttaaaaattttcacaccacgctcatacactttaaacgcatcttcgaaatacttgttttcctgtggaaagaggaaatgtcatgatattagcatatgcacgataaaatagtttactcgaattttggaaatgcggagttaacaaataatcctacctcaagaagatatgcataattgagaactatttggggagtggcaattcgtaaatccaatattctctcataaactgcacgagttgattccaatgttccaagactttcctccaggtccacatagaagctccacagtttcagggatttatgtactttcaattggacaggttcatccccc

SEQ ID NO: 84416 - DNA, 516 bp, Oryza sativa
aaatgggctttacggaataaattgttgtctaccgtcattattgctttccttccgagagttccctttccccgtagtctcccttcatggcgtgattcaggtaccccgattgggcgaaggtcttcgataaattctacgcaaaattcggtgacctcctctgttccataacccttggcgatgcttgcctctggatgagcacggttacgaacatacttcttcaaaacgcccatgtacctctcgaaaggaaacatgttgtgtaggtacacaggcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctacgaaattgcgttcatgaatgcacatagctttgttattgttgcccggacatatgcttccgatcattacgttccatatctttcgacttttcgtatacaccta

SEQ ID NO: 84417 - DNA, 652 bp, Oryza sativa
ttcggaattaaaaataaggaatattagaagtagagtatagagtccatatagaaatacaattaggaaataatagaaattctgaattaaaaataagaaatattagaagtagagtatagagtccatatagaaatacaattaagaaaaaaaagaaattcagaattaaaaaataagaaatattagaagtagagtatagattccatataggaatttaaactaactaaaattcggaaaaaaaagagcctccacgttcgctgagcctccacgttcgctctcatggcctagaaattctcacattaatcggagaaaaagtaaaaaacagagttcatatataaatacaatttagaaatagctgaaattcggaattaaaaaataaggaatattagaagaggagactagtctatatagaaatacaatttagaaatagttgaaattcggaatttaaaaataaggaatattagaagaggagtatagagtccatatagaaatacaattaggaaataatagaaattcggaattaaaaataaggaatattagaagtagagtatagagtccatatagaaatacaattaggaaataaagaaattctgaattaaaaataagaaatattagaagtagagtacagagtccatatagaaatacaattaagaaaaaa

SEQ ID NO: 84418 - DNA, 844 bp, Oryza sativa
ggggagctcggtaattcgagaaattgatcttgaggagaggcgggtgtctgtacccgctccgtcgactcaggaacctttctaatgttgtgccagcaatgcatgacgttgcggtaccaacacctgttgttatctctcctgtggcaacaatgaatgaaagtgaagaacctattctacaggattcaacagaaattattgccacatcagaggaggagctgcaccagcctcaaacatataatgtgccagaataggaggcccctagaaggcctgaaagagtcgcatatcgaggatgatcccatctcatatgaagaggccatgagaagccatgaaagatgaaatgaaatcaatgaaattaaatgatgtctgggatttagaagaaattcctaaaggagccaaaacagtaggctgtaaatgggtctacaaaaccaaatatgactccagagggaatatagaaaagtttaaagtgcgacttgtggcaaaaaggcttcacgcaacaagaagggattgattacaatgagacattttctccagtctcttgtaaagattccttcaggattataatggcactagtggcacattatgatttggaattacatcagatggatgtaaaaacagaatttctaaatggtgatttggaggaaaaagtatacatggcgcaaccgaaaggttttgtcatgaaaggaaacgaaaatatgggatgccgtataaagagatccatttatgggttaaagaaaagcttcgagacaatgctacttgaagtttgatggaacaataaagaaatttgggttttcaagagaatgtggaggacaactgtattgattcaaagttaagaatgggagactcattt

SEQ ID NO: 84419 - DNA, 853 bp, Oryza sativa
tcgaattctgcgtgtgattcgatcaattggacacttaaaaaaagaacaaatataattaagccatacggttggagctatgctcctggacgaactgcttcatctcctccacgagcttgccggagtcggcgagctccgggaacgcgtggaagccatggatggcgtccgggtactccaccacccgcaccgccttccccttctcgcgcagcgccgccacgtacctcgcctgccatcccttgagcaggtcgaacccgccgatcaccaccatcgccggcgggaacgcctccgccagctcgacgcgctcgccgccgcacacgcgcgccgccgcgtggtcccgggtggcgccctccggcaggaactcccgccagaagtagtccgtcctcgccagcgacagcgagaggctcgccttgtcgagccccacctcctcctccgtccgctcctcgccgccgaagaagggcgatatcagcacggcgccggcgagccggagcgacgacgacggcgaggtggtggacgccgcccagcgctgggccacgtggtgcacgatgttcccgcccgcgctgtcgccggcgaggaagcagcgggagaggtcgacggcggcgccgagctcggcggcggcctccgcgaggccgttggcgtcgaggtagcggagcgcggcgaggccgtcgtcgtaggcggcggggaagcggtgctcgggggcgaggcggtagttcacggacaccaccacggctccgaccccgcgggagatgcggcggcagagcgcgtcgtaggggcgcgacgccgcggagaagagcacgaagccgccgccgtggaagtagacgacgaccgggagcttcaccgccgccgtgttcgtgggcgg

SEQ ID NO: 84420 - DNA, 2120 bp, Oryza sativa
atcccaagtttcaagcttatggccaatagtataccaccaaaaagatgcagaaccggtacacttattaatagcagccttaatcatttgagcattagagaaatcatactcatcaaattgtttgtctactgctagctcccaattaacataagcggcggaatcatacttaccatcaaaaactggcaatttagattctaccattgcaagatcattttcatgtacctcgtatgcaatgcgtgaaaaagtcgctatatctcgttgatggtgaagaagtcgaggttgagcataaccatctcgtttccccttgtgcaatcctgccatggttagtagcaaacaagaaacatacacaagaatatacacgctcctatcaactactaggtagtggcagctgaaatattacacacactcaagcttttcaccaagctcttacaagttcttaccaaagcaagcggaatgttaatgtacactgactcaaccaagcaccccaatggagtttagatgtatcgatgccttggcaaacatttactgtacggctgcaatcaaatctgtggagctctgggtaggcttaaatatgtagcaaaggaatagcaaatgctcaaagcaaagaatgcaaagttgaataattgttcaaagtcaagtaccgagctggtcctaggctagaacgtactagagacgcgagcctagacacaaacgataccacaagatagcactagaaacaactcatgcatgctctgatatataaaagaaatctcaatgatacaactgattttctcttttctttttcttctttatttttctttttttttctttttttcctttctctttttttggtgcggcttttgttttctctttttttagcacctttctgcctttttttttattttttttgattttttttaccaaaaaccgactcaaggacctcaatgtaaggtcaaagggactcaaatgtaaatatgaaaattacagggactcaactgtaaaagtccaaaccaaaattaaaaattatacaaaaatggaatgctcaagttatgtcggttccgtttttgcaaacggatcttgaatccgacaccaaaataaaatttcaccgaagtgtttaaccaacccagacagaaacaatcatgagggagtgtgaatcggactcacaagtctcggccacgagatgacgcaagggaaggaatcccactcggcctcggtttggaaaggtaccaggtgataaatagaaacatactcgacactaaatagaaaccaaaccagtcaatctaatctaatattctccttccatctttctcacgcgcacatgcacaagcgcaccatcacggcacagccaccaaacagaagctatgcaactcaagaactcaaaaactaaccgacagaaacttctgaaaactacgaaaaaagaaccgtggcagcgagccgattccgttttcgtagatcccgacgacaacagagacacgggggcggcgacgactatggtccaaaacgtgaccagaactcgaaactctaaatgaactagacgctaataccagcaacacgactcgacaatgcaacacaaaactcaacaacgcaaaaactgaaaagaacaatgcaaaggcacaaagatggctaggtataggatacaattttttttgttgggaaattttctggttataggtagataaaaactcaccgagcaacgaaagctctgataccacctgataaaccctgaattcctctcgaaactcaaggctgttgttggcccaatctttcggtgagttgtgataactacaatttggaagaaacgttgacgatccgactacaaccgtactagacgttgtgttgcgccttagcgatcgatacacctctccgtgggttgttgatcttgccggtgcagattaaccttattcctgcaagcaaatcgaagaaacaagcaagaacaagataaaagcaatatgaattgcaaataggaattgagcacaaatgataagttggggtttcgaatacaagcagacgacggtctagccgacacgcgcgctgcaaggaagtagcaatggctaaactttcatctaaacaaaacccgagataccctgaaggggtaccaagctatttatggagataggaggaccctaggtcgtcctccacttgat

SEQ ID NO: 84421 - DNA, 520 bp, Oryza sativa
acttgttttactgcagagatattagcggcagcacataaaggctcaaatgggatcaacctcttcactgacgagtgtgataagactgaatcattccttccatttggctctgggagtcgagcatgtgttgggcagaagtttgcggttcttgggatcgcaatgttgattgcttctctgcttcgcagttacgaggttagatgtgataattttttctgtatcttggcatggccatgtgaagagacacggccacgaactctgttatttattaccctaaaaaaactgttatttatttctattcactatgagctcagcgagtttctttagaacaattcctgactaaattatggttacaccccccttgagttataaaatttggcccttattaaggttgtattctaaacttgtgatgttgcttggaattcgaacctgcaggtccaacctcatccagctttatcccaagaaatggaatcattagttgacagcaacagccttcaccatattcccaacccaaagatcatcctca

SEQ ID NO: 84422 - DNA, 703 bp, Oryza sativa
cttgatatcttgttcatccatgatgtgagcaacggatgtatccgtagtagccatggtcacatcatcctccccttcttcacagaaaaccgtcctcggtttttccatatggtgctctttgcgtagtccatttacagcaacctgtttcttccaattaaaacaaggcaaactcgagacaatttggttagcaataacatttctctctagcttgtatgttttatccacatgtacaggaagttctaaatccgagcagatgtaaagtctatgcacaaaatatattccaagatcattatattcgccaaagatgtgaaatataacattggttggacatggcaaatcaaaatgagcaaatattttgtccttcaaacaattgagctcacaagaatcatcaaacagaatatagcccaatgtatttaaagaagattgcaattgaagttcatcattctcgctggacgtgtgaataacatgcttaaattaaattcagtacatggagaatcaagattaaacgtagcatgttcattcactagttgtggaatggatataagtgaaatactatcatacaactcttctttatcacaaggaatagaatgcaaatcaacttgtgacaaaggcaattcagaagtaggttccactaaagtttgctctaggtcagcatggaaagtggaaaaatgtaattcatcagaagcatactcacttgagtaatttt

SEQ ID NO: 84423 - DNA, 1836 bp, Oryza sativa
  unsure (1)..(1836): unsure at all n locations
aattaacaaattgagctaagcaacaccagctttattcaaggcacttatactgcttaccacctcctaacataggatggtgaggagtgctgctgataaacgctccacccggagtagatggacaccaagacgatctgcacggagattgtattctgagttccgagaaggcgagaacatgttattgtgatataaaagttagtgcctttgcagtaatgcacatacaagtccaagccactaaaggtttattaaggtccctgaaattacaagtagaagttgataaaaacagagcagctatccagtgctattacagttagtgtcaaatttcaaatgtacatgcaaacccatttcaaaggattgctgtgagagtaattttcccttaagaaatataactgaagatagtgtgtggagtcaaaattacaacagttctcatagatttatgaaaaatttctgatgtactccctccgtcccataaaaaaccaacctagtactggtgtgacacatcctagtactatgaatctagacatacctctgtccagattcgttgtactaaatgtgtcacatccagtcctagattcatttttttcgggatggagggagtaaaaggattagcagaatgtttactgaatggtagatagtactcgagtagtatttatttagtcaagataattcagaaatatttgtaacaagcactaatgctatataactagtagcatgtatgaagttactgggtcaacaaaagtgctagagaaggcatctgaaaagctgtttcaagacggtaagctcacattaatggcttatttatgtaaaactgattgaaatacggcactagaccattttactccagatgactaattgcttcatactgagttaaaaaccctacatattcagaacaaaagagtccaaacatctcccacaaggtgaactatacatgataagaaaaagaccaaccttatttgcgagctgtatagctttctggaacatatatctcccctccagcttcaccatgttgctccccactgattgttttccttgcagctgaaaactcagcactcatagcattcattccttgtatcaccgcttcctccactgtcccgtaaccatgttcatcagcatattttctaatatcctctgnnnnnnnnnnnnnnnnnnnnnnnnnnnnnnnnnnnnnnnnnnnnnnnnnnnnnnnggcaccctccgatggtaatgtttcatcatggaaagacatagcggtcacaggatccagagatagagcaaattgatccaaccatctaaactcaaatcttgccttgcttagtgtatcgtcccatgcttgtgcatagggatggccctttgccaaatcagcagcatgagcagaaattttgtaggatatcacgcctgtcttaacatcatcacggttaggcaatccaaggtgctcctttggtgttacataacagagaagtgcagtgccaagagccccaatgttggcagcaccaatggcgaggtgatgtgatcataaccaggtgcaatatcagttgtcagtggccccagtgtgtagaaaggtgcttcattgcaccactccagttgcttctccatgttttcaagaattttatgcatcggaatgtgccctgagccttcattcattacctaaaaattgagaaatgtcaaaaacactgcttgacaaggttaaaaaaaattgaattgtgtagctaatggaaacaaatcatcattcaggcacatcaccgttcaaagtttctactaccaaattattagggaaacaaaaacgattcatcatttagagcatgtcatttacaataaagagttttaaaccacatctctaacatcttctcatatgtttatctg

SEQ ID NO: 84424 - DNA, 1469 bp, Oryza sativa
taagttacaacttgtttttttttagtttgatttcttcatttacaaactctctttttgggacttccttttggactttaaagctttattttatttctgaaatgcaaatttccataattttgtttgaacttatggttactaggttgtgaaaagaaaatatttacttacattccaaccttgcggctttttttttgtccctcgacgcttcatttttcgtccacgtttcaactctatgttttgagttggattttatttatcttcgaacgttcttctctattaatggttttgatatgctatttggactttaaaactttgatttggtttctcacttaccggttgttttttaatcccttagtttcagcttggtattttcagtttgatttcttcaattacaaactttcttcttggaacttcactttcgactttatagcttacttttgctctaaaatctcattttccgtaattttctatgaatttacgcttactagttttttttttctgaaatcctaatttccgtaattttgtttgaattttttgttactattttgtgagaaatatttgcttgcatttcaaccttgcggcttttttgtctctcgacgcttcattttctgttctcgtaactttatgttttgagttggcttttatttatcttggaacgttcttctctattaatggttttgatctactatttgaacttttaaactttcatttggttattcacttaccggttgttttctaatccttgaatttcaactcgatattttcagtttgatttcttcaagtacaaactttcttcttggaacttccctttggactttaaatatttattttacttctaaaatgtcaattttttgtaatttcgtttgaacttatgtttactagtttgtgaaaataaaatatttgcttacatttcaaccttgcgtcttttttgaacgcttcattttctgtcctcgtttaaactttatgttttgagttggatatctttatcttcaattgttcttctctattgatggttttgatatgatatttcgattttaaaactttaatttggttcctcacttaccggttgttttttaacccttgtatttcaacttggtttttcagtttgatttattcaattacgaactctctttttggaacttccctgtggactttaaagcttcggtttacttctgaaatttcgtttttcgtaattttctatgaagttatgctttctagtttgggaaaataaaatatttgcttacttttcaaccttgcggctttgtttccctcgactcttcatttttcgtcctcctttaaactttatgttttgattttgatttcttttcttcaaacgttcttctctattgatggttttgatatgctatttggactttaaaactttaatttggttcctcacttaccgttcgttttttcatcctggaagtacaacttggtattttcggtctgattttttcaattacagactttct

SEQ ID NO: 84425 - DNA, 938 bp, Oryza sativa
atttaagataaatcaaataggtttaaattaaaaaggtattcaaataaagaaatttaaataaaattttaaaataggaatttgatatcaaaacaaaagagtttgaaattagaagaatttaggtcaaggtctcactgggatgggatctgtggttggagagacatgggtgcttgaagattgaaatggaaattaaaggaaaaagatttactttatagaagtggggcccacatgtcatatgtctcttcttcctccggttcttctctccttgcttcgttttcttcctctctgttagccagggaaccgagaggaggagaggaagggcgccgatgctgtggtggctaagatatgactgcgccggtagaggatggtgttcccgaacgatgcgcatccggggaagtcggtggttggcaaagggagtgaaggagatggccggaacggcgcaggcaagagtatagctctggcaacaagaggaggtggctgtggtggttggtttcggaagggtaaaggaaggggaaactaggaaaatgagttcacctcgtcgaggcaaacccgatggcgcaaggatttaattagtggaattccggtgagggagatcggccgacggtaggtggcagccggacatggcaggagagagagagagaggcagagctcgaagagctcgattggtgtgtggaaaatggagggggttcgtcttcttatataggcggtgagaggcggtggcgaatgacggttgcgaaggcagtcggcgacttggccacggtgacggtggcgtggagaagaggagcacggcgtcggcggcggcacatctggaaggggcgagacggcgacgacgctgtggttgcagacggcggcggcggcaggcccacagggaagaggaaggaggcggctcagctggggctgggtcgcttgggctgaggagggagatgggctgaggggagaag

SEQ ID NO: 84426 - DNA, 1034 bp, Oryza sativa
atgcattattcaattctttttcttttttgcgaggaaacattatttgatttcgaaagtgtacactgctactggagtgttgaaacctgaaaaatggaactgggagactgcatttctgttgctgtctcctgtggtttagcctttcatttgcaaagttattagttgagctacggcttatagaccgagtaatataatgatggtgataggtgaacaaaactacaaatttcgttaattcggattcttccaagtgaaccaaaatagtgtattcctttgatcacaaaataaccatcacaaaactgtcagcaattttgagcatatatttgcaatttgagctctgaaggtaatgagtagtggaaagcatgtacaatttgatcacaaggtctctcatcttgatctatttatcgttatccctttcttttaccaactcatttgtaccaaaagaatcaatcatatggcaactaaaaccccatatgaaaaaaaaaatcctgtcgctcacatccatgtagatcacctgacataatctgcaccgtcaagaaaatgagcatactgtgtcccattcagtttgttgctcacatcatcccagttcctgacaaggcctggaagaggactagtgtgaattttcacctgcctgctgaccagctttctcaccggaactccgaggaattcttgtacctggaacaatgcctgcattcatagagatgatattttagcaaagcgagggttatcattgatccttcgttacagcatttgaatatgttttagtacatttctgttgcggacaatatcctcgtagtagaggatcatgtgccgtgtggtgttgaagtggtccaagcaatctctgatgtatttctcggcatttctgatgtttggaatcagatttgacacatccagcaccggcttgaatttcgctaatatctcagcctgctcagaaaaaatatataagcatttcattttttttttcttccttgccaacatgattgatagtgatgttacatttctcttggaatggaaatatgtaggatttaagtttcaccaaa

SEQ ID NO: 84427 - DNA, 968 bp, Oryza sativa
tgcaatattacaaatgacacattcataaatgtaagtaatttatttttataataatgctattcatgaaaaagatcaagataaatttgttcccttatagctgcaattattgcaaagtatgtttcacagacacttatttaaactaattaaacaacgtatccacacatttaaatagaaagaaaggttatagtcgcgcgaacgcgcgacttaataagctagtcatatgtgaaaatggcacaaatgttctgaaaatttttgaaactttgcacatccatagtgtcgcaaaagttgtgataaaatgagaacttacgtgtatgcactagtaccaaaaccataactataaccacaaaacatacgattcagaaatgcagaaatcacagagaagccactctacggttgtgccttgaagattcctccatataattaatacaacccctagtgctgaagtaataatacagagacgaaactaattatgcatgtctaaaagttcttgttcagtttttcagggacggagagattgaccgactatgcatctcaacaaacacttattcagatgcattactaaaagtactttttttcagggacggagggcttaattacaatgacagatttattacaatactttactatccaagtttgccgcacctaggtttagtaagccgcaggtttttagccactcttggcccactctgttacagaaacagaggtatcactctagtccagaaagcaaagccgaccaagtcacctttactgagattaacgcaaaatcagtctttatttcttgagtatcatagccatggattttctccttgaaggaaacataatgctggtcgaaactggatggaaacgcgcccacttcgaacttcaaatctatgaaagaatccctccttacagcaaccaccgacctctttaaaccacgtgactcactgatgacaccatcaaagagacggatttccttatccaagttactg

SEQ ID NO: 84428 - DNA, 1870 bp, Oryza sativa
ccaaaagaagcagtctaacttgaaacatgtattacacattaaataggaagttgtttttagctgaatagtgtgagtgaagggaatttgaatttgtaatagaacttgagaatttacctgtaactgaacaaattttgcgttattcatgatcacgatgacctgcaaatctgacatcttttctgacaaggtcttgatggcaatatgctggaaaaacttctgcaagacaacttgctcgctaattgattcgttggaatcaatatcagcaaaccaaaatactcgactcaattttgtccatggaactgatagtttatgttcacctccaatgaatagataagagggatcagccaaattctgtagaatcttgaggcccttagtcactgaatcagactcgaatgaatgaggaccaggtgtacaggcaataatcttagtggggtcataatagttacaaagtttacaagcgaactgtaaacttttatcattcatgacaagaatatgcccatcaccagcagcaggcagcaaccttttacaacatactgaagtagctctgttttcctgagagcagattccagatgtgatagatgaagaaaccaaagagccagagtcatgtgaaaatgaacacgagttaccatttcgacaaccctgatcaaaataaacaacatgtcagaaatagaaaagaggataaaaaataccacacaagcgctttagggttcgaaagttatagcaactctttttgtttctaaaagtcgacatttgtacctgtaatgtgaggaagaacttgcatattggtcttggagcacgagaagaatgagaaaaatggcatgtatcacctcgattacaagatccattaagaaagaacacacacatctcattttccaacgctggttgaacataaccatgaactagttctctataagttaccctgtctgccgcagattgtgtcttcatctgtgaagaaaacaggaaccattattgatggttgcatatataatgtatttcatatatataagaataatcatatgcataaaacttataccgcacctccttgataagtgtcttcagtgttttaacaacagtagtggttccaaaatcagctggagaaacataaggggttgcagcacacctgcgatgtgaatccaagtgagaattctcagcttctaatggaagtgaattcacattctctagttccagcacttcatggcgaagacacatgtggtggaattcggaaggctgaaggtacattggaggatttattttcacaagaaaactaggtctaaatcggtgaagtgtgcccataatatcatcatctgttcaaaaggaagggttagcaacacatatatcatattggaaacacaataggacacatgcctcatactaggtatgtttctttacacaaagcacatttatacataactgcaaggtgcaccctttctactatgtcttgtacattttcaaaatcatattggaaaaccttacatggaaagtaagaaaggtaatcagcatatatttaaaaaatgtgaacatatgtgcaaccaaaatatacagcagatgaagagtgagattacctactgctacaagagtgcaattcacttcataaaatttttataatgaggtacaggtaaaggacgtacaaatttcagagatgtagttaagtgctgttggcacaaggttatgaaatgcacaccactcatcttcaggtttagcaacaaaaccattagatgccttcggttcatgagtgttcaccacatttatcagacaatccagacgatacttgtcctgcaacatatgaagacatcactttactaatgtaataaacatttccaaaagcagataaacaaaaataattgccctgagtcttatataataatgttttctg

SEQ ID NO: 84429 - DNA, 1116 bp, Oryza sativa
gtacgggggtcgtttcatgcttaacttcatggctcggtccttaattgaccagggacggcactagccttttccggataccacccaaatcctccgtccgccccagttatagttggccatatgggccgcccggcacggcacggcccaggcacgaccgggcctgggccgaggtcagtcgggccggcacggcccgacgaacaagccgtgccgtgccgtgccagcccacgggctacaaccacggcccaggcacggcccaagtagcctcgggccgtgccgggctggcccgacggcccggcaagcccatcgtgcccgtgccggcccaggcacgccctggcaaaaaaccccttcaaaggttcaattcaacacaacaaattgacataacacatcaaattcatgaaattcacatgtaattcatcaaataagtcaaagaatcacaaacaattcatcaagtcaccagtttatcaaatcatgcatacatcaagtcacagatttacaaacaaatgaacaattcttcaagtcaccaattcatcaagtcacagtctcatagatttacaatcagttcaaatcaattcatcaaatgcatacatcaagtcatctactataatccatcaagtccatctcagaatcacaaaccttagaaagttagaatataaaaggggtttatataagctgtgattgtgcaatggctgcctcattaaaaacctttctaggtaaaaactcacacctcgtgagaaaaccctagaaaggaaaagagtacagcccatagctaaaatgttcatatcaattacaatcatccagttcaagggtttacatcaatttcatcatcaagatacatattctcataagcattttgaagctccacattctcagtagtatgctgactttttgcatctgctagctcccagtccttgatcattgccagaatttccaccagcctagggtttagacgccgccgacggtcctcgatgatcctgccagttaagctaaaagtagactcggacgatatagtagaaacaggaacagtcataacatctttagctaagattgaaagaacaggataagttagtttgtgctgttgccaccaactaaggatattgaagtcatcatcatattggttga

SEQ ID NO: 84430 - DNA, 1210 bp, Oryza sativa
atcgactcaagcgtgaagatggttcagatgtcgacaattcttagaacatcgagcatcttcgtcgtttttatgcttagacattatttgtgtatactttttcctctttgactgccaacatcaagttgtttcttgaagttaccagtcgggggctatcataataatactggagtatgatttttatcaattcaatttgtttacttgatttatcattgtcttgtttgattttttggcttagttaatgaggacttagatttttttgacaacttttgcaggttctaagctcaataaggtttgacaaaaacgtttaagaaatcagcgactaaatttaaattatcaagcacagcataaatttatcagtattgtacagattgagcctccatcatcaaagattacatcatatggaatcaaccagactcagttttctcatcatcagacccagtctgaccaagattggtatcttgaaatctctctacaatgtctgcagcaattttgtcagcagccttttgggcatcattaatgatgtcaacggcatcttcttcgcttgttccatctgcaaagccatcaatggcatcaatatcgatcttcggatacaaggacttagtcatcgctagagccatggttgctcccatgcttccagcctccatgatattcttgaaacatgtgtccggagcagctctcaatttgtcgaagacttcaacagcatcgattgtactcgggccattgttattgtagaacatggcttggatcagcggtgtagcagcattggcgacttcatctctagcctcttcaagttttttaatcttggtaatcaagacatcaaactgagcctgtgatttaattttgcgatctgcatgaagcaattgtgttagcattgaggatgcggagacaagtctatttctggacttccgattgcaattaccttcgacatctttgatggccaagtctctttcctttgcgagatcacccttgtccttttcgagagctttgattcgtttctccagctcggtgatcttggcagcttggactattgtacatcttggcggttagctgagtacaaacaccaactcagaatgaattgagcaaggacagatgttaccttttgacgaaccagtcaactcgaagttgctatcttgaagctcatcactccgatccctgagatcgtgttcagttttcctggctagttacctagtttcatggagttgagctctga

SEQ ID NO: 84431 - DNA, 671 bp, Oryza sativa
tgtagactagccctcattgtaaaaagcatgtttcttttcttaggaagcgagaggcccatgtggtgacccctgaccagataaaaaggaggcccaggcctaggagagaggggatttgggatttttgggagagaagagcatgaactctctctcgctctcgagctctctgtattccttcacacacagatccaccagaacacaggagtagggtgttacgcttctcagcggcccgaacctgtctacgtcgcccgtgtcttgtgcgcttcctctctcgctgacgttcctcagatcgagggcgaagaatctcacttagcgcccccggccgaaccggcaaaggggggcctacgcggtctcccggtgaggagccccacgctccgtcatctggcgcgccaggtagggggcgcgcgtgtctttcgaagccctcgtcctctttcgtgtgcgccaagcttctcccgctcagcccaatggccgaacgggcagtggcgcacagcctctctccgagcgctagcggtgacgacggggagcagaacccgcgctgtcgggctcgcaccccaccgtccccctctcgccgaaatcttgggcggggggaggcgctcggggaggtcggaggatccgcgacttccccgcccgcgggcgacgggggaggatggcgagacggggcagggctgcaggaa

SEQ ID NO: 84432 - DNA, 3045 bp, Oryza sativa
ttcttgacactccgtccacttggcaacgaaatacgctaaagcttgggacttgatggaagtacatggcttgaaggatagatccagagacatcaactccaaagcccattttgcaatccgcccatttgcctcgcaattatgaagtatatctccgagtggaaacgatatgaccaccgtgaccgagtgactttgaaaataatgggataatttcctaacggtaattaaaacaccatataacaacttttgtacatgaggatatcttgtcgtggagtcggccaaaacctcgctaatgaagtaaatcggtcgttgaaccttttggacgtggccatcctcctctcgctcgacgaccatgaccgtgctcacaacttgagatgtcgccgacacatataataacaacgtctcttgcggatgtggtgatgctaggaccggcggagttgtgagaagtttcttgaaatcttcaaaggcttgctgggcctcgggtccccactggaaattgtcggtcttcttcaaaagcttgaaaaagggcatcccccgctcgccgagtcgtgagacaaaccggctgagcgccgccatacatccagtcggtttctgaaaatctttctgagaacttggcggtttcatgttaaggatggcatttattttctccgggttggcttgtaaacccctacgggataccataaagccaagcagcttccctgacagtactccgaaggtgcacttttcaagattcaactttatcccgaagaaacggatgctagcaaaggtctcttctagatcggcgatcagatcatccttctgcttggtcttgacaactacatcatcaacataagcttcaacattgcgaccaatctgagttgaaaaacatctatggatcatgcgttgataggttgctcccgcgttctttaatcaaaagggcatggtgatgtagcaataggccccaaaaggtgtgataaacgaggtcttcaagcagtcggattcctttaggttgatctgatgataacccgagtagcaatccaaaaagctgagtaactcgcagccaaccgttgagtcaactacctggtcaatgcgaggcaacccaaagggatctttaggacaatatttgttgaggtcggtgtaatcaacacatatatgccattgcatgtcttcttccaaaccaaaattgggtttgccagccagtcacggtgtaaatcttccttgatgaagccttcctgtcttgtgtgaaacgacggagtcgttgcttgatgggtttagcatcttctttaacatttaagaagtgctcaatcacctatctaggaataccaggcatatcagatggtttccacgcaaaagtatctttattagcttgaagaaaggtgatgagcgcgctttcctatttacaatctaactcagcgcctattacagcagttttggaaggatcagagggatcaaggggaaatttcttggtcttggcgtcgctttctccggtctttgatatcttgggtgcaggcacttctccttcggttgcagttgatgcagtcagttggatctcatcccgaacaagtgtaatctcatgcgtctgggccatctcacagctttccttgtcgcaggtgacggcttgcttgatgttgctccgcaaagatatgactcctcggggtcttggcatcttcatcatcatgtaggtatagtgtgggactgctatgaatttggctaacgccgggcgtccaagtatagcgtgataagtcgtcttgaaatcagcaacttcgaagcatatattctctgtacgaaagttctcccgagtgccgaaggtgaccagcagagtgatctggccgagtggagtagaagacagcccggggatgactccgtgaaagggcgcactactcggcttcagctcagtacgagggatttgtatatcgtccagagtcttggcgaaaagaatattgagtgcactgccaccatcaatgagggatcgtcggagcttgacgttgcgaaccactgggtctagtaccagggggtaccgccccgggtggaccactcggtcaggatgatccgagcggtcaaacttgattgctgtctctgaccaccgaagatattggggcgtatcgggctggacggcattgatctccctttcaattagcttttgcttccgcttggactcgtaagcttggggtccaccgaaagtatggttgaattccttgcgagagtcttggaaaccagtcggtccgtcatcttcgtcatccttcttttttgaagtgctttgttctccatcagtcggcttccgtgctttcttggcgtattgctctgcgaactgctgatagatgaagcaatctttggccgcatgatttgaattcgggtgatgtgagcactgagcattcatgatcttgtcgaaagtattgatgcgcgatctctatcgagaaaaaggtgctgtagttgccacaaggtcctcgggcttacgcttgcgatccttatggttggtacttccgctcccccctattgctggcgcatctttcttgggcttccaatcgcttcccgactgcttggacgcggtgacggcatcatcggctttggcgtactcattggctttttcaaacatctgcttgaatgtcctggaggcttgcgtccgaatttgccgactaagagttcatgacgaacacccttagtgaaatcggctatgatgacgtcgtcggtaatgtcagagatcttattgcgttgctcagaaaagcgttggatataatctcgaagggattcaccgggcatctggatcacgttgtagatgtcgcactgggtgccaggactttcgaaggtgccttgaaagttggcgatgaagtgttcgcgaagctctgcccaagatccaatcgtaccacagggtaacctgagaagccaggatcgagcagaatccgctaaagccactgacaggtaatttgccatggccttgctatctcctcctgctgcacgaattgcgagaccgtagacggtgagccaagactcaggatttgttttgccgtcatacttcacgatcccagtcggcttgaagccggccggccagtccactcgacgcaggtcacttgtgaa

SEQ ID NO: 84433 - DNA, 5242 bp, Oryza sativa
cgccgctcggtgctctgctcgccggcctgcgacgcggcccaccaactggaggtcgcccagcgcagggagcgcagggacgccgtgctcgccgcgcgccgcctcgccaagctgaacatccatgccgtttgatcaattcttgtactgtattagcgctcattgatttgatctcgtaattctcatatctgtatgttgacccgtgtcttttttttttcgactccccgtgtctataaactattattagtaaattactttcgtgccggcaatatcttttaattcttctcttgtgcattggggttgattaaccgcctaatgatgcaattttcatttcacaaagctaaagctattcatctacaggaacgtttagcagggctatagtttcagctttatctcttttgaagctaaaactcaactaaactgtttcagttttatcaaacaagaaagcggagtatagttatgcaaagttaagtgtgcgattttacagtttagtgtttccaatatttattatcggctttcgatgggtaccgatatgtttccgtcagtatagttggtttcaggttttccgatattttcaatatcgttttcgtttctagatttactattttcgattccgttttgaaaaaaaaattatggtcatgaaaatggttgagacgttttccgaccgttttcatcgctacgttacaccatgggcctgtcgttgtctaaagaagtatcacgattcaaagaattcacacaaattttactgtaaaaaagtggccatgatattttatttggagatttttagtaccgtggaattcatgtctgtagtcgacatacagacatgtactagactccaccagatttcgtttacatcagaaacttgctaaagaactcacagatgtgttcagaaacctcatcaggcttctcctggttgatgaagtggccaactccctccaggacaaccacatcctccagattcggcacattggctttgaatccacccttgtgaatgtaatccttcacacctggtgtgttgtatgtgagatccaggtcaccgacgatgaattttatcggaacatttatcagagccccagtccatggtgcagtcagctcccaatccctgcaagaacaatacatttggctgacgatgaacggcatgaacgaagcagtgaacgggaaaccatgagagtgagacatacaggtcaatgcatctgtagtagttgaatcctcctgtgaaccctgttttgccgaatttgtcagcgtagtaggaaatgtcttcctctgatagccatggagggcaagtaccatctgaatcaattgcatcaaagaatgtcttgtcctggggtagaataatagttgccggtttgcgcattccaaacaccattttaaacagatggtttaaatcgagtcgagcaaattcagcttcagccactccgggtttctgcatatgcatcaaaattcctataagcgtaatcgtttccaacaaaaacatcaatagctgatgcttcagaattcagatcactgcaggcagtggtggccacaaggatttgaattatgaatttatgattcaaatccaaaatttgaattgaccgtccaaatttgaatttcgacaggtaactgcacgcgttctttctgccttgctcacctggaagcggcacacgtagtgatcgtccccgcagagaaccctgacggcctggagcacgctcatccggggatgcctcggctggtactccacgctgaggctgacatgcgccgtcaccaggtccgcccggagcaggcacagctgccacgccacgacggcgccccagtcgtgccccgcgacgaacaccttgagagcaccaaccaaatcaccctcgagcaatcaaacaaacaatggggactgatgctgctaatgctactaactgctaataaggatggtaaaccgtaaacgtaaaccaacctggggccggccgaggtcggcgatgagggcgacgaggtcgccgacgaggtggaggacggtgtaggagtccctgccctgcggcgcgtcggagtcgccgtagccgcggaggtcgggcgccacggcgcggaacccccgcgcggcgagcgcgcgcatctggtggcgccacgagtaccagagctccgggaagccgtgcacgagcagcgccacgggcccgccctccggtcccgactccgccacgtgcagccgcaccccgctcgccacctccacctcgcggtgccgcaccgccgccgccgccatctcgtagagggctcctcctcgatcgatcgatcgatcggcgcgcgccgcggcgagcgtttgaaaatccagcccgtcctctgcctgctctgcctttgtagccgcgcgcgccggccgctcggcatcggtgtgtcagccagtttgggggaggcatctggttgtacggggcgaaaccggccagaggcagagccccgtcgtggtttccgccggcgcgaccggccggtggcttggggttcggcatctccgccgggattctccgtttgccggcgctggcgctcggtttcctcccgtgtaggtggtgctcgacgtggccccagtatacagccaggaatcgcttaggagagaatgggaccacatgtcagtgacagtttctgccgagaatcccatcccagattgtgcttctagtgctttttactcgctcggtaaaaaaaagaccaacttttaattactctctcggtttctaaatatttgatgccgttgatttttttaaatatgtttgaccattcgtcttattcaaaaaatttaagtaattattaattcttttcctgtcatttgattcattgttaaatatacttatatgtatatatatagttttatatatttcacaaaaattttttgaataagacgaacggtcaaacatatgctaaaaagtcaatggtgtcaaatatttagaaacagagggagtataaatctgagcatagctttaaatttatagattttagaaaattcagaagttaatttttttctggaacggagagtatagttctaagtggagaaaatatcagctctttagaataaacaatgcaaccaaaataatttgtgagtaaaatttttatatattatctatataattaacgattaataatcaatactacgatggaaaaaaaacctaaaatcaactccaaaattacattctgaaaatttaaattttgactatagttaataagctaagaggtaaatgagaaggtcagcgtatggaaccctggtgatgtcttacgtttattattctgtgctatatttcacatgaaataatacattactagttttaaatggacataacacaattcaatttgagttgaaattaatcccagcaaattcaggattccttcaaattttctggaatatttagcttccccaacgaaaaaaaaaaacttataacatcacatagctttataggagcctaggagagccattcttcaatcttcatcgcctttagtccacaatccaaactggttatgacacactatcggccatgtgaacagaaactgcttgattttgaaattcacaatatatttggaagatatcagtactggcataatggttctagtttttacagtacaattagcaagcaggctccaagagattttgcacatatcagaacttgctaaagaacccgcaaatatggtcggagacctcatcaggcttctcctggttgatgaaatgggcaacaccctccatgataaccacatcttcgagatttggcacacatgcctttagaccacccttgtggatgtaatcttttacacctggaatgttgtacgtaaggtcctgatctccaacgatgaattttgtcggaacttttattggaactccagtccatggtgcagtcagctcccagttcctgcatgaacagaaaactactgagggtgacatcataaatgactaaaatagctcaggtaaaagccttctttcattttaaattcttgaagacaccggcaccaatggaaatgtagttcagccatatatatcaaatttactgttgtttgaaaagaacatgtttcagtggagttagagccagcatttcgaatgactttccctgtacaatgctaaacaatatcatgttgctttcctcacttaacagcaatgaaggatgaataaaacaatgaactgtataaccaagagaattacaagtctatgcatctgtagtagttcaatcctccagtaaatccagtcttctcaaatttctcggcatagtaggaaatgtcttcttctgacagccatgcagggcaagtaccatctgaatcaattgagtcaaataaagtcttgcctgggggtataatcagaggtgctgccttgcgcattccatagaatttcttcaagagacactttatatcacctctaccaaattcagcttcggccactccaggtttctgcacacataattcggtaatttgtaagcataattatttccaacaaacaaaatataaaacgatgttaggatgacagattgttatcaaggataaacagctgattaaaactccagataccctttccctctgaataaacagtatggactgctgtattcaatatccaaaagggtaaagagaatgtcaagataaggctattaatatctgagacaggagtcatcaatgttcttcaagatcgactatactctcatgcttctgaataaactatttatagctccacataaaaaaagaatagttatagctctccaagcaggagttactgttatgttaagctcggcataatattggaatttagagctaccaagcatattacccaataggatcatgagaagaacatagttcaaaggatggccagtcttcagagaacaacatggttacttcgaagcaataattctttggacccttaagaacccagtaacttggcaatgcaatagggatacattccgatttccctacctaggatgttgaggtcattcaacattcgttgtaattaactaatctattcgttgtaatctatttcaattgagcaaagaattcaaatctaacccttctgaagtctcaatagtcaagaacacctacaactacaagtaatggggtttttttttggaaatactcaaaaggattgctcacctttgtattaagaggaataaaatttacaggaatgaccaaacaaagatgagagggagggggcggggagaaaaggaagggaaaaaaaaagaaggaaatggaaaacaaggacttgagcctactctcatgcagtcatgctcacaacgtgacgacctagcaaccaagaatgctactacctccgtttcaagttataagactt

SEQ ID NO: 84434 - DNA, 2011 bp, Oryza sativa
ggcagcagattgacagtgggtgctttttatttggcgggtactccatctaaggccatgtgtagtttctaaaacaaaaatcttcatcgtgtcacattaaatatttggacacatatataaagcatcaaatatataaaaaaccaattctacagtgcatcaagaaattgcaagacgaatcttctaagtctaatcgctccataatttgataatgtagcgctacagtaaacatttgctaatgagggagtaattaggcttaataaattcgtctcgcgggtcagaaaacggacgaaagagaagactaataaaaatcatcttaaatttttataatagataaagattttatacgagttaagtagaaggtacggtgcaataaaatataagtcaatgcacctagatttacacatttttcatccaaaaaaaattgtccaaattcatatggcaaaatttgctagggacatcgtaagaatgtgtatttgctctacggcatcacaaaaatctggtaattagctgctggacatcggcaggattattttattatttttggagaaataggagagagaaacaatcattaaagaccagtttgcccttggctcaaattaatccaatgtgggccccactgtgagcatgtcctcctcatgtcgctgtcataggtgaaccctacgtcggcgccgtcgagcgtgcaccttgctggcctccatgagaagtaggcgccaaaacggccgcaaccgcgcaccctgggcggcacgacagctgcggtggcgtcgatggcgcactcctcgatggcgtcaccggcgttgaacatgtcgatgagcccgacgggcgcgaacggaccacgaagagggaggtgacgctggcgatgcggaagcggcacatcttcccgggcaccacggtgaacaccgacggcgcgcagtccgggtgcgccatgttgcgcgacgccgccaccgtcgctggcaaggacgagcagttcatgaaccggcttgcgcccgttaatgagcagcgactgcggctcgccaacccagaccatgggcacggaggcgagccccgccgcctgctcatacgtgctccggtgccaccagtcgttgagcagcacggtgtgctgggcagcctcaacggcgatcatgcctttgagacccgccgagcgctacatccgtagtgggcgtggtacatgtacgtcccgggacggtcgacgatgaaggtgtaggtgaaggtgtcgccagggaggatggggcactgggtgacgccctgtcacgcccagaaattcccgaatagaattccaagcagaatgtgcattaaaatccccgtccaggaccggccggggtacacaaacgacaatgttgacattcagatccacgtcttacaaacatcataaaagtcttacataaatgcagcgaaaaaaatgaaagacaacaggagctaagccttgactagaactgcagcgggaacaccactccacaggcatcctcgacggcacggacgaagcctactcctcagagaaacctccatctgacacacactcgtactctggggttgggaaaaaaagagcaagactgagtactacccactgtacttagcaagttataccggaataggggtatgatgcagggaattatcaaaggagagctagagtggttcatttgcataaagcgagcatttataaacagaagttggaagatttaaaccgttgtaataattaatcaatattaatcatccactgtccaacgctatgccacgttgcgacaggcccaaccatccacctatactatccaaattctaaagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctaaccaagcacaccacacctcaggtttcacccccac

SEQ ID NO: 84435 - DNA, 597 bp, Oryza sativa
taagcatcatgctggacatccaacccctgcctatcgtccaaccttttggtcaccaacaattggtatgtgtttttgttgcatcatgactaatgcttgcatcatcatgttgtagtagttatatgttgtacgttttgttttacagtgcaaaatgtatagaaacaattactttgaggaggagggtatcgacctgcaaactggcaagaaggaagctgcacttgttggaaatctttgtgcatttcaattctggcagcgtatgtttaaggtatatcatatctgtaataatcatgttccttgtgcatatttacaggccttatgcagttaataattgattcaacatttatgtttcaggcgcatgtcaattgccatgtattaacatcatattccttcttttagtagttaaaacagttctctattagttccttttccagtaaatatctattaattggtgcgggactcttttccagaaaacattattatataagactcagggcaattatttttgtttatctgcttttggaaatgtttattacattagtaaagtgatgtcttcatatgttgcaggacaagtatcgtctggattgtctgataaatgtggtg

SEQ ID NO: 84436 - DNA, 504 bp, Oryza sativa
gatattgataaaagaaactgttcctttggtcaaaattgatgggaatgcttagactattgatgttaacagaaagtattgttatgctatataccctttgtataaatttctaatttggttccagcatttgctgcatcgcaggttgttgcagttaaacagcttgatctaaatgggcttcagggaaacagagaattccttgtggaggttctcatgctcagtctcttgcatcatcctaatttagtcaagttgtttggttactgtgtggatggagatcagcgcctgcttatttatgaatatatgccattgggatcactagaagaccgccttcacggttagtattttattggaaattgtataatatcctctgttagctcctagaaaaacctgaaagttccctaagaatctgtagttgtgttagaaaacattttatatttttcattgttacatcatcgtgatttaaagcacatctaaccacttgaacatggtgaaaagaactgtcttctaggt

SEQ ID NO: 84437 - DNA, 623 bp, Oryza sativa
atttgacatttttaaattgttcgggaggagtttgtttacacacatttgtataaatattgtacttgcaggtggtactggttgccgacaaggtgctttgtgagggtgaatggttgtcactgaatggttcgactggagaggtcattttgggcaagctgcctctatccccaccagcacttagtggtgatttgggagaattcatgtcttgggtggatgaagttaagaaactcaaggtaaaaatgtcccaacgaattattagaaaacaagttacatgagccaagattttcatgcttcctaagcagttcaaatctgactaaacgcatgtagttattcatcaattatattgttcttattttcatgtatgcctgatgttccaggtcaaggctaatgctgatactcctgcggatgcactgactgcaagaaataacggtgcggaagggattgggttgtgcagaacagaacacatggttggtacactgctttatcttattattcaaggcatcttgatggattaattctgacagctgtctctgctacatttgttctttagttcttctcttctgatgaaaggataaaggccatgagacagatgataatggcggaaacaattgaacacaggcagatag

SEQ ID NO: 84438 - DNA, 12079 bp, Oryza sativa
atgtggtggtctagtcaacaaacaaaaaaatacaaaaaaaaaatacaggttcacatgtcagagcctattaacctattcttctacctccatctcttatcccctttctctccttttctctctccatccttcttccatcctccacacctgagctcgatccgcgaggagagcggcggtggcggccttcccgagctccccaaggagagagacattaacacgggcctcagctcaaccgcaacaccagtggcctccccgagctccccgaggtcaacaggtgaggtcgaactcaagctcccttctcgccgcctaagtcaagctctgtcgcccctcgactggcggcgtcggcggcggagcacggggctttcggcattgtcattggcggagatgccgacgggccatgagaaaaagggaggagggccgaccggcgaccgtagcccccagatattgcgcggccgctcgacccgtcaaatccaacgccgtcactcgcctcagcttctccaccgcgcttccgcatgcgcctcgcacgtcggtatggacatcgatgccgatgcaagcaccctcaatgccaacgccgctcgggcctagcctacgccgtcagcttgtcgaccgcaacacctacaatggttatgccagttctgtgccaccaaatgccgtggaggatggccgatctatagtgggagagaacttggcaggagtggagggaggaaggcctaggacgaagagagggagcttgccggttgctttcgcctctcagcgagattatccaaagaggaagggagaagaagaagaatatatggactgactggtgggactccatgctgatgtagtgttcaactgtatcaaaactagtgtaataccgcttaggggggtaaaatatctggtattgatagttaaagggtgtattatacccggttttgtagttatggggtgtattttggacaaacataagagttcgagggtgcaaattggactttcccttcctaaaatatagctacctttctaattcaataatatattgagtaacaaaggtagctatactttgggatggagggcataacaatatatactaagtagacccttatcagcaaagggctaaatgggcctcgattatgatggttgatatgcttaaacaacaattattaatcacaacaagcagaataatataacaagagcttatagtttcctctatccatgccattgtgcaaccaccaattgtcaacatggccactctttgggtccaaggccatataatatatgcatttcacatatccatattatgagactcaaaaatagaatgggtgtcttttaaaaaagttcctttcaaaacaaccaaagcgaatacacatggcaataaaatttcaacatagcaaaacatactccctccaatcccaaatagcaagatatcgaaagcttaactcaataaaatatactcacttcattctcgaatagataagacgctttagaatgtgtggtcaaacatcaaaatctgaagtcaccagtatatcaaaagatatattcttattgaaaaaatattggcaattcatgtgttaaaatcacattagtagatccatatttcatatagttatatttttcaaaaatatatggtataaaagcagctgtagaacttgtgcgtcgaagaatgtcaatgcccaaaagggcaaagaaaagaacaaagagggctttgtaaggccaaatttctcctttccaccaagaaaaaaggcccatagtatccaaataaatgtaaaaaaattgtacaaatatcgagaatcgatccttggttgctgggttcaaatttcaaagctacatctagattagtgggaaattgtgcatagtaggaacgttaggcatacatgtgcattgtgtagtttcccctcactatgctgctccctacgaatacatcaatctacattctacaatactatttttcggtgtttccgacatgaattgttcgtttcctatcaataccgtcatgtttcctctcctatagttcctcttctgatattctgatagttccgataacgttttaatttctgctctacagattctggttccctgacggttttcacccctaatgttgactaatcactgaagtgaaaaacattgctaacactgcaccttcactagtcaccgatgaaaattagatttacaaaaaactgaatcataattactaaatgttgtgtagttttgactctgctagcatcatgactttaactggtgacaaggtatctcatatttattgtcaatagctaatacaggactaaaaatttgtatcaggcatgatccagtacatgctcaaaaccactcaaagaacacactgaaggctgagtaattaccccattgttttcgccaaggtgtttcccgttggagagttggttactgtcctcctgctctgctttcactttctttggtcttccccgcttcttccctgtattacttctgttgggttcattaagagaatccacaacttgattatccgatttttcagcaccatcatcattctgctcgtcgtgctattagcaaaatagcaatcagtcaattgaagcttcaagtcaacccaaaaaaaagacgcaccagacatcggtacaacgtaaaagaaacactgatacagcgatggtaacgacgacgaattcgggatgaaattagaagatttcagatctcgcaactattggagtgcaacaaaaatacgtggagaaattgcacgaatttagctcgccaagccattaattaattagtcaagcaatgctcaatttgtcacaaaaaccgcaactttccttattatcttggtacataaattgcctaataattttatcgcgcaccggtaggatagatagtcccatcctcaaatcaacagaaaatcttatgagtatatacccgatttttttactccaaaccaacccagtctcgcgccgaagagcgtacccgactttacgggctcctgctgctttcccccaaattttttttaaaaagaaaaaagaaaaaaaaagcggaggatgccaaaaggaaaaaaaaacgacagcgggaataacaaacagtagaggagcatacaaagatctaacttattatgcgtgcaaattcacaagatacagttcaatcgcagaaaaaaaacagaatgcagagaacggagagagaaacagattaaaagaaaggaacaaacggagagaggaatgaaagagccaaagaacaaaaaaggggatgattcccccacctcatcgtcgccgccgccatcatcgtcattatcagctccgctctcgcggtaggcaccaggcgccggcctcctctccctcagcgcccttccccccgccgccgccgccgccgccgggacgaccccgcgccgccgccgcggcccttggtctccgggccccgccgccggcgacgcgagggagcggccgcccctccccctgcccctgcccctgccccgtcgtcccctcggcctgcccctcccacgcttcgggtgcttgccgtctaccgcctcctccatctccatgcgagtcgagagcccgtgcacgcaggcagcaaggctagggcggaagctggtgttgagtcgtgcgtgcgaggggagaggggaggggattttttttttttgtttggtttggattttgaataggggacctcaggcggatcgaatggaaaggcgcccaatttaatgaggcgtcggcgctgggtccagtgagcgcggaagtcgaaccggtcgtcggaacaggaggtaggggcaaaatcgggcgggttatggtaatttgtatatctaacatagggcatgtttactttgttacaaaaaaaaattaccagattttggcattggttaccaaaattttggcaacttgccaaaattttggaattttggcatgatttcttatatagttaccaaaatttagcagcaaactaaatgtagccacttttttggcaactttaccaaaatttggtaaggttgaaaatggtatcaaagtgaacaggcccatagttcccaaattgatcatcatataatagaatttaaaatttcttaaattgatcatcatataaccgcatggatatggaattcatcataatacatgtaatgcgtaatgcagtatgggagaatatgtgcatgctaagatgtaattggtatgatgttttaatcgatgcatgcactatgggagaatatgtgcatggtatgttgattgatgtgatttaaattattcttggtcttggtgcataaacttatatgatcaatttaggaagaagggagtatatattttcccatcaaattcaaaaccgatataaataatccctgatataatcaaaaccgataaaaataatccccgataacatatcactgatcccactttttttcttactagaatcgaacgaatatctatttatgccatactaaatctaaggagtaaattagtgttaaaaacagagaaaaaaatttgtgtaatattacctatgagcttgcactaataagatagttgctgactgatggtggattcataatacatttttatatatatttgataatactagcaaaatgtccatgcgttgtaatgtcgtgttggataaagtttaactgaacgattttctaagcagtctagtatgacaaaaaataatcacaaaggttttctttttatttgaacaattattccacgtgtccgtgtatggtatgaactatattcctaacgcgtatcataatgattgtatcataggagcaacaaacggtgaaggccttcgatcactttcatgcaagagtagatggacgaaaatgtgtgattaacaaacaaaaatatgtatttaaaataaggtaagtttaataatcaggacggataaaaatacttttacatatttactcaatatttactcatagtcttataggggtgatgtgtgctttctcaatctatcaactctcatattgcaagcgtgcgatctcgttttcaaaatcataagtggacttgtgtggagactaatcgtgacacgtggatgatatatatagcgcgtagaccctaatatgtcatgtctcgtgaaaatttttatctaaaacaaatattagagtgaaagtttcggtgattacgatgtcaacaattgaaaaaaactaaaaaaaaatatcactcgtctatgaagtatgtacgtgtaccttaacaattattttttagcagaaatcaattcgatggattagcaaaatctagaaaattaactgcaattaacaagtctactataattgtagttttttttaaaaaaaatatgggttgcctagtcagatagggttatatctctcgctatacattacgattgaaaaaggttaatgaaaattctaacattgggatcactgtacaccataattaaaaagttaattaaaattttttattggttttagaccaaaagcccattcattctttcttttttagccctaggctagtctgctacctccttacactcggtctgcctccattcggcccattccacaagtggagcgacagcccaagctcatagccgactccgtcttcaacctccgaagataggatcgtgcccatacgatgccagagcagatcttccccatcaaatccggacgaattttcttgatatctcaaaattgatcgagagcttttgatccacttgttcccttctttatgttttttttctaaaatcagagcgtaaaactcgagataaaaaggaacgggaaaatcaccgatcggttatcaacggagattaaatctggcgaattaaagccaaatcaaaaggaaaatcatgaagaaaatgataacggaggaggaaatgcacgatcgatatggctgcggcactgagctaggattcaacccgagcggcggcgggaggcgcacagtgcaaaaaatagttcggatttgaaaatgaaaacaacaacaaaataaaccggatggaaaaaaaacaatggaccaaaataaacaggaagcttttttattaggtatatatatagatatagattttctgagtgatcaagtaatcgatcataattttccaacaattttaaattgctcaaaataatgccaaagaaaattctacaaatgactaaatgaattaaatcggcggaattaaataaaatcttattttggcccattacttccctaaccggcccaaaaaatcggcctggcccgtttaccgcgagtgcgcgggctgattgcacagcgaacagcccatttaccggcaacggccagacgcgggcgcactgagcgtggcgaagggtgcatggcccagttatcttctgcggcccaaagaccgcgtggcccaacagcggtggcgacctgacgcgggaccaatccgagtcgtccgatctgtttcgtccgatttgatggacggctcggattggttacacgccgatgaaattgccggccggaggggggaggggtctgaaaaccataaacctaatcccctttctcccctactctccccgatccaatctccggcgacacgagagagaggacagcggtgatccaatctttcatctctctcccttctccaccccagttgtcgatgaccagatcgaccaccggctccaagccgtcgttgctgctcacgtggatccaccgccggcgactggatcccgtcggatctccgcctccctctcgtgggccgcgtatccatccatcgacagcgacgggaggggcagatccggtgacctcttcccctcttgcatggattccgtcgtctctcgggagaagatttcagacaattcagaccatccgagaaaaatatgcataaacctctatacttagaaaagtttatacatataaattttcgtgtgtaaattttggtgtataatttttcgtttgtataaacttacttgaaaaaaaaaagatattgtagcagaacgtgcacacacttacccaaactgggttatcaaggcgtaatcacgcggcggacaggagtgcagtgcagtccatcttccatctgcatccaacagacgcaattattccttcttcaggtccactgtcgccggttgcctggctcaatgtttccaagaagaatatgtcttttggtccgctgtattatgttttttttttgaaactaggcatattatattaaattaaagggaaattaaaattatgattacaaccaacaatgctaacaaactctgccaaacataaaagtatatgaacgagcatcgaccatcatcttcattcttctggcaaatcctcaaagtggtgtcatcatataaattggtgatcggtgatccagaccctaaaactcatgttgtccactgaaccatcggaacccaacagagaagactttctttgttgatacctctgtgatcgaattaacagtagacaaagtgaaacgaaagataaaatacaaccaaatccaacttcaaaaacactatagacagcataccctagactttctaatataaatactgaaaacttgaagtgaaagaagccctaaaatttactatgtaattggtttgattgactcactgtataattctcaaattgctcataaatcttgaaagggaagagtataaattgttgcaaagttcaaatgttcacagttcttgcaaagtttaaatgtgcacaagccaaattgaagattccgaatgactaagtaccaaagacgccttacataggaataacccttatattgaggaattaagtacaaatggcaacattttaaagaggaaaagaacactacaatacttaaaccaaaatgtgtacccggagtttcgaaaaacaaaatgcacacccgcatcaagtccaccttatctttgatctctgaaatatcgatgcttttcaccaaatggacttcttccttcactaggaccataagcatgtagtgtatacatgcagggtagggtgtacacttctccgaggtaaccacggaaggaacggaattactaaatggcattcgatagattattaaggctaaaatcttacaaattaccactgagggatttgcttcacaattcatgctctttttctccagtgacaccttcttctccagctccgacacccccgatgaagacagtggagttaaggtttaaggtcctgggttgggtttggggatgggatggtggaggaagggggagagggaggagatcgtcgggcttaagggaatggctatgggaggcggtggacatgggcgagcggtaaggcgtcggcggtgccaaagccatagtgatagaggagggcggtagggtgggccggcattggtggcaagggggaaaccgaagcttgtggttaggaggaggtgattggtggtggcggatccattggcgggagccataggagatggggaagacaacagggcaggggaacctcacatctttagcttgagggatgtagatcctatgcagtgctgctgctgctgctacagtagcagtggctgacatgtggtgccagacacacaatgacatgtggggccggacacacacataagtgtctgttactactaacaatcctcactatagctagagcaggggaaggggagaatggaggaggaggaggaggaggcgggctaggagggacctcgccagtgccgatcgtgctttccggctagctgatgaggctgggcaacattggagcagaaggcgagggaatatattttttttttgggggggagaaggcgagggaatgttcgtggtggcaaggaaggagaaggataagagggaggggctagggttaggggagtccacacaaatcttaaaagcaatccaaaggtccaaatttataagatttggaggggggttttctcaaatagataaaccctaaaatgaaattctgcttttaaaagaaaagcccatagctaccctaagtaatgtaaaaccagtcatgagctcataatttggcagccccagaatgagacccttttttttttgtccaaaactctcacctcttgttttcagcgctcacgcttttcaaactgctaaacggtgcgtttttttacaaaaagtttctatacaaaagttgcttaaaaaaatcacattgatcctttttttaaaaaaatcagctaatacttaattaatcacgcgctaataaaccgctccgttttccatacatgggagatgggttcccaacacccaccatcaaacacagcctaaggataatcataaatttatcacatctcacattgctagaagtgtggcataccacagaccacacaattgttttttttttgatagaaccacacaattgttggtgtagacccaagaactatgtaagtgtggcaagacataaatatggggatgtttggttgcttactaactttgccaaatcacatattaggtaaggtgtggctgccacaaaatgtgtggctagcatgctagccacaatttagccaaagttagccaaacatacagacatgtggggccatatagagaaaaggtgtggctagccataattgagtcatcaactaaacaaatgactaaaaaactgtggcatgactcactttaggcatagcaagttgtggcatgcaaccaaacaaccccatagtaaccaaccaaaggttagactaaaaattgtacaccatatctaaggtttgacgtggcaaaacataacagccctgaacttcacaaaagaatgtatcatagaagctccacaactacaactgtatcgggcagctggcatcctccggtttacataagcagcctcagcgatgaagtgcggttgtacaatataatcagcttgagactcaccgtagcacctagaagttagtactatactccagatgtttcaacccaacaagaaacctaacagggtatcctacaaaatttgcttccacaaaagtaaatacgccatcgttacagctactacagattcgcttccacaagcaaatacaccattgttacagctgctagctaccactcaattcatatacattgaatacctaccgctgcaagcacactgaagataccactaccaggaagaaaaactgatatacagctcaaatctattgattggcaattgaaaccagattactagatggaagatatcacacacagcttaaaacagtccgaacaaacgtttccgctgctggctcatgctattttggggtgttctttgtggaggagtcacagatatcctgtccacgtttgctagtgcccacctgttgaaatcaggcgatgagaccagttgtttcatagctttatgtgtctcttctctagtgaatgctgcatattcctcctctgaaaactttttccgctcagggttagtgtggaaggtagaatagtagctatccgtagcaaggtcttgagacaatgtcttccttgatcctgtaaaagcaaaagattttaggtcattcaccaaacaataataccgaactatgacatcatacaggtaaaagaaatgacaaacccgtacgaagtgaatttctttttggtgtactcctcatgtattcaccatgaagcttgctaaatccatcttggtgagatccattcatgctggagtactcctcaccaaaaccttcatagccagtgggaacaatgttcgaaaatgccctgccaagagatacaatcaggtcattgatgtgttaaccatgttatcaaaagatttggtggtaacaaaatgaaatgcattcttaaggcaaagggacccattcatttggagaaactattatccacaaagacattattcagcgtcatctctacgaaacatagtgttataaatgtaaccaaaaggtttttgacaaagttgcatacattcaccatcacatctacaagataatacatttagaaagatacaaggactaagacatgaattatttcccagcatacccaattcctgtcagtgttccactttctattcacatctaaagtaattactctgatgttgcacaacatactacacacataggagaaaacatctattggacttagctgtgtgtgcactggccaagaataatcagcagatacaaataacaaagtgcactggctaaatctataaaagttaggaacccaaccataaacaatagaatatgaggaaccctgctcttacatagttacaatcaagtcaaattctccttgatgacaattgacaagggttatgatcaatgcgaaagtatgaggtgacttccctgataataagatatacgaatatattgcatcttaccttgataggcaccgtagaactcttgactttccctcaatcctagaaactgctttgatggctgtgcaaaataataatgctgaaaatgcaaagagatagtccaaagaactctacacggaaaaaaagaacaagcaaaagcttgtatgtcagttaacagataagcaaattattaggattgtcagtaaataacaggtcactataacaacttacctgcaggatcataactgcagaaataatcaagatagcccactcaacaaaataagccacaccagcatcaacagatccttcttctgttagcacaagcttacggacaccccagtaaccaaaccaggctccagctaagatcacacttacgagaaggaatacacctagctgcaataacatatattggatgttggtatgtcacagggaaaagagaaaatggaccttgaacgaatgatgcttttgaaagcattagcaatatatttatgggataatttgacagcagcatataaacttgaagggaatactaatgataaatcatggactatctctttatgggactattataaccagactatttatcaacaagaactggcagagacaagcataagtaaatatttgaagagaatatgagatattatcaaatttatacatcacagtaatctatgaaaacgaacttacaaaacacaagcagcaaactgcaaagttgaaaatattatacacttgtacctccataaaaggtaaagctctttcttccatatggcacatgtaattgaaggtggaaacagaagtagcaaatgaaccataagtaacctacaaggagaacttacatacaggattatgcatgtcttcggcaatcccaatttccacaagcacagaacgtaaaagtcccgacaaatagtgcaaaaaatatgtggtcatgccaacctgttttgagaaaacgtcatgaatcagtgttccaaggatatggcattgcaatcaaagcagaaacaagtcaaattgtatgaatactcacaagtgaagagtacacaaaaattgcaagagaactctttctaccagtgggt

SEQ ID NO: 84439 - DNA, 2281 bp, Oryza sativa
agttacggcggctggggtgcaatggggtggacgtcactacgtcgtggttgtgagagataacacatgcagttgtcagttccctcagctccatcacttgccatgctcccacatgataaccgtttgtaagttgcgaggtttggatgtggaggtggccccccgaatgtgttatgatgcttccaatagagctgtgcaggacacgtactcccctaggtttgaaccttacctagatccatcgcagtggccaagttatgatggagagttcttcgtttcggacttgtcattgaagaacaacactcggggaagaagaaggacaagaaggttcaagaacgacatggacaaagcgtacaaaggttcaggcaaccgctggtcacaaaagccaaacaatacaaattcagagccggtcatgcaaaatagatgttcgctgtgccacgaactaggccataagaaaactaggtgcccgaagcgagacaagtctaaggatcgaccgaaaaagtgccgtaggaccgggggaggtggtgagggtagcacacaggttggattggatcacattcatattttttaatgttgtaaatttagtttgtattacatttgttaagttgttattttggcttcaatgtttactttctattgttctcctttccgttctcattgtgatttttccatttaatttcattgcaattactgatgattccattttcatttacaggatggagcactttccggggttggaggatttctacgaggagaagcactgggctccccagattgtgagcggagaggttagcatcaacaatattccatttgttttcacaacccttgtatatgtcatattgtcgctaactatatgtaattatgtttgtctactgatgcagcgcctgaagacccttcgagtcagaggtcacacgacacacatactgttcgacgaccggtacgtcccgtacttatggtgggcgaagctcttggcgttcatgaccatggcgcagcgaccggtgcctctgtacaacaccgctgctctgacggccctcgtggaccggtggcgtccagagacacacaccgctgctctgacggtcactctaaagtacgtcgccatgatcttgggtcttcctatccggggtcaggcggtcacaggtgacacagcgtcagggaactagaggcagagggtcgatgagtaccttggcgtggagcctccagtggcacctgacggtcagaggcagatgaagacttcaggggttcctttaagttggttgcgtgccaacttcggtcagtgtcccaccgaggcagacgaggccacggtgcagcgatactgtagggcgtacatcctgtacatcttcggcaatattctgttccctgactccagtggagacatggcctcttggatgtggcttccgttactcgcggactgggacgaggctggtaccttcagctgggggtctgctgccctagcctggctgtaccggcaactatgtgatgcctgccgaaggcaaggcggggaagcgaacctagcaggctgtgtttggttgatacaggttagttcacgcatgttctgttttgtaacatttcaatttcttgcttaaaagttgtaaaataacgtatgtgacgcaggtttggatgtggacgaggcttcctgttggtcggcccatgtggaggacccatcaggtttggccgcatcaggatgccgaccgacatcccactgtagctcacatgtgggaattggtcccatctccagtactaggccgcaggaatttggcctattaccactacacaaatgagatggactacctacagccagaacttgtaaggaaatcaccgttctatcgcacatgaaaatattttcttactatatagtactaaatgtgattcaatgtttttttattgttgttgctgcaggtggtatggatgccatatgaggcacaagaagtgctcgagctggaactaaatcccatgtgccatatagaggatgcgttgaagaccctttggtgcccactgatctgcttctatgcagtggagttccagatgtgcaaccgcgtgatgcggcagttcgggaggcttcaaacaatcccgcaccgtttctccacaagtatcgacttacacaagttagtaattttggttaagaattttttttgcatgcagagttattttcatgtcaacatttctgacatattcgagattgatattttgcatatgtgtggggtggaccgtcggaagaacaagaaggtcactgattgggcctattaccatttagatcatatcacacaacgggagaagttcgaggagaatgcag

SEQ ID NO: 84440 - DNA, 812 bp, Oryza sativa
acgacgcaggcgggctccttcgcaggactggaggtacacccccgatgtgcctcgtgctcgcactagaggtaggaggaggtgagtgcatggttcgttggatggatggatggactttatgcatggttcgatcaatggactacgacttttgctcgttgtgtatggatggatggatggaatgtttttatttcttatatgtatggacttaatgtatgcatggattgatggattctctgaatgtatggaatgaggttggacttgatgtatggatgtatggatatagcctgtgatgtgaataaattactgcctggatgtgtggttgtgttaagcaggactgggcagagagctgtgctgcttattacagcaggtctagaacctcagcgctaggcaaaatggcgctgacatactccaggcctgcgccagatgccttggcgctgagctcctagcccagccatccagaaggcttgctgggctgggccatggccgagctggctaagtccaacctcagcgccaggtgccttggcgctgaggttcccagggccagcgccattatggctggcgctgacatcccagcccgcaagccatccagaaggcttgctgggctgggtcatggccgagccggctaagtccaacctcagcgccaggtgggcgccgaggtgcccagggccagcgccattatggctggcgctgacgtcccagcccgcaagccatccagaaggcttgctgggctgggctatggccgagcttgctaagtcccatctcagtgccagggtgcgtggcgctgatgtacctagtctcagtgccatttctgttgg

SEQ ID NO: 84441 - DNA, 3231 bp, Oryza sativa
gggaggaattcgaatcccggccgtctcgagcgcagcgcgggcgggagagagagggagtgggcgcgggggacacgggcgtgggtggcgacgtgggcgacgtggcccggaagacgcgggagcgagggcgcggcggcgccggctggaggttgggggggacccgataggtaggccccacctgtcggcgaccccaggagagaggaggggggcggccggctcagctgtgcctcggccttcggccggcccagtgggaagggggaggaaggagagaatgggccggtggccctttccgaaaagaaaaagagggaaaaagaaagaaaaagaaggaaaagaatttccagggaattaaatattgcttgttctcatttttaattggttaaaattatttctagagctctgaaaattccactaaaaatcttgttagcgtatttcgacatgtagaactcaggaaaaatcccacatgccagttccgattattatttgcattaattccttcaaggtttctctcttgcttttacaccggtattttcttgagaccatttataacttcaatttaggcttgggaaagaacttcaggtgtgacaaacctaaccccttaaacggaatcttggccccgagattcggaagagctggcgaagaggtgcggatgggcggccttcaactcatcttccctttcccaggttgcttcttcctctgagtggtggctccaccgaatcctgcagaatctagtgaccttgtttctagtcctcctttcactggtctcaagaatgcgaactggcttttccacataagttagatcttattgaatgtcaatgtgctccgaatcggcttgttcttcgggtaccctcaagcacttcattaactgggacacatggaacacgtcatggataccgatcatgttggatggaagttctagctgataggcaacttctcctcttcgttccaagattttgtatggccctaggaagcgtggtgccaacttgcctttcgtctggaaacggtgcactccccggagcggggtgacacggaggtacacataatcccctgcttcaaaagtgaactcccttcggcggttgtccgcgtagcttttctgtcgagactaagcaattctcagcctctctctgacggttctgactttctcttctgcttccgttaacacttctgttccgaacagttggcgttcacctgtttgatcccagaagagaggtgtgcagcacttccggccatacaacacttcgaacggtgccatttgtagactggcctgataactgttgttgtaagagaaccccgcataaggcagactcatatcccaagctccaccaaaatcgagcacacaggctcgcagcatatccttcaagatttgattgaccctctcggtctagccatctgtctacgggtggtaggctgtgctgaaattcaaacgggtccccaattcttcctgcagcttctgccaaaattttgaggtgaattgactccctcgatcagatacaatcttcttgggtaccccatgcagacacatgatccttgctaagtacagctctaccaatttctttcccgtatacgtggtatgcaccggaatgaaatgggcaactttagtgagacaatccacgactacccagattgaatcgtggctagatgatgtcctgggcagacctgttatgaaatccattccaatctcttcccatttccattccgggatctgaagagggtgtaacaatcctgcgggcctctgatgttctaccttaactcgctggcaaacatcgcagagtgcgacaaattcagctatttctctcctcatactagccctccaaaacttttctttgaggtcttggtacattttggtactgcctgggtgaatggagtactgagtctggtgagcctcggtgagtatcagatcctttagttccttgtcatcaggtacgcacaatctttctcccaaccagattgtgccgtgttcatcttcatggaaatcccgggcttttccgaccctcatattctttttcagctctgctatttcaggatcatttacctaagctgctctgacttgatccacgagcgtaggtcgtgcctctagggcagccacgtacccgtgttctacaagtcccaaattgaggtgttcaagctcctgctgcaattccttacacatgtcttcggcgcataaagcattgcagtagctcttcctacttaatgcatctgccaccacattggctttgcccggatggtagtgaatgctcatgtcataatccttgataaactccaaccatcttcgctatcggagatttagatcaggttgggtgaagacatatttcagactcttgtgatccgtatatacttcgcagcggttgccaatcagatagtgcctccagatcttcaaagcatgaaccaccgctgccaattctaagtcatgtgttggatagttccttcatgtggacgcaactgccgcgaggcataagcgaccactctgccctcttgcattagaacacatccaagcccgtgacgggatgcgtcgcaatagacttggaagtctttcgtctgatcgggtagaatcagaactggagcagacactaatttcttcttgagctcctcaaaactcttgtcacactcagctgtccacttgaatttctcgtctttcttaagaaactgagtcataggtctggcaatcctagagaaattttcaatgaaccgacggtaataacccgcaagtccaaggaaactccgaatctgtgacactgtcttaggcggtgtccacttggtgactgactccacattcgatggatcgactgccacgccctgagctgtaatgacgtgacccaagaatttgacctctgataaccaaaagtcgcctttgctgaacttggcataaagctggtgctcctgcaacttctcgagtaccagacgaagatgttgctcatgctcttcttccgacttggaatagattagaatgtcatcaatgaataccacaacaaacttatccaaaaattccatgaacactttgttcatcaggttcatgaagaatgtaggtgcattggtgagtccaaaagacataaccgtgcactcatacaacccataccgagtggtgaaggctatcttgggaatatcctcttcccgaattctcaactggtgatagcctgatcgcaggtctattttggaaaacaccttggctcctttcagctgatcaaatagatcatcaatccgcggcaaaggatatttgttcttgattgtgacctcattgag

SEQ ID NO: 84442 - DNA, 1936 bp, Oryza sativa
ggtcatcgtcgattccttgctgcaaaccacccagtacggaagaaaggcaagcactttgaacataaggcggaccaccatacgaagcctaaacatcgcagcgggaaaacagtgtttgctatggttaaagatcttaaagtagtgttcggaaaggggtctggaagccagcctatagagagcgaagatggtcacgcggcgatgtggaaaaagaactctatattttgggagttaccctattgggaattcttggacgtccgccacgcaatcgacgtgatgcacctcactaagaacctttgcgtaaaccttcttggcttcctaggtatatatggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaatgtctggatactccacgaatatcaagcgaataataagcacgaaggagaagaagttcacaaacctaaagtctcatgaccatcacgtgttgatgacacaactgctactagttgtaataaggggtatccttccagacaatgtccgggcaacaataacaaaactatgtgctttcatgaacgcaatttcgcagaaggtcatcgatctggatagattagaagcccttcagaatgttgtggtgcaatgtcttgtctgtattgagttgatatttccaccttcatttttcaatataatgacgcatctgctttgtcactttgtcaaagagatcagtattctcgggcctgtgtacctacacaacatgtttcctttcgagaggtacatgggcgttctgaagaagtatattcgtaaccgtgctcgtccagaggcaagcatcgccaaggggtatggaacagaggaggtcatcgaattttgcatagaatttattgaagaccttcgcccaattgaggtacctgaatcacgccatgaagggagactacggggaaagggaactctcggaaggaaagcaataatgacggtagacaacaatttattccgtaaagcccatttcacggttctgcaacaatcttcattggtagctccttacatcaaggagcacttggctctagttcgcgccagaaacatcggtaagtccgatgcatgtattacacggcatcacattgatactttctccgcatggctacgacaacatctcatgggtaacgagacgatcaaccaacaactagccttcctggcgaggggaccatctgggtcgatcgcgacattccagggatatgagatcaatgggtacacattctacacgagagcccaagacatgaagagcacgaaccaaaacatcgctgttcgtatcgatgccatgggacacgatggaacaactggcacgtatttctgtgccatcgaggacatatgggaacttgactatggtcctctcaaggtccctctgttccggtgccaatgggttaggttgactggtggaggcgtaatgattgatgacagtgggatgacaacggttgaccttaacaaggttggatactcggacgaaccttttgtccttgccaatgatgtaacgcaagtcttttacatgaaggacatgtctagcaaaggaaagaagggcagagggcctgacgagccgaagcatcatgtggttctcccaggcaaaagaaaaatcgtcggagttgaggacaagactgacgaggattaagatcagttggatgggcaatcccctttcatggtgacgattgaccctagcatcctcctatcaaatgaagacaccccttactcacgtagcgatcacaaggagggaacaatagtgaagagaaagtacgtgcggtcaaccgtcaccgtcgatgtattggcgtaattattgtgtacacgatgtaaactat

SEQ ID NO: 84443 - DNA, 1870 bp, Oryza sativa
tggattccccgacgacaaaatactcgacgatttcggctgtggggagatttaacccgaccgaaatatgtctttcgacgagatcggaaccatcatcgccaactattcgatctgtcaagatcgaccaaacttcaagacatcatctccgcggatcacgtcaattttaaggttgtcagtcatggtgcttcgtcgtagattgaacaacctcgccgccgcgaaggatgtggacgccaaacttttcgtcgtgttacaaccaaccgagtctgattactgtgaggctaatccgagcagatatatgctttgattaaactccatctcggactcgcgatttgctaaacagacgaaaaactatgacgcattgcttcgctgacttgctgtgatcaagtcagattaatctgatggcatagcatgcttacgataggaccgtgtacagtaatctgatgccataggtacgagtgcatacgtacagaggtggaccatctacacgtgctgatagctgaggataatccagatcaactaagaggtaattagtaggattaaattttaaattaatctactgattttgtagatatatctaacatatatctacacaggtacgtaatattttatatacaatttatcatgcatattttcagatcatacaatattgtcagatcaatgatttattatgtttacctagagcatgttctttatacaatatctattatgcaagcattccctatattaggccgactacggtctaatactgggggctcgctctattccttttatataaatcatacttgtttacggtttacataatatctgatatttaatctgctcgttatatcctgataatactaaaagattcatgccgttttttagtacatactcgatattctctgctatatattgtcttctagaaaatatttttcaggaacaattgagcactcgagtaggttgtggccaagtacacccattatcaagaacgttctcgaaaaatgctgagttgtcgcacccaactcctggttatcgaccagacaattgtagcgacatctcgccgcctatcaatttaaattcacttatattccaatgaactccatatatcgttgtcaaaggctccatatctttacggtcttacactgggatcgaccaagtgagtacggtaaatattgataagaggagtcacagataacaagagatactctcacgaatacggtttgtttccgtatgcctctcaattgcctataggtgatcgagatacgcttacacctggtcatcaaccagtagatagtagcgatctctcaccaccaaaaatccattttcaggtgatcgagatacacctactcctggtccttgaccagtcggttccaacaatctctcgacatctaacgtgataatcaacatgattgtgatagcgacagccaagaccgactagatcgccgttgtcaccaggacgacaacgtctaggactaatgacaccaagacgacaacggacaaggttaacgacatcacgacatcacacgatgacgacgaaactctagatccccggacttctagagagcccgaggacgaggtagtaggtccaggagccgaacctccaactacgataattcctcattgtcttcgttgtcatcaggagacagttctcgcaggtcacgagaatgtcgtctatctattactctggattccatacaagtggtcaaggtacgactacgactggtctttgggcctgtttgggggagcttaagattctgagaagcagctgctgagaagctacctggtgagaatctagagaagctgggaaacccagcttctggcttctaattcatttttccagattctacaactacagattctcagaatctgggtaaaaagctagactgtttggggg

SEQ ID NO: 84444 - DNA, 582 bp, Oryza sativa
ttgacatgttaaatctgccctttacgtcaagatcttattgcatctaaatatattaagcttctgtttggtatattctatttgttttaatatattaacgtagagttgtatcggagtattagccgatacatgctagatctatctgatcggctatgctatgaacatatatagtcttgttgttaatatatatttcgatctaagtgattaatactgtctcggcacggcgaccgatctatcccaatcacttgatttaagtatatatcgacaccaggattatatattgttaatatctacagccgatcgagtagatttaattctttattatctattcataattgccgattgatttacatatgacattggctcaaagataaatgatacgtcatcggcacctagctgaccggctatcatttatgtacttaaccacggtctcttttgtctttatttcttgttgattgcaggatcaaatcaactggcatgctagcatacctaaaggcaagttttggacctgcactggagttaagcagatcccccaggcctcgtgtttttcatcaacatgcttttggcacgcctggtgggacctat

SEQ ID NO: 84445 - DNA, 865 bp, Oryza sativa
gaggccgcgctaccgccgccggctccgtgtcaccctcatcccccaccgccgccgcctcagcgtcacccgccggccaccgccgccgcagctccgtgtccgcctcccgcccgtgagagaggaatagtgagagagagagaagagaagagagaggaagagtgagagagaggaagagtatgacatgtaggtcccgttatttttttaatgaatagaatgctgactcagctgccacgcgtacgccacgtagaccaaaaccaccgtggattgggtcgagagggtaattcgtccggtttgcatagttgggggtgaagaatgtccggttttgtgattcaggggggtaattcagacgactgtgatagttcgggggaggtaattcgtactttttccttctaaatatcatccacaactggactcatgttgtgagtacgaccatataattaataatgtgaaataccatccacaactttagtattttgacagtgtatgtttctaaaacaataggtggttgacacaatttctaagtgttttcttttccagttttctaacttttttttgaccaagagttttctaaagaggagagcatatatccttgaggtttcatagcacacctcatttcggtgattgcattaatttctatccataaacgacacgacttgaaattcattgcttttaaacaatagtattaatcttcctattgtgcttcttcatcggcatgtcatcgcaaatcccaaagcaatttacataaaaatgtactatattatactccctcaatctacttttgatagacatatttccaaatctgaaaaatttagttttgatagacatatttcaatccaaccacctatcctcttattgactttctcggatt

SEQ ID NO: 84446 - DNA, 657 bp, Oryza sativa
aagctctttgggtcttgccacaccacgtggaagtggggggacattgacgggaatgaccatcgacatgagcccgtctatgaaagaatcgcaagccgttgttacgtatatccttctctttaaatcatgcagtcaaaccctacgcagaacctctgaatcgatctgtcagaagatcagtcattggggctttgctgctgctttgcatgagccaatcataattcgagggctgcagatggaagagaagtggcgtaccttaacaatcattaaacacctgcagaatgaaaatttcatacgcatacgaaacaatagacacattccttcgttcacaaaataaactgactgatgagttcgttctgtgtgagaaatatacttacttcacaaagatgccaaagttctacgcgccactgttggagactatattgttgtagttcgcgacatgaagctcaacgacagaaggtggaaccgcatgtgcaagactgcgtagagcttctctcaaatcatctttctcaattgtggcactcccgtccctatcgtatctgtcgataatgccctgcatgttgccaccaagaacataaattagcccgataggtaacactcactgaaagtacagactagtaggcatcatgacacctattgattaattgagcaccatataatctt

SEQ ID NO: 84447 - DNA, 7072 bp, Oryza sativa
agttctcaaaacatatgcttcctgcactgggcaattgataaatccttccagatgctccatcatgttcgggcaaagctctcctactgctgtccaaaatcagataaagcagaccctgcagataagtaactcctttgaagataaatatttgggctttccgacgcctgagggaagaatgaccaaaggaaaattcaaaagcctccaagagagattatggaagagaattatgctgtggggtgagaactttctgtcaaccgggggggggaaggagattttgattaaagctgtcctacaggccatgcctgtttatgttatgggactcttcaagctcccggagtcggtctgcgaggaattgacaaaactggttcgtaatttctggtggggagcagagaaagggaagaggagaacgcactggaaatcctgggactgtttgattgatcagaagttaaagggaggtatggggtttagggattttaggctgtttaatcaggcgcttctagctagacaagcctagagattgtttgacagacgggacagtctctgtgctagaattttgaaggccaagtactatccgaacggttctctcattgatacaagttttggaggaaatgcctctccaggctggagagcgatcgaatatggtttagaattactaaagaagggcatcatatggcacattggcaatggtaaatcagtcagattgtggaaggatccctggattccgcggagctattcaagaagacccatctcagctaaaagaaattgcagactgagatgggtttcagacctgattgatcagtccgggtcttgggataatgacaaaatctcacaccatttcctgcccatggacgctgaggccatcctaaacattcatttatcttcaaggctggaggaggacttcattgcttggcatccggatagactggggagattttctgtcaggagtgcttatcatttggcagtagctctagcacaggttaatgatggctcgagttcatccgggaatggaagtagcagagcttgtaatgccctttggaaatgcaatgcgccccaaaaggtgaagatttttgcctggcgagctattactaacagccttacaacattggaaaataagaagaagaggaagcttgaagtttcagacatctgcaccatttgtggggtggagtcagaatatgttgtccacgctttgtttcactgcccacatgcccggcaactctgggaagcgatgagtgatgatatgcagcttaaccctctcagcaacattcacaatggagattcgaaagtgatcctggacctgttggagcagtcgcagccgaaggatcaggttatgcttttaatggtactgtggcgaatctggcacacacggaatgaaatagtgcatggcaaaccagccccaggaatactagtgtccaaacgtttcattgaaagctatgtcctctcccttgctgagatcaagcaacacccccaagcaaatcctgaaaaggggaaacatgttgtggatgtggtcctaaagaagtcgcacagcatcaaacggagtcgagaacctgctcctgacaaatggtcgaagccgctcccaggaagcatgaagctgaatgttgatggctcattccaggagagtgaaggcaagggtggtataggcgctgtgttgcgcaactgcacaggagaggttatttttgctgcttgtggacatgttgatcactgtagcagtgctttggaaatggaactcctcgcctccagggatggtcttgccctcgccctacaatggaccctgctaccaatagtgattgagacagactgcttggcgatggtccatcttttccgcgatgctacaggagctaaatcggagctagcgtttttaatcacggagatagattctctcttggtgggaaatagggatattagctttaataagtgtcttagaagtcaaaatcttattagtcactgtttagcaaataagggccgttgtgacaagatcacacagttctggccggacaataagtgtacttttatctcacagtttatatgtgaggaggctaatgagtaattatccctttcccctgcaaaaaaaaagaaggtacccgtgagatgcaagacttggcaataatcttgtgtataactttgttatattcatgtggatatttgtgtgtgcatgagtatatgtgcacgtcttacttgtacttagaaaaacatcttaattgtatcgttacgtacctttttataatgtcgacgacaactaagatggtgacaacaatattggaccatgtgcgcaacaatgggataaagctactaaggacatctatattgtagtgaaaaagcaggtaataaacaataatatatgctttcttgttagcatacgttgtggtgcctaataatagctactatcaagtactccctcatttcctaaatgtttgacgctgttgacttttttaaacatgtttaaccatttgtcttattcaaaaacttttgtgaaatatgtaaaactatacgtatacattaaagtatatttaacaatgaatcaaatgataggaaaagaattaataattacttaaaatttttaaataagatgaacgatcaaacatgtttagaaaagtcaacggtgtcaaacattttgggatggagggagtagtatgcttgctaccaataataagcaggtcaaatatgttatttgtacacctcgaatacatggaatggatgaattttgtttgtgtacgggtccaccttatttaccacaatgggcatcaaattttgtagtgtgtatcaagttactattacttgataatggaacacactattaccaccaacctagacaagatacattgctgttgttttaaaggggataaattgtgtgtgtgtggtgagtggacggagaaggaggagggtttttgcgtgtgtggagctaaaggcaatagttagctctaagacatcataggcaactttgcgacggtgtaaaagcttggaagaaaaataattgtgattgtgcgagttacaaggctatgataaaaaaagcgatattatagaccaggtattttcttccaatttaactattagctggaccattctatataaattatataagactattaatttttaaagggttcttataaagaaaaattaattaaaaaactcacatgttctatagaaaatctgaagggcatggtcgaaagcttgtttataggtctaaaacttgtgtgaaatattggttcatagtattttttttctcgagtttggctggaaaagagaccattaagacaagagaataaaaatctcctaccaaggccataaaaaaggcaatgaagttgtgctcgcctcatcttaagaacgcgaagcggtagctcactgagattccagcgtatttagtttaagaaaagtagggttgttcggaggctcttatttctccagtaaaaggtagtccctttatttgtaccttgttttgaaaacgaaacacattgccctctagcgagcgctagaacaccacttacctcttttagagcacatatattgctatgttgcctcattatccccttcctcctctatggcgaccgctctccttggcagcgagctcccacaagatcatggcatattgcctcaatcagagcctccttagcagtagccggtcgacgaggtgtcagctatgagacttgtatggctttgatcctgttggatcttggattggtcgcactagatgttgcagcgtacgtgcagactcgagtagtggacgttagcttggttacttctttcctttcgtttcataaaaaaaaaacttcttactatcagttactttttactctttctcttatgagacggccatcctatagcctcctagggcacattgtcagcttcatcggcggtgataacctagtggagtattcatttcaggggacaacggcatttctgcttgataatcccctaatgctcttctattttcggtgaataaatttattgtatgcagtattgtttatcatacccaaacactcttttataggggtaataaaaatatgattttatttttagttagcatcaaattacacgtgggaatattttagttgcgaaaacagttactaatgaccaaaacaaaccttaaattatgtatatcctaggaagattgagctgtttatatggcaatctgtggttcaaggcctccagtccagacttgtttagttttaaacctaaattttacttctcaatctgaatattttagccatgttagctggattgacatggcgaaacaaagcttcaatgtgatgtagctggtatggcaagtttgttttgtcacgccacccaggctgacgcgacaacataaaattgtctgtgttgttttgccgtataatcgggatggcgtgattaaaagtttgagattttaaaaataaaggcttcattggttcgtctaataagttaaagcaaaaccaaaatttgaattttcaaacttgatgtagaagatgattttaagatatttataacgcatttttttatattgacttttaagtcattaagaacaaatataaaatttttatgtacaaattaatttttattctataacaagtcatttttaaaaataaaaaaaggttaaaaaaattaaaaaatagcccatcgagaggcataagtaaagtgtgagccgtggacgggccttgtcctattggggttgggccgcagcccacaaggggtgcctcgaacgtcgcatcccgtaggatgatccaacggccggggcacttgcataaagccgaagctcccacccctcatctcccctcgccgcagccacaccctctccaaaattcaaatttctccctcctcttccccaccccaccccccgctcccctcaaaatttccaaatcccacgccatatcgcacagattttgaattcccctcctcctcctcgccgccgccgccgccgccatgtcgtcgcggcaggacaaggagaagtcggtgaacgtccaggtcctcctccgctgcaggtacgcccgccgcgcgccctcccagatctccccagatccgccgcccctaacttcccctctctcccgcgcaggccgttcagcgacgacgaggtccgcagcaacgcgccccaggtcatcacctgcaacgactaccagcgggaggtcgccgtcacgcagaccatcgccggcaagcagatcgaccgtgtcttcaccttcgacaaggtcgcttcccatctcctcccagatctgccaaaattttaaatactggatgcctcggtttacctgctcttgtgctctagttttagtaccctttcaaacttttaaattatttggatgattccaaattctgcgaaatgcgtaccgaggttttcgtgattggtccggcgatttggacggtaactattcagtggctagggtttcttaggtgcattccaacgggctgaatctgcatttggctggagttggttcgcaattaataaagcatctggtttatacaagataatataagaaaaaaaaacaacacaggaatgtgtttccccttgttggagttgctgtggaatttatttcatttccggtttggccgcacagtacagagttctaatatgcagccgtttttctttcaggtgtttggcccgacagcgaagcagagagacttgtatgaccaagcgattatccctattgtaaatgaagtcctcgagggtttcaattgcaccatcttcgcttatggccagaccggcacgggaaaaacatacaccatggagggtgaatgcaggagagccaaggcaagcctacgctgctgttgctctttcatcatgtgtttgcctctaccaaagggttgcttattgtttgttttcctttcgtcgaaatacttgcagagtggtccaaagggtcagttgcctgctgatgctggagtcattcctagggcagttaagcaaatatttgacacactggagagccagaatacggagtacagtgttaaggtcacattcctcgagctgtacaatgaggaaataactgatcttcttgcgccagaggagatatctaaggctgcccttgaagaacggcagaagaagcccttacctcttatggaggacgggaaaggcggggtgcttgtgagaggcctggaggaagagatagttacgaacgctagcgaaatattctctcttttggaaagaggatctgcaaagcgccgtactgcagagactctgttgaacaagcaatccaggttaatccttacctttgtctttttaaactttggtttgctcatctcaagaaactctgtgtgcttattaccatatatgtaacatttcagtcgttcacactccctattctcaatcaccattcacataaaagaggctactcctgaaggagaagaattgataaaatgtgggaagcttaatttggttgacctggctggatcagagaatatctcccgttctggagctagggaggtaggtgtataaccagctagaatgctactatttcatttaacattcatttatgttttggatattttattatactattaagttagacacttgagcctgattgtagggacgagctagagaggctggtgaaataaacaaaagcttgcttactttaggtcgcgttattacagccttggtcgagcaccttggacatgttccttacaggtaagtggttaaaataccttgcaacagtaatctatttggccttttgtgctaactgattcgatctttcttacctttcagggacagtaagcttacaaggttgctccgtgattcactaggagggaggaccaaaacttgcattattgctactgtttcaccctccgtgcattgtctagaggaaacattgagcactttagattatgctcaccgagcaaagagcatcaaaaacaggcccgaggtgatctagcttcattttctcacatctacagtcaatgtgctgatagcagtgtggtgtgtaaacagaacagcttaaaatagtagtaatcgctttattcatattggctaaacaattgtacaaaaacaagtaaataattcaaataggaggtgcctagtacataccaaaattataatgggtttgacgagtacaagctgaaaatttttattaactccttaaagcttgtaattgcatagtgtggcctgctattagggctgcaggaa

SEQ ID NO: 84448 - DNA, 669 bp, Oryza sativa
gttactgtcgaagagaaagttgtagaagcctgaatatagcagccccctggcagatgcatataccagctttacattcctagttattggctgcaacggcagaagtgtatctgttggcgagtcgaagctcctccatagatgctggccttcaggatccatgacaacaaggtttccattgttgagaagctctgctcggtcggctcgagtggctgttgtgttggtgctccatacaactttgccattgtagtcaagaagggccaaggtgccgtccttctggaaggtgagcctggaaccctttccgttcaccggagcatcgcggttcgccgtccaagcgaccgtcttctccgacgacctggagaaccagatggagaaggtgaatgcgttggtggccaccctgtagaatccgcaggagaagtcgccattgggggacactaggatggtggtggtgtcatcctgggttgaaatggatgaacgtctagcaatgaaggcttgggttgaaatggatgaacgtctagcaaggaagggttttctatgatttgcaagagcaattgttggcatgagaaggaagaatattgtggtgaaaatgtagacgcctctcatggctatgacaacatagaaagcaattgcctatgatcatctaacgcaaatgggaaccaatgtgctgtagtccat

SEQ ID NO: 84449 - DNA, 998 bp, Oryza sativa
tgcacgagttctgatttggaatataagcatctataaatagttattctacctgtataatgcatcatcctttatgttacaattctttgaagtctgaaacggtcattgttctttgcaggggtttatgtgaagacattctcagctaatgtcaagaatgatcaacctatattgacaataagtccgttacattttaagatgcaagaaaaagttgctcatgatggtagtgaattaggaagtcaagaagcgaacatttggaggaaaactagcatcccttcagaaaatagagatccctttcaggaagctcattttggtaacaatgatgatgttctgagcacagatgttgataacacttctgaatccatattggaacataagattctcattaaacagtggcttgttgggcaacttaaagatatgggcttacacgttgggaactctgagataagtccagtagttttaccaaccaaagttttgctccattttgaagcagtagaccaaaagcataacaggggaaaagaatttctatacctgctaaaggttggctttgaaaattctagctacagcaattcgcaaggcaatgctgagctttcttggagcattcaaactgatgatctagaaaacttggaattaaaatttgggaggttggagctgggtgagcctgaattttttaattctgtattagatgatgggttcagcaatgggttcaagctgactcgatcttctttaggctggatggagaatgcaatgtcagatgtcacaaaaagtatttactttcattgctaagttccttaattttatttgctctttttatctcgtaaagtatcacatttcttatttcttaatccatgtttatcatcattttctttgtaaagggctatctgttctcttatcgtcaactagtctgaggttatttgaccagctaaagctccccttccctggtcatgttcttgtccttggacctcgagtaagtaatagtatctggtttgctttatgggttgtat

SEQ ID NO: 84450 - DNA, 1042 bp, Oryza sativa
atagttgatgcccggccaagagcaaatgctttagcaaatggtgcaaagggaggtggctcagagtcagcatcaaactacccaagatctgaggtatattctgtatatattaactttttttatataccatacaatttctttacaattattttttctctgtttatctggatcctggaccaggttctctttttaggaatacaaaatatccacacaatgagagatagtctttttcgccttagggactatgttgatacccatggatcagtatcatcaaatggaacatcatcagctgtatctcttgttggagaccgggtaagcctatggtttgtcttgttgaactaccacttgcagtatacatttccttgatctaaggttagattatgcttgtgccaggccagttgtaggcttctccatacgtgggcttggtgccagccttttcttacgtatctgaatccattacctgcctccctagctgcaatttacattgtttagttaaatatgtactatgaagtagcttcttaagttagaacttgggaccctttatttctgaattagaaatatagtacacattatgaattttttgactaacggaagacatgtaaagttggtccggataagtcccaagtgttacttttatcatactgaaatgcctataagttcattaatgacaaaacagaagaagaggagattgacgatctttttttctcacagagaaatcgtggatcaacctggggtggagggaatctgaatagcatgacacaattttcttcaatgttaggggagtggctaaaccatatccagagtatcatggtcggtgcttcgtggattgctgcacaaattgtccaagaatcagcttctgttctcgtccattgcaggtttttttttcttcaccagcttctggagatgctctaattgaattggtttacttattagtaaagggagaatgcagagaatgttttttgcacctacattcttacctgggcacctgacatttagttgagtctgtaggctaggtttgtaattgctggctgataagggctgcagg

SEQ ID NO: 84451 - DNA, 682 bp, Oryza sativa
attcctgcagcccctccgagcttctggtggcagcttccataagcatcgtaatccattctatgatccattaaagcataatggtcccctagtgccacctgctgcagcacttgctcctaccctttggccccaattttatttgagatggacatgccccattgaatctcaaggtggtgatcttgaatctcaatggcatgccatgaataaaaagtacacagaagcaatgaaggtaactaagtatagatctttatgtatacctttaatcattttgttgctgtatgtcgagtcatcatagtattttttttgtttgatttgatcacacaatctttaggaagttgcatggagcaagactaaagacataaatttatggtttgagataggataaccatcataaaagggacactgggatgttttttttttaaaaaaaattgctttgtgtgtcagacatccatcctgatgtttatttcttgttttgttttctcttgtaatggacaggcaaaggacacagctgaatcaagggtaaaagatattaaaacgaagatggaatctatgcaattagaattacagagggagaagcgtgcaagtagttcagccttggccatggctcaacgtgctcaaagggagagcgttgccatcagaaaggcagtgcgatcgttgggctgtacggttaatttcggcacgaatg

SEQ ID NO: 84452 - DNA, 625 bp, Oryza sativa
aatgcaatgtcagatgtcacaaaaagtatttactttcattgctaagttccttaattttatttgctctttttatctcgtaaagtatcacatttcttatttcttaatccatgtttatcatcattttctttgtaaagggctatctgttctcttatcgtcaactagtctgaggttatttgaccagctaaagctccccttccctggtcatgttcttgtccttggacctcgagtaagtaatagtatctggtttgctttatgggttgtatgattttaaatcctacttaaacctaaggattgtttaattcttatatttttgtgaactctttctctgtttcagggttctgggaaaactgctttggttagggctgctgcaaaatactttgaagaccataaagagatattggctcatgtgtaaacatctcaatctttttattcagagttatgcagttgtttataaaaaaaaagttgggggcaccttaagttatatcattaaaatgttgatttgtccttgtgagcagaatatatatagattgttccaaacttacagtgggcaaggctaaggagacaaagcaaacaattgaagatagcatttctgaagctctgcttcacgcaccttcagttatcttat

SEQ ID NO: 84453 - DNA, 685 bp, Oryza sativa
tgctttaccatggaacatcttcaaaaaattaatcatgatttgacaagcttattgtaacatgaatgacgtcccagtgtcatttaacatgaatgagttgacagcattgctttactagcatttttttatttggtggaataagatatatttcaatattgaaatgcaaatgctaacacattagatattccaatgaaaaaaaaaaaactataaccatagaaatcgtctcacctgagccaacctctcgtcacgcctggcaatcttcctctcacgactggccttgctcttggcacgcttagcctcaaactggtcagagagtgtcttctctcttgccttctcagccttagacttgtggatactttccatgagaacacgcttgttcttgaacatgttacccttgaccttcatgtacatgtcatgatacatgtgcttgtcaatcttcttggcctcacgatacttgcgcagcaaacgcctgagcacacgcatcctcctcatccacaggatcttggtggggagcctagcctccctggtacccctacgcttacctgcaaaatggcagaataaggaatacgcagagacattttcacactaaaataacaatgaacttaattgtacacaacgcaccatagccagagtgacgtcccttctgcttggcctcatgggctctccgtgcacgggacctggagtgaat

SEQ ID NO: 84454 - DNA, 703 bp, Oryza sativa
cgaccactaagacaagctggaaatccccaaaacaacacaaaggtagaactcgaaggtagaatggctactcacttgaggcagttgtagtcacttcgacctccgcatcaagagtttggtcctcgacgtcatgtgggacgtgtggttcaaactcgaataccggaattatcgccagtgactcgggctgcccgcgctgctggacatcctcgtcatcagcatctctacagtcgacaagaaaaaacttccgagatcaacggtgaacaaggatgataatcacacgcacgaaggcaaccagagttcaagatttacaagtcacaaaaaatacaagaagtcctactcttcaaaaagggggaggacagactcccccaggtcatcgacttcttccatcaccttcttacgcgtgtcgcttgccgccccctgatccaagatctcgcgcatatcgagttcaggacgcgacaacctcacacacgcgaggacatgacacgccccggtatagatgccgttggacgtctcctccgcgatcctggccgtatgcttggaggggatttccccatcgccgtcgccagctccgcaagagaagaggtcaacgagaactcgtcggggttcgccgggatcgtggacttgatgccgcactcctcggcaagctggtggagaccggtgtaggtgacccgcagcgacccccggatctcggagaggtcatccccca

SEQ ID NO: 84455 - DNA, 1278 bp, Oryza sativa
tacattacaccacgtcgaacaagcccaacgcagacatcctgaactacaccggttcattatgtaaagttaattaaggagcaggactaatcatggtgaaactggtcgatcgctcataactattcgactagttttactttggccagcgatgtatagttgtactcacaagacacaatcccctgtcatgtcaccatgcttggcttgacacatcaccatgcgagtgattgtgacaagacccttcacataacttacctcaagccatttacatcacactgcaggtttcgcccctacccttggcgccactaagggatggcagtgccaggggccacccctatctcttcgactcgacgaagcctgatgattgggaggcagggaggtggaatccctggcaccgaactcacctcccatggccaacgcatctggtggcagcaccaacaaccataaagaaaacaagaggaaaggcaaggttgtagttggtttccgatagaggtgaaaacagatcggataatatccgatccgatccgctctgaatccgtccgaaacaaggatatagtatgggcttttagaaatccagtggatatggatgtggatgcggatagtatgatgcggatgcggatatggtatctctaaaatccggcagatgtggattatccgacattttggtcggattatccgataggtcgtttgccaaataatccgaaattatcaacatatgcaaccactctatctattgtatataacataagttggtacatccaatgggctaattcatcaattaacatagtttttttagtctaagagcttttatcgtctcatatcacactcgcgtagctactccctccaagttgataatacttgtcgttttggacaaggacacggtctccaaaaagcaactttgacaattattttccattataatatgtatgaaagtgttaacaaatatatgattgtattaaagtactttttaagactaatctatacaagtagtcaccatatttgaaagacaaatattttgaaaatgattcataatcaaagattataaagtttgacctcacccttatctaaaactacaagtattatcagcccggagggagtatattttatattatggacatcatgtatgttgtttagcacttaatcatataattattacgatgggtcatttattgattatagtattattgttccttgcattgctaactcgatgttgcattgattgcatatacacgtaacatcagataaatttaatccatttcccaaattggatcttggcctcaactg

SEQ ID NO: 84456 - DNA, 587 bp, Oryza sativa
cattttaagatcttgagttcaaatctctataagatcgaatattcggattggattatttgagggctaagttttaataggctaagtttctaatttaaaaagattgtatatatccagagtaaaagaatacccttctaaaaaaatgacatcatcaacgttccccactccctgagcatctctgaacatccatgcaaaacgattcaaaagtggttgattattaagcatccttgcataacaaatttagtctgtgaaacatccatgaatcatgtagtggtatatgtttacacagctctgatcgctaagctagcatggaaggatgattattaaacatgcttaataattttataatgctatattttactaccaagcttcacccaactctgtttgatcaaagtagcaaccggttggtccatcctgagggagcagagctgccttgaccgcacctctcgcgccttctttaggagggatgatccctggtttccagttgatctccgtgttgacaaatccaaggtgaacgcagttgatgcgcatctccgggtgcctcttggccaggatcctggtgtagaggttgacgacggtcttggacatgc

SEQ ID NO: 84457 - DNA, 501 bp, Oryza sativa
tgctacagagttcttgaagtgattcttttcccctgttcttttggtaaaaaagaaggatggatcctggcacttttgtgttgattatcgccatctaaatgctataacagtcaaaaataactatcccttgcccgttattgatgaattgttggatgaactcaatggagcgcagtggttcactaagcttgatttacgctctggttaccaccaaattcgtatgcaagtgcaagatgaacataagacagctttcaagacacataatgaacactatgaattttgtgtgattccttttggtttaaccagtgcaccagccacttttcagggcgtcatgaacagcattctgcacccttggcttcgccgctttgtgttagtctttgtggatgacattttgatttatagttctactcttgaggagcatattcaacacttgagaactgtgttccaggttttgcttaagcatcagctcaaggtgaaacgtagcaagtgttcttttggccagcaacg

SEQ ID NO: 84458 - DNA, 3146 bp, Oryza sativa
aacataccccgccaattggaaggattcggccagttaatgttacttcacccgtcatcgcaaggtccttcttaacaggttttcccatagctaaggacaacattgatgtgatcatggtgcatccagcactggggccatccttaggggtggaccctgctggaacatgcaagtgtacctttgagtttgcaaagaacagattttctggctctttatctagtaatatagctctaccaacagtatgcgcaatctgagcactttctttcatgacatctccaagctggccggtcatcacaagtgcacctttcccatctccttcctccactttcgttgtttcaatgtataaagtagaaccacccatagcagtccaagctaaacccatgacaactccaacaggagtctgctcatatattcgctcagcttggaaaacaggtttcccaacataatctccaaggtttgacgaatcaattactaccttctcaactgccttatcagctgactcttccttggctccctccatatccttgttgccctacataacacaacagtaagcaattttctttcaaggtgagctataaccttgtaatgaattaatgacaaactatactgagccatagattatatttgtatgtttattaagctatcaaggtcgaatttatatgtttgacaaattacttaacgcttgcatccatggttttcagagccaacacagtagccagggaatgaaaaacaacgataatatccagtattctagacactggaactttgtcaaccataaatatagacaagacaatcacaaaacatgtacctcccaggtaagctactataggtcaaatgtcagtcatacaatagatttacgcatgcaaatgttatcttatcaaacagttaagcaagcgaagttctctacaagcaaaaccaatcatgcatgcaagcatatccaactaaattggtcaaccagcctaaaccggtgacaactttaacagcctaatcagcaggtcaacagccagcagcacagaaataccacttgtaggattttgcatatttgaagtgagcattatgttcaggttcaacatctaaaagaaacacataagcagaaaggaaaccatgacagcaacatattaacactacctctggtgtgcacaacttgtctgtcgatagggctgaatcagttaaaacagcttctttgggtgtttcagctggatgcacatcatgatcgactgttctattcagtaaatctaattcgctagcttcctttgaggcagtatcagcattggtcattgcagcattctctgtagcaggatcctccatagtctcatctttcaacttgtttgcactatcgccaccattaggttcttcgctcgctgttacaatggcagcttcttgagttggctcatttgataccccttggcgaacaagttgcagagctatctgcaaaaagagtaacagagtaggtaatgcaaagcttgtaaaaggacaaagttttgcatattactgaagagtggaggatataaatggatgcacaatagcctttcgtacaaatgacttgaagattgcttaaacactatcaacagtcagctaacatataaatgacatatcaatgcaccgtaatatatatagataatttgcttgctgctgcaatgtgctaggaatgtaggtaggtagacataattttctgctgctgcaatgtgctaggaatttaggtaggcagacctaattttctgcaaggctaagcaactagcgaaaacaatgtatgatttgaaaatgtataaattaattaaataatactaatataaactaatgctaagggtgcaagagtacaagcaaaaataacaagaaccaacattttgtaacttagaacgaagaaaatgttgctttccttttgtgagtagaaattgattcctcctggctccttgttccaaactagaataactgtcgttttttttaagaaaaaaaaaaaactagaatagttgaaagatcatcaggcagaagttctgttacacaccttgcggtaaattttctcaatttgcttttgaagattccgcactcctgcttctcggcagtaactttcaataagggcaagaagagcagcatctgtaacctcagcctgtacatgtttgtagtcaggcagttaaagttgaaacaagcactaaattttggtcctagaagcaagccctgttagcatattccacatctcaacaaagttgtattgctgtaaaagtggtgtgtcgtttatacaaacttgaaattacaacgattattcttcacttttcagtacttttagtccactcgggactctaatagcaattccaagtttatttgtcgaaaaagaagctaagaactttacaatcctttatcatgtatgcaatattaaacagtaaagggtatcatttccgaggtaaacttaaaagaattctgatatgaattgcatatgcaatcctcatcgaattactcagaaggcttaatgaaatataaaataaagtataataatctatatatctcgtgcagtgaacctacccaaatgtaaagtggcacatggtgagaggatgagatttctgaattagtacatgactattcaaatacaattctggagtcaaaaccagtggtaaggtgcagtttcacatctaggtgtgtttaccataaagcttataggttaaggcactctttggcattgtgttgcgttaagaaaataccccctctggttttaaatgtagattgttttagccttcccaactttttcctaaatgtacatcattctggaacttttaggcacttcttttttttccatatttgcccttgccaaaagaacgctacccctatcacaaataaatgacatctttttcaatgtattgtaaatggagggaaacaaattcttttgagatgtttttttattaatgtgcacaagcctaaagcaatagatatgataaacaacttccataatagcttgccatagagaggttcaatgtagcactaatgagtccatgaccactaggagagaataaatcaaaatccattcatcatggtgaaaatcagggaattaattaattaccaaaatttgctgccttttttcataacattggaaacaattgttctgttaaataataatatttaaactagtcactgttgactcctaaataaaacgaataattcatcac

SEQ ID NO: 84459 - DNA, 885 bp, Oryza sativa
aaaggtaaaagaagtggaatttaagaaagtttcttacatccaattcctcaagcacctcctggcaaagaaacttattgcaccagaaatagcagcaccaaaatcagctaaccgtgggtagttgaaatcacccatgtgctgaaccaaggaaatgagacattcagaatgtagtgtgtatccaatggcatccaagaaaataaatttgtaaattaccattgcttgtgaaaaagataatggacttgtaaccaattaactctgtgccagttcttacacaactggttagagtctctgttttaatgacctatatttggttttgtaagaagtcagaagtcaggtcacacctgtgtgtaggtttgcacatgatccttccaaagggaacttgccttgagaacctccctcaaggtggatataacttcaaatgaagttgcttttataacatcatcatccttatcgtacggtttttcctgtaaaggacaagataaatgatccaaaattgcaaggcacctcccggcagtaaatagcaatctcgcatttatttcatagtgaaatcaaggctaaacaaagtttcttcagaacagcaactgactttcttcagtttcggaaaacaacactctttcttcttttctctgagcatgtttataatgggaaatacaaaataaaacatgagaatcggtggtggcactgtagaattaccttaagatggtcaacttttactgtaagtggatcctcctgaacctacagttttttgtatcttggtgaaaactaagttaccaacataaacccacaagaattgaatagcaagcaaaaactaatgtatcttaccatttcggttatctttaaacgacggtgaccaagtagcacaccctgatccccttgaatgctagttat

SEQ ID NO: 84460 - DNA, 1040 bp, Oryza sativa
ccaatagactcagtaaaaggcaagaagcaactaagaaacaccatagtagacgctaaattaccatatctttaagaaaaagacctgatccaatacacatttcaatatcttacatgcgaagattctaaaattacactgtaacttacaaaagtaacaatgtaagtttcataaattacattataacttacaagaaaagaaaatgtactgtaaatttaagtgagaaaatcgagtgagagataagaaaaaatctttcgagtgagatatagcaaaatcgattatttaattaattcaattgatgttgctcctagagttggacgaatcgacgaaggccctgactgcactattgtgctgcacacatgtacattataaaaaagaaaaggttaaatggtttgataactttatgcattgagaagaaattattggatgaaattgatattggtaccattatcaatgacttcgcagctagaaatgtcagaagaaattttcgaggtaaatgttcaatgtttcctatataaatattattgatgaatgcaatttaaatatttatgaccataattcaatatatatatctattgattattattatatcgtatgataagggcctttatatctagtttcacaccggggctctgaaaagtcaggactagccctgcctactctaggaaggccttgtcatctcccctgattcctttctctttatcacggaggcaactgatgtatgcatccatcatatgaatttgaggttagttcagttacattacaaatatagttataaaaggaaagtaggtttgttaaataggcgaacttatatcgtcattcaagtattctggttctgttagtactttcattgatttccgattaaccttcactccttcaatatgcaccatcactttgttatcctttgtctttattaatgtaggtaatgaaacggacttcttttttaatcaactcttcaaaggtcgtacaaatttttaatatgtaaacatagaatctatataatagatttatacaaaagtacaatgtttagatattacctttagaat

SEQ ID NO: 84461 - DNA, 883 bp, Oryza sativa
aaactgcgccactacttccaagcgcatcgggtttccgtcgtgatgtcttaccctctcacccaaatcttgcacaaccgagaaggtactgggcgggtccaaaagtgggccatcgagctcgctgagttcgaccttcacttcgaaccacggcacgcgataaaaagccaggttctggctgatttcatcacggagtggaccccggtggacgaccctgttgcatacaatgccccccccctcctcggagatggaggagacccaaacgccaacattcgcgccgggcactgggttatgcacttcgacggctccctcaaccttcaaggtgcaggggccggagtcacgcttacctcgccaagcggggacgtcctccagtacgtcgttcggctcgatttccgagccacgaacaatatggcggaatacaaaggactcctagcgggattgagggcggcggccggaatgggcatccgccgcctcctggtcctaggcgattcccagctggtcataaatcaagtctccaaggagtaccagtgcaccgacccgcaaatggacgcttacgtccgcgaagtgcgacgtatggaatgccacttcgacgggctcaagctccggcacgtaacccgacgcgacaacgcagtcgctgacgagttgtcacacatcgcatcagcacgagccccactctccccggggaccttcgaggaaaggctcgcacaaccgtcgttgcggttggacccccccccccccccgagggacccggcgccacggtctctgccccaatccccgacgacccatgggcctcggggcccaagggggtcggtcccgaccctcctagtcaggttgtttggatgactgacatccaggcatatctcgacgataatactcttcctgaggatcg

SEQ ID NO: 84462 - DNA, 566 bp, Oryza sativa
gggtgcttgcgctcacacctcccgccgtggcttcaaggccatgagacgtgagcttctggctgcagtcccgactcacgaggcaacacgaaaggcgcgctggttggaggtgaagctcaccttcgaccagagcgaccatccgacagtgctcgctcggggagggaagttggccctcgtggtctccccgaccatccacaacatcaagatgaagcgtgtcctggtcgacaggagggctagcctcagcatcatctccccggctgcctttgacacgctcaaggcccaagggatgaagctccagccgtcactgccgatcatcggcataacctcggggcacacgtggcctctgggtcacgttgagctcccggtaaccttcggcgactccactaacttccgcaccaagcggatcgacttcgatgtggcggacctcaatctgccctacaacgcggtcttgggcagacctgctttggtgaagttcatggccgccacccactacgcctaactccagatgaagatgccgggccccagcggccccatcaccgtcttcggcgatgtcagggtcgctctcgcct

SEQ ID NO: 84463 - DNA, 671 bp, Oryza sativa
aaaattaggagatctccctcatctccagtgtattcccatcaaccgcttgaagttaagcggcgtggtgaactggcgttctccgtcgtaaaatgcagctgctgccagcttagcggccttctccgtggggtgccccacgtcccagaaccagtactccctccggttcccacacggtgctccgaactgctcattgcagggccctatgcagcacacagcatcagtgttcgtaaaccctgtgtacatacgatgacgaactaacattaggaatgcatcatcattaagaagaaatgcatgaagtaaattgtgacggttcacgaataatctgacagattttgtcaagtaattaaataccattagccgacgggttcatgaaggtggcattggagaagccgtagaaatcggcgacagagtagcggaggccggggagggaggagctcagcccggccatgagagaccccaatccgtcgttgaactccctcgcgagggcgttcatccggtcgtcgcaaccgccgacggggctgtggctgtgcggctgctccgtcaccgccggcgcgcacccgatcggcggggcgttgacgacgccgaacctcctcgcgcccagggcgtgcagtggccggacgacgagctcgccgtaggaggcgacgaggtgcgggatgtcggtctcgttgtcgggc

SEQ ID NO: 84464 - DNA, 946 bp, Oryza sativa
gcaggagcccttttacggcatcctcccgtgaactcggagccagagacccccgtccagcgatggttggacgacgtggccaacttggtcaccactgcctagcggcagctggccgcaggtggccggcccaccaccactagtacgtcgcgtacccccaccaccctctcctcgtcagcaaggaggagggcccgtcggtcggccacggcctcgaggcggtccacggccccaacgtcgtcaggggcctcaggaagtcggaggcatcacgatggcctctacggggagcaggatgcttaagcgacgccgggacgagcgccgtgctgcccgcatgggagaaggcgcctccttgttcggagtgccgcattcctcctcgcgaggcggtccgccccccacgttcacccctggagggactagttgtagggccttcgttgcgagtcttgggaatgtccggtggcccccgaagtttcgccccaacctcacggagaagtataatggcagcatcaatccctccgagttcctccatatctataccacaatcatcgtggcagcatcggggggggggggacgaccgggtcatggcgaattatttccccatggctcttaagggtcaagcgcgcggctagctgatgacccagccccctgactccatccactcctgggaggacctgtgccagcagttcattacaaacttccaggtcacgtacccccacccaggagaggaggcggacctgcatgctgtgcagcggaaggacgatgagtccctctgctcgtatatacagcgcttctgccaggtccgcaacactattacgtgcattccggcccacgcggtcgtttatgcgtttcggaacggcgtgcggcacaaccgcatgctgaagaaaattgcctccaacgagcccaagaccatcaccgagctcttcgaactagcagacaaggtggctcggaagaaggaggt

SEQ ID NO: 84465 - DNA, 13460 bp, Oryza sativa
attatttttgtaaatattttaataaaaaaaatgtataaataaaaaaaattcgtacatgacacacattggaatatctgccgaagtgagaaatggataatggaaaagcgaaagcatgtacgggaattttcagagattggcctaccttacgtaatagtattattattatttttagaagtatatgacaaaaataacttcatctaatataatacacggttacagtaaatcatgcgttaaaaaaaactgcctcccgatcagtctctacatgaactagattacatatattcagagaaattaaagcaccttccttattgatcatacatggcgatcgatcgatgcaccaccaccatctttggcttaatttcatcgtgctcatagcaagaaatgaatcacttgcccagttgctgcttgctaattttctactacctgcttttctccatcgatcagttaagttggttcagctccagcctgcaccattcagatcgatgttttcgcgcctgtgagagtgggacgacgacctgccattgatgctgaggtccagctccgacgcctgcagcgtgctcatctcgcggcgccgttcatccgaacacgatcgtcgcctgctcggctcgttggggaacagcaggtagtggtgctccttgcctgatcttgctgctgccggctcaaatggcggcaagccgatggacaggatgtcctgctctcctctgtggccatgagagcgcgagtgatgcgagccctcgcagtcgcaggcggtcaggcagctgtccaccgatccatcgccgacctgctgctgctgctggtgatggtgaagctgggtgtgctcgttttggaggcgtttcgatgaggaggcgtttgcagttgcagcagtttctgctacggcgatggtgccgagtgcctcctgcgccttctccagcactgactgcaggtactttccttgggcttcaatccgaagctgcaggtgtctttgtaccttttattttcaggatccatgatcacttataaatactactgatttatttattaggagacacaagactattgctatgcattgttacatatattccatcgagaaacaactgaaagatttttatatatacctctagttgttcatgcagccgtctctgcacctcaatttgcatctggagggcttcatttatgtgcatagaactgctaaaaagattgtgaaatatacattacattctgatgtttgatgtttctattcatgagagaaaaaattaactttatttgcttcttagttacctgtttgtctgagtctctaggtccaagtgactagccggtgatccatttccttcacatggtttatctatctctgtcgtactacaacctaagactgaaaacgtgaaagcaagtttactatctcgcttattactaatactgataatcaagctacttcagagttcagaatcatgtagcacttaccaccttgtgcacgggaagcattggcttgagattgaagattcttgctaagtcggtatttctacgataaaagaagccaacttagtttctatcttcaagtcacgaataatgctagacacctatagtttaaacatatttcaaaatgtacctgaagatgactcttaagatggtaaagggttaatccaggaattcccatgagcctcatgattgttttcggcgtcgcctctgaagaagtttcaagtgtagccattgtaagatatgcaaatttaccattcctctgctgcttcaaagcatgaatgattaattaagttttgaatactcactgtccggccctcccagctgatttactgcttccacaaaacgctcatgcaactctgatgtccattttaaccgaggtttagcgtcggtcgagaggacaagccctgatgatgaatctgctccgccttgcaggagaaattgcttctccggaggcaaacccggccttgaagacaggtgctggctatcactctgaacctgttgctgatgatacatcatctgccatcaaagatgtcatgttcctaatttgcagatatcatcttgtgtgagcataagcatatgatacgaaaggcctctcttccttgcatggttcaaagaaactaacacagtagtacatacagacctgttcagttccagtcatgcactgaaatgtctgtctgcttgtagtaggctgcacatttatcagtagtgataagatcctctgcagcctttttcagtgcctctatttgtagtaaccaaagacttgattggattatgtgtgtatggtcttctgggagtgagacaaccttggcttcttcagactatctgcctctccaatgactagctgctgctgcctctgctcatgtcaaggtctcaagcagagagtcttgagtctttataaggcagggaagagaatgtggaatcactgggacaacacacacactcaagcctgcctgacccaatctttgcagcaactgaaaagagatattatccttattctctcagggtgcccgtggaccctaacctctgccgatcttttccattgtaaattccaaaaacgctctcccattctgattatacacttgtaccaactttggttgaaattacatggcacatgagaagggcgaaaggcgaagaacaatcttttatttttcttccttttcttttcttttgagaaactagggggagggaggggcggggggagcaccttattctcatgacaactttggggctgtggtgctgcaaacctatggtgttagaacttgccggcctcttcggctggattcctgaatgatatccatagttgagaactaattctggtctccactgcatttctggaggcctataagtgttgaaatgaaagggcaacatctgtggtcaatcagcattggttaagattccatatgatctgctgtatgatcacaatgaattgtttcgcattttgcccggatgcggtgtacatatgtgtgcacaagttctttcttgatcagaattcaggcacacttggttaaggaataatagagtggttaacctaagaggcccaaagttcttttgactgcagctgcagctgcaggcatccagaagaagaattgtgcaaagttgcctgcatagagtgaaagtgaagttgcccattctataacccctttgatgccttcttggggttgcacaaaggcatggaatggaataatggaataagcatagaattcccttttgtctcctttggtaagtttggcacctgttcagctacctgcaagccaaagcaagctgctggtagggttaaggcaatctaaatagggctgtgtctgtgtaaccttttaagccattgccgtaacttcgttgctgttcttcatatggcacccaaaagtgagcttaaaatgaaggtttagttccaacgtttttaagcactctttgctgctttccctttattcctgcctcaaaaaaaccgcctctagaagtatcaacagcactcccatccttgtccattcaggtttaaatccgggttaggatcccacacaactttgtgaccgacatatggatctaacgaaacctagacccacatgtcaatgataaagtcactgtgactttaaagttagaggaactggtaccaactgtcaggtacacattcagcaagccataccaaaatttttaatgaacgctagagcttcttgtcagatctcaaagggagatgatcatacttgcatgctcccacagtgctacgtcatgtgcgtttcatgattgcatcagcatctgtaatccttttgaagtttatagactcctgccatgtgaaaatgagaggaatctagacgataagcttgcggcgtagtggactagagttttatcccccgtgacctttctttctacaccccaattaaccttgtcaagttggtgttgctcaggaagacaacttgttaattgcaagggctgtaaatattcctcacaaaatttacctttattagtcctttttatatactagtacggccgtgctgtttcactcgcgtaataagtaggaataattcatccagcctgttatgttaatgtttggccaagtacagttgtgttgtttcagagtatcaaactactccaggtaggatacaaagttaataacgcaatatgtgccacgagagtgataaaccagagatcaagtattcaccagagatcaagtattcagatgctgcaggtctggttgaaaaagattgacagagtatgggcatacgaaggcagagcacatcagtattttcgttgttctttcaaaagtcccttgcattgcacttttattcggatttgtgcctgttgctgttacgtggttcgatacaatttcatctaagttggtaagggaatcttggtggctaacccaggtacggatatcacttgtactaagataagcaaagtgctcctgtgatatggtatctatacctgtatttccttagctatatatcgaagttgaatatgttctgttccagctgatagctgcctgattctccagctttggtcgatcgtgagttgtcaacaaaggtaaccgatcaatgatcatacagagaaactaaaaccatgtttatgttccaacagcatcggttcgtgaaagaaaaaaagaactataacacggtaccgtagaatatggaataaactccttcagccctaatggccttagctttctctaactccgttttatgctgttatatatttgggaaaagaatacatgaatacattcggttgttacttgttaaatgtttggtatcatatgcttttgttctctctttgcccatctgtccggctggtaacctctgttgacagtttcatgcatgtaactcttgatgctcgcatgcccatttacttgttgaaattaaagtacactaaaccaaacatcacaacatgaattaactaggcgttagccaaataccaacttagcataccggtaccaggatgatagaatatttgtattaacttagaattctgatcatgcatgcgcactgctcatctatctcttgttgaaagaaatagggggtccaaaaatgttcgtcagtcagttccatattagccactgtgttcgatgtacaaatatcgaggttgaacttaccaggtgctgggagttccacaatagctacagctaatgcacgaagaacaatttttggtgcatgcataagggccactgcagccgaaaggaatgaagaactaggatacctggaaacaactctgttattttctcatctgtgtcaaaagattcgctgggggtcctccagatccagcagagccactcccagcaaatgccgagaagccagacccttgattaccaccaaaagctccaaatccaccttccaattcaaccaaatggagttaattctcagaaaaatggagatggagttaacagattctaagcaaaaaaataagtgtgagatatgtgcattaaagctttagtagctgtggagcaaattggatagaatttactattaagtcacatttgtccagacggtcaaactgcttgtaccaaatacattattttcaattaaaaggaataccttgatttttaatcctttttgccagtaaagaatggttaggcatatatcatttgccaaaaccatacgagaacttagaagttacaaatgacaacactatatttaagttatgaaatagattggaaaagatggttaggcaaaatgatcaatgattactcgatcaataatggataaatccattatatgctatagagctaagtaaatcatggtatgcagaacagcttatgacttaccgattgaaaactagctgtgaatgaacttaaattagcacgctactgctagagcaaataccaaacactattattcacaaggaaaataaaagtaacgcatttatgtaaaatagacctaatagagcagccttaccaaagtcaaaaacagactgctcatgttcctaatatggaaatttagttccacatttggttatatgctagcagttcaagtttaaagaatagttggggagtggcaggctttctaaatttcacaacattgtcacaatatatatcaatcaacaagatcaagttgataatcaccggttcgataattaactactattctaggacatgtctcaaacacaaagatgtggacacatctaaccatgaacatgttgatgtaggctacatcatcatgatctcaaagacgaaaacagcaaaaatccagagagctcaccactgctgaagccacttccctgggctgcacctccaaagccgccaccagatgaagccgcagccgcaaaacccccacctttggaggcaagagcagcaaaccctccaccagtagcagcagcagcaaatcctccgccagcaggagcagcagctgcagaaaagccaccgcctgttgcaccaccagcaaatccagaattgctagaaaagcccccggaagcagaggcactagcgaatccaccaaatcccccagcaccgaaacttcccaattggcgtgattgtccaaaagaacccaggacagatccaagtgcttgctgagcaccaaattgtgcaggctgcccaaatcctgactgctgtgctgtcccaatttgtgcaggctgcccaaatcctgactgttgcgcaactccaacttgtgctggttggccaaatcctgactgaatttgtgctggctgaccaaatcctgcctgctgcccagctccaatttgtgaaggctgcccaaaccctgactgctgcgctgatccaatctgtgcagactgtccgaatccactaagcccacttgagaatgcactagaaaatgtacttgagctagttgattgagatgactgtgctggctgagatgagggaatactcagtgacgccggacggaaaagctgtcctggactggttgtcagggtaaatgacgaacctgaactcttattgtcagaggtagtaaatgagttcccaaagggattggattttgggggacttgaagaaggcacagacccaagaccaaacccaccaagggctcccaagttgagatccgaacttgcagaaggaacttcctcttccatatcatcttcatctgatgagggattgctcggtcctacatcttttccggtggaagtgacaacaacagattctgcagacactggcaccactttaggtgcagagacaggaattgaaggtaagcttccactggttgctggaatcgatgaaggtttgccttcagtgattggtacgcttgagctagtacttgcagaaacggttgttccagttacctctgatgtaaccacttcaggcttagatacaattttattcaagccagttgatgactccttaacaggcattggaatagatagtagggaactagatatggtaccatcaggtaatggtgatgaaggttttgtcattgattcctttgatggaagaatggaaggacctgttggagacaaaacatctgatgtttttgcagctgattcttgcatagttgacgaggatgatgtagctgaagagggaacagttggcttaatagagcatggagaagattgtgcaacaggtgttggtggaaatgcaggaggttggaatgccacctcaggtttagctttcactgggctctgcactgtttcagtaatcttaccaagttgcacagtcttcccttgtaacagagcagacttgggaggttcaggagacaaagacggtttgttaagatctctaaatgcaccacccatattctgtggagaaacatccagtccttttgtggttcccaaatatggcattgcctgtccaccttgtttgttctttgtaataatggatgacgcacctccagaatccccagataaagttttcacggtcaatggactcagagagaattttgagcccgtcatcaaaggcgacaaatctgggagtgtactggtattagtttttggaatgacagtggttttaaatgtcaaagtacttgactttggcatggtatgagttgttccagaggatggaacattggatgagctgatattatcccagacatccttatgtgaataactgaatgacaacggtgaagatgagcccaactttggtgtctggtcagaacttttcagctgccctggtaattcaggatacttatgctgagggccttgagatggtccagccgattcctttacccatttgaacagtgtgttgtgctggggtcctgacggctttgttttctcgtgcagcactgtaaaaatgattcaataagaaagttgtacccaactctataatcaaactttcttaaaataatgaaatttctactgaagaattgttaaatagcttaccttcacttggataatgcagcttgtttgcatatgattctactatggaggaagtggggctactgctggacttctcctgggacatagctgccatctgagaatcaaatattttcttatttgacctgaatggcaggtcactgctgatcttgaggcgctgttgttgcgctattcttttaacagtagttttctgaggctccaaactagccaggctctaagaaattgacaagtattttgtggttagatttgcagccaattcaccatacatagagcaacaagaaaatacgatgagaatgtgccaaaagaaaagaagtgcagaaagaagtgataaaatggaacagaaagatccacatttcttccctcaatcatgtgcataatgcatatatatgcaaagtttgggtctgggttaaaaaatttaccctatccagtgactctctcctcctccttgcagtctcaggctcagcagtcttggaaggccctgatatgctagttatgtgttctctcgttgatggatatctcttaactgacttggaaggagtaccacctgaaaatttggctgcatccatcgtgtgatctagaccaatcgattcaaacaactctttggccactgaccctcgctttgtagaaggagaacttatatttagtgcagatatttgttttgagaggcagtctgacagttgttcagctgctgctaattgtgaattaagcgcattgtaaacactggatatttgtgtctgactgcacaataagaagataaaaatcagataagaaactcacatacatcgatttatatttgaaaacaaaaaaaaagattaaagtattcttttcagaataaacagtttcttattaccatcaccatcccaaaataacttcatctttgcctatctcacacataccaatacaaaagccaaaagactaggatacccatcactttttcaaactccaatgcatttatccccaacttcctcaaactccaatgcaatgattgctctaaagttgaagcatttgtgggacaaatgaattaggtaaagtcgtaaagatgaagttattttggaacggagggagtactaagaaagagtaaagaacagtttataattttgtcattatgatgtggtaaaagtcgtaaaagcgactttagagatatgttaatgtgtgagaacaaaatcaaagaggtatgaacaagctaacagcatatgtacaagctactacatgcatctgtaccaagatagtttctgctcaccctgatcacatagcaagctagcaaagcaattggttactttgaaaattcagaaaaataattggatattgatcaagtttggtacaccatccatttaatgatatgactaaacacacaggaattgctcgtgaggtgtagtattgagtacctggatcgtgccttactagaataaatagctctgcgactagaagcaactcttcctgtttctccaaatttgttcatctccagattattgaaatgcctctccagctctaccagctggtttgtcaaattctgtatgacaaaagaaccacgaattacaaattaggctgttgatgttattttccttaaaaaaaagaacataaagggtcagattgtacctggttagccttgagaatattctgcctcttcgcttcgaattctggactcaatttctgacggttccatatatcccagtattgggtatctgaagattggtcgacgattcctttcatgtaagcttgcctagcagagactgtagagaaacagaaataagtttcttatttagtgtgctaaccaaaatttaatttacccagatagcagatgcaggctaagtgtggcgtccacttcttgcctagaaggccaggaacactttaaaccctttaatttccaattgagatataaaacattgacatcagtagaaaaggagaaaccgacaaatccaagctcaagtcatgatgggtaaaactcctttgtcatgtcacaaccatatcattcacttggaaggctttttcaaacccacaaagtcgaggaactaaaaacagaccaggtctagcatacactcaagttaagggcaagcaatcagcattccgctttctgggtttcctcaatccttatatatggaatgcacaaaagcattgccaaaacaacaaatttgaaataaatacaaacataaaatgccatccccactctccacaattgcaatgttgacaaaatgttaaaatagcagcagagcaaaccagttcttcaaacctaaccctggcctgacgaattgtttttatttttttttcaatatatataaatgtgcagtaggcatgtattaggaactactccctctgtcccagaataagttaatctagtactaggatgtgttacatccagcacttgattaacttattctgggacagaggaagtatgaagtaaccaaagtaatgacagtcatcaattgatggaaatatcagagatgatcgatatatcaattttcattttttttcccaaacgcaaagagagaatgttggtattggatgaccaacaatatcaactaccaaaacaacggcaccaaaccaggtgtggataaaacttagctaattatctgtaagcactatgaagatacatataacctatatttctttcaggcatatattgaagtactagatgtagtgtgtctattggcaaaaagaaataaccacgagtagtagacgtgccttgaaacatcttattccgcaggtcttcaactcttgaacactgttctgctatcttgttctggagatcaaaaataagaaggaatttctttagcaggttaaaggcagaactggaagataagaaaggtaaaggagaccaaaaaaaaatgtgtggtgaaaattagtataataccttgaagatctgcaacagttccagaaaattttgcaaatcaccctcaaacatagaaagaggccgttcctggaaggttatgcaagcatctctgaaaccaccatccttctctatgtatgataggagtgtatctaactccttggtcatatcattaatctgtttaacaaaagggtaagaaatttactagttgaaataaagataacaaaaggtagacccaaattccaatatttaaaatattcactctgtttaaggacatgtttcatacagtattgcacaacagttgaggtgaataagatattagcatgaaaacaattgaaagagtagagagatgaaataaaacaggaaccgagcatgagtgcagaagaacataattatctatatttataccctatcctaaggagatttaatatggcaaattgaactgaaaaggttcaaaacatcatttccgaagacaatattcaggaaaattaattacatgctgaatcataaaaaacagaccaaactgaggcattggtagtaaaaaaacattataatcaaatgtttttgttgatcttacactgtaaaattttttagacaggtcctgttcagtatcgaacattgcgcctaacttgaaatttttagaatggtccactactgcatgtgttctgtcatgtggtttgtcaatgctttcctgtggtagaggtgatccacgggaggtaggaaatgcctcaagatttcctgtgcgaaagccagtggatgaaggtccagctgaggaaggttttattggagaaattgatggtgatgacttggaacttaagccaactgaactaggaactttcttatcggtagtgtagctgctttgcagcgggtgacttccaaaaccaggttcattcctttctccaggcttaaccagggtagatccatcagaagtgaacactgatgatttattaaagctaaggttaccatctttctttgagttctgagatcctccaaatgctcccaccggctgagtggaaggtatgcttcctttaccaagttggttatttacgaaattgctactgctgctttgttgccaggaagaacctaattcactagatgtgttgcttccagctggactcaaactgacgctattagcagtagaaaagctgaaagatattccaggtttcaagttgcttgctggtgctaagaaagaggcaggtgcaggtgaggaagccactatttccttggcttttgaaactggagaactgtttttcatatctgttgatccatgcaggtctctatctgcaagatacaaaaggaagaattattaagtctccaaagaacttggaaacctaacaaacaacccctcaaagataaagtaactgccgcataacagtccttttacctggttgtacactagaaagctcagccccatctgggcgaatactcttgtccaatgagctggtagcacttggagtaaactcttttccagatacagttacaggtgaaatttctttcatcacatcgctatcttcaatagcagatagctttgtttgaggtaattcagaaggatcagaaatcctaggtaagagaccagtggcaacacattagtttttctttcccaaacaaaggttagtacacagacgctatagcaagtaataaacagaccatatttttgtttgtgatttggcactggcaaacagaggttgactacctggcaagataatatatattcagtttcccttcaccagtcagataaagtagaatatgttgaggagcaacctccttttgttcaggaccaactgttactgtgatcttctgaaataatgacacattctcgacaccaaaccccaatatgacattgtcatcaccattctctgaaatggtagattagagtagagaaacccaagtttagactttattcacagagaaacagtctgctctagttgcggctgaattatgtcttaccttgtaggtcaatcctaggactatatttatcctccaacatctcaagatatactacagtttttttgtcatcagttgcagatgaccacttcaagagagaaatgtgttcatcaatgctctttttgttggaagtcaccattagatccctgtcaaattacaatcacagctaacaaatgttggaaaaaaatataagtaaaaataaatgcaatattaccacattgatgctaattggcagaactaagaagatactaatgccccaatctaaggtcagaaataacatagccaattagaaaagttgcattgtgcaagtttagtccgtatagcttaaaatttcagcacatatactattttacttcatgctatggacaaaataacatgaaatccacctattaaactctcaggaggtgacaaaagaacagaaatgtttagttaaataaatactttgatcaagtatttacttgctcacaacatgaacatttctgttggactcttagaagtataacaaaaaaaa

SEQ ID NO: 84466 - DNA, 720 bp, Oryza sativa
ccgactggtgtttccgcctgcacggctggcctattatgccgccgttgctgggcgtctacgtcttcaccgaccggccgcctcatccgccgccgactggtatctccgcctgcacggctggcctattatgccaccgttgttgggcgtctacgtcttcaccgaccggccgcttcgtctgcagccgactggagtttccgcttgcacggccggcctattatgccgctgttgttgggcatcatcgacttcaccgaccggccgcctcgtccatcgccgactggtgttttcgcctatacggttggttggtcacaccaccgttgttgggcatctacgtcttcatcgaccggccgcctcgtccgccgccgactgatgtttccgcctgcacggctgacttattatgccgccgttgttgggcgtctacgtcttcaccgacaggccgcctcgtccgccgccgactggtgtttccgcctgcactgttggcttattatgcctccgttgttgggcgtctacgtcttcaccgacaggccgcctcgtccgccgccgactggtgtttccgcctgcacggctggcctattatgccgtcgttgttgggcatctacgtcttcactgaccggtcgcttcatatgacgccaactgatgctatcttcttcacggctggctacgtcgtcgtcaccgctaataggcaccgtcatcttcaacgcaagctgtctacgcctggggctgcag

SEQ ID NO: 84467 - DNA, 1444 bp, Oryza sativa
tccctgcatcatacccctattccggtatgacttgctgggtacagtgggtagtactcagtcttgctctatttttccccaaaccctagagtatgagtatgcgtcagatggtggtttctccgaggagtaggcttcgtcctgccgtcgaggatgcctgtggggtggtgttcccgctgcagatctagtcaaggcttagccccttttatcttttgtttttccgctgcatttatgtaagacttttataatgtttgtaagacgtggatctgtatgtcaactttgtcgcttgtgtaccccacccagtcctggacggggattttaatgcacattctgcttggaattctattcgggaatttctgggcgtgacacgcatgggagaggtgtgtgcaaagctagggccacctatcggcacggaaaagaagcgtcgtatgggcgtgggatcggatggtgactttgcctgtccaagtagacatttaccaccttttagttgtagtgaccttttagttgcagtgacagagattttgactgttgcgcctcgtgagccatgtgggccacacccatcacccacccgcacgcactcgatcgattaaccacccaaacaacgccaatgcaagcagctcgttcccaagttgccacaacacaccatgcatcttcgagttcgactcgcgggcgcacttgtggagattatgggtaccccatacccacacggcacggttatccgactagttataggggataacttatatatatgaaatatgtaacagatcatgacttgggtattacgtttccttgtatattacggaacggcctaaagtcctggtttgataagattgtaaagtagatttaggaaaccgataccgtattggataaggtttctatcttgtaatcatgtcccccatcctatataaggtgggcaggaggccctctagggggcatgagacaattagatcgtcagatctatactacactcggcggattcaaatccccaaacaggagtagggtattacctctcattgagagggcctgaacctgtctaaatccttgtctctgcatccatatacttttaggtttcgtgcgctaccccgttttattattgccgaattcatgttttgacagctggcgcgccaggcaggggatgcgtcgagtttcccgtcgacgagtgcgatggaatcaattcaagcattgagattaatctcaacgagttcgacgactccaaatgttaatcggtttgtcgtttcaatatattgttatcagattgatctataatcacaattgattttctgttgtttttcctctctggttacatgtgccgccgcgctgtgaattcttctgatcactgcgggttgaaaaaaacataagccatggggaaaacggccggagttacgcggggtcatcagatcggttctgtccatgcaagcacgggatcaatcaactgaattaatatgaatgg

SEQ ID NO: 84468 - DNA, 1396 bp, Oryza sativa
aaggtgccccattttgagttggagctcctctcaggtgaggacggcttctggcagaccacgacccccagcgggatcgctgacggggccgtttggcgtcgcctcccgactcccgaccacgggcacgacatctgttgacgccgtgacaggggacgcgctagacgttcccccggacttggcccgagcaacgttcgcccgcgcctccctataaaccgccatgaatcaaaattccactcaaacagaagacacgagaatctaaaagtttctttacttacttctcgccgatcgtcacaatgcgcttacgtcgcgcaggcggaggagacacgtcggaagcctacaaaacaaccaacatagagtgagaacaaaccttccttgctacataacctgacgacaaggtgaaaattactgagggagtcgccgccttgcggcggtgtccgagcacagacgagaatttcctcgccttagtcggagctttgccaccactagtggtggcagcgtcagacgccaccttgacgaccttctctttcagagatgccgccacctgatgatccgcgagcggaccgacgacatcagtcaaaggaagggcctacactaaatcatgtcataagctgattttgagcaaagaaggcggacgcttatcgaatgaactcacattgattgcttcgtcgtgctccgtcactcccctttcacaaaagggtgcggggatgtcgctcgccgtagtcgggccgctgatcatcacctgaccaacacgccgctccacggcttcgctgctcagacctgtcaagaaggaatcaatttttgataagtcgaaaaggaacgcgagtacaagcatatcaaaatgaatgcgagaaagataccccgaggagaaacccgggtcgcgtcatctggcccggaatagttataggccgggtgggcccgagcctggagcggctggattcgcctatcgacgaagtctgcaacgacttcatatcccgataagccccgttctcggagatcatcgatgatgtcgataaacgattggagagagggggtcaaggggggcttggcggtccagaccagaatcttgttgttcctcgggaacaacgaggatcggatttgaatccttgatttcaaggtaaaaccacctgttccgccatttactacgagaagagggacactggaaggggacatagcgcgacttcatcccgtcacgaagtcggaacccgacgcaaccagacaccctattgggttccatccagcgcaactcgtaataaaagcggaacagatcaagaaagggctctaccccaatgtaggcctcgcaaagatgcacaaagacactaaggaaagcaatggaattggggttcaagtgcataagagaaagcccatagaaattcaaaaccagcagaaggaattcggaggg

SEQ ID NO: 84469 - DNA, 1818 bp, Oryza sativa
tcaaattcatcagcagcgaggagttgcccgaggacgatacagaggccgagaaaatgacccgtaaagcaaagatctactgtatgggcggcaacgatttatacaaaaaagcgccaaacgggatacttctcaaatgcgtctccaccgacgacggcagacaactcctcctcgacatacatgaaggcatatgcgggtcacacgccgccggtcggacattggtcggcaaagcctttcgacaagggtttttctggccaaccgaccttaaagatgcatgcgacatagtccagcgatgtgaagcctgtcaattccacagcaagcacacaaagctacctgcacaagcactccagacaatccctctgacttggccgttctcgtgctgggggctagacatacttgggccattcccacgaggacagggcggctacagattcctatttgtagcaatcgacaaattcaccaaatggatcgaagcagtacccactggggaaatcaaggccgataacgccatcaagttcatcagaggtatattatgcagatacggactaccgcaccgcatcataactaacaacggccctcaattcatcagcgccgatttccaggattactgcatcggcttgggagtcaaaatatgtttcgcctcggtctctcaccctcaaagcaatggacaagtcgaaagggcaaacggcatagtactacaagggataaaaacccgcgtctacgacagactcatgtcacacgacaaaaaatgggttgaagaactcccatcagtactatgggccatgcacaccacactgacaacatccaataaggaaacacccttcttcctcgtgtacggctctgaagccatgttccccggcgagttacgacatcaaagtacacgagtacagaagcattccgacgagaaccaggagaaacagcgagacatcgatgtaaaccttctcgaggagcatcgtgagcgagttgccgttcgagcagctagctatcaacaagccctccgccgttatcacgagaagcgcatccgagcatgcatactttcgatcggcgactatgtcctcagacgagttcaaacccaagcagggcaaaacaaactctcaccaaaatgggaaggaccctacacgatcacacaagtcttgcggccaggcgcattcaaaatcgcagacggcgacgatcgcgaactagcaaattcgtggaacattgaccaactacgtaaattctatgtatgagtcaataccactgtacctgtaagcacccttacagtatcaataaagcctatttctaagtcacatgtcacgaccaaagtgttttcacccaatgatcccttactctgacgacacctagcgttgaaacctgtccttatgtccctttacgccgtcttgacaaggcctccgaggaacctaagggatcttcgactggggacgcctagagccgataaggccttgtcagatcctttagagacgaaagaccatgtaagatctggtcgtgtaagagttctcgccgtgcgtattaaccaagtcgtgtaatcggaaaccgagctttccaacttcacggctgggtgctaggatcagagcttattcaaccaagacaggtcaagggtccaagagccttgtcctccgagaaaattcctccgacgacaaagctgggggctagggagagtgtacgactcaaacggctaactaaagtcattaactgagaacacactcatacacacgacatccagagtaagaaacatttgttaaagatagatttctttattcacaaaatatttcttacagtttgtacataaatatttcgctgcattacatcttcccctaagatatctgg

SEQ ID NO: 84470 - DNA, 2177 bp, Oryza sativa
ggtggcacggatactgatgatggcaaggcacctaatgctggcaatagtcctcaagagctggatccagagagggcaaagctgcatgcagaagcccctgtgctgccatggagctctgttttggatcgttggggttctaacagggatgcacttgtaaaccaaaggggacttgagctcgagagccattggggaagggtggataatgatgctgttatacctgctgcaaagattgcagaattaaatgttcatagttcaatatatagagaagatccagttgagattctaccatgccttgcacctctgaagaaaggaggcctttgccagagaagagatctcaagatatgcccgtttcatgggcctattgttccacgagatgccgaaggaaatccaattcatcagagtgatggccattgtgatgcagaaggaaatccagttgggcagactgatggccattatgatgcagcagtaagtcctattgatccgaatgaagacagttctgatgtaagagaaaatatgattatgccagatggaagcagtgatggtgaatgtatttatgagtcctctccttcaagaacggcaaacataaataatgacattagcgacagcgatgtaggtcatgacctcggtaaaattacagtggagcagttggcgagacaggcagtgcagaatgtccggaaaagagacagggatgacaaaaaagctctggaaaaagcccaacgagcgagaattcgtcagcataatcaagatgttttgcgggaagcggctcttgcttcaacctcgcgctcagcggcagactatgacctcccttcgccagcagtgtctcgacgggacgccgaggtaagacaaagggaccaacactggcatcgatgctgaagaagaaagttacttccaaagatagaattgcagagaggcttctgaatgctcgagctagggatgcgacaataagagaagtttcacatactgaagatatgagctacagagaagcattcccaaatcaatggtagtataagaagcctaatttttgctgaataggttggtgaatcgtcatgataagagtgaatcaataattctttctgcgcgcagttttcagttaaccacatgtcttcttgagttgcccagatacaagtaaaattgtaggttttcattgtgaagtttagtttttgtacagtacagtagattgaataagtttcttttatttcttttgcatgttcattttccctttgtaaacatgtatatgtaccactccatacttgctggattaataactatatacgctgaggctgcagttcaaattgtgttattttatctgagtaatattgtggattaattaatattgcggttttatatggttcaagacttcaagttgctggtgcaactcgtgacctcaggttttacagaaaaaacaaggaccgaccgttgtgcataatagatgtaacatgttattttcacccatacatgttagcatatattcgctacttcctctaaaaaaaaaaaatttgatggctaaaatgtggcaaattttacgaaaacggttttttttcgggccgagagaagaacagaaacccgtttggaaagaataggaagggtttttgtgatcaatcagcacacctatctttaaaagcatacaaagagaatttccgttctcagggcactatgccttggatggaacagcgcaaaagaacgatgaacctttgcacatactcactccgcttcataatgtaaaactttcaggcattgccaaggttttttttgtcacatgtatataacatagttgctaacacattggacaatgttattatttttcacacattactaacctaattagtacatagttatatacacattcacttacagaaatacacatatacacagtgtggtaagtacatcacatggttcagatcgataaacagaaattacctgtgttcagaacgattagaaacgctcttatctgaaccaggcacacgtaaccaaagctaagaacttgcagagatttccattccagagagccgcttatgcctcgaatggaatttaacaaacacaaatctagcaaaagcaatatacacctgcacatcatcatcacatacacaaattaacctaccaaactggacacacacacacacacacacacacacacacacacacacacacacacacacacacatatatatatatatatatat

SEQ ID NO: 84471 - DNA, 1488 bp, Oryza sativa
  unsure (1)..(1488): unsure at all n locations
gaagggtttctcatccagctcgcccattctcttgagtccgatggtgctacgagggcctaacagttctgataagccctacaaaacatacgcacaaactcaggtctcagccacaatcatagtataataagattgaatctgaaatgagtccaaataaacacaaatgaaaatatcttcagactctgtcaagcagtagaaaggaaagatcagcatatcatcacattacagaaatcagcgctttcttggcatcttgcagttcatcatttgtcttcctttctttgataatgnnnnnnnnnnnnnnnnnnnnnnnnnnnnnnatctcctcaatcttctcatttagttcctcagtcagctcgtcagtacgtttcttcacatcaacaccctctccctccatgtgttggaccaccagcagtcttcctctaagttgttgtatttccagttccagcttttgcttttcatccaattgcttttctaactgcaggattttgttcagagcaatctccttctctttctgtgagatttttacaagccagagtaaattccagagcatgagaaattaaaagaatcttgcataagattaataattggaaacaagagtgcagaccttgtgtttctcaacaagctttagcacatttttatcagacttctgttgctcgattctagccatgtggatggagtcgttttgctcagagttctgtaggggaaatcagtaagacaaacagtcagataagatattctaacaaagatcatcgtaaccagactgtaaatgcggagctaacaggaagtgtaatatagatacatgacaagtatacagaaatcctgtcacccctagaaagattgtcatagctgttcctgaagatagaactctgaagaggaaatgcaaatgctaaacagtaacataaagcaaagagagcaaagctgtggttacattcatacctttttcatctcactctccaattttcttctttctatgtcagtttgagcaacaaacttgcttagttgcttggatctcctctcgatggcattctctttatcatccaactgtttcctcagctgatcagtctcttcaaatattttctgtgaatgttcacgagcagcagattgcatatttcgcatttctgtaacagcaataaaatgaaacaacacaatagatattattattctggcaaattggcaataaaagtagacaacaacatagcaatcatatgcccatggcatgagaattattcatatgaacagtttgtagtatgtaccttcattgtaacttttgtgcagcaagtcagtttcttccattgccttttaacagagagaatcatttgattgcatctgcattccagttccaccaaatacttgctcttagctgtaatctggtgtgacaagttagctatgagagtctcaggcttgcgagacgtgtcattttccacaccagacacggtcgtcatatcaccatttgctgacaaaaacctaccaactgggtcactagattagtag

SEQ ID NO: 84472 - DNA, 809 bp, Oryza sativa
tgatcttcaagactccaactcgtactcggtttgtagcccatctccgactcggattacacgtaggcgcgcgcctatttatagctgctgccctgcccgtctccttactccattagcttgctagcgcgcggcacaagagcagtaagcgaggcgcgcatggcggcgcgcgcggcgacaccggcctgagcaaggtcaggcgctactggcccgggagggcgccggactgggcgtgggcgggcgccgctgtcgctcacgacgaggacgacgcacgtctcgtctcgacgcttgacgagatcaagcacgtggaggaggaggcgctgaggtcgccgcgccgccgccgccgccgtgtacggcagcctcccgagatcgtctcggcggcgccggcggttgactgctggcatgagcccgatcagatcgaggaggaagaagaagatgacgatgatgcccgggaggagcgcagagcgaggataagggagagggcgctgctcctgaggcagcatgaggaggagcagcttcttcttcatcatcatcaccagcggcatcaggaggatgaggcggcgtctgagtccgacgagacggcggcggaatcggactcggacgacgagcagatggccgtcgtctacatggccgcgcccctgttcgtccccaagtcacagcgcgacaccatccggctcagggaggaagaacagcatcggcagcgccggcggcttgagctggagctggacaagaagaggctcgaggacaggaaggctcagacgaggcggatcctgctccaagagatcatcaaagaagagctcctcgccgccaccaca

SEQ ID NO: 84473 - DNA, 690 bp, Oryza sativa
  unsure (1)..(690): unsure at all n locations
gagcgtaccccggcactggaggagtgggcgcccatgctagaccagcgctagacgactttggccgcccacgatagaacggcggccgaggcggagtcctccctccacctccgtgaggaggccgctgccgagcgcaaccggaccaccctcgccgcagagcttttggtggctcgttgcgcggaggagctgcggcttcgagaggaggcgtgccgggaacggaacgccgtgcttgccgtacgcgaggctgaggtgaaccgccgcgaggtggcggcacgccggctgggcgagcaactcgcgaagcgcgaggaggccgttgcgggcgcgaagctcggcatctggaaagcgcccgcgctgagcgcgcggcgatggcggcgagggcttccgagctggaggccgcgagaaagagctggtggcaggcgggcagcccagcggcgcggagttggtaagccaactcaccgcggctcaaagcactctcgccgacctgnggcgcctggtgcaggaccaagccggggagatcgtggccctccgcctcaccaacgagattagacctggccaactctccgacgccgtcgaacagctggagcgcgcgggatgcggggtaggcatcttcgtgcgccaggacaggaagctcccgcctacacagccggcacttgcgttccggctggacgggatggcggcagatttggagaggct

SEQ ID NO: 84474 - DNA, 1200 bp, Oryza sativa
cgatatattctcttcattcatgctaaagtggttctacatttatcccgtatgtgcagattgacagaggatatatctctcctcagtttgttacaaatcctgagaagtcacttgttgagtttgaaaatgctagaattcttgtcactgaccagaagatttcttcaataaaagaaataattcctttgctggaacaaacaactcaactaagagcaccactcctcataattgcggaggatgtagctggcgaagctttggcaactttagttgtcaacaagcttagaggaattctcaatgtagctgcgattaaagcacctggctttggtgaaaggcgtaaggctcttcttcaggacatcgccatcgttacaggtaaaactactgggcaggcttattggatttattttttcccgttctcatgatgttccatgtttgttaaccaatagctctcacgtctttgttaacaagtacttcatcttgctactcagatatatattcatcatttgttatctttttacaattatttagtatttatgcaatacacagacagagatgcttacatgaattatgacataaacctgcattgcataatccaaatatttatcatctggtttattggctttgtacacaagtcattctactgcaatataggcaacattaatgcatttctttgccatctagcaaaagtgacgcgctaacaaagactctactaattgccaccacctgattttgtattagttaaagtggttggagccagtaagtatggtaaagtccggagacagaactgagttacctgaacatagaactttgagaacatatctttctttttccaaaaagcctacagcttgtttcatcctgtggtgtgctctatctctattgcctgtctgatttactgttttttaatgcggtgtcttttgtttcaggtgctgaatttcaagccaaagatcttggtttactggtggagagtacaaccgtggagcaacttggcatagcccggaaagtgacaatctcccagtcatccactaccattatagcagatgttgccaccaaagatgagatccaggcaagaattgcacagctgaagagagagctttctcagacagactcagcatatgactctgagaagttggctgagagaatcgcaaagctttctggcggagttgcggttataaaggtaggagctgcaaccgagacagagcttgaggatcg

SEQ ID NO: 84475 - DNA, 617 bp, Oryza sativa
acattttcaggaagaggaacagattaaacggctggaaaggcttaagcaagagaggcagaagaggattgctgcaagaagtagcacatctaattcaatatcaacaccacagcaggtcaaagtgaaaccttcaccaaagacttctcccagtacctacaagagttcaaagtttagtgatgctgaaccaggatccttttcacctctaagaaagcttcctgctagaactactgcagagagtgaccatcagaaaacaggaaaagctagcaaactaagcgatagtagtacaaatgcagtgagtaaatcaacctcatcattggcagcgatgaagaaagagaaaaatgggagaaatgaattgtccagtgagagattgaagaaacttgctgaacctaaaagtaatgctttgaccgaccgtccttcaaattcaaagtttgctagcatggaccattcacgaaggaaaagcatgccagaagatacccaaacaaagaaaatatctgctataatgcagctcgaccagaggaaatcagcaactgtaccagaactggaaagtcaaatctccacgagctccctcgatatctgtgaagaataagacaattgctagagaaataagggatggggatcct

SEQ ID NO: 84476 - DNA, 1300 bp, Oryza sativa
ccttgttgacatatacaccttctacatgcaatacttccatgtccttttatcttcactaggctaaaaaaagtaaagaacataggccaatcaaagctcttgacgcttggtcacattgccacccctcctctttccatcgccgagttgctcctcatattctctccaaaattaagtatacatcacaagttaggggcctccatttggtgttttcatacgatcgagggcaatgccagatcgtgagatttagctataatttatcaccctctttcttggctttcttgatcatcaccgtgttcccaaatattacagacataagttggtggtatcgattgcatcatgggatagaattgatgtctacaattttggctcgataattccatcctacgcaatggtaatagcttgtttccttattgttcttgtttctttgaatatcaaaacttattattgcatagcatctttcttttctaacatggtgttaccttgacttctgttgaacattccacatattgttagacaaaaaatatttgacaaataatgcatatgagtcgaatgcatttattacgctatgtataacaatttgtaccacaaaaattcatgtatgtgcattaacactttatgatgcacatgtgtgcaatgagttatttataacataatatacaaaatgcaaatagaattgtttctccttagttattcaagtataaatgtaagtcaatcatatctctcttttttatggagacaagccaatcaaatcttaggatgcattttctagctgatacctcctccgcctcctcctccttctcattgtactctctacacaaacactactaaaaaaaggtaaacatcatgaaccaatcaaatttctcaatgtgccgcctcctctccctccaccacttactcctcctgttatcctgtcatgaatcattgctaaaaaaagtaaactccagaagcccactagatctcataatgaaagccaattaaggccctcaatttgctccaagacgacactacgatcaagggggaaattcactcagatttcagttaggatgccaactcagtatttacaatgctcggcaaattggcatcacattgcattgtcgggctgtgctgatcctctctatcctagtctttgattgtttcgtcacgcgtaatggtacccatttctttccttccttttctcttccttttatatacatatcaaaacaaatttatgagaatgcattacatctttatttttccagcctaaaccctcttcatgtcttctatatgtttgaagatgtccaaatgcaattaatcaacataatag

SEQ ID NO: 84477 - DNA, 571 bp, Oryza sativa
aagtgtccgacccacaatatttgaaaattcgatacataaactttgattagttccacccaacccatactcaggcatacttcatattgggtacatatgcaaatggtaaagcccatctaccaagagtcctctatatgtaaggtctaaatgtattttggacataaatagtagattaaatgcaaaagcataccagttaagcacctgtttgtcttgaaactttcaaaaccataaatgtccagtacaccaatcaaaatctttgaatcgggatcttgaccaattgaactattgattttatttacaagcctgtagtagtgaaaatacaatagttaacaataattataacttattactgtctgtaccatgtattatacaaggcagcagaaaaatatttcccaaaatgattgcttgtaaacttaccaatcaaacaaacgtgaataaacaatcctagataatgcatctctactaagagctgcagctcgtggatctaaattttttgtgatactctccccacgtgttgccataacacgcttacacaatgattcctcgagacccttttcatcacacctggaaaatg

SEQ ID NO: 84478 - DNA, 604 bp, Oryza sativa
ccgtgggcatggctgttcgaacagtttgttaacctctgcagagggggtacactttacccacacgacattactaacccggatcacccagcccgtggggatcagccacgtcgggagacctccaagctttcatgacaaggcattttcaaagccgacacaggtttaccatatgccgacgagaggggtcccagaccaacaacaggttaggtcccaaaccatactgtgccaggaagcccaggggtcctccccgacaccaccccggcggatccacatgtctctcggcatcaaggctcccctgataagctagttactcagctaggggtgtcccattccacccatgtggtcgtacttgtcttatgtttggatgaaattccaaggaaacggtccttaagtgcaagagcgggaaaccgtacacccggtacattccccggtccgcggttttggaaattcatttagttcgcaaaagggcccccaaccccccccaaaaaaacccccccccaaaggggtttggggtttttttcccccgggggggggggggtttttttttttcaagtttttgtaaaccaaagtttacccaagttgttaatcagattttaagttttgaagg

SEQ ID NO: 84479 - DNA, 1048 bp, Oryza sativa
tgcttgttcgaaacatgcattggttcttgccatcgctgtaaggaccatcattgttagaaggcttgaatattgcctactaatttgccgatgtttattcttgatttactttttacttggtcttggactcctggagttagtaaaatttttccaagatccaagagggacgtttgttagcatttggcttggattggctatttacacggtaaatgcgcgtcatgcatgttctaaatatgtatcttcttttattgcaggtcacttatcaaacagatcttttcctagataaaaatatagattatgctgtaaatgaacaccaaatcttgctaaatgcttcaaaatgttcttttgtttcaagtctttttccaccttgtgaagaatcaacaaaatcaactaaattttcttcaataggatcaagtttcaaggtaaaacgatgtttgttttctcttgcctttccatcatattatgcataaccatttactcccttgatcgcgtgatctcacagcaacaactacaatctttgttggaaactctaagtgctatagaaccacactacatccgttgcataaaacccaataatgttctcaagccagcaatatttgaaaacagtaatgttctccagcaacttcgatgtggggtgagatcttgcgattcaatttatttatattcatgaatactcaagtgaacatgctaacctgaaatttgattatgttggccaccactgttaactaatatgcatgtttacaccccccccccacattgttggacaatttgctaaccttgtgcatagataagggcaacttatttagttattttgatacatcttaggcgggccggataaactagaacatgatactattcttttacatgtgtgtgtgcgcgcgcgcgtgtgtgtgaaatcttcttggaatcaaacagtaacctacatgtcacttcaatttagacagtttactacctattcttaaacatttttccttctgtatagtttacatgcagaaaaggtgcaatttcaccatttttaagttcataaaattgatttttttatcagggagtt

SEQ ID NO: 84480 - DNA, 2993 bp, Oryza sativa
tccaagtttgtgcttcccataatcccactccccttatcatcgccatgttgcttaccatggctaggtaatcttcacatgacattccatattgcgatggacacataacataataaagctgttaattatctgtgattaggagatgtccgcatgacagattgacaatcttggtggttgtagcaagcaaagcacaatcatgttactagaagaatttccatgctcttttcactggaccttatagtctcctattttgcctcgggcacttgaaatggtgaccatgagggaagaaaatattactagagggaatgattattcttctaaggacaaatatgtgtgggctagtgtgctttccgcttaaggacaaatgttgcaattttccttgcagaaaatgtgtacttctcttataaaatcaagccatccctgatagttgattctgggtgagttgcaaagctaccactgccaagttagcaatgagcagctttgaacaatgcatgttggtacatgtctctctatttgtacaagaaacagagtactaagcttattctaaataggagtaatttgcgtaacgaatgtgagtttcaagatcttaagtatcatgaatgaaatttttgataaaaatggatttgtagctgaggaatacacattagcaatgcagactaaaaaaataaaatagatttaaatgtgatgtgtatatataaactaagagcagaagataaaacatgaaaattgcttacgactaagcttggcaattcaattgattaagaccaattaccaccatagaaaatgtttgtaccaacttggctttgattaagatttcagaactatcaattgatgccatcgttccctgattttttttttataaaactgaagccctgccagagtgtcacttttcagggaatatatagttaattgcatgatctacagaattcagaatggtatagccgttgttattacagatttcatatgctctccacactagaaagaagttcactatgtaatgatggtacaatagttacagtatagatttactaactccactgtgtgctatgagctttggaaacagaacgtgcaatagatatgcatttttatcaccacaatcaaaagtgcatacaaattaataattacacaccactctttataattaaatacgggttctcatattaggccccatacaaacattacattgtttacacacaacaaagcacacattaaagtagtagtgttctacagaaaacagatactccaatcatatctggaagcaaacttaatttcacacatgacaaactggtttagctatcactagatggctggccaacagactggtctccataatcaaggaagctaaccttttatttaaacattctatgtgtgtgtgtgtgtgtgtgtgtgtgtgtgtgtgtgtgtgtgtgtgtgtgtgtgtgtgtgtataagcagatcaacactgacgaaagaactcatatattagtactaatatgcagaaaagttttcttattttcttttttttttcaatatacatggatggaagcagtggatgggcattgtgaaatatgtatggattgatgggcggtataatataatggtatgtggcatatgtatggtactagaatgggtgtaggtggaatactgtcaagtaaggtaagttttttttgttgttgtagtgaatcaaggtaggtgtttagctagcacatggtgaatatatggcagatgagctagctagcagagggcattgccaaaatggcaagagaagtcacgtggcatgtcatggatgcatgaaagctgagaatggattgatgagctcggccatgattcacctgaggtagctcatcaccgtggcgcgctcgttgaaggaggcaaacggcaggggaagcttggatttatagctggcgctgtgcatggtggagtcgtcgtcccagatgagcttccgccaccatgccctctccccgctcacctccaccgcctggcttgaatgttcttggcggaggagcgggagacggcgtaggctccagcacccgcggacatggagctccttccacgccggtgcggatatggcggcgttgacatcatcgcggaggtgctgcagtagtggcaactcctgaggcgcatcctttggaggatagggagctgatagttgatgggttgctcacaaggatgttggtagaagattgtcttgaggttgtagcagaataggatgtcgagtgtcgtgaggcttggtagtgcagactcacgtggcacgatgcgctctagtcttgggcagtactccaggtgcaggtgcttcagggaatcgaagttcgaagtatcattgtactccaaaggtttgtagaaatgaattagactttggagctgagacactcgaacattttgtagagattgccccatggaatatgcatattctaaaacatgcttcatgtgatggcatgagcgaagcttgcagtcctccaacttgtcaaaggagctcagtttagtaaggcaggagacataaatatcatctatcaaagaaatcgatttggcaacttgtagaagagaatataaaccatggggataccgattcgttgcagacatctccacatgacgcttggtttggcgaatgggaggcgcaatggcaaccactgaaaattccttcgccatataacgacggtacacatcaccatatggtgatttcttatttgctagttctgtcaacttgtcggccatcatgtcttgttcatcctccaacctcctaatattggtcttgcattgggcaatttgaacatagaaatcttggaaaaactctccatattctactagccttctggtgtttatgttgaaactgtaaaacaatctagaatcttctatgcaaacatgagcaatattttttttgatatttgcaacttgatcatcataattattaccatttccttgtgcacaacaatccaagcaaaacatatcagggaatctttgtagcttatgccaaggaaaccgactcaaggatgaaacacccatgagaagcaatcgcctaa

SEQ ID NO: 84481 - DNA, 778 bp, Oryza sativa
tcttctgcaatgtgcatggcaactcagttactcacaacatgaagccagtatattctacatgttgatggataaactaacaaacatacagcagaggaatattggaagaatatattacctggaactcagaaagaccatcacctgctgccgctgctgcctcctcagccttctccttctccttctctacttcgtacttgggcttccaagacttctccaggatagaagtggcaaccttctcatcatcagcgatcaaaatgttgtcaaacaggatgccatcttgcatcgtccagatctcaatcccaatagcggcaatcggatcagagtcaggcttgtcaagctcgaagtactcagggttggggatctcttggggcttccagattcctttgtagttggggttgtcgataagaggcgcatgccacttgcccttgtaagcagggttctgcttcatcggcctcttccactcaccacaaccaggagcctcttcacacttggggttgtcaatctttggtgcttcccattctccatcctcctcatcatcccagtcttcaggcttgttagcctccggatcatcaatttcctctggctcatcatccagccacccctctggctttgtggcctcttcgtcctcaatttccatgggggcatcctcatcccagtcatcaggcttcacagcatctggatcagggattttagctctctcatcccagtcttctggctttttgtcatcaggatcaggaatggtcttggatgggataagtgatggctcaaaatcatcagcaga

SEQ ID NO: 84482 - DNA, 5803 bp, Oryza sativa
ccatggtaatcttttacttttttttcttacatatatataaaatcatgttgcatccattcatgtaagtatggcattattataacataatatgaacacctactcttttacagattataggtgagtgtcagggagttgaaggacctgagtttgaagtattttacattgactatggaaaccaagaacttgttcctcacagttgcctgagacctatcaatctatccatttcctctattcctccccttgcaaactgtgcagccttgcctttgtgaaggtgcccagtctaaatgactatcttgggcaagaggcagctatgtatctgaacagtatcttgcttgacaatgggagagaatttgaggctattgtcgaagagcgagatgctgcttcgggagggaaattgcagggtcagggaaccggagaaatcctcggcgtgactctactcgatagtgagaccgacaatagcatcaatgctgagatgctagaggtatgcaattctagacagagttttcacttaaatggtatttatatattgaagttagttaattagttctagtggttgttttcacccctatcgacctttagcttataagcacacagaaaaaaaaaactttattgtagacctgatttggggtttttccattgcaatttatttttcaatattttcttttcaatcacgaataacctcttataataagtatatattgttaaattacgttacatttggaattcactaactttagcatataagattgtaggttgtgttcactaacatctgttccttgacatactcaaactcctgaaatacatgtctaagattttgtgttgctgacttattttagatttcttttgaaaaaaaaatcatgtgataaccattgtgtatctctccatttgcagagagggtatggtcaacttgagaggaggagatgggactcgagggagaggagggcagccatcaagaagcttgaggaattccaggaggtagcaaggaaggagcagctaggcgtctggtgcccaaagaatgcaaggaagcagggcatggatgaaaacgagtaccctgtcctggccagagcaccacctcccccaaagaagggatatgacctgatcaagttcattgcgtcccggtccgactaagaaaaaaaaaaaagccttgtgtgtttgtgttgaagatgtcatgcatggagacagaacaatttccttaaatccaatttcgtttttgttggtgcatctcttgtgatgtcaaactttgagatactacctttcaacctttgtaaataaaactcactattggacctaaataacctagctatgttgtttctatggacttctcagttattggtggttcatatatgcttgtttgtttttgtaatttgtacttcagtttggttagctcactttcaagttgaaactcatagcacaaatgaaatgtctacaggaaaaaaaagaaagtgatattaaatcctctgctggctgtgcatgtcatttgtatatttttttctttttagagatgggtatttttacccggccactacatccaaccgaatatatgcagcctttttaaattgagatcttagcctaacctaatctgaaattctctcatatatagatttgatctcaggaccatagggtgctactcaggtcactgcaaccactaggctacatgccctttcacgcatgtcatttgtatatgatagaccatgaggaccttcatctaaattaataatgagcttaatgtaacatgctttaattatcaagcgggactatgcccattaagtttatgcaggggaaaatgcaagatctacaacctcatcttgtactccagattttgggccaccgcaatcatgtgtaaacaatctacactctatttttctttagaggtaaactcattgttatgttctaaatttgcacctgctggccagcgcaaccaggtgcgaacaatgagccactcacttctatggagtcatcaatttcgttctgctctgtgaatagctacaaaatcactacaaccagaaatgatagtgatatgatgtaaggatatgttacatccaaccaaaatcccatatatttaaggacggatggagtaacaaatatatgattatgtaatgcacaattacatcatatcactcatctatccaaattcgttatactaggatatgtcacatccaatcaaaatctcttatatttaagggcggagggtgcagtaactttcccgattcatgttgtgaagctcgggatgctcactcaagaaaatatgcatgtttctttggctcctccaaaacagttctgttgctttgtccaaaaaaaaacacttgtattggcctaaaacatctgtgtgttcaacttttagccttaacatcaataaacactccaattggttttaaattaagaatttgctaaattacagtcggcagaaaattaggactaaaatcttgcatatttctctttctggtgactggcagaagaggcaggtgacatcggcatctcacatggtgggctggtgttggtagcgggggtaatgtagactgagtgattaggaggtaggggtgtctctggtggcggggatccctgaagaggtctggtgggcctcaatcgcgtggtgcagtggggtggcggcaatggaaagacctaatatgcgcctaggcacacgctccccctacccgcgcgtgcggagagagggaggtggaacggcgtaggagaagagtgcaggtttctttttttttgtttctctttgtttttttttcagttttttatatgtacatataccagctttgtatccacatgtacttttttatacgtcaatttttttatacatagagtttatatatatacgttgtatatatatgtctgtatatactttgtatacatacatataaactttatattatgcaatacaaagtttatacatataagttggtaatttaaaataagggccttaaaataaatcatatgtagagcataggagagaaatatgaaaaagagacaaggttgacatgtggattgcagtattttctttttttattattaattttggttttgtttattattattttgtagtatttttttgataactcatgcatttattcaaaggccaaacggataacatggtacaggagtagatacagtgctcaaagaagcccctcaagactgggcaaaatactctctccgtccaaaaaaaactcaacttctagagtttaaaatttgtcccacgaaaaaccaacttttaccatcctacctactctcagcacgtaaaacgagaagttttatcccttcaatattctttacctaccttctctcttactactttttttaattattaagggcattttagtcattaagggaattttttgtgggacggagggagtacactgtaagacaacattttgcagaagaggacctaacaagaaactggaaaatcaatcaagtccttttcctttgtttgccttcgctgtcgatgaaatcctaaagcgcaactctggtggagagtagatccagataagccgcagatgattaagctaccacgtaatcccaaaaggggcctcacacacatgcaggtttggatggtggcaaaccatggtatgaattccaacagagcacaagaagataatcggctaaaaggaatttcttccaaagatgacaaacgaatccactagaccagcgaaaaaacaaaggaaaacatagcaatctgcagcagaaaccaagaggcaaacctatacgaggcctccgcacaaaggaggttgaaactatctcggtggagcttgaaaacctcagacgtcttgagagagagattcgccgcatgttgagaagaaggccgccatcgttggaaggaggacaccggagaaagaaagtaagaccggtattacttttgactccggaggattggatgaacccacagtgaaggcgcgtagtagacacccagctccaatggcgagtgtcaccggatctgaaatcggcggaactcaccgtgatactaggacgagggaaactgaatgccgacaaccacttcgggaaccaaaagacaacaaacaacgacatgggaaccacgaccatacgcccatacgggaagacccgactagaattacaactaatagtagggtagatgggttggacctctctccatcccttccagggcggtgagacaccggagaagaagagagagagagaggggccggaggaaagaaaagagcactatagaggggatgcagaagaactctcgagaggagagaagcatggtgaatagcatctctttataatacttcctccatcccaaaaaacatgacgtttcaccgccccagcatcattttgtagtatgttgatgttatcactattagctaacgtggactccacataagcattgtcatcgaaaattagtttgtactcatggatgaaatgtagaaatttgtaacaaatagtgaacaattttataattgagtgcccaaaattgaaccaagttaacggagcaaatttaatctttccttgaaagaataactcaaaaggaaaaaaaacatagtaacaacctcattttttggcttaagcttatggttatcagccaaaatttaaattttcaaccttaaatttgagttgattttggggaattttcatcgaagtttattttccagcctttgcttttagatcgctaagaacacgtatataaaagtcttattcacaaattatttttcgtttacaaatatgccgtttagcttatttttttgaacttcggctaattaatccctctatcttatatggatgtggagacttgggtcatatgtttcttttctattttcttgaaatttttaaataaaaattcaccctcttttaatttatttatgcataacagtacagttagtgccattacaatctatgtcgtggtgcggtaaaaagtttgaaattttgtaacttgttgtagatttgtagggtttattttttaaaacgttaaaaatgaaatattaaaaagccaataaatatttctaatgaaataatcctttttctttttatatactcctatatacatattcgacgattttagcgttcttttttcgggtcgtgagcacagcgtggtggtactggcactcctatatcggagtagtagttcttttttccttccgagatcttccatagtcacagccggttgaagcccccatccgacgtggcgtcccctctggcccaggcgtcaccagtcccacgtggcgccaccccattggccgccaccacgtcgcgcaccttctcattggccggaacaagtcacgccacgcccgtttcctcggtcgcccccccgccccgacggcccgatcgacggatccccgccgtccgctaccccctccccctcatcctggccgtccatccgctccagttccgcctcttcttataccctctccccccctctcttcatcccccaagccgcggagagagagagagagagagagagagagagagagacgcagctctgttcttcttctcctctctggaaatttctggatctcgcgagagatcgggaggacgatggtgggtgggcgcgcgctcctgccgctgcttctgctctccgcgctgctcgtccagatccgcgcctccgatccggtaagcggcgagttcttttttggtttccttggtggagaatttgcttggagtggtggtttggggggtgagatttgtgatgcttttttttgtgttggatttctgtgtgtgcttgcagctgttctatgagccgttcgacgagagcttcgaggggaggtgggttctctccgggaaggacgactacaaaggtatgcttaccgccgcatcgagatctgtgggtttagcgggtgtgcttgggggg

SEQ ID NO: 84483 - DNA, 1351 bp, Oryza sativa
ttaaataaaacgatttgcatattataattgttcgtttaatggtaaatctagtaacatcaaatttacatgattgatattttttatttttttgctattaatagtcaaaattaatttaaaaagtttgacttgtcactatttaaaaatgcttatattttgggacagagggagtagtattgatattatttatttctttgctattaatagtcaaaattaatttaaaaagtttgacttgtcactattctaaaaatgcttatattttgggacggagagagtaggtatgttttaatttctacatggaaatgaagcgcaataatgtctctatttttttttggaaatttaactcacatattcctttttaatttatatattctgattttttatattttatatttcttatttaccataattcaaatttaattcagccctaaaattattgtttggaacaaatcttttttatgttcattaaatttatatttataatattgcctaaagtctaccatgcaggatccataactataatgtatatttatatataattagataatgaacaaaaacctagtatttaaattaggctactttagtcgcttaacttaaaagaaatcgttccatattatcttgcaaaaactaatttttattcccacaacctagctagcatcgcaatatgtacatacttacaatttacaatcaaccaactaaattagggctgccatccttttgttctgtaatttggtttggacactttcggatgcagcactgcaggtacatggtcatgaccttaataacaattcaacagtagatatatactagtatatgatatatagtgtagaaactaaatctataccgtagttcaacaggaactcttcccttcttttatggctagaaactaaatctatacagtagagttgaacatttatagaatagagttgaaaatttatagaattttctatttatgtgggaattaagctttcttttacccactaatatgttgggccgttgggctctttatagctgttttttttcatccattaggattaatgttgggctctcctaggagagccttcaatcagtataattaaaattgttttcattttctaagaattttgaatgactttgcagattgagatcaacacagttgatagaactggaacattcttaggttccttatgggaatctaatatcaatgtggcttcggttcttttggaggctggtcttgctaagatcagctcatttgcagtggataagatgccagatgctcaggttctcttaaagactgaaaaaattgcaaagcaaaagaaattgaaggttagacacatctatttttaataggttaaataaatttcttctaatgctg

SEQ ID NO: 84484 - DNA, 2268 bp, Oryza sativa
tgtaattataattattaagcgtgcttacttgttttccaatcagtcttgtgcgcaggaattcctttgctgtgcgagcaaattgttcagaggatttgttctcctctgaaggcttttcaaacttggggggtctgatgcttgaaagattaactcggcgttctgctgaaggactgccataaggttcagcgtcatcagcgatgactaggcagtacccgttcacaacctctatcacctggaaaattaaacaaccattcacagggtcagctgtgttgctgtgctgcagaatctgatattttctttcttatagttataaggtagatgtagttgaataggagtaattggtacatataaaaaactgcaaataaaagtaattatatattatggatcatcatgctgaagtgcaagctgctacaaggtactgcagcaagagatgggaagtgattttaataagttatagggcatgtgacatgttttgttcccatgtgattcaatattaatggttcctgaaaattttgactaacataatgctacagattattgtatcacatatcttctcataaacatgtaaggtcaaattcaattcacaatgtattgtgagaaacagaagtgataaaactaattactaggcggccatattttttcatgtactctagagagaacttgagctttcacgtttccatagtaataaatgacaccataatatatgtgttcaattgaatttaagagaaaaatgagcaattgaaatttgaaaatcattagtgtccaaaaatggaagaaaatggatggtcaagaccactcacttttcctgtgaacttttggttgtgaattggctttgtgtttgtcaccgggggcttaaatccagtccagattcttaactgttccttcttaacctgaagatcagcattcctcaactttgtcttaagttgaggatcaagcacatttgcactccattcaacatactttgcgagtccctatacaatgtgacaagaacattggtaagtggagtgaaaggaaaatttgagtggtacgacatggagaaacaatattcgtcatacattttgaaccagatcaagtgccaagtcctttacaacatccccatcagaataataaactgaaccaaatatgttgttgaaattgtctgtaccctccatcacaatccgcacctaaaggcaaatggaaaaaaagatagtgatcagaaattatatcttttacaatatgtttacactaataaacccccacaaattagcatggtattgacagtaacaatacatatgaaaactgaaaaaaaataataacttacttctctgttaagcacccgtgtctcggtgaagtgcttagcttcttgtccaaacctgtctggtgggacttcagaataaatgtcagctgatgccaatagtttctgtgctgctgccattggtgctggagtagtggaagcttctccatttgctgcgccattgccaactccagcttgagcatttgggggaggagttgctcgtcttcccatggatggggcctggatcatagtacaaaatcaaagttcgtcatccaagcagttaacattaacagattcatgtatatttacatgtttatatataataatgctcaagatgtacaaacattaaaaggatctataaaagaatatatataactcaaacttactatcaacaaattgtgttatactacttgctaaagtaactgtcataataattattatatcatacagactagtgagaacaaagactgattagaagcatgcaatcaatacacagttcaaatcttgaaaacataaataaaacgaatggagaaaatgcatgtgattaataaataatatacacctcatatttagtgttggttgataaaactttaatcaggttgccatggtcctaattatcctcaactagcattcatccatggtagcatatacgattacatataatgtatataaaaggggctacacatcagctccatacctggacgccagcaacgtaaacttggacataaaggaaactgggaatcaagtgcacacgaatagtacttccatcgcgaacatgctctacaatggcttccaagctcttccctttgttttcagcaacgaaacccttggcatcgaaagatctgccatctccaattgtcgatggtggcagatctcttattgacgactcaagagcgccaggaagctggaagtaaaacgagatagatatatgcatcagtgatatgatcatagatatgatggtgcggcagcgcatgttgtgtcgtcgtaagacaaaacgg

SEQ ID NO: 84485 - DNA, 1897 bp, Oryza sativa
aaaatctatcagcatatcaacaaaaaaaaaatctttgcaacagcatattgagtattgttaatcttctattaccacttcatgcatgttctggacagctctaatctcttgccagtactcatctggtgattttgagagaatagagcattgttcctccttcttccttttaaatgattccatcctagctctactgccagcttcatcaattagatcaatggccttatcgggaagatgtctgtcagcaatatatcttgctgacaaataaactgctgcattgatgctttccaaagtgtatttgcatttgtgataggtctcatacttctcacgcagaccaagtaatatcttcacagcatcctcctgcagagagttcaagagaattgaaataatgatcaagtggaaggtaaccccaagagcagagagttcaagagatttgaaataatgatcaagtgaaaggtatccccaagagcagagagttcaagagattgagataatgattaagtgaaaggtaaccctaagagacaagtgatttctgaaattgaaatttgtattacctggctaggctcattcaccaaaacaggctgaaatcggcgagccaaagccttatccttatcaaaatgcaatcggtgttcatccagagttgtagatgcaatacactgcgaaaaaaatacatcacaatagggaaaggacaaataaacttggttccttttatagtagagaacactttgcactcaattgcagatgaccaaaaataatccattatacttcacagcgggtgttgtccatacagatcatgtccatgatattaatgaacattttagagactagacatccttcttcaaaggaatatccctcaagtgcacatggaaggacatcaagagtgtgtgtagcagtactgaaagggtcagttaaatactgaagccctagcaccaagtgttacttggatatattgcaacttattttaacaaaaagaattgaatatagataggatgtgcataagtattgttgtatgtcaacaggttgcaggtagagtggtattcataatacttcaatgatacaaataatggaacacatgtatggcatatttaactttatttttaagggattacctattgaattatatttatctattattttctgtttggaaactgcactaaattagccattccacaccactagataaatagatattcacctagacagtaggtaaaatgatgcaaacccaggcaccaattgctgctaatccagaaaagaatcaagtagttttgagaaacaaaatgggcaacatggattgagggatgccttttcatgacatatacctgcaattctcctctagccagtgcaggcttcagcaaattcgcaatatcaagaccagctcctttgcttcctcttccagcaatcccagacccaataagagtatggacttcatcaatgaacagtataacatcacctgcatgaaactttggagctctttgaagattgaagaccaagaacggaagttttggatcttgtaatgcatcaagtcagaatgtcagataacctgctttgcgcacttcacgtattaaactagtaactctggcttccagttcacccctctctttagcaccagccattagtagagcaacatccaatgataatatacgctttccctacataaccatgtcaatgaatggtaattatcaggtattaagtacaatcgagcaagcaaaattatgcaaccaacatgattgtatccatctcttgtagctaaaacttaccacgaggaaaataggaacatctccattggcaattttatgggccaaaccctcagcaatggcagtcttaccaacacctgcttcgcccaaaagaattggattgtttttcgtgcggcggcatataatctgaactactctttcaatctcat

SEQ ID NO: 84486 - DNA, 2649 bp, Oryza sativa
cctattatggaaaaacaacttagcaaagcttcataagaaactatgctcaggtataggctaaaatgtagaacaatccaggtgtaacatgatttaattaaagaccaagactaagaaaacagttggggaatcaagaggttcatctcatctttaggtcttgtttccctttccttttctgaagaataccccaacactacaaatggtcgtgcactaaagaaaaaaaaagtacttgcatttctgtgcagaattagataaataaacaagttaagctaatgtgctggcacagatcagctcttcaactccttgcttatttagaagccttccctttatttatcagtatatatatgtatcatactgccctttaaattatgataatttagtctttattctgaaactttaggaccatgtgagcaaaactatatgtcatgaggttacctataagtttttggatactgtgagcaaaaaaggtcagcatagttagtccctggaggaatgacacatgagtcatggctggtatgtttaaatctttgattctatgaaaccttagcatcatttggtaaaacctggttgatgtcaaagtttaaagcagagcaaagtcaacatgtttgtcaccttctgcaattctttggaccaaggtgttcagtcaagcatttcttaggaagagaatttagcagaaagtcagaaactcatatggatgtgttatgtcaatgctattcaaaacactacatgagctcaaagttgtgtattcttctacaaagaaaaagattgcatcatcaaaatatgcctggataataataagatgtttgtttgggaataaattctgaatgtaaccattaggaaatagaccgatatgaagtaaaacacaattgagaagcaaataattgacttgatgaacctgcacatacatcttataaaagaacacgacattttcacccgaattggccaatggaaggcaatgaatagcaataattgataatacttcattgcaaactgcccttagttcatcctctactttctttttgtagccatttattgttacacctggttggtcaccagctgtcaccttctgctcaagtgattcaaggattctccatgatgctctcctggcaccaatagttttcttaaaaccaactgaaaataaaagcctctcttcagcactcatatccacatccatcctagcaagtgtcttcataaattccaccatatctgcaggaacaatcatgcattgagtgaagagtcacttcaacgaaacaaggagaacaaaatatgtgtatagaacataattgatctggttgcgtcatgaaaactctaagcagaactgaaagatctgttatgcagcagaacagattcagttattaagacatgctacttcagaagccaagatcaaggcaacagagttgcaggaaactgagtcaagcattatgttgcctaccacttcaagtggggatatggaagccaagaaggctaccagaacctctatgcactatgaaagtggtctatgaattagaaagacttttttgtgttttgagccaagacgctaggagccaacaaaatggctgacaagttcagatcaacaatcatacagaacatagtggcatatatactactaagttacaacagatatgaccatctaaatatctaattgtggacatattatccaaaggtgccccccaaattatgggcaaagggcatttcaaatagtctaaagttatttagttctagcaaagagggatgataaatcaaaccacactagtacactactttatgcactgctaaacctcttttaacctaaaataaaaatgtgaaccgaaatggtgggttccacaagttccacatattccagtagatcatgtagttaggtcataaagaaatggatagaaatctctaactgtttacccatcctcataacagaaaatgtgtcatccatgattccaaagatattccctttttttcctcagaagaaaaccaaaacgcaacagaaagcgactaaggagcacccaaatcatagagttggcccccacaaaccatcacaaacatacgagcaacaataattacaaatcatccaagatatcattcatgatctcactatccccttttcaagaaccactcaaaccccacaaactggcagctaaatatcatggaaaagcaatatttttcatcaaaacatgttcatatcgcactggatacattcactcaaattggctcagagtaataatcaagaagcagccttttcgggtcaaactgctatacatccaaacattctgctcatagattttcttttgacgcaaacataatgtgcgcaatgcccggcctccgctgttcaaccaagcgaccaaaagcaaaatcatagggcagcaatcccagaagtcacaaatgaatcaagaaccccacaaatccttcctatacttaaccaagaacagggtcagcgagatttccccccaacccccaaatgcaaagaaccaagaacaagaactgcacaacagcaacgcgcaatcgaacaatccagcaatccgagatcccatcccagccataccgtcgtatctctccgcctgctcggcgagcttggccagtcgcaccaccttctccctctccttcatcttcttcacttcccagcaatggatttgtctgcagcagcagcgcttgatggcttct

SEQ ID NO: 84487 - DNA, 737 bp, Oryza sativa
aattcctgcagcccgtaaaattttaaaccctgtcacatcaaatatttggacgtatacatagagtattaaatatagacgaaaaaataactaactacacatattacgtgtaaattacgagacgaatcttttaagcctaattgcgttataatttgataatatggtgctacagtaaacatttgctaatgacagattaattaggcttaataaattcatctcgcgatttacagaaggattctgtaatttgttttattattaaactatgtttaatactttaaatgtgtatctatatatccgatgtgacacaccaaaactttacgcattgaatctgaacccagcctaaatacagccgtagtacatgaggatgagagagagagacgacgatcgatcgacttggtgcacatgcacgaaaacgagaacgagagagaaaactgatcgactcgaaaacctgcagtccgtgtttaaatttccccggcccctgctgtgttgcgcaggcaatagggcaagttgtgcgacgatcgacgacgatagatggcgaaatggaaaaaccattcatttccactttaatcctttgtttctgcatcagtggcagagagggggtgggggatgcagctagtagtactgtagtatgctcccatcggatggcctattcacctttaaaaaaaaggcaaaatttgaattttcaaacttaattttgatattttcaacgtagtttcttttttagcattggcttctaagtc

SEQ ID NO: 84488 - DNA, 738 bp, Oryza sativa
gcaagttgaagggtgatctctatcttgtcgattttgatgtggatagagtgaatccggaagcttgtttaattgctaaatcctccatgggttagctacggcatcttagactagcccatgttggaatgcggaatttggcaacccttctaaagggggaacacatcctcaggctcactaatgtcacatttgagaaagatcgtttgtgtagtgcttgccaagccgggaaacaagttgggaatccacatcctatcaagaacatcatgactacaacacgccctcttgagctttttcgtatggatctattcgggcctgtggcctacataagtattggaggtaacaagtatggttttgtcattgttgatgatttttcccgcttcacttgggtgtattttctccatgacaagagtgaagcacaagatgtcttcaagcacttcgccaagcaagcccaaaatctttatgatttcactatcaagagggtgcgaagtgacaatggaggagaattcaagaacactcaagtagaggaattccttgatgaagagggaatcaagcacgagttctctgccccttatgatcctcctcaaaatggcatcgttgagaggaagaaccgaactcttattgaagccgcaagagcgatgcttgatgagtataagacttcggatatcttttgggcggaggccgtgaacaccgcatgccatgccatcaaccgcctctacctccacaagcttctaaacaaaacttcat

SEQ ID NO: 84489 - DNA, 2631 bp, Oryza sativa
  unsure (1)..(2631): unsure at all n locations
gctccttcaccctttcttgggaaacaagtgaagctcatgtgatacaattgtatgatcttccagttatctgccactggatagctgaatggcttcctggatattgagagactcctcactgaagctgaacagcctgcgctgttggttcatctcatgctgatgccgccgggcaagttcagccacctgccactcctcccattgctccgctgggacaacattgccttccagcatctgcacaacctctgacatagcagggcgaagatgaggctccacatgagtgcagaggagtgctatttggatcatcttctccagctgttgcaaatcgtatgcagtgtccaggttgtggtccacaatgtctgtcaatcgtcctccttgcaccaaccttttcaccttcacatgtaccaaagagtcaatcccatcagggtcatctatgtgaaaagaatgagnacaccaactttcntaattcttcagaaaatttatgttgcattgttcatacaataagtcaagcatcattcatagttatacctaacttctactcatatcaattacataggtgagaagcttttgcttatctgatcttaatatgcttccattctctagtttaataagatattattaatggtgtgcaatctaaactttctttggtagctataaacgatagtaaggtaatgtaattatatcttacttgatcattgagcatgatctcactgtctccttccgagaattcagggaacactgcacgctctcctgtcactatttctaacaacattacaccatatccaaatatgtctgtcttcactgatggccttcctgtcttcaggtactcaggagctatatggcccattgtcccgcgaaccccggtcgtaactgtattcctctctctgtctatcatcttcgccaacccaaagtctcctaccactgcttcaaagtttccatcaagcaggacattggctgccttgacatcgcggtggataatcttggggttgcagtgctcatgaaggtattccaagccacgggcagcgccaagggcaattcgcactcttgttggccaatctaatgctggttcatttagtttgatatctgcatgcataggtgtcatcaacagtactattgcattagatatttttagggtttgtatcatcataaaaggacctatttttttggtagtaacctgcctaaagaagtagataattcaacgattcaattgcctatacttcctttttatcaagacatagaaaccacatttccttctatttcctggcactgttttaactaatatacctcaattgacattgtaaatgaagatgaatcatgaatgcatattctaggaacatgctaaagtgatattcttatgttactgttacctctcaaacgggaagcaacactaagattctccatgtaagggtagaccaagagtcgctcttttgtagtcgtgcagaatcctatcaatcttaatatgttcttgtgcacagcaatgcttatcaattcaacttctctcaggaaagctatttccccttcaggtttttccacttcaaacagtcttttaactgcaacctttctgccatgtggacctgaaagcactcctttgtacaccttaccaaaaccacccttgccaagaacattttgctcgctgaaattgttggttgcaatttggagttctcgcaatgagaaccgctttatctgtccaaactctagattgtgatcatgttgacctgaaattgttgcacatgcttatcatcttggtaaaaaaaggagtctttattaatctgtttcagtccatgtgaattgtttctttagctgaatatgtttcctacagtaaccatcacacaaatgtcatgctgctgaactaacctggaacatcaacgtatatttcaggtcggtggcgcattctttgccaccataacagaaatagtactatgataacaaggagagttactgctccaccaatgcttgcaaccaccttgagtttggagttatttgatccacctgttgataaaaagaatggaattgtttattgatccaaattaagggggcaatatagattgccatgttgatttctatattacctgtatttatattgtttccttcacaagaaatcaagtgttggccacaattcaaatggttacctatataactggaattacaattgtcagtattgtgaagcactaggcgtaaaattgtttgtagaatatatccttgcccatacctgtagtgagacacctgaagcaaccgtttgggtatttcaccgctcagattgttgtctgctagattgctgcaaatcacagtgagatgtgatacatcatataatgtaactgtaatccaagcggtgatatttggcaaggtcacaatgttatcaacacagaaagacttacatatcattcaatgatgagagattagacaaagaagttggaatattcccgattaagagatttttgctcatgtccctgtcgaagatgtcccattattacggttattatgatcaactactacactattgactcataatcttacttgtattcttagaaagacacagagtttgacttacagattttggagttttgaaagacggccaagagagtcaggtattgaaccatttaagctatttcctccaagttttagtgttgttaagcttga

SEQ ID NO: 84490 - DNA, 638 bp, Oryza sativa
tgggaggattgtttctcatgagatgcttgaagaggaggcccgtgagttgaggcaaatggtgaagaatgccgccatgatcaagaatcaagaggtggctttgaaagctaaacaagaggaagactcaagaggtggtaaagaaagtgaggatgaggagatggccttaatagtcaagagattcaagagctttcttcgcaagagtggttatgggaaaggaagaaaggatgatgacaaggggaagagacaatccaagcgtgcatgcttcaattgtggggattgccccaagaccaatgaagccaagcataaggttgtcaagaaaaagcctgatcgcgctcacgttgtggaggcacacatggccgaagtgtggtactccggagatgaagactctcccaagacaaaggacaagaatgatggagatggtggtgtggctaccgtcgccatcaagtcctcttcaccaactccggagcgtctctttgacaacttgagcgatgacgacaacgactcctatcatcattcgtgcttcatggcccacgggcgtaaggtaatgcctaatctaaagcccactcatgaaaatgatgactctagtgatgaggatagtgaaaatgaacttgatgaattgtttaagagctttagcaaaccgg

SEQ ID NO: 84491 - DNA, 713 bp, Oryza sativa
aattcctgcagccccgccgtgcggccgggcgcaaggccggtccggcagaaagtgcggcggcaagccccggaacgtcaagccttcatccgcgaggaggtggctaaacttttggaggccgggttcatccgtgaggtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactctggttaccatcagattcgcatggctagggaggatgaggaaaaaactgcgttcattacccccgtaggaacctattgttatacatcaatgcccttcggattaaagaatgcaggtcctacttttcagcgtactactcgaatttctttgggtagccaaataggacgtaatgttgaggcgtatgtcgatgacttggttgtaaaaacgcgcaaccaagagaccttactctcagatctagcggaaacttttgagaacctccgctccgcccgcataaaactgaaccccgataagtgcgtgtttggtgtacctgcgggcaagcttctcgggtttttggtctctgcccgaggcattgaggccaaccccgagaagatacgagctatagagcggatccgcccccc

SEQ ID NO: 84492 - DNA, 769 bp, Oryza sativa
tgcaaccacctttctcccaaagagaagttttttcttactcattttgttcgtcttttggttttttcttctgcttcagcgatgtcccgtcgcattcctcccgccaccccaaatccggccagtccgaggccgaagatccagcggccgcagaggagcggaggcgagagtctgaccggcgtgaagccgcagcccgccttcgggaagctgaagaggccgcccgggaggccgcccgggttcgccaagcggaggaagctgctcgggaggaggccgcccgggctcgccaagccgaagaagctgctcgggaggaggccgcccggtctcgccaggctgaggcgacagctgctgctggcgcgtcacttgggcctactccctcgggcggccctcaggcgacatcctccgaggcggcttgcgacgaggccgcgggcgcatcgcctgggcctacctcaccgggcgacgcccaggaccaaacgggcccgggggacatccccgagcccagtgcatcctccggggggccaagccacgtcgccttttctccaaggcggctcttctcctcatcttctgtcgccccgctgagcgccgagccccttctgcaggccctggccgccgcaaacaccgcagtgctggatgggttcaacacccaagtggaggccctgcgtgcagaacgagcggagctcgaggccgcatgggcgcgtgttgaggaggggcggcgctcggtggacgccatggtggaggtgggccgtaaggctcaccggcgtcatgtctcggagcttga

SEQ ID NO: 84493 - DNA, 697 bp, Oryza sativa
ttcgactatttagggtcactttgaatcgccggattgagaaaagtaggaataggaaaaaagtaggattttgataggaatgtaagtgtaaaacagaggattgcaaaacgtaggaaaaacacaggaatgaccgtttgattgaaccgcagaaaaaatgcaggaattggatgagagaaatagactcaaaggaaagttaccaagagattgaaactcttgttaaatttccttcaaaatctctaaaggatgtccattccataggaatttcaaaagattggatatgattcaatcctttgttttaaagggctttatgggaaatatttctataggattaaaatcctctaaaatttcaatgtttttaggctgtgggatcagctgaccagatagctttttcgcaaacatgtttgcgagtctccatttttaaatgtaaatttattaaaaattatgaaaatgacccactaaaatatggataatggtatttgatcttatagaaaaaatttattgctctgccacttacgatctacatccaggttatactcctcatatttccgccaatgcatatatatcctctagctacctggatacagagatggcaatgggtctccgttcaccgtttccccacggtgaattcatctattaggtggcggcgatgggtaatatttatccttcatagggaatgaaatggtttcatacttatcaccat

SEQ ID NO: 84494 - DNA, 3047 bp, Oryza sativa
cggcatcgggctcgccgtcgacggcggcggcggcggcgggggaagctgcgcggtgtgcctcaccgagttccgcgacggcgagacgctgcgcctgctgccgcggtgccgccacgcgttccaccgcggctgcatcgacacctggctccgcgcccacgtcaactgcccgctctgccgcgcgcccgtccagatcagcgacaagtccgccgccgccgccgcggcggcggcggccaacgccgcgccgggcgccgccgcggccgttcccggcggcgcgcccgcgccgaacccgcgcaacgcagctgccgccgaagccgacagaggagagctccagggctcgccggagcgcggcgtcaggcgagccgcgtcgatggtgacgctgccgaggcggccatggccggaggtctcgctccggtcgccggcgtcgaacagtgggcgcatgggcgagatgggcctcgccaagatcgctcgactgatgaaattctcggaagtgttggagatggccggcatcggagcgaccaggtcggtgtccttcggcggccacggcaggtccggccagtccgccgccgccggcgccggcaacaacgccgacgagatttcacggtgaattgctgctcttctgtgaagggatgaatcgctgaaggtttcagattttgggagacatggaggtgtttggtttggagagttttgtcacaagggaaaggtaaaaaaagtttatctttcctaaatcttatgtgtgattaagcaaataaataacatgagctttgtgcatacaccgcgaaacgtcagaaattgtaaatatgaattcctgacaaaaaggagatgtctttgtatgcgagtttgtaagatataaaagagatcactgctgcctgttcattacagttcatgaaattatatgaactatgtttggacttgtctttgcatcacctctcttctttacttccaatcatgcaagatgttaatttcaccaagatgattcatgactgtcggtgcaggatatggctgtgtcttgcctctttgatcttttatcaatctgtgattgttaagagattttgattcactcatcaagctatgggacttgccgacttggtgtttcttcatctctcttctttacttccaatcttgcaagatgttaatttcaccaatatgatggattcatgactgtcggtgcaaggagaagggttgtgttttgcatctttaatctttcatcaatctgtgattgttgagagatttttattcactgattcactcatcaagctatggacttgtgtttcttcatctctcttctttacttccaattttgcaagatgttaatttcaccaagaaggttcatggctgtcggtgcaggagaggggttgtgtttgattcttcgatctttcatgaatctgtgattgttaagaccattgattttgattcgctgaccaaacaacaaccttctcaaacctcatgttcttccagtttatcacaaggttgttgattgttgcataaaagtaaagcaagcaacctgcacctagttttaattccagtacttttcaatgtggttgaaacatttttgatgactgtgatcagaccaaagtacaggaaatgtgttgcaacttgtgaggaatttgttctgctgcaccaatccagaatgaactggatcctgttccaatcctgttcactgaaaaagaaaagggaaaaagaaaaaagaattcagcattgcatctggagcctcctgatttgctcatccaatggagtgcatcaatatggctgaggattctcaaggaagttgcaacgacaagccacctactttttttcccatgtcaccatcaagctactgacactgcattaaaaagatgatgctacaccatttggaaatgctaatggtgtgacaaagcaaaggagggatgcaagttaggcagttaaccttcagtcacctcacaaggcactagagcagtagtgagtagtgaccatcaattatatatcgacctaccattagttgcaggtcattgttgataaccaagtaatatggggttaagttagcattgtgttattctcaaggctcttgagaaaatggagtagtagaaagcaagtacctttcacaagttattcatgcttttttgttagatgaggggatgggatcatggtttacaaaaaccaaagaaaatttgtcggtttttgtgaaaaccggacttcttggactggcttaggaacatggaccgctttgtttacagatcaagttcatgaaaaatttaaactgagttttatttttcttataaaattttaccggattttattaggagtcaactgcttccagatggttttcatcaaagccatgaaaacctctaacctctggaatttttttttctcgcaaacggtctagtgaacctggatatgattggtgaggaatgtctgtagtacagctgatgtagtagcagacaccgacgtatgcatccggatccatatatcagccaccgctaaaatgtatcagtcttactacaaaggatctgcatccgtatgtgattggtgaggcaaaagtaatgaaaaagtttggcttggtttggtgtacctttcacaagttaatttaggctttaggataaggccatggatgattggacagtcttgtgtccttgtgtagagcctttagtagatattttggttttcttgaggctatgatatccctgtcattttttgctcagagtgagaaaaatgattaaacgagtgttgttagtggagtcccgacacgcacggcagatacttcactcgcacagtaccactgaagtgctgttttctttgcatgcttattcacactcgctcagtgctgtctttccatgcttcacacttgccagttgcctgtctctgtctacatcaaaacaaacaaacaaaaacaaaaaagtaaaaaagaagagtttttttattgaaaaaaacagtaaaaagaagagctgagagacagccttgcatcttcactgtggaaatcaaaatcttaaaaaaattggcattgttggtgacactgcgaatagcgcgtgaaatgcctgagtgcaaatatgctttctgtagatgactcacacagatat

SEQ ID NO: 84495 - DNA, 1856 bp, Oryza sativa
ttcccctcctcgccccctccgccgccggccacgacgagtgatgacgacggcgccgatgcggcagctcggctcctccctctcctatgtggggcagtggacaaaggagagccctggccacggtgcccgtggtgaggccggcggcggcgcccgtggtttttttattatttttctgagatgattttcgcagcggggcccgcctacgaaaatgatctattttcgcagtcgacgtgttagcggcggtcctcctccccgcttgcgaaaatggttttgggccgtctggaaatatcgttttttctagtagcgtcaattttccagccagcgctcctactcaagcacatttctagtacattactagaagcaatatttgatctggtcgcttccaacatatttgatccggtggttacttttggcaaacaggaaattccagtcttacattggccaattcccaagccaggtaaattccttacttaagttgcttcagtacataataagttggtcgccatccagttcatcacaattagagcaacagcaattcttgtcctcttccttaatgtattaatagatactaagttggcatgaaaaaataaatttgtccctgcattagttattttttacacatatatattacctccagtaatttgcgcagcaacgcgtaaggtattttctattattcctatatttccaagcacgaaatcgacgtggaagctaggagcatatatatgctttgtcacgagaggtcactaactcgtcatttaatttacaagtcaacacaaaataagatttatatatccctctttaattttttaattttccatggtttaggttaacgctgtacatattacacgtagtcgttgtattatttcaccaacgactacgtagccatgcgtccatatcgattgtataagcacatctaatttagtcagagtacgttacacgctaattaattagggtagttaagttagaaaaaccgttttaggcagctagcctgttaattaaataatcaacctcaaatttttaatagtaaaacagattgacctaggtagcagtagaaaagcttcggatatgtgtattcatggtgcatatatacctcaactaacaaattccttttttctttaagttctatacttgcactttaatatatcctaccccacttgtatatgacctaataatttttaatcctaccctagctattaagaaaattttaggtttacattattataaataaataaaacgaaaaaaaatgtacactcgtactccctccgtactcgtagaggaagtcgtttatgacaatgtttaaatcaaacattgggaatataaatcatgaataactctcaagttgttgagtttgaaaatgtaaaaattatatgaatatatttgtcttgagaaatattttcataaaaatataaatatatcacttttcaataaatatttttatagaaataagaagtcaaaattgtgttttggagaccgtgtcgctgtccaaaacgacttcctttatgagtacggagggagtacaattttgtattctttaaagttttcacatgtttttcctttctaccataaaatacaatgaatttaaaattgactttttatatatattcatgtagaagttctatgggagcttttataacactagaaccgtgaaattaatcaaacattgtgtatatataatacgttgcagctatagaaactggatagcaaattaaagccttgctttacttcctgtaaataaaatttggatttgccaaatggcattcgacaaaaagttgagaaatactccctccgtttcaaaatatttgacgccgttgactttttagcacatgtttgaccgttcgtttattcaaaaaatttaagta

SEQ ID NO: 84496 - DNA, 579 bp, Oryza sativa
aatgagaatgaaacatcaggctgatttaaagagatcggagcgctccttctctgttggcgattgggtctatatgaagcttcaaccgtttgtgcaacagtcggtcatcactcgcactaatcgcaaactttcttttcgtttttatgggccctttcaggttttggccaaggtgggaactgtggcttaccgtctggcactgccagattccagtttaattcatccggtggttcacgtctcccaactcaagaaggctttggctcccgtagaacgggtacagtctcatttacccgttttgcctgctgatgaagctgcagacatttcgccttgtcaggtgttgaatcacaggcttgttcgcaaaggagctaaactggtgaaacaagttcaggtctgttggtcccgccaagatcccgccgccgtcacctgggagaatcttcaggaactacgtcaacgctttccacaggccgaagcttggggacaagcttcatttcaagggggggagaatgtcatgacgactacttcatctgatccacccaaaggcacggatgatcaaggcgacgaaccaatctcacacaatgggtagag

SEQ ID NO: 84497 - DNA, 977 bp, Oryza sativa
ctctttcttaagagcttgcatagcatcaatattagtagcataagagttcaaatcaatattgtaacacctagcacaaccattgctagtagaagggttagaagaattagaaaccacatttggttgagaggtgctattccaaagagtgtcaaattgaacttcaagatctttatgacttttgtctaaattagcaaatttttcttgaagagtttcattgacattcctaaggctagctaaagaaccattagccaaattaagctcattagcaagttgttcatttttagcacattctttagctaagctctcctctaaggcaaggtttcttttcttctcaagaataagcaattctttttgcctttcgagtgattgttctttactatccaaagctctcattaacttagccaaatgttgcatatcgggtttgctaaagctcttaagcacatcatctaattcattatcactttcctcatcactagaatcaacatcaagagaagtttgagagggcttctgagtcatcaccttgcggccttgggccataaagcaagagtagtggtaggagtcgtcgtcgtcatcactcaagttgttgaagagatgctccttgcttgaagaggatgacttgaaggcgacggtagcaacaccaccttctccttcaaccttgtcttttgacttgggcttgggcttgacctcgggatcttcttcatctccggagtaccacacttccgccatgtgtgcctccaccacatgagcacgctccggcttcttcttgcctcccttagcgttagcttcatttgacttgggacaatcggcaatgaagtggccatattcgccacaattgaagcacgctctctttgatgcttatttcccttgtcatcatccttcctccctttgccatagccactcttgtgaaaaaagtgcttgaatctcttgacaataaaagccatttcttcatcttcactttcttcacaacttgactcttcttc

SEQ ID NO: 84498 - DNA, 792 bp, Oryza sativa
tgccccgtcgttggttaatgaaggccagatcccgttcatcaagatgaaaatagcgcgccagttgcacgtcattaggttctgcagcataacaaccgtaattctgtttttggtcagaggttagaaagtcgacaggcatatcaggctccctacctgacagttattcattaacaattttgcaaccgtccgaaatattataaattatcgcacacataaaaacagtgctgttaatgtgtctattaaatcgattttttgttataacagacactgcttgtccgatatttgatttaggatacatttttatgcgactttttggttacgcacgggtatcaaccagccagcaatctctcgatattcaaattgaattgaagatcaccaattgattcttctgggttattttcatctaaatactcctttgcgacaagcctacactttcttaaaatgtcaccttgtgcagaattccattttttcaaatgttcattcaacaatgtttctgatgatatttgagatgacaatttgtaatgagatgatatatatgatgctatctccattagcatagcgtatcgccataatagtcttgatgctgcccttgctaaattaaatgatcctgtaaatggtttcaacattgatctggaaccaaatatttgagaatcgtctggtgagaaactcaggattaatatttttttgtctttcttccaatgctcatttagctgaataaataaagcacttttacctgtccctcgtctaccaacaacaatggtcctgtcatcagtttcaattagagtcctaaagtca

SEQ ID NO: 84499 - DNA, 612 bp, Oryza sativa
ctgcgcatgcagttgcgacggcctcccgagctcctgcatggcgaggtccagcgacagctcggcgccggacgccttctgtttccgaaggaagttcccgatgagacgcgtgggcggatcctcgccgccgtctaccgcacccgcagcgtgtgccggctgcggcgatagcgaaggggacgacgcctgcgacgacgaaggccgcggcggcgcccggttcttgaagctgaacgcctcgcaggcgcgccggccaccgccaccgccaccgccaccgcctctgcctccacccccatcgctgcccccgtccccgccgccatcattcttccaaaactcaacgctcccgtcccgcctcaccttgggcggggatcgcggcgagttggtccagctggaccacgtcctgctcgccccccgcggcgtgctcgccgtggagtcggtgttcgggctcacattccccgccccaccgccatcctggccggggaacgcgaacggctcgcggcaaggcccctccccgtcgatcctcacgaccacctccccttcctcgccgccgtcacgatcggccgccagtccggaccgctcatcgaacacccccgatcccacccgcggcgaggacttgcctga

SEQ ID NO: 84500 - DNA, 679 bp, Oryza sativa
gcaggtatggtacgcatgaggtccatctatccatgccggtgttctggcgccccggtcaggatgaaactactggcgataggtagttataacatggaccgtagattaatccattggggtttgcagaacaatgagaatcagttaaccagttctcaacaatcgcttacgattcagcaaagatatatatacaaaaaaaaaaagcaaatgcttatcaattgtatcatcatgaatatatgttgctgggagttcttggtagcatcgcaatcacgctaagcagaccatgtgttgatgaaaacagtttcatgtttcatcgcatctctacaagtcacggaagatccaaagaacatgttctttcttactggtttggtttcttcttcacaaaataagagagggattacatcggaaaaaaaattgaatgaagtatgaaacccaaagtacaacaaagactcggtttctatttcttcttcccagccttgccctcctttcttctgacgatctcatcggcataccggatgcccttccccttgtatggttcaggcggcctccacttctttatggaagcagcgaattgaccgatctcgctcttgtcgtagccactcacaatgatcctggtgttctcttccaccttaactttcaggccttctggaacagccatccgaaccgggtgcgaaaatcccaggtt

SEQ ID NO: 84501 - DNA, 784 bp, Oryza sativa
aataatattgtatagctctaggaccgtgtttacaaagtagctttgcgcaactaagtgacttttaatgctgtttactgcaaaccctaaccccctatattatggctcccttgtactcccttgcatttattctgcacttgtgggtgtgtcgtgttgagtacggtggttgtactcagtcttgctcaatttttctcaaacccagaagaggagttccttgaagatgaaggctttggtgtatagctcgtgcctgccgtcaagcgcctgtggtcgtcgccctagtcttccgctgtttcccgtttgtctttgtgtgtgctgggccttcgctgcccgggtaataaatctatttacgcttccgcttgttaaactctgaattggatcaacttttggtgtaccttgcctcctgggacaaggattaatgcacgcacgtaaggaatgcccgttgggttatttccggtcgtgacaccaccacggtatacagacgggagacgtgacatagtttccaacccaccctagccatagacaagagtaccgacccaatcccacctacggccggaacccccgggacaggtaggcaggactgagcccctagcagcaggacaccggccctgtgccatgacatctcgactaccgggccgcagctcgtgtagccttcatttgtcctagagatgtccatcgacccccgacttcgtccatctccatccgtatacttttgtttatagccagactgagccacaaactaagccttacccactagacatgtgcaagtacggtagtgctttgcaacaga

SEQ ID NO: 84502 - DNA, 523 bp, Oryza sativa
tgtacatcgtggggctcggcctcggcgacgagcgcgacatcaccatgcgggggctcgacgccgtccgccgctgcgccaaggtctacatggaggcctacacctccctcctttccctcggcctcgacccctccgcgctctccaacctcgtgcgttcccccccccccctccccctccccctcaccctccatgcccgccacctgttcgaccaaatgcctgttcccgctcacgcgccatcgccccactgttttcttgcgcaggagaagatgtatgggaaggagatcacggtggcggaccgcgagatggtggaggagcgcgccgaccagatgctccgcgaggccgccgacgcggacgtcgccttcctcgtcgtcggcgaccccttcgggtaatggtttgctctctgagagccttctgggtactgtaaacctttgctcttgtgcgacagcttttcggttatgtcctgtttgaatgacaaattgcagcgcaactacacacactgatctggtggttcgcgccaagaacatgg

SEQ ID NO: 84503 - DNA, 1946 bp, Oryza sativa
  unsure (1)..(1946): unsure at all n locations
aagagagagtttagagcactcaaccagggatctcgttcggttactgagtaccttcatgatttcaaccgtttagctcgctatgctccagaggatgtccgcaccgatgaggagcgtcaggagaagtttttggagggactgaatgatgagttgtcctatactttgatgtctacggaattccgagatttccagcagttgatggacaaagcgattcgtcaggaagacaagtacaaccgtatggagcagaagaagcgcagggctgcccaatttaaggcacagcagggtagtaaccagaggccgcgtctcgttactggacctcaagttccatcgtaccctcaaggaggatcttcatcagttgtccgtccccaacgccagttctacaacaacaatactggtaatcgtagcaatgacaaccgcaatgtggttgctcgtcctgcagcaacttcagttcagaaccagcctgtcaggaaggagcagggaagtaagccggtgatatgcttcaactgtggtgatccaggacattatgctgataagtgtccgaagcctcggcgtgtgaagaacgttccagccccgaacaactccaatgttccagcaccgaaggcacgtgttaatcatgttgcagcagctgaagctcagaatgcaccagacgttgttttgggtacgtttcctgttaactctatacccgcaactgtgctttttgattccggtgctacacattcctttttgtctaaaagttttgcaagcaaacatgggatggaagttgttagtcttgggagacctttactagttaataccccaggcaatcaagtattttcgacacggtattgtccttctgttaccatagaaatagaagaagtttctttcccatcctctcttatcttgctagaatccaaagatctagatgttatcttagggatggactggttatctcgtcacagaggaattatagattgtgccaaccgtaaggtgattttaaccaatagcaatgggaaaaccgtttctttctttgcgtcctcccctaaatttcatggtgtgatcttaaaccaagttgctctacaagagatccttatagtccaagantcctcacgtgtgttcccggaagatttgtcaggtatgccacttaagagagacatagagtttcggatagatttggtacttgcaaccaacccaatccataagagaccgtgcacgggaaattttcgcgcaagcgtaatccatgttagcgtgagagtgaagaaacaggtggatgattgggctcagaaaggatatattagacccagtacttcgccatggggagcaccagtcatctttgtggagaagaaagatcatactcagagaatgtgcgtggattatcgagcgttgaatgaggttactatcaaaaataagtatcctctacccagaatcgatgacctgtttgatcaattgaaaggtgctacagttttctccaagatagatgtccgttctggatatcatcaacttcgaattcgtgaggaagacataccaaagaccgccttcacaactcggtatggtttgttcgaatgtaccgttatgtcgtttggtctcactaatgccccagcctttttcatgaacctgatgaacaaagtgtttatggaatatctggataagtttgtcgtggtgtttattgatgacattcttatttactccaagacgaaggaagaacatgaagagcatcttcgtctagctttagataaactacgtgagcatcagctttatgccaagttcagtaaatgtgaattttggttgtctgaagtgaagtttcttggtcatgtcatctcgtctggaggagtggcagtagatccaagcaatgtggagtcagtgttaagttggaagcaacccaagacggtttcataagtgcgtagtttccttggacttgcaggatattaccgcaggtttattgaggaacttttcaaagatcgctagaccaatga

SEQ ID NO: 84504 - DNA, 8927 bp, Oryza sativa
tgccatccttcggacgtttatcgccttcatcactagcacatctagcatgctacaaagacctgtcagtgaagccccagagtcgtggaacatggcgcatctcatcggcagagacggtgacgagacgatgctgtcgatgcgcgacgacaacctctatgttcttgggtttgccaacaggagtggagattggcacgcattcgagaggcacgcccatctttttcgcgaagatgtgacgcccctcaagatcaatgataattatggttctcttctaggagctgggcaccgtggacataaggaccgacctaggatcgcccttggccaacaggccgtgctagatgccatacaagcattatccaactacgatccatcaaccacagatgacaggattctcggagatgccctagcaaccctgatcgttaccctgccagaagcggtacggctcaggaaaatccgtgactggcaactcagaggatggtccacagggacgcatcttaccagtaagctagccgatgaagtagtgaaatggcgagtgatgacatgtggactcctcgttagtcacaggaacaatggctggtggggcggagaggaggcaagggacttgtatggatcgttacgtattgcgaacaaatttggtgcgatggagagagtcggcgtcatgctttggcccgcacgaaggaaatgctcggaggaggtgttggatgaatggcacatcagcaaaatcaggagagatatgatgatggtgcagcaaagaggatgatcgatcgcgcgcttgtgtttttttttctctctcaatgtaatagctgtattaaatctataagtgttttcttatcaatgtaataggtcatatttactctttgcaagtgtttatctcaacgtacgtaataacttgttatgtactgatctaaccatatttaatttatatataagccatatttactctctggaagtatttacaaagaccattcgacttttaaaatataaagtatatatgtccatgtttcttgcatgaattgaacatttattcattttgatcgcacggccggtattgctagactaattaaaaagggtgaattggaaccatgccattgtacttttgcaataatatactcgttcatgctaacgctatgggctggctacggagacatttattctttacctcttaccatgtggtctacaaagaaaatcgctacataaattttaacaaaaaattcaatacattgtcgcatgcataaaataaatcgcaacttttgataagaagaatgatatgccttggacgtcatttcttaaaaaaaattgttaaagcatatatactggctttcatagtcatgtaagaatctacctctaataaataaaattttctggtgaatagattcgggtaataagttcatccgatcctctcaatagaagatagttaatcaagttcttatcagagctgatgggcaatcctcattgttatgacagttgatttttgtacttgacatttcctcaaatcaatcaatgcaacttttctagtacaggtacaaaactttggtccatacacaaacatgaaggctacctgctcatcataggaatatcttcaggaagctcacggttgctctcgcaattctggaatgcattgcatacgccacaggcctccctcttttctgcagctcgtcctcatccttttttttttttttgcatttgcacttttatgctcgttaacttggtttaatataccaaccacccatagtacaatgatcctctgactatgtgtgaccgctaacgtgacgcgctacacaggcaactcatttgcacttagccctgaccagtacattccaacccgaatcctcaaattggctagggtttcgacggtgaggttagcggtgggaggcagcgaggtagctgctatggctgcctagctgatgagattaatggtaagaagcggcacagtccggcaaggtaagcggtggcacggtgcggcctgattaacggcgggaggcaacttacacacttggcatcgcatggattctccaagctcgtcctcgccctacagtcgccggaagaaggtaccattgattaagtgcacgttgtgcaaggataaggccatcgtggagcgtagaccaatggcatattgctaatcggggctacattttctaagaaagaggaaataatgatttggggactttttttttttgggggagggggggattcgggtgtcactatagctacaaggaggtataagcgacgcgctgtgatgtgaagggggctgagcacataagtgttgcttgtgcggcgtgacacgttggcggtcaaacatagtcaaagagcaattggaacgggggtggtacaataaaccaaattcatgaacctaaatatgcaatttttaagttttgggacctaagtaacatcaccctacaagtttaaggaccggctatatatttcactcgatatcttatcactgcttagtactataaaataacatgggataatgggtcaaatgttttcatgatcgtactcatgtaaaatagatgtcctgagttgtgtactgaccgagtaaaaaaatgtgaagtctaaacagcaagcaacaggaacatctgaaaatataaagcgctaatcatctgagctaatcactccttcaagtcttggaacatatcaaatgttaataatgaaaaattcatattcaaagcatcaaaattcagagtgtatgttatacctctatgctgcagaatagaacaaaattaaaagcatagataaaagcagagcgatagtcaagatagtacctaattacctgacctagagagcaatttgaaagaggattggacggtgagtaagaaaaaccatcgctgtggcagaacccctataggtggtacccatcacacataacggagcctgtcatggtggagcaggaagcaacaacaggaggtcgaccttgtacttaaaattagctggggccaaacagaatgtggaagacccataattttaccaaaacaaaatggaaagtggatctgcaacgtatcgcccaatggatctgaaagacagtggtcattaattagcaagaatagtaggattatctttgtaggtttcaattctgatatcaattacatggataaattatgttcagattgtgttatgtgtataatacagggagtagtagttccaattcatttcatgcagggatatttatgtcaacaaaagctttgtagtaattcttaattgttgggttagagaagtcgtctttagaagtaattgatttcaagataaattcagcagcagcgcatcagtagaataaactatcagatgccctattaccccacataatgcatgaaattaaatttctttatttctgagtagcctccagatcataatgaatgcattggacaatatgtgggtttttaagcaatctgaaaatcagttggcccaaacacattggcatacacttaatacttacctatgattgacaagaaaattgattgatgtactgaatggcagattgttccacttgcattgaggcaaaaacctcatgagctttgggcaaagcaaaacagagtacgtgcccaaatagagatgttgctcgtaatcgttcatagctcaagtccaaaccaaatcagacagaatcaggcagaaaaacaatgaacgaagaagatgttgaaactggacaacagaatgaaaggaaggaccttgaggagaggatgcagagacgctgaattcagagctctacctaccacctcgccgctgctccgctcccccggagaactccagtccccgccaatggcgaaggccacaaataaccaccatgcatggcgctggagcgagatgcggccccttcggtgtagccgtcggtgaggtggagcagcgcgatgaggcggttacttcgtggacgggcgttggtcgaggaggggcgtcgtctccgagcgcttgcggtttcaaggtctggagacggcgatctgcgaggaggaggagacggtgtgacgcgggtaggcggcgatgtggggaaggaattggcagcgatagcgacgaatgcggatcggcgactgagggagggagagtgatctgcaaggggttgggggtcggtgcgacgcgtgggaagcgaggtgaggtctcgtcgcgcacgcctcgcgatcgtagtgaaggcggactaggtttccgtgggatgtgatgtgactagtacggtgatttcgggagaggtggtatgatatgagcgctctggttcgttggatctgtaccagaacatctgcaccagattgttgttggtgaaccagataaggaggaaaagacatggttatgaaaagaaaaataataaagttatgctctcacaagcatgagcatgatgttgaaaaaaaatgtagccatgccctctcctaatcaataaggaaggatttttgggagaagaaagtaagcacagaggagaagcattttatttatttttcttcataaaccattttcatcatataccacacacgctgcacgatcttggtcttgatcttgagtgtgtttagttatctgctttagtctgagtttttgacttagtaataaatgtgaatgcaagtatatcatgtttgatctctaccaagatccacatatcaaaccttagagtaggaatcaaaaaggcagaaatggtgaggaattcaaattgatacacttagagagattgagtggatcatttgaggaacttagttttcttttgcaaaatcatttgaaaacttccggaataagaagttgaataaatattgggtgattgatgctctaattgctattctgtctttcaaccgcccaaggcaaggagaagcagtgtctcgtgggaatcaggggtaagggtaagccaccgtgccaaagattatttaacctgagagagagtacatataccttgcacctgtatatttgagatatacagcatagtaacaactcctgatcaacaaccaagtctttgtttcctttcatccttcactcgggatgagcaaaggttcaagcttggggagttttgttaacggtcgttattgatcagttttgaccgtcaatattaccaaaatagaagagaactagtgatgcttgcaatgcatatatatgttagaataataatattccactaatattaggtttactaacctttttgcagagaataacaataaagtggaggagaatcgacatcaacacagacgataaatcaatcggacgaggtcgaaaattagacttatgtatgaatgagccaagaactcagaaatgacacaaccaataaggccaaaattcacaagtctacggaggagagtaataaaggaggccgccagccgacgatgggccagattggcccagcccatggttcggccgaacctcccggggcgccaatggatgaagggtttggatggacggctgggattgagacccaatgacggttggagggtattaccgaccattccaaccgtcataaccgtcattacctgcttataaaaggagctcctcttctcacttcactcacacacctcaagcaaagctctctcatattctctcaagtttagtttagtagtattaagctagtggaataggaataaagtagaaatcaggagtccggaagccttcggaagagttcgggtatggctctagtagtttttctttcctcctttataagctttgtacttttattagaatactcttatatatacatttatggtattgaaatactttctgagtatatgaatgctagctttacattatgttcatgttatactgaatatactgctagcttatctgggagatgctttgatgcgggtataatgtttgcttatgcaattactctatgtcatgaagatgatattagagtagtatctggtagtttagacatgatgtctagattacgagatatcattatttggggttatatgctgcggatgagaggtgagccgctgatggtgacagctcagtacgagtattcctccgcgcgtgtatataatcctaagttaattccctggggagggtactcctccgtatttagccccggttgtatggtcatgacgggctgtcgtaaggaactcggcagtcaggggtggcttctcgaagtaccaggatggcatcggatagagggtattagctagtatatcggataactagaatgtatgtatattatgtttattaaaagtataggagtagattatctttctcttttctttccacatagcttagataatatattatgagaatgagtagctactggttgtgttcactcttgtcgacgtttgatgtcgcgattccggtatttgcatagtatggggatcgttggtactaggatatatgcgagattgaggtaaaagagatggagacagggatttttatacaggttcgggctcctgaattgtcaggtaatagccctacatcctgttggccgaagccggtcgttgctcttattcatcataattacaccagtacaatatttggggtagcctatctaactgttgtcgacttggcggtctgaagtgctgactcatagtcgacaacagggtagtcttcctcctcgaatctatgcccgacgagatcagagatagcgctagattcctctctttggttcccgtgggtaccctatggggttttcctaggcttatctctgatatcgatatccggcggcttgtcttggcgtatgttggcttgtatgttgatcttgcgtcttgatctattgttccgtatcccctctcctcctagggggccttgtatttatacccataggtgtccccttgtccaagtagaactagggaaaccaatttggatacaatccgagtagtacttgtcgtttccatgtagaactccattcatccttccttatgcggaactcctcctatatccgaaggttgtttccgtataagacatggtatgtggtgggtcctgccaagatttagtcaactactactaggtatgtggtatccataaccctgacaactctacccttggattatcttaacccctgcttaggatattattatcacaagtaacatataaattattagtcaagttctctctacatgatcttcccacaggataaaataaatacgatacccttggaatactctcaggtgaaatgctacaatggtatatccgtgcgcttgcggatgaactctgtaaccataatataccagaagtatttctgcgtcattgctgggaattatatttttagtaatgtcgttaagaaataccaacagatagtcttagccttagatagattacacacgttccctaagttcgatatccttttggggtcacccgaaggtgaagtgctacagtggtattccgtgcgcttgcggatttatctgtggtcgtaaaaaatacccaaactcttgagacacaccccctccactatcggatcgaggacgagtggatagcgacctgggtgggggaggtggtcgaggtggtcggatcgatcgaatgtgatcgaggtcttagaccaccgtagatattgcggtgtgtcagagattgcgttaacttatgcttgcgtcgggactcgtatgcatcggggcagccgtagatatggttgagctcggcgtgagggctcgagaagcttgtgacttggtcttgtccccgtcttgagagggatcgtgtgttcttcctcctgagccactcttgtcggccaattgctgggcatactgtttgagtagccagcattgcttagcggagtgcttgagctcggggtggtataggcatggaccgtccatcatcctgtcgaagtcgtctttcttgggttggcggaacttgcgctgggcgttgctgcgcccgatggtgttgactttatcatcactcttgcacttgggtggcctactacgggaggagttgctttctcgacgcggctggtacgaaggcctcctcttgatttgggcgtagactgctagctcggagttggcgtccttgttggcgtggtcgaacatctgtcggacggtgagagcggcgcaccctccgagtgacgtcttgcaggcccaccacttgatgaagtcttcgttcttgcagccttgttggaaggcggccatcacctctgtgtcggtgacgtgtgggatggtgttgcaccgttccgtgaagcagcgaatgtagtcggagaagcattcgttgtggccttggacaattcggtagaggtcccactgggtgcccgggtgagggaaagtgccttgaaagttggcgatgaactgtcccttcagctcggcccagctgttgatggtgtaccttggtagccctgtcagccatgctcgggcgacggtggtcagcatgaccggcaggtagttcgctatgaccacctggtcgcccccggtagcttgaatggcgatggagtagacggcgagccatgcgttggggtcggtcttgccatcgtatttgtcgatgcctatgggtttgaagttggctagccagcggactcggcataggttgtcggtgaaggccggtatgccctcagcgccgtcgtcgcggtgtgggatgtggtctggtgagtggtcgtggtagtattggtaaggtcgatggacgacgatgcggccgtccggctggacgtctgtgtgacgacggctagcgtcgaagtcgtcctcgtgaatccgcaacctttcagcgtcacgaagtcggcaatgctcgttcatgacgttacggaggtcggcgtttagccggcgcccggcttcgatcttgtctcttaggtcgctggtgcgtagactggggtgtgaactccccgcttgggacgccttgacgcgcttcaactcaaaggctggttgtcgggactgtctcttgccggaggaaccgccggcagttgaagtcgttggcagtgcatcagcgtgttgaacagcggtggcttccaccatagccttcacttgggcgatggtggtgttcacggccgggtcgactgggaccggcatgttgtcgaggagggccttggcggcgatcatgttgttctacggcgtggtgaagacgccgtgttctcctagcttcacttggaggatagcgtcttg

SEQ ID NO: 84505 - DNA, 1321 bp, Oryza sativa
tcctgcagccccatatgtgaggtgcttttataggtacataatatctctcatgtctatacattgaaaatttatagctggattgcacacatgaatagtccgtcgtaacgcgcggagcattatttagtttttttttaattctagtgtcacataagcgtcacgtcaatgctacgtggaacgaggaccgggtcaacaccaccacgtaggcaccacgtcagcgaaaccgctctccaaaatcgctgagggagttaaattgcgccggttttaatagttgaaggtcgaaatatccggtattgtggttcacaggttcagggatgaatggccactcgttaagagattcaaagtgaacttattgtggtggctatagcttcgtcagcttgttagaccgtttgagcgtgttgacaaccgaccatgatatcaatctattatattattaaaggaatagaaaaaggagcctccacgttcactctcatggcctagaaattctcacattaatcggagaaaaagaaaaggcagagtccatatggaaatacaatttagaaatagctgaaatttagaattaaaaaaataaggaatattagaagaggagactagagtctatatagaaatacaatttagaaatagctgaaattcggaattaaaaaataaggaacattagaaaaggagactagagtccatatagaaatacaattaggaaataactgaaattcggaatttaaaataaggaatattagaagtaaagtatagagtccatatagaaatacaattaggaaataatagaaattcggaattaaaaataaggaatattagaagtagagtatagagtccatataaaaatacaattaagaaaaaaaaactagaaattcggaattaaaaaataaggaatattagaagtagagtatagagtccatataggaatttaaaactaactaaaattcagaataaacataataaaattaaaagtagagttttgagtccatataaaaatacaatttacaaataactaaaattcgaaattaagaaaaacatgggaagaagaatttaaagtcaatataggaatacaatttagaagtaactgaaattcgaaattaaaaattaaagaatattgaaagatgagtttagagtccacatagaaatacaattagaaataataaaaattcagaaataaaaataaataatattgaaagaaaagcctagagtctatatagaaatacaatttacagaaaattcaaaattaaaaaaagaaatattaaaggacgagtatagagtccatataggaatatatataacttacaaataactaaaatttgatattaaaaataat

SEQ ID NO: 84506 - DNA, 560 bp, Oryza sativa
atttgtctttgaaaaatactttcataaaagtatacatatatcactttttaataaatatttttatagaaacaagaagttaaagttgtattttggagaccgtgtcgctgtctaaaacgacttcctttacgagtatggagggggtagtttctacacaatatccaacatatcatgagagataagagaataaatttaagtatggaagaatgggttatatgaaagatggttatatatttattgatgatgtggagttatgaaaactatgtctaatgctggttagactggtcttagcgacttgatcataacccgtgagccctatacccttgaccgacaccgcactggcatatgctggtccttgggacatgaattgctgaggatgcactgtcgacactgccgcaggcatcgcgacactgaccgtggtcctgcatgatacaaatgtgtgcaacatgagaggatctgggacccatccatgaatttaattattcttttttatgaaataggatcacatgaattttgtagagttaaacaaatcttttttttttgttgtttgttaagtgagtcag

SEQ ID NO: 84507 - DNA, 673 bp, Oryza sativa
aattcctgcagcccagaagagtcccccgagccgaacggtggcctaaggctcccgatgaccggggttgaccctttgcccgcttgtccgacgacgccaggagcccccgacccccaggacggccctgaggccactgtgggaaggccgcacctgtcgtcctccgaccccgaggtcgtcagcacagaagacaagtgcgccccgcgaggccgcttggacgaagagcgccccagggatgcggcccctggcgaagaggatcggccccatcgaaaggtgcagcggcccgtctactttgttagtgaggccctccgggacgccaagacccgataccctcaggcccagaagatgctttacgctattctgatggcttcgaggaaactgcgccattatttccaggcgcatcgggtcacggtggttacgtcttaccccctcgcccaaatcttgcataatcgagagggtacaggacgggtggtgaaatggacaattgaactttctgagttcgatttgcactttgaaccacgtcacgctatcaagagccaggccctcgccgattttgtggcagagtggaccccggctccccgccccccgggaaagcccaagttccccccccgagccagctcgggcccctcgcagctgcctcacaccgcccactgggtgaagcagttcgacggctccctgt

SEQ ID NO: 84508 - DNA, 1390 bp, Oryza sativa
ctgcaccccgagctcttgcatatggatttgtttggcccaacaacctataagagcattggtggtaatagtcattgccttgtgattgttgatgattattctcgctatacttaggtgttctttttgcatgataagtctattgttgccgagcttttcaaaaagtttgcaaaaagggcccaaaatgaatttagttgcactcttgtgaaaattagaagtgacaatggttccgaatttaagaataccaatatcgaggactattgtgatgatcttggtatcaaacacgaactttccgctacctactcacctcaacaaaatgctgtagtggaaaggaaaaatcgtacattgattgagatggcaaggactatgctagatgaatatggtgtttccgattccttttgggcggaagccataaacaccgcttgccatgcaactaataggctttatttgcatcgtctcttgaaaaagacttcctatgagctaattgttgggaggaagccaaatgtcgcctattttcgagtttttggttgcaagtgttatatttaccgaaagggtgttagactaaccaaatttgaaagttggtgtgataaagggtttcttctaagttatgcctcaaatagcaaggcataccgggtctacaacaagaacaaatgtattgtggaagaaaccgccaatgttcaatttgatgagactaatggctcccaagaggggcacgagaatttggatgatgtaggtgatgaaggcttgatgagagctatgaagaacatttctattggagatgtcaagcctattgaagtggaagacaagccatccacctccactcaagatgagccatctacttccgcctcgccaagtcaagctcaagttgaagtggaggaggagaaggcacaagatccacctatgcctccaagaatacacaccgctctttccaaggatcacccaattgaccaagtgttgggtgacattagtaagggcgttcaaactcgatctcgtgtcgcttcgatttgtgaacattactcgtttgtttcttgtcttgagccaaaacatgtagatgaagctcattgtgatccggattggatgaatgctatgcatgaagagctcaacaactttgcaagaaacaaggtgtggactttggttgaaagacctagagaccacaatgtcatagggacaaagtggatctttaggaacaaacaagatgagaacggattggtggtgagaaacaaggcaaggttggtggcgcaacgtttcacacaagttgaaggtttggactttggtgaaacttttgcccccgtggcaagacttgaggctattcgcatccttcttgcttttgcatcatgctttgatataaaactatttcaaatggatgtgaaaagtgcttttctaaatggtgaaattg

SEQ ID NO: 84509 - DNA, 752 bp, Oryza sativa
ttagtagcctaagtttccgtacatgcagtttgtaggtggctcggtctctcaaggttcagaattgcaaatagaggtggcagaatttctatggcaagatgttgaggtaagtagtaaccatcaaaggacatagtttccttctacattttcctttatatggcaaactaactttatttgtttaagttttagctcgatggaagcctaatcgttttagctgacaatattatgggttcaaccaacaagaataatactggagaacaaataatgcactatggtgccaggtaaaatcctttccttgcactcttatctgtaaactcttgtcctgtacagacgaaactcaaaactccatggttgttgaaaggtgtgggagatgcaaactgcaaagtgttaaaattgtgaataaagggatcaactggattctgccaataatgtctactggaagcatgatgtcgagagatcagaatctgtgaagatcattcttcatgaaaatgccgaatttgaggcaaaagatgttgtccttaaggtgcaattatttataaacactttgaattccattatctaaaaaataaacactttgaatagtgtccccgctttttcttttttcttactattgaatatccttgttctaccagggtaaccatatctttgaagttcccactggtcatagaatgcgcattgttcaagatggaccaggtttgttaaatacatgtcctattttcctcttatctttggtgccattttgcgaaaaggctacc

SEQ ID NO: 84510 - DNA, 3420 bp, Oryza sativa
ttcagcagttcagctacacccaaacagcatactgttacagaagaaaagaacaaaaaagcagcttggagctatacatgaccatggcagatcagcaggtgtactcctagtacattgttagagcaagttcaatattatagacaactactggctccaattcatctatagccaatctaatagctcattcatacaatagttacatactacactattaatacctagtctcacctgtcatagacacactgcatcttggagtgctacagctggctacaaatctgtagtccgctgctattctctctcctgatttatctccttaaaatatgtttgcagctggcttatagcttgctattgtacctgctcttactagtactactcctggtactatagtattgacaccattctgtttgcagtcttgcactcaagtggtttgatgctgatgctgccagtattcaaccacagaccaaactgacataggaatataggattccctgcagtttggcacagtggaattcagactttgttttcaggtctcgtttggttgtttgcaatccagtgtacagtattactactatggccattatggccatgtttaggttgtgtaccaaaaatttcttgtagtataagaacacacatttaaagtattaaacgtagactaataataaaacaaattacagattttgcctgtaaattgcgagacgaatttattaagcctgattaatccgtcattagtaaatgtttactgtaacattacattgtcaaatcatgacgtaattaggctcaaaagattcgtctcgcaatttacatgcaaactacgtagttgttttttttcacatttaatgctttatgtatgtgtctaaacatttgatgtgacaaattttttaaaagtttgaagggaactaaatactgtctaatactgtctatgtgggttttcaagctgaaacaaaagggtaaattagggaaaccgtggaaaatcatgtgccatagtacttcttttgatttttctttgtgtgactaatcgtgtcgaacttgacaattaacttccatctaccactgttctcatgtggaaagcaaaataaatcacgagaagaaagagacttgcctaccttttccttttctttttccctttggtggctttattccgaaaatgtataaatataaatatgaaagttaagatcaagaaccgggctagaaacgtgttagtatatttttctttttactgtcgtttttcagaaattagcatgtgggtgacaccgatagtatggcgtggggtgagcgtgtagttatggcctccaggcttgacttgtctgctatagttaaacctatgtactactccctctgtcccataataagtgacgtttttggctttttatttgtaacgtttgaccattcgttttatttgaaaaactagtgcaaatataaaaaaagataagtcatatgtaaagtacttttgacaataaagcaaatgacaagaaaaataaataattattccaaaattttttgaataagacgaatgatcaaacattgacaaacaaaaactcaaaaagacaagtaatatgagatggaggtagtacgtgttagtatatttttctttttactcctatgtacgtttgtctcctacagtatatttccctgctgtaaataaaacgtttactaggtcgatcaacacattatttcttctaatatcactttgaaagatgattaaattaatcacaaccagatcacccaaacatattactctccctttttacacgtaaattctccctctttttcttgaagtttcgcatttttcgtcaataatagagtaattcgaagcagtgacctggaggaaaagagtgttcagaattcaggtcacgttaaataaacgtaccaagcttcctaccggcctgaaaaaaggggctctagtactgtagcatagctaatcaccaaaacttgggacccaaatgagttgttaaagaaacacttaaccgaaatgaactgtttgcaggtaagacatctttttcgatcgccgcttttgttgtacgattaccttttcaactttaaccctgaattccgccgtcagttaagatccattcacttgcagtaaatgttactcctgctaacacaattatcacagtaaacacaggcttcttatcagcaactcaccatccctccccaaacccaactaccatgacagcaaagtctcacagtaaatgacgcttcttctacgcctaacctgagtgagacaaatactgtagcagagcaaagcaatagtagtactaccctgttctgtaaatgcgcagttgataatccatattattactgctactcaaaattatccatacatacatgattgaatatattttaagatatactccctccgtcccataatataagggattttaagtttttacttgcactgtttgatcgctcatcttattcaaaaaaatttgtgcaaatataaaaaacgaaaagttatgtttaaagtactttggataataaagtaagtcaaaaaaataataattctaaattttttttgaataagacgagtggtcaaattgtacaagcaaaaacttaaaatcctttatattatgggacggagggagtaggttactttattttggaatggagagtactgtgatttcattatctccctcttgataaaataacaagaaactactccagtacacaatatttctaccctggaatcgaaatcaagctatctgggcggtaattggtgactaagtactacagtacccgtacctgaagcggttgtggttggagtagtgttatggtggggtgcgaccgtgcaagaggcaagagatattaaaaaaaaaaagatctggggaaagagaccggagccatcgtttcgtgcaatattacaaatgaaaagtaatttataaataaaacttttatatacgtgtttttatctatctaaaagcaagagctgaaaaataaattttgatgaaaaaaacctcaaaatcaactctaaatttaaagttgaaaatttaaatttcagttgataagcataaacacaagcgaaaagatgagatccgacgtttctctaaatatttttcaaaaaagaaattacgagtgtgttagaaaatttaacttatgacctcggaatttaaaccacatcttgcgactgtactgggcaagacgcaagtggatcggacggcgagggagctagggcggccggcacccgtcggggcgtcacgagcgcgcagagagaatcccccccagcgaagcagcggcgagaaggacaagccaccccaaccagaaccaggtggtggggagagcgggacagcgcaacagcgactgacaataatggcggtggtggcgggcgaggccacctcggatcgcggctgcctccctcccctcctcgacctcgaccaaccacccgcgtcgtctcgtcgcgcagttagcgaccgcgacgccgactccccc

SEQ ID NO: 84511 - DNA, 4551 bp, Oryza sativa
tgggtaactgctgccggtcgccggcggccgccgcgagggaggatgtgaagacatcgcacttccccgcctctaccggaggcgggaagaaaaagccgcaccaggcgcggaacgggggaggcggaggtggtggtggaggagggggaggctgggagaagaagcggctgtcggtgctcggggaggaagggagcgaggtgaacggcgggatcgaggagaagtacgcgctggacagggagctggggcgcggcgagttcggggtgacgtacctgtgcatggaccggtgctcgcgggagctcctcgcgtgcaagtcgatctcgaagcggaagctgcggacgcccgtggacgtggaggacgtgcggcgggaggtggccatcatgcggcacctgcccaggagcgccagcatcgtgtcgctgcgggaggcgtgcgaggacgacggcgccgtgcacctcgtcatggagctgtgcgagggaggggagctgttcgaccgcatcgtcgccaggggccactacacggagcgcgcggcggcggcggtcacgcgcaccatcgtcgaggtcgtgcagctctgccaccgccacggcgtgatccaccgggacctcaagcccgagaacttcctcttcgccaacaagaaggagaattccccactcaaggccatcgacttcggcctctccatcttcttcaagcctggtgagctccccggcactgagatccatccgcgattcggacaatcggacgaactgttttttttttcgcgcttttggattttttgggggagttttcgcaggattggtgggttggcagccggttgggtggaattctctgtactctgtagtagtgtagtggccgttgctgtagctgattgctagtatgttcttgcttgcgtaatctgacgagaacttgttctcttttggtaggacttctaacttttggaacaaacatatacgcactgcagagtgagctctgagttcagatactggaatcttaagaactaggttgagtcgttgagtggttgctgtttttggaatttgggaaactaccggtgggagcagacgtgacagttgctatttccaaatatagtgtcctggtgctgcccttataccaagtcttgcgtgctgattcctcattccacttcagtttagttgttttgggtaataagattcaggctttcaacacaacaattgtagcaactcttcttataattctatttttatcaactaattaatttggcaccaatgatcttggttgttaatgtacacataacaatatacacttgtcgaaccaggacactaagaatatgctgtaagagacttgaagcagtgctttacaattcttttttatgcttgtttatgcacttttctcaataggtagtattcttctatttcaattccattccccttgtcctctggttgaattctagtaaatagttaactacttggacaacaaatttccagtggctctatgtttgcttctatgcaatctcagattgttgcagaatgtttcacattgtaacagcctgaatcttatagagttctgttatgacaatcatcatcactcttatatcatgtggcattcatgcaattaatttgttcacctcatatccatttccatactggtcctgcttattggtagggggaaaacatattttcgccaggtagataagttccttaaaaataagtggctactggaattttacattaaaacatggaacaactgaacaatgtaaattctggagctacaaaacttgccatagctaaaccttgatgcatttcacagtttttgccaaaaaaagtagtcttcaaaatttgtgttgatttgtttgctgttgattactggagtcataaatgctttaatgtggcatcaacattgggaaaatatcgatcaagcctttttcagaagcactctcgttttcttctcataggattctgttggattagtaatgcctctatatgatatgatcgcctataggtgtggaattattcttattttgatacatattatagaatgaatcattgcattgtttggattttgtttaatgaccaactgttttttgtaagacacctcttcacatttccctgtgaaatgcctgtatgctatatatttaaatatataaaatgtttaatctgatccactatcttgattgttcaggtgaaaaattttctgaaattgtgggaagtccatattacatggctcctgaagtgctgaagagaaactatggacctgaaatagacatatggagtgctggtgtcatcttgtatattttgttatgtggagttcctcctttttgggctggtaccaactttgccttctctttgtgaaaaccttaaatcatttagctttgctcttctgcaaattcttaccaagcaaaattgcagagactgaacaaggagtggcacaagctatacttcgtggaaatatagattttaagcgagaaccatggcccaatgtttctgataatgctaaagatctagttcgtcagatgcttcagcctgacccaaaactcaggctaacagcaaagcaagttcttggtaagtggcacatagtgcttttaaagctggcacattgttaactaagcatgacttgtacttccttttggctatgtgatgcattgattgcactagtaattgttacaaatagttgatgatctagctatgctttattgcattttcctaatgtgatttggaaatcaacagtaagaaactggctgttgatgaatgtcgagaatagtatgagatgtttaattgttgctataaattcaaggtaaatttgagacttggatgaaccatagttcatactggcaagtgccagatggaaacaacttagaagatatgtaagtttgagcaaaagaggtaaaaaaaaagaagcatagttattaccaaagccatggacaacaactgatgcaattttaattatatcttatattgccttctaaacttattgagttgaagcatgccaaatggtgtagtgaattagacaggtttgttttattttgcttcttcatggttatgcgttattttgtacaatcatgggatgcttatcaaactatgaatcatttgcgtcaaaaaaaaaaaactatgaatcatcaaaggaattcgtcgtgttgtccacatgctgaataatgtagacaattaagcaatcatgttttaccacgtatttccttttttctttgatcagactcagacagtgatatacaggcttggtactcaagatagctgtttcacttctgttgtcgcagagcatacctggcttcaaaatgctaagaaagctccaaatgttccacttggagatattgtaaagtcaaggctgaaacagttttcaaggatgaatagattcaaaagaagagctctaagggtttgaatccttctctaattgattatctttttctaagtctaacaaacatatatatttactgaaccgaactgattcttgaccaggttattgctgatcacttatcagccgaagaggttgaggacataaaggacatgttcaaggtgatggatacagataatgatggtatagtctcttatgaagagttaaagagtggaatcgcaaaatttggttcccatcttgcagaatctgaagtgcaaatgcttattgaagctgtaagtaacctggaagtatttcacttgcttgttggagttcaataaaattgagttacaaaagatagttcaatcagattaaatgttcaccatctttggtgatagctgatactgtgtcacatgtttttttttctaagtctgatgtctggtgcaatgtaaaagtgttccttttacaccacatggtggaaacactggccaattttccctttattgcccttttctttttgcaataatggatcaagggcataatcaaactgttacttccatttgtacaattgacctgcctgttcttctcattagtcttgacatgtttatatatttcacggagcgtgctgagacatttactattaacattccttttttgttttgtcattttggtgtctttttggtccatagtatgcaatttgggagtcagacttgaatacatgataattaggtggtctcaatggtttgattagtgtaaatgtgtaatgcccttgagtattaataaaacaaaaagataggtgatttgcatatctgatatttttgtggttggaaaataggtggatacaaatggtaggggagcactagattatggtgaatttttggccgtttcacttcacttacaaaggatggcaaatggcgagcacctccggcgggccttcctatttttcgacaaggatggcaatggctatattgagcccgaggagcttcaggaggctctggtggaggatggggcaactgatatcatggaagtggtgaaggacatattgcaagaggttgacactgacaaggtgatgattcactaatgctggtagcaatgatataacctccagatcttatgcctttacttaacaaacatttcgatcgtttattcaggatggcaaaattagctatgaagaattcgtagcaatgatgaagactggcacagattggagaaaggcgtcacggcattattcaagaggacgttgggccgcaggaa

SEQ ID NO: 84512 - DNA, 7898 bp, Oryza sativa
ttgcctactacctcatttgttgctctcggtcgaatcgcatccctcatcacaaaactggttataacacctccctcagcttctagaactagtgcaaatcaatttattcagagatttagcaagcagtttatgctgatgtggtaggttgacttggtccatctgtgctaatgtggaagcctagtcatcaaatgaattgaaaataaaagtggggccgtaacaaggtaaaaaagaaactatagtgcccacttgtcagccctattcctcccctctcaatctcgacgcaccatgcagacgcaacccgcatctcaacatgtcgccttggcgtcattgccgcaggaggaaggggaggggactgtcacggcagtcggcagcaaaggatgcgcttggcgggcggaagaggacagcaatgatgatgacacgcggggcccacaacaatgactaccaccgctgtagccctctcttcccctcatgttgccatcttcctccacggcaacctcgaggttgacgaccaggaacatgaataggttggtgtggaatcgatcgaggcggagctcacacatgcggtgggggcagagtggtataggaggaaggtgaggttggtgaggagcacaaggaagaggaggagcgggagcgtgcgagtggaggtggacaaggacataaacaaataatagcatcggtggaggatgaggaggcaatggaatgagggagagagatgggtggacgacacatgggggccactatgatattttagtggctgtttggattgtagccaaaataaaccttactaagttttgtcaatgccaaaattttggcataatagtaataattgccaaaattttggcaggatttcttatgtattgaccaaatttagcaacaaactaaatgtagacatttttttggcagctttaccaaaaaatgatatagttaaaaatagcataaaagtgaacgtgcccttaagtttttctgctgactcggcaagtcaaacgtggttagcttaccatgtcaacgtaaaccactttctaaatcatcgaaggaattgatttgcaccgatttctgaagttgagggatgtgttatatccagttttgtggttgaggtatgcgattcgatcaaggtaaaagaagagggaggcaaaatagacttattcccaaatgggtagcaattagcatcggcccaattccataccaccattgtgatcaagtcaagcactattccagcatgactgggcgcttttctggtaaatttcggtgcagctttgggagaacgggagctactacgagtctacgagctacctctaccggcgggaagaaaatgctctactccaaaggcgattcctgtgcaatttcctcgacttacgtcttttgagagagaatcttctctctaccgcctgaatgctacgagaacagcttcaaatatttcctttcttccagcgacacgccataagtgctcaccactcgaactcgtgcggtaaaactttggtggtgtaaggcgaaagtgaaacgtgcaatcattaaccgaactccgaactgtgcactccagtgtccactccaactcgttcagtcatctcggcttatatggtccgacaggcgacaaggcgacattgtggcaccatatcaacagcagcaacagacacgcagcggtcggttttaggcttccctacgattattacgagttgacggctagttcgaaaattgaaactccacatattgaaatatcatattaacattgagtaaaaaagcgatttattacaatatactccatccattccaaaatataaggcacagtcacccttaatccaaagaccaagaatgtagtttgaatcatcctaataaatgtaatgcatgcatccaataggattagataacatgagagtggagaatttgaaaaagtaataatttaatagagaagatgccatggttgattgtatgtttgcatgcatgtcttatattatggaacatctaaaaaaagtggttgtgcattatattatggaatggagtgagtacttagttaggtattaactattataaatttaaaaacatttttttatttaaacacttgtgtaaagaaattcttttttacttaaaacacattgtttatcggtttggaaagcgactaacatacaaaaaaaaaattagagttgaagtttagaaatcatcataagccccacactgccagctaaccggaaccgggtgtgtttgcaatcctgggttcccgacatgcatagtacgtacgaaaaacggaacgatctattagcacgtgattaattaagtattaattattttttaaaaaaatagatcaacatgattttttaagcaactttcgtacaaaaatatttttaaaaacataccgtttagcagtttgaaaaacgtgcgcgtggaatacgatggagaggggttggtaacaggattgcaaacacaaccgtagcgcgaatgcgtgcgtacgtgcgatgtggtcatgtggtgatactgataggagtaggacacgcacacgcggtagctagcgaggcaggctgcccgcgtgactgcggctgagttcggacgggggatatgagaacccaactcctatcgcacgaaaaacggagcagtttattaacgcgtgattaattaagtattagctaaattcttttttaaaaatatattgattttatttttttaatcaactttcgtatagaaactttttgtaaaaacgtaccatttagcagtttgaaaagcgtgcgtgtggaaaactagagaggggatgggaaaagttgcatgcgaacacagttgttcggtagttagacggggagttattattgcgatgagagcaaacagctgttcggtagttagagcaattttaatagtatagccaactactagctccaattcatttatagccaatctaatagctcattcatataatagttacatactcccttcatctacttttgatagtcatatttcatcttgacacacagacaaaaaataagtgattctacttatcatccatttaaatatgctactagtcattcctcgtaaacaagcgattcattaatatttatatttctcgatgctcatgcaaccaatcttatatggaagaatgaagagtcatgtattaaatccaagaaaatcattaagatgataagttgttggattgaaatatgcatatcaaaaataaaattttcagatttggaaatatgactattaaaagtagatggagggagtactacactattaatacttggtctcacatgtcatacacactgcgttttggagtccgtgctacaaatctgtagcccgctgtccttctctcttattatttatcttcttaaaatatatatgcagctagcttatagcctgccattatacccgctcttagacggggagttattattgcgatgggatttgattaagattaaggcaccaatggttaggaggaaggcgccctgctttttggcgggagtggggcacaagggaaggaagggaggaggggaacaccgtgcgcgggccggcgcatgatggcgccctcggcgtggaaagggaggcgtaaagctgggctgaaccggcacggcaaggcccgttttgtttaatccccgggggtttggtacgcgcaccaatggctcttcgatagggataaatctattctatcgaaaatgtaattcagtttttttttattatgcggataacacacacgtacgaacatcacgctcgtacactcgcaatgttaatctgggcttctttttgggtttagcggaatgctgtggaatttgccgttttacgaggagcgatcaatgataacagtaagtataagagcacccgcaatattaaagtaagatgctctctataaaatatgtacatctcagtaatagactagattaatagtaaatcacctcaatagtatgtctacattggtatctatagctctctaatgcattgcctcgtttttctctatagactatcttcagattagtagatagttttgttctctctcttcattcaatctctttcaaataggaaaatatgctgacatggatctcttgcagagaacctatagataaccattgcgggtgccataagagcaggtacaatagcatgctataagccagctacaaatatattttaaaaagataaatggggagagagaagagcagcgggctacagatttgtagctagctatagcacggactccaagacgcggtgtgtatgacaggtgggactagatattaatagtgtagtaagtaactattgtatgaatgagctctaatattatagccaactactagctccaattcatcgttaatagtatagtaagcaactattgtatgaattggctattagatcggctatggatgagttggagctagtagtgggctatactactaggcaaaatttgccatgggacacccaaaaattgtgtaattggttgtgagacactataaaatcgtgtcattgctgatggataccacaaaattcatgtaatttgttataagacacccgagacaatattttatcatttctgattaaaaagatgggagagaaatttcaaaaagacaaaattgccctcagcgtcgctcgccatctgccaccgtcgaagccgctgccgccgcgctcactgaccgtcgtcgatgccgccgctgttgctcactgctgcctggccacagccacctccgtcgccaccaccgccatcgaagccgctgccgctgggctcatcaaccatcgtcgaagtcaccgccgtttcccgctgttgcctccgtcacggccatcactcgccgccgccactgccgttgttgaagccgcttcctgatctcgtcgaccatcgtcgaagtcatcgccgtagcctctaccgccaccgccgctgggctcaccgaacgccatcgaagccaccgccgccgaagcggccgccgggcatatgcgggccgcgggccgagcggcgcgaatgggcgcccaggtgacgccatagggaagcgctcacccacctcctcgtctcaggccgctgccacctccccggcgagcccagctgctagcccgacgccatcaccgccgccggagagatcaaccgacgtgaggctgatgccaccggaggggcacttcttcatcccgcaaccgcacttcatgcacagctactagcttgtaccaggcggcgacgccgaccaccaccaggtctccaacaccggcaacggcgatggatcaatcgatggatcgatggaagcgccgatcagaaggggcaaaactatcattttatgtggtttctttctcatcaattcagtgaatattatattttaatgtgcccagtgtcctgcagcaaattaccacacttttagagtgtcatcgggcaaattcatgtctttcgggtgtcccacaactaattacacaatttttgagtgtcctgtagcaaattttaccctactattaaacttgtgactactagctctaattcatccatagccgatctaatagccaattcatacaatagttgcttactacactattaatatctggttccacctgtcatacaccacactacgtcttgaagtccgtactgcagctggctacagatatatagtctgctgctcttctttctcatcttttacttcattaaaatatgtttataactgactaatagtctgctattgcgcttttttttatctccctcacaatatgtggaatatatatatgtaagggagtactgcattaaacttgttttaatggcatatgtggagccaggaaccggtgcagagtctggcgattggtcttggattcttgggaagagggcatctcgctgtgcttacgttttgtgatttttgtcagccgtccagtctttttttttagaaccgtcagccgtccagtcaaagtgatgatttatgttgttacacaagcgtgacacgccttaactcaggtagtttatgggtgtaaattttatcttgcgaaaaatggctgaaccgagagaattgagtaaatgtgtaggaatagtttaattgcattgtcttggaggagggtgacagcaagaatacccaaagtattcttcggtcttactccaagcaagcaaccacttttgaatgacaaagtataatcgaaaggaggcgtgatacgtttcatcagtcaaaagggaataagtggctctttcgaagttaggccaaaccagagaaacaaaaccaagcagatatgcatttttttaacgagaatgatagctaatggtttttcacaatcatcatcataaatgtgcatttatatatataatattattatcccagatacatggacgtgtccaatttaaatatgacacattcggtggccttttgacttatgagaaaagtcatttacttacaactgaaaagtggtgttcagagatataaagaaggaattggttctcttccttttagctgccctgcccatggtcttctcatcataacaaggtgaccatttaaggttaaacacaacaagacaaagcaaataaggtgatagtacttaatccttcgctgtaaataagaatttgtttcttgatatatcatttgtagaaagaatttatctcttgattatcataataagcaccaaaattcaaagtcagcacttcgttttcttctgctagaatatgtttcacgattaatctcgccggaatgtcttatacagtatttgcatacatggctgtttatcggttatgattgaaaatcttgcggataaactgcccggtataccggccagaataattcaaatttaaatataatatttaatgttttctccttgtatagtaagaacatactacgttttttttatcaaaagaacatactgcataaactagtattttatcttataacatcatgcttctagtatataaatgtaggggaatttaactatttgccactattgcgtttgacaattatccaaatacccctcttgcatttgcacttaactttttttacccttcttaaaaggtggcttcttaactatttgtcacttttactcacgtggcatgcacgtggcaacacagagcgaaaaatgatgtgggacccactagtcaatgtctcccttctcttcatctctccctccgccggccttctcacgacggcggctttttcctcgctaccgtgctttgcacggcctgccgccccgggtggtcgctgccaccgtcgccggtgttagcctaggcgaagtcaaagaagggcggatcgagggagatgaagtggaaggagactgactagtgggtcccacatcgtttttcgctcaatgttgccacgctggcatgccacgtgggcaaaagtggcaaatacttaataagtcatcccttaagaaggaaaaaaaataagtgcaaatgcaagaggggtatttggataattgacaaatacaataatgacaaatagttaaattcccctgtaaatgtaggagtatttatacatcgaaactatgaaaacctacactttagctgtatcaaaagttcaaatccaaagttcaataagttaattcgaaatttgggttcaaactcggttactggtgattgaccagaaagacaagtttttgtttttttaagtatttttctccaaacccggcatccgaaacttgtttgtacgatggtcgaaaaaataatacgaacatccaccaccggtggaatatccaacgatttctgcgagaataatcgctaagaaaattctgcaagaatcttgtgactaaaataaaccttaaacacaaccgtcatcagtcgcttaataatgcgctttccttcaccggattatccgattcctctcgtcacctcacccgcacccccacggtcgtcgtcgtcgtcgtcaccggagccagtcaaaactcgccgatgaccgtgggccccaccacccccgaactccaaccccgggccccacgaggcagcgacccatcggtcgccatggcaacgccacgtgggaatgttcctcgtctcgccgcgctacgcgtaccccgggaca

SEQ ID NO: 84513 - DNA, 1871 bp, Oryza sativa
actaaaattaaacacgtagtatataatccctatcccttatcctctcatccacagttacggatcgaatctcacccctctcctcagatccatcctctctaactctcttcctcatcccctcttctccaactcctccccttcctcctctcctcccccttctccccttcctcctccccttcccatccggcgggccggccggcggcgggcggcggcgagcagcggcggcagtggcgggcggcggggccgcgcccggcggtcgtggtgaccggcggcggcggcggcatttttttttaatttgtgatgattcactgagatgtatttgactaagaagttataaatttatgattcattgtttggatctgtgatgtatttgagtaattttgtgattcattgtttggatctgtgatgtatttgagtaatttcttaggatattgtgatgtatttgatttgtgtgtataagtaactttatgatttgtgatgtggatttggtgatgtgaatttgggatgttagtttgatttggggattgatttggggatttgcctacttgattcaggagaaaataaaaaggaaaaaagaaaaagggaccagctgtactacccgctattgtctctttagtcccggttatttcaaccgggactaaagatgtccatccggttggaaaaccgggattaaagaggggttcccaaccgggagtaaagatggtttttccaccagtgacatcggatgtttggacactaattataaatattaaacatagactattaataaaactcattctataaccctgaactaattcgcgagacgaatctattgagcctaattaattcataattagtctatgtgatgctaccgtaaacatgcgccaattataaattaattaggcttaactacacgaggttgacgaaacaggaagcatgtgcaactggtattctgtatgtaccagatcgaagaggtacgtaactcaaatcttcttgtcgtcgccttggcctagcttccaagttttaactgtgcgtaaacttactgctggtaagctatagctagcttggaaaggcgagctctctttgtctgaaagtgtgttctgatttctctctgtctgaaagtgtgtttctgatttcactctgaatcggtcacggccggcgaactcatcgatcggcgccgcagtctcgcagagagagaagaagagcctcttttggctagcttgtgtttggtgacttcacttcagacttcagagaggcccgtacgtactacatatatactgttccgggattctagtagcacaaagttacacagtactgcagctagcatgcacgactgtctactgtctaatccatgcatgcatatatacttgtgtttggtgagagattaatgttctccggccttctgtcctggattattgtatgcatgcatattgtctgtgtcaaagagtcaagcttaagagtactagagatggtacttcttgtggcttttgttgtagctttctactttgacatatcgtccattgccaactagtactatatggacttatgcagcagtggctcatgtgtagtagtagaacttagcttggaagttatagtagagtagcatatgcttgagagggcgatttcagatatccatttctttcgctgcatgcatgcatggcaaaactttagtctgttgactgtgcaggctgctgctgctctctgcataggcgcagccttgcatgcatgcaaagctcgctgaagagatctgcacacttgtcctcatcgtctctttctcgatcgatcgatcacatgcacactctcacagtcacagtctcaggctcagctcacacagtgccacgaacacacagatcaggagagagatgatcgatcgataagctagcagatgcagtacg

SEQ ID NO: 84514 - DNA, 519 bp, Oryza sativa
tagtacaatcatcggattctgatttgtttgcacagcacctcaatgttcgtgttttctttgacatttcagaacattgtccctcattctcatgttctttccgtgtacttccctcagaaatttgattatttttgtgcttcactaaagatggctccaggtgaaatctagaaaaactattttgggcttcttcacatcctgtactaataggcaaatagctggatgaggaacatttctcaattcgtgacccttcatcaaacacaagatttttgtgttcaagaccatacttgttcaattcaggtgatgcagaaaacttggtcacaacatcgctggagaatccagaagagaaaccggattttagttctttaaatattccagaatctctacaagcactcgctttctcttttacagtttcatagggccaatggccacctacagccgatgcttctgttacattcttcagctgctgtaatgtaggaacacaaggtcggttcaatacttcagtagagacctcattctggaaag

SEQ ID NO: 84515 - DNA, 565 bp, Oryza sativa
atcctacacatagaaacaacccagtaaggaaaaataaactgcaaaaatgttatctctgaatgtgtattatcttttgtgcaaatattgggtggttccaatcagaaagggtaacaattagaccagaattgcatattgacaacatatcgcctcctgtgtccacctgttcgcaactgcggatcaagctactacattaaaagggcaaactaaatctgccgtataaattgaaactttcctccttacatatgcttgaaagaaccgaaaagaattcctcttctgcatcaagagacgaaaaggaagctacaggattaaagaatcacaagctggcagcacgcacctgttggtagtcctcctctgcatctccacctcatcctggactcgggacccaaacatggcggctgctccccttccccccggaccaaatcttgctgtgtcaactgaggaggccgatcagaggagcagacggcgagcccgatgcttcttcccgccccaaatcaacaccatggcaagtcctcctcctgcttgagaagacttgccaaggactaggatggaacggacacagaaattt

SEQ ID NO: 84516 - DNA, 1032 bp, Oryza sativa
gcatatatagtatacatgaagttgctccagcacatatttaatgccggagcattgttatcagtaccagttttctcttttaggtgagaatcattatagtggtaccatatatctcttcttgcacatgataccctcgtttgtgcatgacatttctctttttagccctcattttggcctttaagcattgccaaatatttgggtgtaaaggaagcatctttttatgtctttttacgtgcatcagaattaggatcttatgactacttgtaccgcggtccacattttgattccttgcactgcttggttttgatgattgtctaaactgaatgtgctgaaaatatttgttttataacctgttgagtcgcagtaacttgtttagcatccaatggagagttcataccatgttgtcaattgatttgatctttgcatggacaaaatattgctgctatatagtctaatgttatgtattctgtattttttcatggtcagtttagaagggcttggattaaaacaacttagtaatttagtatagacttaagcttccccacaaaaaggaatctctgtgaaattaatcttaaattattctaaagataagtttaggaaccatctgtattaactccttaggtttagcgaagtttaggcataactgcagttcctccggcaagtccctaaactcttgttagatgaagttctgtttgagttattctgctgctactatagaatatttattttctcatcagtcacggtattaacgtttcaatatttctgagtagctgatttgttcattcatctttgtcagatttttgtaactaatcttctttaaatccagttagtatatcgcatagttcatcaaactcttcctttattacacttgcaatactgaatttggcttctgatttcactctgcaggtcaagttctgcatgggatacagtatatggatttcttgtgcttcatttttttattatacattcgaagagtctgcttccttgttgtgaagctttttatagaaacttattctttgcacaaggctggagcac

SEQ ID NO: 84517 - DNA, 1049 bp, Oryza sativa
tctttgatatattcatccaagcccatcttctccagcaccacattctcctggctaggttttgaccgattcttcaggcgttgctcttccatttcctcccacatctctgtacccctctccatgttatcttcagctttattgaagagttccaggacttcagatgatggccatgtgtccaggtctacgctactaccaattgcataataccatgacagttttgcttgctcaaaatgttgatgtgcaagtgcaagaaaaccttcgaaaaagtttggctttgccttcacggcttcttcatatctcctcccagccttattgtactcttcttttgcccattcatacgcttccttcacttgttcaagtaccgattcctgtggagagtctcctggcagtaacaacctcttcctggcccgagacatatgaacattaccccaatggaaaaacgcaagcgctgccatctcctggaagttgctttcagcaagttgaaacacctcctgggcttcctcagtagtaattgtgtcctcgatagcctcggtgtacagcttcatgctgacctcatggaggtccaaatactcatcagagctgaccccgacatggttcttgaaaagccgagcaaactgcacaatccagtcgtcaatgcaagtcaccgtgctcctatcctcatcctgcctattgcttctggtacttccattgtcggaattcacgtttctctccaacggcccgctgttggtgtcatcaagataaggttcatgctccggattggcctcggtgacatagagcctaagcgagctccctggctcggccaaatcctcagcccatttgagctcatcctgattggtgattgtcaccaggtcaccctctttgtccttgtacttgacaagaacagccttgagccccggaaacttgctccggacagcctcgcgaagctgtgccatgctgcagctcgccggcacctgcgcccacctgatgtcctcaccaaacacaagcttcacctgccttggtggctcctccacctccttgacaggctccaccaccttcgcctcctcctcctcctc

SEQ ID NO: 84518 - DNA, 1061 bp, Oryza sativa
tttgaaatgttaacatgagacgaaatcgataatcttttggcaatttataataacatttgctgatttgtgtacaacttaaagtcaagaggatgaaatcatgggctggccttattattagctaagtgatttatttgtttccagtgcaatttcaccagataataatgcatttcccccctacacagttattgaagctgattcactgcttgagacagaagtggaaacccttgctgaagctctggaaagtgccaacaacgctgttctgtcaactattagcatgatatctatcatgatgtctgtgagtcttaaatcccttattttttgtgtttgtatacaaaggatcacattttactgttttaatcctattattcttgaataccaggggttaaatcagacgttccggagttcgattaatgctcaaattatggaagtccatcctgatgaactaggacaagtaacctcatgaatatctttactgcttagttgtatgatctgcacttatctttttcctgatacatacaactgtaacagctactcagaagttatggagaagccagaattggatttggtgctggttataacatccagtctgcaattaaacaagccgtcttccactgtccgtttcttcgtggtggaatcaaggtccatatgatcatctaattttaacttttaatcttacattgatgctcacccactttttatcaaaagaaacaggaaatggaattttagtcttgtgttgatatcctcatatacaaatttacctgtgcaaaacatcacaaatgctatacatttatacctctgcaaaaatgttgttgtaaccaacaaatttcagactttagaaccatcaaatttcaagtgtgtggccacttggccagctaacctgcataagatgattgcttacatattttggtaactataagttgggctgttgatatttatttcttataattaataagtacatccaacgaaagtaagcaactacgctgcacacaagaaatagattcataatacagtggacataatttctcatgactgcactacataagagacagatccttggagat

SEQ ID NO: 84519 - DNA, 602 bp, Oryza sativa
ataaagctgaagataacatggagaggggtacagagatgtgggaggaaatggaagagcaacgcctgaagaatcggtcaaaacctagccaggagaatgtggtgctggagaagatgggcttggatgaatatatcaaagatgtatccactgatgacgcagctgaacaagcttctaatatgaggtctcagataaacattttatggggtatgctactttatgaacgttcagttgtggagtttaaattaggccttccaatgtgggaggattgcttgatggcagctattgaaaagttcaaacttggaggggcttcagctacagacattgctgtgttggttaaaaaccactgtgccaacgaaactgcccaagatggtaaggcaattttaacttactttatctcatcatgttctcctgggaatagtatatacagtgttgattttgctagaaaataccagaactagaaaattatagcaactctagtgtcattaatattgcggaacaatgaattgcaaatttctcatataccttatgtaccacccagaatatttttttcaacttcttatgtttcaatatatatatcatttaattctcaaaagcatacgcaactt

SEQ ID NO: 84520 - DNA, 505 bp, Oryza sativa
cagtgtcattccctctttagtttttacagtagcatagacacttttggaatgtgaatttacagatgcttttaacaaggcaagccaaagtacaaaggcctgaataagtcctagaagccaaataggctcaggatcatctttccaccaccccaaggtccggcccgactgttttgctggtagaaataaagcataaggttagtaaaactaacatggatataagaagatataatatacctggtaagtgtagtacagtctgtctgatgcaacattaagctgttctatggatagttgattggggacctgtagtgtgtaccaagtaaaaacatcctcaaagcaagtgggtggtacagttccgtaacctgagaaagttggaaatctttgagaaagataaagcgcaacgattagacaaaaaatgaaagttatatagtcttactttgcgtatagtgacaaagttgcccagcgattttgacattttctggctgtttacattgacaaagccattgtgtat

SEQ ID NO: 84521 - DNA, 846 bp, Oryza sativa
tggctatttctcagagtcactgagtagatatgtactgatatattatcaatatagttgccttcacttggaagaccagaaataattgatataattattttgagaaagtgttttcatttttttagggtatatgtcacctaagtacgtagttttttttaaaaaaataagatagattaacataagttattcactccacaaacatatttgatttctaagagataaaaaaaatagatacataatactagattcagtttaatttattttcgaatttaacctttgttagtatataactcataaatctatatattttcttaattttttcaatgatcatccctcgagaggaatgagaaaaattgaaaaaccatcgtcgaaagattttgattaagtttaattgatgggagctgttcataactaattaattgcagtaagtgatgaagactagtgtggctgaccggagagggcgatcatgtcggcctgagagaggccgttggcggcgaagagcgccgtgagctggtcgaggttgaacgtcggcggcggcagcctcccgttgacgctgctcgccgtcgatctcagcccgtccagccgcccaagctccaccgcgtacgacggtcctccggcctgcacaccattgattccgatcagatgaagattcgctttctttgcatatgtacccatgccaacacacacacacacatctctcagcaaaattaattagaactttggttaattatgcgacatatatgatgataaatcttgatggtgacgtggcgtgtctcctgttataggttacaagatgttttaattttagtccactctaagtttgtctaattctatagaaaaaagtagggg

SEQ ID NO: 84522 - DNA, 2670 bp, Oryza sativa
  unsure (1)..(2670): unsure at all n locations
cacctcgtgatctttggtatggtctgcttcatggacatggcatctgaatctgtcaagggtgtaatatcctctgtacatctccttccttagtatgttcagttgctgcagcatggattggtttgtgatgagccgttcatctgcctcctccaggatgatacgggcccggagcagcagccgttgcagtctctcctccacggttagcgctgtcggtttcgaggacttgttgatcaggaaagatatggatctactggcaagatcacctagaatggcagacagaaatgtctccatatgtaacaatgtaatctcaagttttgtagtttgagacaagaactgagacagagagaaagtatgtagtctgaaagtttttagtggatctggtgaagcagagtaggaattgaggctggcacatattccagcagctccatgtcttcataaaaggaaacgaattgcactgtgatttacctcaacctagatttatttttcagtgtgaaccgtttgaatataagcttcaggttttctctgcagtttggattaatataatcatacaagactgaccatattgtgaagatgatgaaagaagtagagtaaattcttacagatttnnnnnnnnnnnnnnnnnnnnnnnncaagtttcacagacacgtgtatattttagttgaccagttctgcatactactactaggcaacacaatagccttctaatgtgacaaaaaaatatttgttttgatgcgggcgttatcttggtgacttagctaatttggaaagaacgcaatgctcgtgtctttgaggggcacgcagtctcaccggtgaatctttgtgcgtcaattgaggatgagtggaaattgtggtaagaagcgggcttgaccacctctctttgagttgtatagtgggtgcgagggttttcccccatagttgttgtgtatagagggtttctttcttttttgttgtgatagcacgccgtttcctctcggcgtgctttgagacctgtaaattctttcttacctcttagtatattccggccagttattgccgaaccagcgaaaaattgtgaaaaaaaaggacttgatgaacatgaacataaggcatctcaaactttttttttatgaatgtcaacatgttaaaactgttgaaaaatgataaatgcatgtaacatgttaaaatgaaaaagcctgttgtcccaaattaattttccattaaactgttaaaaattttccatcctattacaagttaataaattcccctgttatgccccagtacaaattctaagtcttctttttctttttttttgttgggccaaaattcaagttttttttcattttgttaatttagagtcaatttttttgctgctacttgtctgactgaggagtgaggaccagcaaaaacgacattcagaaaaagcaattttacagtccttaaagaggtaccataggaccactttttctattgtaaatttggtatctcttgctacctaggtactataagataccaaattttacactaaattttgatatttgctccgatccagcaaaaaataactcgaggtaccgataccccacggtaccaaatcgtttccgatcgttggatctaacaatgcccatcctgcccagctagacccaacgatcgcaaacgatttagtaccgtgaggtaccggtacctcaaggtactttttctggaccggagcaaatctcctaaatttttggtacctcatggtacctcctcaaggaccgtaaaattgctcttcagaaatgctttccctactaccatttctgcctatttatacatctgactagctacatttcttcaacgatagaattatggtacatttctggactatctagacactttctctgaaatttcttttggggatcagtgcacacttcaatggtaaatcaatatattctcagaatatgctacagattcttgaaaattaagtacctgaatagagagcagacatggatgtagaggagggatcgccgtcagccgccgccattatcgccaacgtctctagattcggtcggcgacatagcagctcgccggccaagttacagggccatgaagcaattcagaaattccccatcaataatcgacactttaatttcgttagtttttgggagtactacctccatcccaaaatgtagcaacctagaatgggatgagatccatcctaggataatgtcatgtctagatacattgttctaggatagatatcatcccctcctaggttgttatattatgggatggagggagtaaaaaaatgttttttttagagtcgacagtataagtggtactcactcccattccaaaataaaatgattattcgactgtactatatctgattatatatatagtacttgccactattgactctcactgattccatttcgacccctgattttcaaaatgttttttaataatggattaaataaaacccggtctccacatcccgaaggtcggatgtacacaaccacagtattacatcaccaagcacttgggcttacaaataagtttaaaagcaaacgccatcataggagacaaatagacgacaaagacatctagaacaagtctcacaacaaaagatttcaactaacaattcaatcttcctatccaattccacccagattttgagtagaattccataatggtaacttccaatttttgggctgcaggaat

SEQ ID NO: 84523 - DNA, 792 bp, Oryza sativa
cattggcgagccgccattgcagatggcggttgtgaagcagcctcagctggtgctcctcctcggctttccctgcgcttgcagcctccctggaacggcagacgccgccgccgtcgccgagcacctcgccggagacgggctcgccggcgaaatggccgccggcttagttggaggtggctgtttaggcgacggcctggtgaatggcgaagagagcagcccgttgaacagcgacttgaccgacttcttcttcgtcgttgtcggcggcggcggcgccgtcggcgtcgtcttgggtgacggtgaggccaggaacctcggagtgcgcgacatgaacggcgtcgagtggtccgcgaagcgctccgagcggctccccatggcgtcgcgcgagaaccgcgcgggcgaggccatgatgcttctgggagacggacgcgctctggcggcgagcttggcgtcggcgtcggcgtcgccgtccggtgacccggcggacgacgtcgcgctctcggtgtcgtccgatgacagcgcggcgcggaggggattcgggacgtccaccgacgcgcgccgcggcgtcatctcgtcgaacgccacggaccgcgtggcgacgccgccgcggaaaccgtagggcgccgagttcgccgccgccgccgacgccggccaccgggcgtcgcacaccttggcccgcaccgccgccgcgccagctgcgaaactggccctcttcttctccggcgacggcgcatgcggcacttgcttggccttgccgccatccaagcagtagctcgcgtcctggaacgcgaccgacac

SEQ ID NO: 84524 - DNA, 702 bp, Oryza sativa
cgacgagaagcactcttcatactgtttttgcggttgagacaggcatctaaaactgaactcattcctgcatttgcagaagcaacaaaacccttagcaacttcctcgtcagggcttcctgaaatacccgctgaatcgtcaacttctcaataccaaccagaaaagctacagaacaaatttgacatactcagataaattcaaattatataaggattgcagcattttggataaagatacatacttttctctttcggaagctctgcgcaaacttgttcaggcacaatcttcggttgcacgtcatgattgtttccacttacattgacattgctcaagctaatttcccttgaaccttgcgcaatatgctctgaagatttcgctgcactaacaaggttggtgccagtggccacattgtcagtttttgctgcagtactcactggcacaggagcggtattcatcggctctgcaagaacaacattctcagaaggatgcatggacaagctgttggtgtcactgatcataggttgtagttgcgaatcatgaaataagaagtctctgcttctctgcgtagctttgtgaatcattgaattaccatcttcatcttcatcatcatccgagatgcggttctcagactctgaatcatggcggacattcagcttactgtagcctccataagacaagtcctcagaaccttcatctgaagaatgc

SEQ ID NO: 84525 - DNA, 3513 bp, Oryza sativa
acatttatatttgccctttaggactagatcaatgttactgttgaaatccccaaatctatctcttagatcaattttctgcaactgctcttgtaaactatggccactgacccagaagaaccgaacacgcttggcaggattgaacttggattttgagaaagagttactcaccttgttatctttgctattgtcttgttcatgggcatggtatctgaatctgtcaagggtgtaataccctctgctcgacatacccaaagagttcgactcagtgcgatgggactacttgctagctatgcttcagcattatggcttcccacagaaatggagagactgggtctcatctattctttccacctccacctcacaagtgctcctcaatggaatcccggggggcaaaatatagcatggcagaggtctaaggcaaggcgacccgctatcaccgctcctctttatcctggcgattgatcccctacaatggctgctttcaaaagcaacggagcttaatgccatcacaaagctacggggaagagcagcccgcctaagaatctccatgtacgccgacaatgcagtggtcttcatcaatcctgtcaggaaggatgtccagaccttcactgacatacttacacgcttcaggcatgcggctgggctggtcacaaatatgcagaaatctcaggtggcagtaatcagatgtcaaaacatagacctcgacaccattcttgacggtgtaccagctgtgcgagcacacttcccgataaaatacctaggtctgccgctagtcctagggaggatgaggaaggcggatattcaaccactttttgacaagattgcaaagcgaacggctggatggagggggaaaaacatgggaccagcaggacggtcaaccttggttaaatcggtgctgacagcgcaacccatctaccttctcactgcactcaaggtaaccaaagaagctctaggccaactcgatgcgaagagaagaaggctcctttggcaagggacgggagacataagatcaattgggagaggacatgcctcccaaccgcgcaaggggggctcggagttctaaacttggaaaagttcagaagggcccttcatctgagatggctctggcatgaatgaaaagatcccactaagccatgggtaggcctcgaaacaccgtgtgatgaaactgataaaaggctttttgctacggccactaaaataacgatcggggatggcaacacaattcgattttgggactctgcctggttggagggacagagaccaaaagacgccatgccactagcctatgcgatatccaaaaaagaggaaaaacactgagggaaggcattgagaacggctcttggatcgatgacctggacctcagcggcaccattcctcccactgtggacctgattagccagctcgtctccctatgggaagcaacccagtacattattctcaatcaaagcgagcccgatcaaatcacctggaagctttcaaaccatggagaatactcagcctcgtcgacatacaaagcgcaatgcctgggaaccactggcaccaacttcaacgccttaatttggagagcctgggccccaccaaaatgtaaattctacgcgtggcttgtgatccaaaacagggtgtggacttcagaccggctagcagctagaggatggccaaacaacgggacgtgccccctctgtcgcgtgacaagtgagtcagcaagccaccttcttgtccattgtagatatactagaaggatctggagcctgactgccgcctgggtggcttaccagcaactggactcgtgccactgggctccatgccagagtgtccaaaattggtgggaaatgctagccaatacaaaggaggtgcccaaaaaaggccttcggaccctaattcttttaatagtttgggagatctagaaggaaagaaatcggcgggttttcgaacacaaggaaactgcggcccctagtcttatggcaaaaataaaagaggaggcaagaacttggaccatggcgggagcaaggaggctacgggattttctatcaaattgtgtataggccttctcagttttgtacagtttctcctttttttacccctaggggttgtactttgttccctctattttcaaaaaaaaaaagtaataccctctgtacatctccttcctcagtatgttcagttgcagcagcatgccttggtttgtgattagccggtcctttgcctcctccatgataatccggatcctcagcagcagccgttgcagtctctcctccatgtttgatgctgtcggctttgagcacttgttgatcaggaaagatatggatttactggcaaaatcactcagaaacacagttaaaaatgtctccatatgtaaagtgtgtaatctgaagttttgtacataactcaacggatcaacaagagctgggacctgacagaagctatgtagactgaaaatttagaggatctggtgaagcagagtagaaattaggcaaccacatactcaagtagctccaggaaaatgcattgtgctgtggtttacacaaacagtgttccatgcgtacttggaatatatttttcagagtgaactgttttgaattcaagtgtctgtttttctctacagttagcgttaacatgactgtacaagactgaccacatggcgcagacaatgaaagcaacaaaaagaattgtacagattcagttcatcagtcagtaccatctacttctaccactgttattgacagaaaaagaaaggatctgaacttcttgtcactaccgctgttattgctaataatcaatccaacgtatccattcctcaggatgatgccaaaaaggccccaatacacaaatccagtcttgtttctctttttcttttcctgccaggacaaatttcaagtttattgctatttcttttatttagatttaagtcttggcttctacttgtctgtctggaacagtagagaaaatggcatgaacggagaaaacgagatcagcaaatgttatccttaaacagtagaattatggttaatcacttctctgaaattcctctctctgggatcagtacacttttccctctggacagggttgaagaagctagtcagaaatatcttcttttctttctttttttttgttgagagttagtgctgatgctagtactgaacctctaactgaagctggtgtaattagtgtgatcataatgccatggagtgtttgtattaggatgctttccgtatgttgcaagctgcaacaagcaatgaatgttcagaaacagtaaacacaggatcaatatattagttgctgtcaattatcattgacttctggacaagtgtctttgtgcctcacgcatggtgacatgatcaaacttcaaatacagaatgttaatagattctgacgacttgagttcaacaacctcttaaaatagcacatacacatgagcttggactacaaatggcgcagccgctcagacagtaggtgaaagcatttcaacaaatgctcagattcagattacagttcgacataattacattatacatc

SEQ ID NO: 84526 - DNA, 2338 bp, Oryza sativa
tgtgctatagattcttacaattaagtacctcgatcacgagcgagaacaccttacaatctggaagccactggcccctccccgctgtcgctacttcctctggtttggtcgcagcgaatagatgctaggctactgatcgtcttcgccatcggggccggggctcccccaccctgtccactgtgttctttgcaatcaacatgaacagagtatagatcatatcttggttgattgcccataatcccgctagctctggcggtgggttctcagggtgattaatcagccagattgcctccccttgcatgaggcctccttccattagtggctttgccttagcaggaaaaaagtcgcgaaagatcgtcatcagggatttgataccattgtggcactagtagcttggatgatctggaaggagagaaacaactaggtcttcaacctccaacagtggccatgggtggaagtagtgaaaacaatggctgcggaggcggagttatggcgcctagcaaaggtggtagtaccggcacttggtctctatttttatgagtccctaggtcatcttaattggttgtgagattgtagtttaagtcctttgttccgctccggtatcccgtccccttcaaaatttatgtttgatttgtaaatagcttttattcctcttaatacaaagatatgctcctagcgtattcctgaaaaaaagagagaacaccttagaaaggttagagattgtaacaccctgacttttgtttagcagctaaaagttattttaattaaaaagcataattttaaaactttgattctttgtgtgtatcaacgaattagtggcaagatatcaattaaatcattcctagtaaacccaaaattttgatccaaaacattctatcttaacaaaaatctcagaactcgaattttggaatttacatctcccttgtaaaaccattacaaaattaattaaaatatccccattcactgaaataggacatatactaatccaaataactccttattcttaacactgtgtggacatcaaattataaatttgaattcaaatattcattgatatctccctaaaatttcatcttgttttatgttctcctcaaaatttatttaaattcatccaacatacaaactcccttgcattcctagaaactttttgaattcaaatttcaagcttgaattcaatatgtcaagtcaaatcatccaaacaaccatcaaatcaattttatggaaaatacataacttctagtgtataactgttcattcaggccgcgtcctataggatcaatcagtagctatcaattctcagcatgttgaaatcttcaaacttcaaacagtacaaaattaatagatgctgatgaattgagtttgacaacctcttacaaatagtaatcttacataggagcttggactacgccctcgctcatatagtttttttagataatggaaactttatttagactcagttaattacatcaagatgatacaatcaaaccgagtcacccccggcctctgcataaaatgcacacagccaaaaaagaagaaagaaacaactagaacatctcccaagcacaaaagtttaacagaaacatatatcttagtggctattatagtaggtgaaaatatttcacaaactcagttttagatgacatcttcagataattgcattatacagcaggttctgacatggtcagttacaaagcttcagaaaacaatcaaactgtcaggtgcaaagttcctgcgatctcttctttttggcgaccatacgatatttcctctgtacctcacagctgagcatgtagttgtagtgaggtggaaggtgagatgtccatgcaagaaccttgaattttccttgaggtataacactcgcaaagagaaaatcttgaatattcacctcaggaacttcagcttcactctgagcagggtttgtgatttggatgggacatgtctgatagtcgtcaagaatcacaaggtattcagaggaaattctgtttaccgtcctaacatatgtcggttcagacgtctgccaaggattgtcaatatatgcgccgtatactaggaggttcgtttgcttgaattctttgatgcttgccagagccatgttccaaaaccgagcgttgaaatttgctttcagaagtacactgtagatgcttgcacccatgaaacacccatccaactccctggccatatccatggctattgatgccagctttgggtgctcctgttcatccatgcttccgactgtgcacaccttgaaaaagtaccagtatgcttcttcagtaaacaattctactctaagagcttgtgttgttccaaagctcgcaatcttatcagattggcttgcgacaat

SEQ ID NO: 84527 - DNA, 682 bp, Oryza sativa
catggtagagcaaacgcccaccccactcgccatgtgtgagccacataagaaagtgagctagtcaaataatacgcctaagccggacggcaccatcaagatagttccgctctctagtgctaacccagcaaagactatcaaaattgggcatactctagatgagaaatagtaactcgtgttcatcacattcttccgcaataaatcatatgtgttcgcttggcatccgtgcgacatgctgggggtccccagcgaggtgattgagcactaacttatggtgcatccccatggcaagctagtaaagcaaagattgcgtagatgtgcaccaggccgaagacaagccatacaagtagagctcgacgttctttttaaacctggcttcattagagaagtacttcacccagagtggctagccaacccagttatggtgaggtaggccaacggaaaatggagaatgtgtgttgaattcacagacctcaacaaggcatgccccaaggatcactttcctctccctcgaatagctcagttggtggatgcaacagccggttgcgagcttgtaagcttcctcgacgcttactctgggtccaccaaatcagcaaggcacaagagtatgaagagaagacagtgttcatcacgccgttcggggtactttgcgacgtgaatatgcctatcgatagggctgcaggaa

SEQ ID NO: 84528 - DNA, 519 bp, Oryza sativa
ccccgacggcgtcagcctctccttcttcatggagtccggcacgtcgatgtccaccccgcacctgagcggcatcgccgccatcatcaagagccttcacccgacatggtccccggcggcgatcaagtcggcgatcatgacgtcgtccgacgtcgccgaccacgacggcgtgccgatcaaggacgagcagtaccgcagcgcgagcttctacaccatgggcgccggctacgtcaacccgtcccgcgccgtcgacccgggcctcgtctacgacctccacaccaacgactacatcgcctacctctgcggcctcggcatcggcgacgacggcgtgaaggagataacccaccgccgcgtctcctgcgccaagctcaaggccatcaccgaggcggagctcaactacccgtcgctggtggtgaagctgctgtcccagccgatcaccgtccaccgcatcgtgaccaacgtcgggaaggccaactccgtgtacaccgccgtggtggacatgcccaagaacgtcgcggtcac

SEQ ID NO: 84529 - DNA, 1758 bp, Oryza sativa
tctaattcctgcagcccctatactctacttctaatattccttatttttaattccgaatttcagttattttctaattgtatttatatattgactctagtctcctcttctaatattccttattttttaattccgaatttctactatttctaaattgtatttctatatggactctagtctcctcttctaatattccttattttttaattccgaatttcagctatttttacattgtatttctatatggactctgtcttttctttttctccgattaatgtgagaatttctaggccatgagagcgaacgtggagggtccttttttattcctttaataatataatagatatttattgaaaagtgatatatgtatacttttatgacagtatttttcaagacaaatctattcatataatttttacattttcaaactcaacttgagagttatttatgatttatattctcaaggtttgtcttaaacattaacctaaacgactttctttacgagtacagagggagtaatcaccttgatataaatgtaaattaaggtgtttactgaccaaatgaattgaatccataagttgcttctgttcattttcttccttttgtccttcttcccttcttcctatttttcttccctgtgttctgtacgtcgggtagaggatgcaacgctaatgcacatagcactacgaatcccttctagtgcaatacatcaatcggactctattagggttttgggatttagcgtaggaattagtcgtcacttcttctcaacactttctttcctttcatttgcactagtggggttcaggggtaatccggatagaactctaggtcctgttcgtttccactaaaaaaaagtgaatgaaaatttggatactcatggcacgcttttcaaactgctaaacgatacgtttcgtgcaaaaactttcaatatgaaagttgctctaaaatataatattaatctattaatcatacgttattttttttagataatggaatagataacatccggcctttgctcaacagagttacagccaattattacattctatcactcgaacaaagagtgtagttcaaatagaattaaacacacccaaacattataaaagtgaccagaccaagataaggaacacacaattattcaagtatatttgtgaacctccatccatggttggcaaaaagttgcataaccgtcgtctcaagcttacggcatgcaaccttcaagagctctccatcttcatcacacttttgcaactgtgaccaaaatcggagccaatatgttgccctgaaaattgcctgcatatatgaagcagatagtgatttgttaaaaaccatatcattcctactcaaccacaaagcctaacatatagcagaagctcctacaagaattagttttgcgtaaaaacttaatttttatcttcatcttcgtttacaggagaatagaacatcacctaagtttgttaccacttatcatagtaacgtttatctcttatcttttattttcttatttgtttcttttttgttagggaagagaacgatgtaacttatctctccctaattatcttggcaataactgataaaatcaaccaccacaacgtagtagtacagagacttacagattgctgcgcattaaaatgttgtttatgcagaatatgtaaattatggaatatatattcagttttctcttaagtacatacatgcatgtgtggactcggatcatttcgtttttacttgcgaaagtacgacaccaatagtaaccgg

SEQ ID NO: 84530 - DNA, 2478 bp, Oryza sativa
tggcatgggatgagacggagtggagtgcccgccggggcgttgctggcggagcaagtgtgcggctttccccacatggggttgaggacgacagcgaagggaaggtaaaggtggtggcgggagggacggtggtgtgacaatggcctcccttctcaccgctgccttcatcctcactcgtgcttcctcctcccttacagcggcgagcggaagggggaagagggggcggcggcgcgacgacgacctcccctcatcaccgccgtgttttgccggggaaagggaaggaagagaagaaagagtatgcgacactaacgtgcgggccccatagggtgacttagcggattggaccaagccaaagcgccaagtcagcgaaactgtcctctaaaatcgtcgagagagttaaattacatcggttttcacagttggggggggggggtgtttcaatctccagcgccaaatttgctatgagatttcatcgttcaagataaatagatggatctgttcctttggacgacattggttttatgcctttatccacagtatatcagcaaagaagatcctttgattataaaaatccaaaaaaataaaggttttatgtatacctaagcatgatttcagccatgggaagcttgatcaaatctgcaaggaaatcatttctggtttacccatgggagctgaactaccgttggcccgttgcaatcatctgaaggataagctagatcatatgtcattcggaagcttccactgatcgaagaacgagatacatcactatgacggccaagggacaattatctcctacgaataagacctgcaaaccttttgcagacgattggtagtaccgatcatatgaccgatgcggaaatccttttataaagactgtcaagttgatcatagaaaaataatgcaaggatagctgaaagtataagatcgatccccgcgtgaatgcacgatatatctcctcgaaataatgttcagagatcgtcagaactttataaacacgcaaaccactttggctaatgcttatgcattacccagcggatatgccgcggaacattatctcattgtcatcacttatcactcatcacttcattagtcgggtcgggctaaagatcatcaaactgatcaatgatcggtcgagctagtgctccctgctgccatttcacacttgtatgtgcatgcatgtgtgtgaccgaattatcatcatctacctatttcttccatccaaactcagtgcacaaattttgtactccactagccacgaaccggctgggccaactcctatcctggttttctctggatctcgtcaggtgcagtgcagggagggaggtagtgcattgtatgggtttgcagcacgccgccgttgatcaggcagacatgggcaacttttccgttccatacgggctgtccaatgtccattgcccaaattaaatccaagataaaatcaatatccgcagcgatgcgatcagaaacatgaggcaatatatgcgcacaaaatccccctagtgcgtggcgctgctgtactgcaacagagcaaaaaccgtgcatactgccagagaaagaaaagcaatggcagcaacgcgcggacgaaagtgtatttggaaatgtttaatcgtggcctgtccctcggtccctgtaaagcgaccttatcggcttgtgcgtatgttgggtcctttctggtagagtacaagcggtacctgcttctggtacgtactgctgctactaccgacagttttcaaaaaaaaaaaaagaagaagaaaaagaaaaccaaagtataaaactcgttttataaaccgagaaagaataaaaatcagttgagtagattgagtttttatgagataatgatgttctcaaaatttctctgaatttcgagtgcatggcgtttaaggagaggggaacatctgagctcatatgccttgcagtgttcctgtaaaaatatcaaataatgttctgttaatatatgtacaaggtagtagtacatcatgaatgcgacgatacatgccgacttttatgacagtggtaagccggttttattcgtcgtgtaagccgtggtatgaagttgccaagattctctccactgtaaatcgatagagttattctgttaatcaccagaagaagctagcaaagagcggtggctcagccagtttagattcaatcatgtattcgtgtgttcttccggtctgactcgtcccgctggttgattttgtgcggtttgatttgatggacgtttttaaagtttagacctgttcagggtgcttcgttgtagtctggctttcatgtgtcgacgcgtcgtgatcatccggcacgttcagcgggtgcactttcatctcggtttgtcccttcttgtcgtcatcatcctccacctgcttgaagctggcgaggctggccagcgtctcgacggcgtcgacgacgccctcgatcctcgccgatatctctatcagcagcgacgccacggtgaagagcggcatcgcgtccatcagcgacatc

SEQ ID NO: 84531 - DNA, 640 bp, Oryza sativa
gactccctggatgtacactttctgttgtgctacattttggtgggcatggatgtcaaattaacctaccacttgccattcagagcatttttcagtgtggacatgttcacaaatttctaccgtattgagagcatattcatacatagaattacacaaagttttgctacctttcctttttgaagtacttttggaatgatctgatctttgcatgattttcagataatactttggatggcgttgtggtggaaaccagttcgagcaatggtcatcttgtctaagatgttctttgcaggtaaatcttgtgtaatttgccttgtcttgcagttagtatggattttttattttgaatgagagcttgtggaaatcatagctggagatagatgggaaaactatctgatcataagttaaaaaaattctcgcgtacgtttagttcctcacatcccctaaatattaatgaacatgaaggaaatacattgagtcatgataaaccaggcgtagtgcaattttgagttttcttgttatacatgataatttatcatttattctactaatacaaagttatttgccagcgacatctttatttgctgcccttggatttcttctctatggagggaggtaagctgtccttggttttcttattttt

SEQ ID NO: 84532 - DNA, 711 bp, Oryza sativa
cattaaaaaatggcttgccaagaataaactgcaaaagcaatttctttgtcgtgttattttgaatatgtctagaccaataattgtacttactgagtgcttgttgatagcgttcattttctctttggcagttggttgagattgtaccttcagctttggtgctgttcatattaaggaaactaccacctaaacgggggatcacacagtaccatccaatccattagatcagtccagggatccccaatgtgcccttgcaaattgttccttcaaactggtgagtacagaaatgtaaatcttaaccacggatttctttgtaggtaggttgcttggttttcatgtgaaaaaagctcaacaaaaattctgggatatatatagtttgtaaaaagtctaacatcccgtcatcccaaattcctgcaattgctgtactgcgacccaggagtattctgcaactacaggttttcttctgtaaactgaaggacaaatatgctttgattatttgtttgattatttgtaataatgtcagctttggtttattgttcctggtaaaagccccttgcacgcttcctcctgactccccagtggtacacattgttcattactacctttttttagcctggacaatactgggcaatgttgtgttccttggcagagtattttcccttttacaccttcctgttcactggattgcttatacaagctctgatcggcctgggg

SEQ ID NO: 84533 - DNA, 695 bp, Oryza sativa
ctctctctctctctctctctctctctctcccctagctttcccctcgttctgcccgtgcccgcacgcgcgtgcgcgtgagccgacaccgagccgagccgagcgccatctcctctctctcattctctcgctctcgctctccccgtctctctccccggcgaccccgcgtccgcgaatttcgaacccgtgcgccgttgcttcgcgcgcgcgtgcccgcgcggtcgccgtcgtcgtcagtcacttgctgcccgtgcctgcgccgtccggccccgcgccctgccatgctgcgccgcctgcgccgcgccctgccccgcgagccagcatccgtgcccgagccgcgccgctcgcatccgtccaaaacccggaggcagcgcctcccgctcccatctctctccctccccaaatcggcatagcgagagcttcctttctccccctccgtttcccgccttcctctctcggaccgacgcctcgccctccctccgttccctcgctcgattccagcgcctggacgcagaggagcagccgcgccgcgccagccgtcgcccatgttgtttgaccccgcacccgtgagcccattccttctcctcgaagctccctcgccccagcactgccccaaggtcggttcccgaaccgacatagccaccccttaaaaaccacccctccccctctcgctcgatccccctgtttcgctcgggctg

SEQ ID NO: 84534 - DNA, 3857 bp, Oryza sativa
ttcctgcagcccctttccgctacctactcacctcaacaaaatggtgtagtggaaaggaaaaatcgtacattgattgagatggcaaggactatgctagatgaatatggtgtttccgattccttttgggcggaagccataaacatcgcttgccatgcaaccaataggctttatttgtatcgtctcttgaaaaagacttcctatgagctaattgttgggaggaagccaaatgttgcctattttcgagtttttggttgcaagtgctatatttaccgaaagggtgttagactaaccaaatttgaaagtcggtgtgatgaagggtttcttctaggttatgcctcaaatagcaaggcataccgggtctacaacaagaacaaaggtattgtggaagaaaccgccgatgttcaatttgatgagactaatggctcccaagaggggcatgagaatttggatgatgtaggtgatgaaggcttgatgagagctatgaagaacatgtctattggagatgtcaagcctattgaagtggaagacaagccatccacctccactcaagatgagccatctacttccgcttcgccaagtcaagctcaagttgaagtggaggaggagaaggcacaagatccacctatacctccaagaatacacaccgctctttccaaggatcacccaattgaccaagtgttgggtgacattagtaagggtgttcaaactcgatctcgtgtcgcttcgatttgtgaacattactcgtttgtttcttgtcttgagccaaaacatgtagatgaagctctttgtgatccggattggatgaatgctatgcatgaagagctcaacaactttgcaagaaacaaggtgtggactttggttgaaagacctagagaccacaatgtcatagggacaaagtggatctttaggaacaaacaagatgagaacggattggtggtgagaaacaaggcaaggttggtggcgcaaggtttcacacaagttgaaggtttagactttggtgaaacttttgcccccgtggcaagacttgaggctattcgcatccttcttgcatttgcatcatactttgatataaaactatttcaaatggatgtgaaaagtgcttttctaaatggtgaaattgccgaacttgtctttgttgaacaacctcccggttttgaagatcctgaaaatcctaaccatgtttacaaactctcaaaagctctttatggtttaaaacaagctcctagggcttggtatgaaagattgagagattttcttttgtcaaaggatttcaaaattggaaaagttgacaccactcttttcacaaaaatcattggtgatgatttctttgtgtgtcaaatttatgttgatgacatcatattcggttctactaatgaggtattttgcaaggaatttggtgatatgatgtctagggaatttgagatgtccatgattggagaattgagcttcttccttggacttcaaatcaagcaactcaaggatgggacgttcgtgagccaaaccaagtacatcaaggatctactcaagaggtttggcttggaggatgcgaagcccatcaagacacctatggcaaccaacgggcatctcgaccttgatgagggaggtaaaccggtagatttaaaactttatcgttctatgattggtagcttgctttaccttaccgcatctaggccggatatcatgtttagtgtttgcatgtgtgcacggtttcaagccgctcctaaggagtgtcacttagtggctgtgaaaaggattctaagatatttaaagcattcctctactattggcttgtggtacccaaaaggtgctaaatttaagcttgttggctattccgattcggattatgccggttgcaaagtggatagaaagagcacatccggtagttgccaaatgcttggtagatctcttgtgtcatggttatccaagaaacaaaactccgtagccctctctaccgccgaggcggaatatgtttcggcgggtagttgttgtgcccaattgctttggatgaaacaaaccttgttggactatggtatatccttcaccaaaaccccactcctatgtgacaatgatagtgccataaaaatagccaataacccggtccaacattctagaaccaagcatattggcattcgccatcacttcctaagagaccatgttaccaagtgtgacatagtcattagccacataagaaccgaggatcaactagccgacatttttaccaagcctcttgatgaaatccgcttttgcaagttgaggaatgagttaaatgccatagacttctctaatgtggcttgagatggtgcaccatggttgcttcttttgcatattgtatatttgctcctatttgctcttatgctttggacttattgccatttggttcttcattgcgaaaatggagcatgtcatattaagggggagttttggactcttgcatgtgctctacttccttttatatgtgagcaaatcaactaaaagtgctagtagtgttttcaaaatgcccaagtcaacataagtcaaaaattttgcaaaatcaatgaaatttgaaaactatctcttggaaaatgttttaaaagggtccctatatgttttccaagcctcacattgctagaaaaatgatttttgaatgaaaaatgctattttggctctcttttgaagaatctagatttttgtttttggccaaaatgagattaaaccccaaaatgagtttgagaaggaatctgagaaaagattcaaaacaaagttggtagagaggagaatttgaaatgtttttggtattcaaatcatattcaaataccaaatatttcaaaagttgtttgaaaatcaaattcgcccaaaaacccctatagaccataaatggtcacctcctagcactcaagtgagttttgttgcaaatcttcataaatttcaaatattatgaatggttggcaatatttcaactcacacatttcaaaattgctccaaaaatcaaatttttgttgaattttattgtgtgggggtagccgaactgtacaagggctgtgcacagtcggctgggggccaggcggtctgaccggcgctatatgcgcggtctgaccggcctggtggcggcggtctgaccggcctctagggaccggtctgaccggctgcaccctagcggtctaaccggccgcgtatagccggtctgaccggccaggtatggtgggcccatgtagcgcccgttccgtcgtggcgcctagcgggaaaaattatctcttaaaaaccctaattgcgaaatttgtttctttgcttgttgtctagtgtccgtgccatctcaagatctcaatccccgatctatcgtcgagttcaaatccgaatccaaatccttccaaatcaaattcctccacaaaagtctattttgcctcccccgggtcgatgggccgaatctcgctcggcccatctccctctctccctctcccgggcgctccctctctctctctctcgccctctcccctccccggcgcgctccgctttcccccccgctcagctccgctccgcctcgcccgcgcgccgcgcgcgcgtgcgcgagagccgcgccgagtgctcctcctcctccgctccgcccgcgcgcgtgcgtgtgagccgccgcgccgagcgcccccttcccttctcctcgctctgccgcgcctgcgtaagccgcccgcgccgagccaagtcctccctctccgctccctcgctgcgctccccacgccgtgttcgcgtgcgcgcgcccgtgtggacgccgcccgttgcaagccgcgcgcgcgtgccaagtggctgaccgcccggttgccgccgccgtcagcctctgcacgtgtctgtcgcccgtgtcgtcgcgccgctccaaaccgcccgccgtcatc

SEQ ID NO: 84535 - DNA, 1582 bp, Oryza sativa
gtccattcgcggccgggtcgtcgtctacctcccgccggcctgcgtggcagccacgtaggcgccacgtcggcgccagctcagcctagaccgggtcgagccgaccccggtcagtccctccccgtgcgcgcgttccaccgcgagccgtgaggctgcgcgtgggcctgccgcatccgcgtccaccgcgaaccgcgcgcgtgcaccgcgtccctcccccgcccgcgcgcatgagccgcgtactccctccgcacggtgagccgaaccgctgacaagcgggtcccacccgggaccgcgcatggtgagcccggtccaccggctctctctctcctccctcccgcgcgcgcgcgtcttgggccgccttgggccaccttcttgggccggccggcccgttaagctcggccgagccgccctttctctcgggccgcgccctagccgcccgagggaagtctatatttcctccctctccctttttcttttcttttcttttccaaaaaggatttaattaaatccttttcctttagaccaaaaatccaataatcttagaaattcaatatcttcccaaccgtaaatccgtttgactccgttcaaattccaaaatttctcaaatctcgagatctatctaatggcacgcttagaggtcattaatagggctttattttcgccgtttgttgagttgtcccgttttgcgtatagtttcggagcccgaagacccgcagtgcgaggatttcgaggatcaagctccagatctcgagcaaggcaagccacctttgaacatcttgagcctatatttgaaatctaattatattgcttgcaaaatattatgcattgataggattgcacttaatctgttgttccgtctgcagggcagattggcagacctacctaacttgttgcatttgatccttccattgttaattactataccatgtccccttgtaaccatccagttgcgcctcgatattcgtgcaccctgtgccagtatcgacggtcgccttcaaacttaaaatctgagtaacaacttgggtaaaactggagttttacaaaagacttggaaaacccgacacctgggtcggtgcttgcgaactaaatgaatttccaaaaccgcggaccgggaaatgtaccgggtgtacggtttcccgctctcgcacttaaggaccaattccttggaatttcatccaaacataagtcaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctaggacccctctcgtcggcatatggtaaacctgtgtcggctttggaaattccttgtcatgaaagcttggaggtctcccgacgtggctgatcccctcgggctgggtgatccgggttagtaatgtcgtgtgggtaaagtgtaccccctctgcagaggttaacaaactgttcgaacagccgtgcccacggtcatgggcggatgtgaggtgattcctagcgtagtttggtttgactactg

SEQ ID NO: 84536 - DNA, 675 bp, Oryza sativa
  unsure (1)..(675): unsure at all n locations
ggacacgccgaattcagtttccactatcttggtacacaactgatccaggaaagccctgtcatgagaaatgatgaccatcggcacttcctgcgtcttgaggtaactctccagccactcaatggtgtccaaatcgacgtgattggtcggcttatcgagcagcagcaaatcgggatcctgcacacaatcaatttcagcattggaaatgcacacagacactaaaaactacaattcaaattcaacaatccagaccaaattcatcaccaattggccataataccactcatttttctctccatcacaatatgacaaccattgattgctacatgtagagctcaaattttcttttttatctgtacctgaagaagaatcttgccgagggacatcctcatctgccacccaccactgaaggaggcgacgaggcggtcggcgtcctcgggagcgaacccgagctcgggcatgagcttctggatcttgacctcgaccatcccgaggtcgacgtcctgcgaccgccgctgcagcaggtcgagctcgtcgaggagcgccccatgaggtccatgtnctcggtggcgcccttcagcgcggnctgcaccttctncaggcgggacctcaccttcatcttctnctcgaacgcggcgaggaacctcctcctgacggtgcgcgacgcgcacacctcga

SEQ ID NO: 84537 - DNA, 773 bp, Oryza sativa
aacatagctggattaactgtgaaatcaccccctttttatgcataccctacaattgcttcctagaaatcagggagcactgtttcagacagtcctgcaccccttgcagagtaatgtctttaccagaatgagtaaatctcacagtcttacgcccccaatgaatccacatgggactatgagcctcaagccaatccattcccaaaatcaaatcatagccacccaacccgagaatcttgaagttagaagagaatgtattaccctggcaccaccactcaacttgctcagccatctcatcacaaaacaattttccaccatctattatcatcaccagagcactaggtatgctattgggaaccagatgcaacctgtccaccaaatgagaagccataaaactgcttgagctacctgaatcaatcaaaatgaggacctgctgaatcagtccttgcaaccatatagtacgcttgccctcagttccaaacaaagcattttcagataaaagcagttcttcatcactgctactctcctccacctgcccaggttcatcagaaaactgaaagacctcaagcaattcatccaagacatggagctgaacagcctttggacacttatggcctggaccaaatttttctccacacttaaagcactctcccctagctcttctagctgcattcaatgagtcatattgttcttcccatttaggcctttcttcagttttcttgatctcatcaggtggagggccaaggatgcccttagctagacttgcaccttgaaattat

SEQ ID NO: 84538 - DNA, 4205 bp, Oryza sativa
tagtggatcccccgttttgctcagaaagaaagaacactgtttctttttaggctgaatgtaggcttgagaagcattgggagattgatatagttagtctgcttcaacatgtcaagggtggttggcacaatttgtggaatggagaaatttcaagtggcggcggtcggcaggtactccaatttccgattgcaattatctattaaaggaactgagacacaactgtagctaggcaagaagtatatattaagaagattacatagtttctaatgtttatcattatcagaaagagagccatccttgaacaatacagaaaaaggccagcttaattgaaagataggtctgcatctccagaacatagttgtccatctttctgttgaaaaatggaaataataggcttctttccagatcacatacattcctaactgatagaacatatttgctttgcagatcatgtagatctttgtctaccaactcgcagctgtgctcctcaaccatatcgatacaggctgacacactgagtacttgaatccacatttgcctcattggccctgtacatttacacaagtatgaaatgctcaacagttaacacccactaaccctaataaaactgggaaaaagataaatcttttgcaaataactgaagatgcaagcagcctggccctgcataagctggataggagcagatgatttcaacaataaggttttatttgtggaagtgatgccttactcattctgcagattcccctggaacagcaatcaggcacatattattaatcttaggaaattcatagaactactgtaattgaggtgaatctgcactgcagcaaagggcaaaaagatgaacaccttgttctctcgaatttttaggattacagtttccaatgctaccgtatcatcctagctctaaccaagcaaacggcttaaaatttgggctttcactgtcacaaatacagaaatataaacagaatgctctcaaaacaatccacagcatccgaaatcgtgaacacaagttaagcagtaggatcgatgaggaaaatcaggaaggattttgccaaatgtggaaggtgactactagtgacttatgaggaaaatattgatctatatgcttcctaattttttctttttgcggggaacttcctgattatctgataagcttcagaaattgatcagtgtctacaacatgcagcaagagttttcttgtgcaatttagcttagttctttaatctctcaaggcatttttcatattacttctagaattgcactgttgtacaatatatggttttagtcagtaagctatgtgttatcccaatattcacccttggatggacaaagtagagcaagcgattcaatacttggaaatgtgctcagttacttaatttaattttttgctagtcagagatcatatatatgaaccactgagtatgtttgtgtgcctcgcaatttgcttctatcattcttgggtctcagtttcaaatttcatcatgcctggttatgaaagaactacttctctctgttgctcgatgtgagattggtaggcatcgggaggtcagtttgtccactgatgcttccattaactccatggattatctttgaaatagagaaggttcgagtgaagtttgcgacacattcaggaagcaggaatcaaagtgatgccacattcacgaaatcgaacaaacaaggatagagtcatctttaagctcaatccagtggcggatacaaatatatctaggcatctacactcacacactagaaacaagcatgcaatgcactaacaacactgcaaggcgcttaaggcgtccagatctgtatgaacctcatgattaattagttgatggcgaatgccggagcataaaaaatggaaaaaaaaaagggaaatacatattgttctttgtcttcagacatcttatatcaaacagtattatataagttggcataacaacattttcgtcctttgcatatatttattaattaagaaaatgtatagcaatgtgagtgacagcctaaaagttgttgcaaagctgtttcatagacaaagatcatcaaacataaaaaggagagctcacattgagatgatcgagcaactcgtatgaaacaaaaaccagttgcttcctttcaaactgctgagagttcttgaatcgtgattgtcaaagtggatgctagcttggtcagtcctgaatatctccgttgtcatattattacatttgttgtctaagcgcttcaccaattaagctgtgctgccatctatctgctgcctcaaattaccacttgtgaatggaaggtgctgggaacttttgcctgcaagctactggactttcatatagtttcattcgtagagtttcctttcccactgttttagaatatacatcacatcagaaatttgtatccctcttgtttcgtatatgaagaacaggactcaatgttagtgatatgccctagaggcaatcatagagatgattgtatcacatactatgtttatatatttatccaactttgttccttgaaatagataactcattattggttaatgaatatgtgattctttcatgagactctttatgttgtgtgttgctatttttaaaggatcccttatcaaatatcatatgtggaacaaatatgtttagatgatcagcacatgtattaattgatgatcatgtctcatagattatggtataaagataccaaattaataatgtggacacatgttagtgaacatgttggatagacccgacatgagacactgcaagagccatatgtgttgtgtcatcagtgatcagcgtgggaatacggcgaggagaacgcacgaggaggagaaggtcaagccagtgcgatcgactacttcctctacatcgacgcgcgctacttcgcgagaattccttcgacttcttagcgccttcttctactgcgcagcacgtcgaatggtaacgctctatgatctaattaatacttgcatggttcctggtttacgcgatagaaaattttgatttatactatcatagcctacgcgtatcccaacactcaaactatccgttttcggattttgggatgagcacaaatgagaaaccacaaaatggctgtcaagatatatattggcctatccaacctaaaagattaatttgattggagggcaccaccctcacatttttgcgttatgctccttcatcatcaatttgcgatcttagatacctattactgaactccccatcgtgcaacccatgaaaaatcgttctaggtttctcatggttcatgccccctactcggaccaaacttatcgctgacggtccacctatgatcttatagtgggggtgcctacaaaaagcattatttgtagcagtattggacactgatagaatataaagtgaattgcccacctttcctcaccagcttagattttttggttggtcggtgcatgcaactcaatatcatatcagagccataggtcacgagttcgaatcctagctagcgcactattaaataaaaaattgcagcccacttcttttccatgctaaaggctgaggggggtctctcgtgagggggattcacttctattgcacggtagagacttgagagggcctcacttttgggttgaactggttggtgtatgtaagtcaatagacgccttggtcaacctagcaaatcccttatgtgtggcttgaaccaatagtgatactattctcactaccagttcattattgatctaggccagaattaaatgtgaactggtcatcatgggccggcagggatggcctttttctttaatggtagtggatgcaccacataagtataacatttttttatatatttatcgataaattttcttctaaaaatttctcaaacgtaaatacggtgtaatcgtagtatagttacattctaacttgcatataattttagtgtaatttgtatgtaactttcaggtaattttcagataaatgtatagacagtcccgatgtataatactacttcaaacactaccacaggtacagtttgattttactcaaagaagacgattattgtcagaccgcctaaaccttggacaatggcatgtgctgaaagtgatacgctagtatcagagtttaagggcttctgggtatataattaaccacaagttaaggttatttcgttgcttcatttgtagactgcagaaatatacgtgctgttttgtattccttgaaagttgaaatcaatgagacgaatgtgcaattacgacttaa

SEQ ID NO: 84539 - DNA, 574 bp, Oryza sativa
cacaactcagtcagctaattcattataatatgaacagttttcctactgatctactccatgttcatgtgaaattcaaatttttaatttgaatttggtgaggcgacgattagttagttggccaaagtgtgggggtcgcaggcgtcgaccgcgcaggcgagcacgtccttgtagcccctggtgatggagaacgcgtcgagcacctcgccgtcgtcgctgcggatgaactcgagctccagccgcgagtggtcgcgcgccgtgagcttcacgtacccgtagctctcgctcctcgccgcgctccactgcggccactcgccgccggcgtaccccctcagcctggcgccgcccgtgccggccacgacgtggatcgtgccgcccagcgcgccggtgtacgccgccgccggcgagctcccgttcccgccgccccccgccgccgccggcgccgccgtgcaggtgttctcgtagaccgggcacgtccgctcgtagttgtggacgtggccgtagacggcgaggtcgacgcggtgcttctgccacagcggctgcagcgtccgccccatgggctccgagaagggagccc

SEQ ID NO: 84540 - DNA, 8007 bp, Oryza sativa
tctatccaacaaaatccatcaaccccttctctctcaaaaacgaaaaaaaaaaatcaaattccttccccctttcaaattcgaaatttcgaatcaaacacgcgcacgctcctctctcctctcccctctcgatcgaggcacgcttctccgcggcggcggcgcgcgaccggatcacggcggcgggggaggggaggggaggggaggatgcagcagaagcccgcggcggaggccatggaggaggagttgaagggggaggccgtggggccccgccgccccgggctagggttatggttggcggcgcggcggcggctggcccccgacgaccccttcttcgccgccggggacatggagcgcgagctcctcgccaagcaagtgcgttctcttcccctttcacctcccttccttctgctcgcttaatttgggcgctttagcttcttcgattttacggggattttttttgttagctgtattgagctggaacccgtggaaaagatgaaatagagatagtaaaatcagccatgataacctttgattttgcagaaattcagctgtactgtacataagaggaaaagcttttgcccttctttgaaaaaaaaaagagagaagaaattcagctgcacttagcatcagttaggtgggaattccttaatgctctgcaatacttgtttctttgatttcttgaacggatcatggccgattagctcagataccctgccctgatgtgaaaagtgtagatgaactgtgcttttactcaacaagtcccctatactccactgtttttttaggtgtctgatgttttcttgtttaggttgctctggatctctccgaagatgaacggtaccagcttgagaggatggaagtggcgagtgccaagtaagagattgatctttacttatgcttactctttggattgatgattatttatcctttccgtttcacgccgaattaggggggggggggggttagtccctgtcacatcagatgtttggacactaatttgaagtattaaacgtagactattgacaaaacccactccataaccttggactaattcgcgagacgaatctattgagccaaattaatccatgattagcctatgtgatgctacagtcaacatgtgctaattatggattaattaggcttaaaaaaaatttcacgtgaattagctctcatttatgtaattagttttgtaagtagtctatgtttaatactctaagggcccctttgaatcgtagaaatgaaaaaacggaggaataggaaaaacataggattcgacaggaatataagtgtaaaacagaggattgcaaaacacagggaaaacacatgaatgatcgtttgattggaccagaggaaaaacacaagaatcggatgagagagatagactcaaaggattttttccaagaggttggacctcttgctaagtttcctccaaaacctatatgccataagccattccataggaattttgtaggatttggaaaacttcaatcctttcaatcaaagagctatataggaaaatttcctacaggatttcaattctatgaaattccttcataatttcatttgattcaaaggggcccttaattagtgtctaaacatccgatgtgccagggactacagtttagtccctagatccaaacaccccctaacataccctctctacagatttaaaacagcatgttaatgtactgtttttctgcatccccataacaccataaatttcttcgctgtagctaaggaagtccctgaaccagtggtccacaccccacagtgactaaagtctgagaaaatgacaactggatgtcttgaactaaattattgtacgagttctctagaacctataattcaaaatgattggcgagtattccatcctgacacctgctaaatcatgtcaccttttgcagttgtatgttctctgtgttgtgttagtactgcaagttttggtctcattctgtttatttgatcatatatactactgcaagtttatgtcaccttttgcagttgtatgttctttgtgttgtgttagtactgcaagttttggtctcattctgtttatttgatcatatatactactgcaagttttggtcttatctgttcgatttatttgatcatatgtcttaagctcttgcagtgcccttttatgcccaatttctggctgtggtgctcatctagattgcctggagaactttgaggaccactatcgcacccgtcatactgcttcatgctctgtatgttggagagtgtatccaacttcaaggctgctgagtattcatatttctgaggcacatgattccttttttcaagcaaaagttgcccgtggttttccaatggtaataaattcataatctatccatgcccccagttctttaattggtttaattttgtggcatcatgcacactagccaattttatgcaaacccagaacttccagtggactgtgcctgctggccagtttaaaattactactcaatgtcttagcattagttagcattacatggttttctggtcccgctaatgaagctttccaatttccacatgtcacctttactggcatctgattcttgtataaatttacatagtagtaagtgatacttttatattccctcaactttctatagcaattcacattgtgtatgctatttttgaaacagtatgagtgtttggtggagggttgtggggtgaagttgaagagctacaaaagtcggcagcagcatcttcttgataagcaccagtttcccaagtcatttgaattcttcaaaaaagcacgcccttcgcaacgccagcggaacaagaaccagaagcaacggcaaacagttcacaagggagacgagacaagcgaaacactaatggatgttgatgggaagaagagctcaaggtacatgaattccagatatcggccaaagcaacatgatggaaaagagtcaaaagaaaatgagcatagtagctgtaaggaggccaagaacaacgaaatggaggttgacaagcaggttgatgagcttgcttcggccgtatcaagactgagcacagcggattcaactccttctagcataagctttggtcatcgtcgctctcgcggtcttgcttttgtccctaggtcgattcggcaaaacaagcaggtttctcagacagaaccaaaatgacagcatttgataccatctttctcttcattgctgatctcggatgcatcaacaatcctgaatgtgctgtttcctgtacctggacattcaccgaatccactaatatacattcttgtagttgtatcacgagatatgtcttctagctggttatccttgcttatggatgtactgagcttcctgttactgccatgtagtagaacaatttttctgaagcggcaaatatgaagtgcaaaatacaagacagttcttgtggttgatcgatttaccagcttgttctttctttcctgcaggtgaaagttaatgacactgaatgaaggatcctgttagggttagctacttagcttgctcttctcttcgatggatagaacataccaactccttcgtcaactgcagtgtagttttgctcggtccttttcacacctctggatatctgaagtagatgtaatctgaatttctgattgatacccggcatgtaatcgacatggccagtttgtgagtttagtttgcttcgtaattctgataaaaattaactatctgaagctatgataaaaatcaactgtatacggactagtgtatggaattcaaattcgaaagatatctccatgggtacaaatcatccaggatttccactaacattcctcgtaaagttgtctccatttgggtccaataggaacaatttgggctggctggcctagatattgtacacttgctagcccaacaaatatggataggcatgtacttatacaaagtaggaataagtccactattcatcccatatctttttgccgagtttaatttgcatcactaaactgcaaaccggtgcaaaagagattataagacagtacggagggcgatgctaatgggcgcccccatccccctatacgtcctctcccccttctccccttcttctcttcctactacaccataaattttaaaataataaaaaaacaaagttagaaaattttatgtataaaaatactatatataaaaaatatttgaattcaaatttaaatttgaatcggatatataaactttttacttataaactttgggtctataaactttaggtgtatagaaatactatatataaaaaaaattgaattcaaattcgaattaatatttgaatttaaattcaaatttgaatcgggtatataaacgtttgacttataaactttgggtctataaactttagatgtatagaaatactatatataaaaaatatttgaattcaaatttaaatttgaatcggatatataaacttttgacttataaactttgggtctgtaatctttaagtgtataaactttagaggtgtaaactttaggtgtataaattttaggtgcataaattttctaaaataggaaagtaatgcggtgccaaaaaaggaaagtggagggaggggggattgatcgcccggagcgattgatcgctcgttaggattctcgcaatatggaggctggttttggctgacataaatagtgaattaaacagcgctggtgtctcctgtagcctatgtggctgcatgctgttcctcccaatgctctacttcccgcggcaccttttgacacggcagatggtggaggccacgctggaggagcttgtcatctactatcccttctccgccatgtgcctgccgctctggctggtgttgccaagcgcctcgctgcgggggctcgtgccgagggtggacttcgacatgtcctcggtggcgtctagcgggtggatccgggtacctagactagatcggcgtcgtgccaaaccttgaggatatgaggctgtggggcttcagtactagggctgaatatgggccggtacggttggatcatgacattcccatatcctagacaatattttcctttaaattcggaaccggatataggtagtgccgaataacatatcattcatcctgtatcatttcccatattatttccttatgaatcggattcaggaatggatacctatttgttctctaattcatatctattaaatataagaaggtgattaaaatgctaaaagatatatacgaaggcaaaattatacaatattacatgtgagctcgtaaaatagtgattaaccaatcttttaccatgtttatatatggatctataatagattttcatatatattttataatatgggacatacgggtggatacaagttttcttgtatcctaacccttgccttttttacggatttagattcgaactatccaagtttttcccgcaagcctcaggttggatgagcgagcgattgggaaatatcgccccattttcacccctaggcctcacgatggcacgcgccctagcggggagggggggcagttggctttagcgggctagagttggcacggtgctacgggatgtctggagagaatagagggaagagaggcgggagagaaaagaggggaggagtgaaatgtggggcccactttttttccctcatgaacgtctagtcagtacgagtggatcggatcagcataacacgttagcgaaaccagctatctatgttgctggaggacctaatctaactcagaaaagttagggaatagacagtgaacttatttcatatgaagagtagacgggctttgtgggctcggcccgttggatccaacggcaagcgccgcgtgcaggagggggccgccgcagctgcagccggccacggacgcgacgtgtgcggatctgcacgcgcgcggcggccgacctgacgcgctctctttaacgtggccggccgccccgtttctccgtgctttgtgcctaccaacatcatgctgtgacatgtgagctatacatgtatgatcatgtgacaacgtggccggcaggcatgatgatggattgcagggttgcagcacactcggaggaggtaccatctatatcaaaatgtagcatcgtacaattagattagacacattctaataaaacgaatctgagaatgtggacctgtctaatttaatcttaggttgtatattttaggatagcgaaaatataccattcgctaaaaaatttgatttttctatgacggagaaagcagtagtgtaagcagagcgcccgtaaacatatcctcacttttggttcatctcatatttttgtaagatggaggaaacatgagtgaaattagagcaccctgtaaacatatcctcattttggttcgtctatcagtcacgtaactttgttatttctgtcggttacctagtactaatacctaagatgataatccactgtaatgggaagatgagcacggttttatatctgaaactgaaaatgggtctgttggtcataaaacttactacctccgtttcgaaatatatcaaactagcttgtattagattagacacgatctattattcaatttggacagagtccatatagctatgatatgcttactatttcatattgctttcatgaacttaacttaaagttttggaccacaatgaaagtttcagttcatatcatatggcatactacttctattcttttttttttgttaaaaaaaaactggagctctcaatttttttaaagtttgtcctgttacaattttaatcagttctttattattcctctccacatcaacaatttttcctcgatgatccggttcccttttgacctcactgcactgtcccagatctctcattaatccaacccagaaaaaaaaaacagtacaaaataaaatacacaagattcaacaaagcaacctgacctggtcggtgctgtaccacgtggcatctcccctccatgtcccaatcacttcgagagacaaaagaaacactcctccagtggcatcctgccatgtgtcctccattcttgtacttaatctcttcttatttaaggcctcataatctcttgctttcccttccctagtaaatcaaagaacacaaagcatccaaaacaacaccaggaaacttcttttcaatcgatcactccactggtgagtagtgagtggctagtgactggtcagttcatcacttgtgaaggttttgcaatcaggaaaagttcagaagatcatgggcaagctctggacaatcctcactcacgttcattcccttgcagggtacatatggtttctattcttgtaatgttaatatgcacttagctgcagttaaatttaagcttaaacagttaaaactgattcctgtgaattttctttctgctgccctttgtggttggttggttgcaggcctaccgtcatgctcctgtaccccttgtaagttcagagattttctctctattagcttttcttcttcttctttttataagttcatgtgattgaatgtttaattttgagatgattttggttggtgcaggtatgcgtcggtgcaggccatggagagcccatcgaagcttgacgacgagcagtggctggcctactggatcctctactccttcatcaccctcgtggagatgcttctcgagtccctcatctactggttgaattcgattaacccatctcatcttgatcttgatcgagcagatatggattaatttcagaaagaactcattcataaaagtactatgattttgttcgatcaggataccgatctggtacgagctgaagctgctgttcatcgcgtggctggcgctgcccaacttcaggggagccgcgttcatctacaacaggttcgtcagggagcagctcaggaagcatggcctcgccggcgccggcgccggcgccgccgccagcgtcggcaagaaggacaagtcgtcgccgtcgtcgtcacccaaggacaaggagaagaccaagagcaagttcctctccttcgtcactcccaagaaggtgagttcttaaacctcgagcagcatcagtctcttttttttttcttgattaatcttggctgaaatttgatccatgttctttgtgtgttcgttatgtcaggatcatg

SEQ ID NO: 84541 - DNA, 646 bp, Oryza sativa
aagtagtttaacttctgtaccaatcaataactataaaggattatcaaggaaaaaaagagcaaaatttctgtatgtaaaaagttctaccttgtcaaaaatgataaggtgatacctgaagttatgtgcatatattatcttacttcgtcgatgcagtaataatctcaaggtaacaaaagaagttacctccaggctccagcttactgaaagtttcagtaaaatatgtaatttcaggcctatgtgacccaagatgacaacttgatcggcacattgacggtgagggagaccatctcatactcggcgcggcttcgccttcccgacaagatgcccatggaagagaagcgcgcccttgtcgagggcacaatcgtcgagatggggctgcaggactgcgccgacacggtggtcggcaattggcacctgaggggaatcagtggtggtgagaagaggagggtcagcattgcccttgagatactgatgaggcccaggctgctcttcctggatgaaccaaccagtggccttgacaggtaggtactgctattatatttatggcaaatcatttgttattacattaattaatggatcatgcaagcatgccgggtcggccaaaggctggccgaccaatttcattaagattgggagaaaataaagt

SEQ ID NO: 84542 - DNA, 592 bp, Oryza sativa
aggctttcacactcacgaagcgatcgttcatcaacatgtcgcgggacttcgggtactactggctgaggcttatcatctacattgttgtgacagtctgcatcgggacaatctacctcaatgttggcaccagatacagctcaattctggtaaaaatttccttcttcagttgtcacttctatttggatgcaaacttacactgaaaagtatctagctaccctgaactgaatacttgatgttaagcttggtgatctgataaaactgtgaaaacaattaggcaagaggtgcatgtgcttctttcgtcttcggctttgtcacgttcatgtcgattggaggattcccgtcttttgtggaagacatgaaggtttgtgtcaccactgaatcaacaaatgggttagaaaagttcttcagattacagcaaaccatgctcacagaatcttttttatgctctttcaggtgtttcagagagagaggctcaatgggcactatggcgtgctggcattcgtgataagcaacacgatctcggcaatgccattcttgatttgatcaccttcatctccgggacaatgtgctacttcatggtgcgcctccaccc

SEQ ID NO: 84543 - DNA, 572 bp, Oryza sativa
taactaattatatagattgcgtgtaaattgcgagatgaattttttaagcctaattgcaccatgatttgataatatggtgctacagtaaacatttgataatgatgaattaattaagcttaataatttcatatcgcggtttacagtcggattctgtaatttgtttcatgattaaactatgtttaatacttcaaatgtgtgtccgtatatctgatgtgacacgccaaaactttacacccctagatctaaacacaacctaaagtttagataggatcggtttcccgttccatgggcagtactgcccatactgtgcagccggccggcacagctaacctatccagctgcctgaatcacctggtcaaaaatcatcaactgcttgttattgttagctgggagtctgggacagcttctgcttctccctttccatgtatctagtgtgccatgcttgcaagtaattgtaaatatgcaaattgcaatatatgcagtgtgtgtgttgatcttgatctagctgaccttttctttgtcaaacccgcagcaatagctagctagcccatgtgattggtcctgactaatta

SEQ ID NO: 84544 - DNA, 2583 bp, Oryza sativa
tgtgaggtcttgctcttctgcttgttctcctcttgttatcagggcctagatcaatcctactgctgcttgtgcctccatagctactgtccgtttcatggccaactgcatactcatcttttctgatgggcagtagaactttggacttctttcgtgcctctgcagcaactcttgaaacttcctccgcgttaagacgagcgagtgcccatgggctaatttttataccacctgaacccttcttcctccttacttcatcttctttcctcttggaagtagaattatgcgatgaaccagcctctgacggaataacatcgaactgaaaagaagttgagtagcacaagatcagctagtggcaaatgccaaatcgaaaaaaaaaaagccatacagtagtatcttttatgatcatgtatacgactcatgatgaaacataaatatgcatttgttgtaatataggactgcaattttacaaacataagaggaagttccaaagacgacaagtctaatatagactaaaaattagcaaggctagctaaacaatcaaatcacttaacttcaattcgcatcagcacatcgcacagctacaaaggctagcagtaagatttttctgtacagacataccgtcacttcgaaaggtatgcagccatttatcatttatcataagattcttcaaggttgttacctgatcttcaagaaataatcttggaggagtacaccatgaaccacgacgtcgtccaccaaaggaacttgtactgctaagtccagtgtaggagcttacacgagacatctgtggactctgctgcccaccaacctcttcttgttcttgctctcttatggcgatgatgtagtcatatgtactaattccctgtatgaagttgagaacatgatggttagattcaacatcgcatcacctcagaatgcaacaatatgacacacactggaaagttaacatttcattgtggatgtccttttaataaattttttctaattcaatacataaatattttttaagtgttcaaagggtatgactgtatgagaatctggtgtacaagctgctctaaaaaattatcaggaatagcaacgtagtacctaatcaatccgtggcattacataaaacgggaatgggttaggagttaccttcttgattagaagaatgtgaaaaaagagaagttgcgcaattggcagcaaagcaactatggctagaatggtacaagatgcctgtatgaacaaagatcaacattttgagcgttcaagaaaaaatgtgaacagagtcaactggttctccaaaggaaaggtgaaatagctagaatttgaaagtagaacagccaaacgcaccaccacaataacataaggcaccacagagaagctgcttccaagctttgacacaatttgaatggagaattcctttcgctcaacaaagcagaacactagcaccaatactccaactgctgattgtaggataagctggcccaaagtgcacaaatcatgtagacctgtcaatggtcaactaggatgaaaaggaccaggaataaaatgctctatgcggtaaccatgaccaaatttatatgcatgcaaaagactttaagtgtagctgatgctgggactatggtaaacattatagactaatgacaacaagattagagcactatgcagcactcctatccatacaatcttataagagtaattgtagctgattgaacatgagcttaccaagaatagggaagaagtcatcagaataaaaaacctcatatagtttctttttccaatgcaattgttgagccactgttgagattgaggagaaaaggagagttactaaatactcgctaatggatgaataagaaatgatctgtttcaggataaccttaccctgcagtgatgatcaaaaccatcaacacatttgtcacaaactctgcagtgcttactgtacttcaatacctataaaaaattagcagcatattaaagagttgagttgacagaagaaaagcataactcaagtactcaacagctagaaatacaagaagcatacctcaacttcacagaggctgcagaaaaacattccttcctcactggcttgctgctcagaccattcccgtggttggcagcaggaaaaaacaagatagagagggtagaaaataatgagaaaaacagaggaagttgaactgcagcaagatgggttattgtctttgtagcgagttgttgacttttcactagcagctgcaaactcatgttcttgcttttctccagttccctctacttgcaaccctgaatctgaaatgccatgtctgaattccttcggatgcttgtgtttgccgcttccatacaatcttaggtacttctttgatttcaagacacctgggtcagctgggtctgttgcagcacaccagatgtacatgaagaagacaaatgaaacctgaaaggagccaaaatacacatttctatcataaaggtgttaagtaaatgcatacattgaccataatggaataaagtaaattcatgcagggttttgcacttttgctaagtgtcattattttcttttaaaagggcatacgtgctcaagctcgccatttggccacaacagagtgcctgtca

SEQ ID NO: 84545 - DNA, 1718 bp, Oryza sativa
ttactcctactttgcaacacctggttttgcatgtgtacgagccaatctgtttggcaccttttctgctatcttggttgtcgcattgcagattcttttcattttgtttttattcagctcttcattgtcattcctgaaaatggaaatctttaaaatggacactcctggaaaagtatgctggaataattatgtttttaatggataggtgacaaataaagtaaattctctgaagaaaatccgtggcccagatccaaattataaagacatctgctttgcaggtgctggaaggtaactcttgcaccatgataacaatttctaccccctttgttttcatcatcaatgttcttatcttatcactttaccttcaggaacgtctcccaattatcagaggtatttccagatgttgacatggtatttggaaatgggcagaagctttcgctttcacctgaaaactatttgttccgggtatgagaaattccaagcttagacctgttctgatgaattatgacaccccattacttttttgctttgcctgttgttgagttcatgttttgtcttctcttctttccggtttcaaaataaagcattcgaaggttgaaggggcttattgcttgggtgtgtttcagaatggaaaagatccgacaacactattagggggtaagatcttcaactcttggtctcttacgaggaacttcaagaaaatttccattggacttcttttatttatatcatctgactacactatctctactttattcgcatataacttgttactagtgtatgctgaataacatttgcacctgtactatgagtctttgaccagcttatacactcgcgtctgctggaaacttgagtagaaaaccaagtaactctctttgtagaaaatactactatataacaatggtctccttatctttttcagcataaccagctgatgcacttttcaatattttttagatataatctgaggtaacttttgtgtcagtgtagcttgttccttcatcactatggcaatttcttggctgcacttattcaatttcgtaatccaatagtttacgtgtgcaagtatgcaatgattggtgtgtaatccgaaaaccatggctgtgaaataccaacattgtttatcattttatgaatataagaatgcataaaccctctatttttttcatagataacaaacatgcaattatctgtgaacaatccaaaaacaagcatccttaagagttattcctgatttcagaaaatttgaggttagaagcaaagtgttcatggaattatcagttaaaactctaaaagtggttgagcctacaaaggaggcattctctttattaattgccggttgcaagccaacatacggtattgtaccaagaaattttttttctgccaacagtataatagaccttggctgcttgttgtatttatgcactcttttgtctctaaaaggaaagtatggtgtttttgttctcttctctatcccttaaagagtcaagcagatcaatctttagagagatttatacttttcttatattaattttgaccttttatttgatttatagacagtctacatgaatgttctaatagtttgcatggctctatgtactttgaaaccttgcccgctttgagtgtctaaagaataatgatcttactggcaggaattgttgtccgtaatactcttgtaacctatgaccgtcacaatgagaagattggcttttggaaaacta

SEQ ID NO: 84546 - DNA, 735 bp, Oryza sativa
  unsure (1)..(735): unsure at all n locations
ttagcctctgctccttccatctatctctgtagatgttccattcttctatggggcacctttatactctcgtgccagttatccttaaaccatgcccattcattttagaagtaagagctaaacaaagtttccccccaccctatttctacactcttaacaaaaatttagcctctgctcactatgccatctatatctgctgcgttcagcttttctctagctatagtgccatttttctcctatgccaaattgccagtttattatcgagccatatcatacggcctcttctacacagtatccaccctgttttgagttgatgttaaaaacagggatattagttatcaagcagaggaaccagaagactgttttatgtacatttaaactctgaccattgggttcattctaaaattgccaaaatctccaattaagacccaaaaaatgtgtttttatgtgtgctgacaggactaatatataataaagcacaatgggcaaatattctaattccagtaacaatgggcaaatattctaattccactagatgactagatggcaaataaccattacctgttcgcatttacccagatnttccttatctccagtgtaattctggaaaaaaacgagacagtaagccaacatagttttcagatgagatcacaacaaggccaaacattgtattaccttgagaagttccatttcttcttttgtaggacagaactttatgagattctccacttgatcaac

SEQ ID NO: 84547 - DNA, 778 bp, Oryza sativa
gtaacatggtcatttacaaagtctaataaatacaggttcttgagactgtttgcatagttttgtgatatgataatgagatcatgtaacacatttgtcataacttaaatgtccaacaaatctagtgtctttctgaccttgatcactgatacaaattagaaaggaaattaaaattagcatgtacttactaggtgaactttttctggctttgaaccaagcgattttctacgtgaatcagatttagagctgtcattcggttttggaacagctgctggaaaaaggctttccagctctgacaaatcaaactccgaaacactgcagaaaagaaattgacaaacattaaggcaaaacctagtaaaaaagcatcacaaatattgagccagtctttgtggagtagattgtacgagatattagcaactgaattgtagaaaattcaatgctacaatcatgacaccaaattatttacaaatcctggatgaagccttacagcaatcagccaatcacatcattgaaatttatgtgcatatatcaataagcatggtcaaatggaggaagaattttaatcaaaaggatatacctctgtgagtcatcatttcgctgtaattcttcccatagacttccttgcaaagctctagtcaccttgatccaatgtaatggctttaaagttgatttacgtgcagctgcagccccaaaacctgatcctgaagcacgtaccaccccacgccctctacctattaaactactaggattgcctcctggagtggtggtgctcctggtcctc

SEQ ID NO: 84548 - DNA, 667 bp, Oryza sativa
ctgatattgatatgccattctctgctaatactgggatgaggccagatctcatcattaatccccatgcatttccttcacgaatgactatagcaatgctcttagagtcgatagcagcaaaggtacaaacttctttcataggttgaggaagcttgcatttttttcttcattttgaaagaaatatcatgattgttgcgagagagagacagagattccttgtttccaattcttctcatttaagtatgatagcgtcttggtactttctttactcactgaagtcttgtcttcacaggccggaagtctgaaagggaagttcattgatgcaacgccttttgcaagctcagttaaagagagatcaaattccattgtggatgaactgggacccatgcttgcttcttatggatttaattaccatggaacagaaattctatatagtggagtttttggcactgagatgaaatgtgagattttccttggacctgtatactatcaacgccttcgtcatatggtctcagacaaatttcaggtgggcaatcattatttgtgtaccatcttattatgtatagttaaagtcgttatctggcttatttttcctccttttctattcgatatcggattgaagatctctacaatgctatgcatcaaaagtattcattgctctatttatcta

SEQ ID NO: 84549 - DNA, 539 bp, Oryza sativa
ttgcattggaaaaagaaactatatgaggttttttattctgatgacttcttccctattcttggtaagctcatgttcaatcagctacaattactcttataagattgtatggataggagtgctgcatagtgctctaatcttgttgtcattagtctataatgtttaccatagtcccagcatactacacttaaagtcttttgcatgcatataaatttggtcatggttaccgcatagagcattttattcctggtccttttcatcctagttgaccattgacaggtctacatgatttgtgcactttgggccagcttatcctacaatcagcagttggagtattggtgctagtgttctgcttgttgagcgaaaggaattctccattcaaattgtgtcaaagctggaaagcagcttctctgtggtgccttatgttatgggggtggtgcgtttggctgttctactttcaaattctagctatttcacctttcctttggagaaccagttgactctgttcacattttttcttgaacgctcaaaatgttgatctt

SEQ ID NO: 84550 - DNA, 679 bp, Oryza sativa
atacgaggatgaactgggttcggaaatgatcaattaccgttccccggcaacatacatcatgaccatgttgagaccaaaagatctagtaatatgcatggctttctctggtttgatcaatacaactctatattgaggtttgtggacaacagttgtgtagggagttagtactgccgatttattatcttcaacacggtgcgaattttctaggccatagaagttccttctttagttaaagaaccaaagtatttgcttttatactgtaaaaaaagtgtcaaagtttaaagatatcaatgtaaaaaaagttgtgcacaagtagaaacaatgtacacaaggtaattccaataataatcatattgatcatcacctccaagaccaaggggaagaataatgcgttttacctggaagagatgtggacaagagttatacgccatcaactgaggaaagtagttaacaatttcacattagttaaacagaatgttgcaaagatcaacaatatatcacatgatagacatattgttcagttctattggagtttggagataattaagtctgatttgatctagttgcactctgtagaatatgtgtagacaaaaaaggatggaggcaaaaaaaaaacatagcatttcaagtcttaaagcttgtgaccctagtacaaaccaccttcatagggctcaggaat

SEQ ID NO: 84551 - DNA, 518 bp, Oryza sativa
aattatagggcgttctctttttaaagtaaatcaaacttgataacttttaactattatcatactaaccatatacatgctaagtattatgcatgttatattactagatatatattttaaagtactttcatgtgatgctaatttcatatttattaggaacataagttggaataaattaatggtcaaattatatcattgaagaccgtataaaaaatatagagcttataatttcaaatggagggagtataatctaacaaagaagcccagtatcaaacagttattaggcacaatgagataacaggaacttagaggaaaaacaaactcaagctaatgcatcaaagatgtataacaatgcacgactgaaagtgacgtgaacttggtacaaaggcagtaaacattttcttttgtttagttgttgcatcatccttaatgtccaaacaaatggcccaaacgaaagaaccgggatattctatacttggacggcatgtcaacacatgggcatctgacactggaacaaatag

SEQ ID NO: 84552 - DNA, 516 bp, Oryza sativa
agcgtgcggacatcgtcgcgggccaccatcctgtgctggcagatcgggcatgcgtcgttcagcgcccggtccagtgtcctgacgccgccgcgagcacggatgtgctgaaacctctgagcgttgtggtctatcaggttcgccggcgacgccttccacggcagcatgcagcgggcgacacggttgcatattctgcatctcatgccgtgcttgcggttgcggaggcgctcgtcgacgcaggccttgtggaagacgtggtcgcaggagagcgcgcggaccacggcgccggccatcatcttctgtttacacagcttgcactgtggtcgcagcgcctgatccagggtcctgacaccgccgagcgtccaaatccgccgcctataccacatactcagcgtctctcaccccgccgccaggtacggccacggccaccccgccgccgtccacatcctcagcatccgccaccccgcacacagaaggtgaaggaagacgagcgaggccatggcgccgacgaggtccatg

SEQ ID NO: 84553 - DNA, 545 bp, Oryza sativa
aggaggaaggggatgaggagtgggtggaggagggggaggaggaggaggaaggggaggaggagtgggtgggcgaagatgctattcctgttaaagatccagaggtggcatatgatagtaatgatccaccgatgacagaaaatagtgtgtatgaaaacattgtgcaattcagattggcaatagctcagcatgctattaaacatgaattcgagtataacattgttaagactgacccagggaggttcattgccaagtgtgctgctgagggatgtgggtggagaattcatgcctcaactatgcaagacggtgttacaatgcaggttataacttaatttctattgttttttcaacaggtttcatagttttgcagttgctaatgaaacaatgtttttgttcctttgttgttttgacaggtgaagaccaatagtgtgcctcactcttgttcaagtgcaagaagaagtgaaaagattaaacctgcaagtaaggcttggatatgtgaaaaggttaaggattggttgttagaggatgcaaccgtgggagcaaaagaa

SEQ ID NO: 84554 - DNA, 842 bp, Oryza sativa
atctattgctacatatggcctgcaaccatctcgaaaaccatctatgcaaggttttagtgtaaagaatagtcttctgaatctcaacttattcagcactgtgtggtgatcaattacaacaaggcttccagggcattctctttcaattattgccttgtaactgtacaatttgtcaaaactgtcctcccatttaccatacaacttttcaagagccaattccttcccagcatataccctcttgtagttaatcagaactttgtgagtttcaaggatccttctttgcaattcttttgctcccacggttgcatcctctaacaaccaatccttaaccttttcacatatccaagccttacttgcaggtttaatcttttcacttcttcttgcacttgaacaagagtgaggcacactattggtcttcacctgtcaaaacaacaaaggaacaaaaacattgtttcattagcaactgcaaaactatgaaacctgttgaaaaaacaatagaaattaagttataacctgcattgtaacaccgtcttgcatagttgaggcatgaattctccacccacatccctcagcagcacacttggcaatgaacctccctgggtcagtcttaacaatgttatactcgaattcatgtttaatagcatgctgagctattgccaatctgaattgcacaatgttttcatacacactattttctgtcatcggtggatcattactatcatatgccacctctggatctttaacaggaatagcatcttcgcccacccactcctcctccccttcctcctcctcctccccctcctccacccactcctcatccccttcctcctcctcccccttctcct

SEQ ID NO: 84555 - DNA, 1675 bp, Oryza sativa
tgttccgatagtcttaagattgattgcatttttctcaccttttcacaggtatattgctgaaggaagaagagcaccaacctatttatcatgtcaggaggatcttcaccaaggtcaagacgaagcagctttaattctttatcaagagatctcgaactcccttcagagcaaggttgtctctctgttattgtcctcggggcttctggagacctagccaagaagaaaactttcccggcactcttccatctttttgcacaggtaatttgactcctgagtcctgacaataactagctgtttcatgtacaatttccaaaatctacactacgaaaggaacaatctagtgcacagtcatttgaggcattccagagcaaaggttcagttactcatacttgatcacaagtaaaagctcgaacacttgtactattttttcttcccagatacagatagtggatataggacacaattgaaaagaatgctggaaaattgcagagcaagcttctttttatccagcaagctgtttttacgaaccactcataaaatcttagtctttacaagcatgcaaaatgtgtgcagtgctataattcccaggttatcgttgatattcatgtccttgtgttacagggatttatacaatcaggtgaagtgcatatatttgggtatgcgagatcaaacctttctgatgatgggttaagggaacgcattcgtgggtatggtttctaaaagctgggtttttgacatcttggcatattgctgctgtatttagatatttctacttcttttaaacatatctagccactgaatttgaatgttatagctaggatagttgtcaataaaaacatttaatactctaattatggtcaatacgtactaaaaacaagcagtacatgatctgagatacattgtgtgtaatgcggtggcagttatatgttcgacatcttcatgaaattgtatttgtttttcctgtcccctatgaagttcaatcatcaattttgcacatatttatgcctttgttgtatattgctacagatacctcaaaggagcctcagaagaacatctctcagactttttgcaacatgtgagttgttgtttgtaatgtaaccaccattttgtgatgcgcacacgtcattatgataaatttctttttcagataaaatatgtcagtggttcctatgacagcggagaaggatttgagaaattgaacaaggaaatttcagagtatgagaagtcaaacaaatcagaaagccctcgcaggctcttctatttggcattgcctccatctgtctacccttcagtctgcaaaatgatcagaacatattgcatgaatccatgtaaagtttctttactattccatacgttattctttttggaatttatacaagctatgcgctctagttgaacaaaagcaatgaagcataaagttagtggaaaattcaggtcttcttggaagcatttcttcatcaagattcattttctttgcataaatgttctgtttgcagctggatggactagagtcattgttgagaagccatttggaaaggacttggactctgcagaagaattaagtgcccaacttggggagctatttgacgaaaaccaactctacagaattgatcactacttgggaaaagagttggtccaaaacctggtaatggctataattttgtcgggctgcaggaat

SEQ ID NO: 84556 - DNA, 1811 bp, Oryza sativa
ttgataatatacaggtaagctggtcaatagttggtacttagcagtaggcaacttataggttatgattcaagaagtccaacttttataaactgcagttaatgcatcatgtagaagaaatattttgtagtcctcttgtcagttgattgctgaacttctttctgttttttggtggagaactgctgtgttctactggtataatttatcattgtctgaatggactaattgaatctaagaaactaaaaatataggtatatttcatttgtactattttaacagtatattgccaacaatatggcatgccatagtagctgcaatttataatcaatacaatcctgcagattgtattcagggaggactttgggactgacgggcgtggtggatattttgatcaatatgggtatgtagaaacattacatttcattagcacttttcttaattaagttttctattataaaatcgtaaccttacaagtcaaaagtgtacatatgagtatattatctagagctaagtgttgataaattttggaaatatttaaattctttgttaattcttactgattaagaaaagcatactctgcatttcagtgtggaaatgaacattttgctttattgagtttgcaagccaacatggaaattataattttcagtaacagaagtgttcagtactgaattcgaagagagtgcattcgctttgtatatgcctttcctgctatgagttaactaaaccatttaaggataatgtatactggatcatagtcctctctttttgcataattgtttattgcttaaacatgttttacacctcccatcgtgtatctcgttgttcctcaagggagtatctaacgttactcttgttgctgcagaatcattcgtgacatcatccagaaccatttgttacaggaaagtattctcaatatgtgtcaacattccatatgatatgatttgcatcattgtagtaacccccaccctgtcctaacaaagaaaacttttagtactttagtgactaggaaagaaaagcctcttcttacattaatttgtttaaaatttatattcacagatagtttcatgctgaattatatatggtcaagtagtacatgataaattccttgatgagaacaatgtctttagcctttaggagttaactgttccaacaacaatttaatgaactgttgcttcttctgcaggttttctgtttggttgcaatggaaaagcctgtctctcttaagcctgagcacattagagatgagaaagtcaaggtactttacctttctctattctctacatgtcaatactatattgcagcttgccaatactataatactaagagtattatgttttagtccgtttctttagtactaaataaaaccagttccctgttaatgccaggttctgcagtccgtgaaccctataaagcatgatgaggttgtccttggacaatacgaggggtacaaggatgaccctacagtgccagatgactcaaacaccccaacttttgcatctgtcgtgcttcgggtacacaatgaaagatgggagggtatgtctctcatcagtatatatacacattagggttctggagaaggacaacattgattttcgttttcccttcagattgtctttcagtggaccataattcttcattttaactctgtaatattcatatcctgcaggtgttcctttcattcttaaagctggtaaagcactaagctcaaggaaagcagaagtccgtgtgcagttcaaagatgttcctggtgacatctttaaatgtatgtgctataattacgtgcagttcatatcatggtgtactcaaccctt

SEQ ID NO: 84557 - DNA, 794 bp, Oryza sativa
agaagaatgagatttgaaaaatatttgacaaaataaaattaatgggaaaagactatgattcaatagttacagctgcagtacagagacaccttttcattatagaaaagccaacaagacaccaaatgctggcaatgaattctcaaaaagtgcatgtgttgtcgtttgttcccagagtaacatgaacacaacatgtagaatggacattttacaaatataataaaatcttaccaactacgtttattctcggaaatgtagaatgcaactatatttctcggaaaaaggaagacgctggctgaaagaaggaaaaagataaactcttaccaactacgtttattcatgtcagcatcggacacaccttctgcagctggtgtcccagcaagtatttcaccttcctgccacgaaaatgaatcatgagataggaaaaatgatttaagagatatgagagagagagagagagagagagagagagaagggggaactctggtgaagaggttacctttgtcaagtataggttgcgtcgatcctccacctcattctttgacttctcaagttcctttttgtgagctgactccttgtccagcgctttcattatcttaagagccctgctctttataaagatccccaatccaggagcagcattggcagcagaaacggctgcatcagctgcctctgctgtagagaacttcagaaaaccagttcctctaggtctcctgaataacaccaaaaaaccatgcactaatgagtgtatatgcaaaactgcaaatgtcctctggttgatacaacaggaggaaata

SEQ ID NO: 84558 - DNA, 1230 bp, Oryza sativa
atttttcctatctcatgattcattttcgtggcaggaaggtgaaatacttgctgggacaccagctgcagaaggtgtgtccgatgctgacatgaataaacgtagttggtaagagtttatctttttccttctttcagccagcgtcttcctttttccgagaaatatagttgcattctacatttccgagaataaacgtagttggtaagattttattatatttgtaaaatgtccattctacatgttgtgttcatgttactctgggaacaaacgacaacacatgcactttttgagaattcattgccagcatttggtgtcttgttggcttttctataatgaaaaggtgtctctgtactgcagctgtaactattgaatcatagtcttttcccattaattttattttgtcaaatatttttcaaatctcattcttctataatttgtatttagtttttctttagctgattgaacgttcagtactcttcttaagatggagtttgattatgctctcaatcatggtcaaaggatctcatgaataatgtttaaggaatcattgatcttgtcgtgcaggctagctagaagaaaagcagaaatgctccagtctccaaaatttcatgtgtccagaacaaggcttatcatctacaacctgccaaagactatgaccattaacgacgtaaagaagctttgtagagaagcagttatttctcgtgctcacaagcaaaatcccatcattcgaaaggtttcttgggttttctttattcaacctctgttttattctatttctaggtattcttttataatgcttatgcgtgtgcacttgtcttgaacaggtaaatatcctgaaaaatgaaaagaagagcaacagtactgcacagaaacattcccgtggtgtagccttcgttgattttcaagaacatgagcacgctcttgtggctctaagagtcctaaacaataaccctggtactgcctctataccaaatgcttctaaatattggtttgtaactgcctcggttgcaactttataatgtggaacatgtctttctccaagaagatttaatgtgttatattgcattgtgctgcatccctacattgcatggaatcaccgtatcacatgttcgtggcttcatgctacctatctgtattgtttcttgtcctgtcatgagcctgatgtgtcgtagtgctgctattagctgtaattttactttttttcctctatatttgcagattactacgatgtaa

SEQ ID NO: 84559 - DNA, 1689 bp, Oryza sativa
aggactatttgctttggggttgacttatttcctgtgctgccatttcttgttatcaggaacaggactttcgcttgtgggcaaacaacgatgtatccgtggagtatcaaatttcagaagcaacactggatccacaaccgaaaatgattatgtaagttattcataacttcaaatcgttcagtgatctcctatgagaaatattaatactattagtacactacaaacttggaaattttctatgccgtttcttgtttctgaaacatatttgttgctacagatttgttcagactctagggtattcaattacagaaattctagtggcacttctacaagatgttctgccggtgaacaactgaaaaatggaatgggaagttgtcattcacagccttctgtgttggcagaattaatgcatcttgatacagcaaaggcagaaacttccttttcgagttcaagacggagcaaattctcttacaattggaaatcgcttcatggaagtagtactacctcaagttatggatcaccctgtcatcctatgttcaacctcagcaaacacagtactaatccgaagccacctccaccattaaagaactccgcacggatgagtaatttcagttatcaattggttagaagtgctgaaagtccaaagaatgcaaaatattccctatcagagaaaatgtcacacttactaaaaccacctaatagtagcagtcatcagaatggaaacttcactgttggtgctttaaagaggcgtcataatattgcacattttggaggagcaatcaacaagcttttgaaaaatgaggttcataagaaggccaccccatcagagggaagacattggcagactttattggataactcattaatccgacagaataaattgtactgttcagagccacgcaatgaagaatcaactgaacaatcatggagctctacagacagtgagtctgagaaggctgtgtgcttttcctccagtggcagcattgctgatttgcatgcatcggtttcaactgacaccagtgactcaagtgaccactctatgtcatcttcgtgcctatcagtaaatgatcgatggaagatgacttttaagaaggtaaatattggaaaatgttcttttagaagaactcttcaattgtgataacattcttgacaggaaaagtttagctagtattagtatttgtcttctctattcaaatagccatatttatttagcttttattattgctttccttcaaatctgctagttatgttgagcttctcaaatgttatgtgtcaggtacactgtgcccttgctgcaaatttagactctatgtatgtcactaaccacaaggagctagagcagccaagtccagtatctgttcttgaaattccagatgaggatttctctgtcactaaaagcatcaagctaggtacagaagatcctcttgatctgatactgttcacttcctatgttacactttccttttattgtagttaactttattttctacctctgtattgcagatctccatccagaaagtgaacttgttagatgtccatctgttgagagtacagctgaggtaggagaaattggaatcagtgattatgctttgggggtggatggactaaatgctagtctgaacggtgaagcaatacagcttgttgaagatatctttgaagaatttggagatgaaaagaaagataatttcttac

SEQ ID NO: 84560 - DNA, 792 bp, Oryza sativa
cgacggaggcaagccggcgaatgaagtcgtagacggcccaacagcggcggcataataggccagccgtgtaggcggaggcaccaatcggcggcgacggaggcaggccggcggtgaagtcgtagacgcccaacagcggcggcataatagaccagccgtgtaggcggaggcaccactcggcggcgacggaggcaagccgacggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccactcggcggcgacggaggcaagccgacggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcttaataggccagccatgcagacggaagcaccagtcggcaagagtagtgccgcggcgttacatgcaaacagcagaaaataccaagagagattaatctgacatttagagatcatctaata

SEQ ID NO: 84561 - DNA, 652 bp, Oryza sativa
atttaaattgtcatggcaacccactatttcttttcgattataagtttcatgttctctttaagacagtcagcaacaggctcatatttaagttaatctgttgagttaacttgaggaaaccattttccaataatacatagctaatacaacaacgtttgccttctttacatgcagtgactgaaatacatggtcgcacttttggggtctggacacttttgacctgtactctgtgctttctgtgtgcattcaacctggaaaacagacctctctatctggccactttcctgtccttcatctatgctcttggtcatttcctcaccgagtacctgatataccatactatggctgtggcaaatctgagcactgttggcttcttcgcaggtaatgaatttagttttgactgtgttgtttgctcagttcagccttctacttagttatcatgcaactataatgtcaactgatgatatcagctcaaacattcaatagtcaataataacagtcaaacaccatgcttgtacatacaccaaataggttgatgtctctggtgcttaagtagtggaagatttgttcagtacagctagcggtttcttgtgcatgcttactctttaaaatcacttagcattcacctttataacagttatcttgccatctcttc

SEQ ID NO: 84562 - DNA, 1035 bp, Oryza sativa
gtcggtcacctcctggtggtcgtccaccgtgatctgcaccgtcctggcgtccttgcccaggtccgccctcagcttgcgcgctcgccgggcgcaggcgtggctcaggtaagcctccacggcgaggaagaagtcgctgcggcggaagcgctggtggccgtactcggagatggtgacgtggaggtaggggctgaggtagaaggtgagcttgtccaccatggtgctcagccactgccggagccccgcggggacgtggttgttgacgacgggccagaagaggaggacgctcaccaacgccgaccacaacgtcgacaccgatcccagattctccatcatgcccatggccatttggcgccgccgccaccgctataaaaagagatgggcaagtgttggaaaccagtgcctgcagctcctgtaggtgatggccagtatatatagagagtgcgctggtattaaaacattttctatagacaacttaatatatggtatttcctccgtattttaatgtataacaccgttgacttttcgactaacgtttgaccattcgttttattaaaaaattttatgcaaatatgaaaatatttatgtcatgcttaaagaacatttaatgacaaatcaagtcatagtaaaataaatgataattacataatttttttttgaataagatgaatgatcaaacgtttgataaaaagtcaacggtgttatatattaaaatatagaagtagtagtatactacaaatctataacccgtttttctcctctcttcttcacataactataaatattatatttgacaaacttatacagtccgcttattatagcctattaagtttttgatgaatattcttagtaatttcgctgcttggttgtgtcgttggtgaggagtacgtgacatatcgatggacggagatcgaatttgcagttggtcgtaaatcatcaagcgttatctgcagagaccatcatatcgaccgtcaataaaaactacaagtggcaaggaggatggattctaatctctcgggtgaacgtccaccctgagtg

SEQ ID NO: 84563 - DNA, 730 bp, Oryza sativa
ttttccaataataacatagctaatacaacaacgtttgccttctttacatgcagtgactgaaatacatggtcgcacttttggggtctggacacttttgacctgtactctgtgctttctgtgtgcattcaacctggaaaacagacctctctatctggccactttcctgtccttcatctatgctcttggtcatttcctcaccgagtacctgatataccatactatggctgtggcaaatctgagcactgttggcttcttcgcaggtaatgaatttagttttgactgtgttgtttgctcagttcagccttctacttagttatcatgcaactataatgtcaactgatgatatcagctcaaacattcaatagtcaataataacagtcaaacaccatgcttgtacatacaccaaataggttgatgtctctggtgcttaagtagtggaagatttgttcagtacagctagcggtttcttgtgcatgcttactctttaaaatcacttagcattcacctttataacagttatcttgccatctcttcagttttatcttgtaatactcaaatgacatgcttgaagctcattggactacataaggaggttgaaaattatttcgtttcatgcaccaagtagttcgcctatatgatttatcatgttactcctgctgagctaagctgatctgtggagcaacagaaaaaaaaaacaattatgatttatgttacttcggttagaaataga

SEQ ID NO: 84564 - DNA, 635 bp, Oryza sativa
cgcggtggtgttttatctagaccagtggatcccccattcttgacctaacccttggaaaagctctacttttacaagagcagccaacttcaccatcagatggaagttccagatgttttgatcgtagttcacttgaaaggatttctcccagggactctctttctcttgccagcacaagtgcacgtatagatgaattggatgattgtgtcgagggattgtcattgcttcatctagcatgccgtgttgcagatgtgggtatggtcgaacttctcttgcaatatggtgccaacgtaaattctgcagactctagaggtcgaacgcctcttcatcacagcatcttgaaaggacgacatatgtttgcaaagttgttgctatccaggtatgcaaaaatcaacaatactatgtaatttggattttgttgtatgcttaggttttgaaagttatcattctgggtttaatattgatgtaaagggaatgtgtcaatattatcaaattaggaattgtacctggagagatgatcagtggtagttggttcctacaatgtggttcttggtaagcataggaccttaggcctttgggtacagtacccatgcttgcttcctgaagcagatttgaacacatatttccataaacaagca

SEQ ID NO: 84565 - DNA, 691 bp, Oryza sativa
attgcttttagtcagcctcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagccgtttttgctcacggatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaaggcgtggcaagccaacgttaagctgttgagtcgttttaagtgtaattcgggcagaattggtaaagagagtcgtgtaaaatatcgagttcccacattttattgtctgattattgatttt

SEQ ID NO: 84566 - DNA, 2151 bp, Oryza sativa
cacttcacacttccagattaaatcccacatcttcctggacttgtcatctgacgagctggagctttcatccatattggccagagacattgccaatttataagcacttctgacagagaaacgtcccatcttgtccggatgccaagctaaaaaatcctcatcctgcctcattgaagtccgaatcctcagtatttcttcagcaccacagggaaggaaaacccgattatctttctgaacgtcccacacaccgtcaagtcccaagagctcggacacccatttcatcctgcaattacctttccttgttattggccgtcgagaatggtcccttggaatccagggatcacgccatatgcaaactgactgaccatttccaactctccatatacaacccttcttaatcaattccaaaccgtattcgattgctctccagccaggtgaagcattcccactaaagcaagtatcaactagagttccatttggaaagtactttgctttcagcactctcgcacacaaactatccgggttcacaataaggcgccaggcttgtctagctagcagtgcttgattgaacaatttaaaatccttgaatcccaagcctccatactgtttggccttcgtcaaatacttccatgccctccaatgtgttttcctttttccctgttccgcaccccatcagaaattccgagccaacttgtttaaatcttcacaagtcgagtccggtaacttgaagatactcataacatacactgggatagcttgtatgactgcttttagcatgatttctttgcctcaactagagagatagttttctccccacataattattctcttccaaatcttctcctgaagactttggaacttgcctttgttcattctcccctccggggttggaaaacccaaatatttatcttcaaaaccattgccgacgatttggagtgtacttctgatttcaacttggacactagcgggagtaatatcatcaatcagcatggagcactttgctggattaataaactggctagttcctacagcatagtcgtcaaggacttctcggatcacattagcctggccattatcagccttgaaaaagagtagagtatcatccacaaacagaaggtgggagattccaggcgcccgccgacaaacttgcaccggggtgattgccccttgaagtaccttttcatccagcaggagtgatagcccatcagcaacaaaaagaaacaagaacggagaaagcggatcaccctggtgaaggccgcgagaaggagcaaatgtactcagtaaggttccattgagtttgactgaatatctcatcgaggtcaagcacgtcattatccaactgacccaccgatgagtgaaacctaacttatacattgcttgctccaaaaacgaccagtcaacccgatcatacgctttagagagatcaagcttgtaggcacaagcagcttttccagggctcttgttcctttggatggaatgaaagcattcaaaagctaatagggcattgtctgtaatcatccttcctggcacgaaagcactttgattctgagaaatcaaatcatccaggataggcctaagcctatttactaagcatttggagacaatcttgtaaatcacgttacataggcttataggcctgaactctttcaactccattggttgattaaccttcggaataagcacaattgcagtcgcattgataccatctggcatgatcccagtgtggaagaattccttgacagccctaaccacatcactcttgatcaggccccaatttcgttggtagaagcgagccggaaaaccatctggcccaggcgccttaagtggaccaatctgaaacaaagcatctgcgatttcttcatcagagaaattcctgcagagggaatcattcatttcggcagttactttctactggaacagccttgtgactctagaatgatcaacagtagggtctgctgtgaacatatccttgaaataatccgtggaaagattctcaaggtcttttgtcgcactataaacagtgccatccgggcctcttaacttggagattttatttttcttcgctctccatcttgctctgttatgaaaaaagcgagtattccaatcaccctctttcagccagctaattcgcaagcgttgtaaccaaagcatctc

SEQ ID NO: 84567 - DNA, 604 bp, Oryza sativa
gaagagctcgtcgatcggccatgatctcgagacggtccacggttccaacatcgtcgggggcctcgggaagccggaggcgtcatgacggcctctacgggacgcaggacgctcgaatcaacatcgagcgacgccgagacgagcgccgagctgcccgtatgggggaaggcgcctcctcatctggagcgccatgctcttcttcacgaggcggccctcctcccacactcacccctgggaggacgggttgtagggcctttgtggcgagtctccggaatgtccggtggcccccgaagtttcgccccaaccttacggagaagtatgatggtagcatcaatccctccgagttcctccagatctacaccacggttatcgtggcggcagggggtgacgaccgggtcatggcgaattacattcccatggcactcaagggtcaggcgcgtcgctggttgatgacccagccccccggctccattcactcctgggaggatctgtgccagcagttcattacgaacttccagggcacatatccctgcccgggggaagaggcggacctacacgctgtacggcgggaggatgatgagtccctccgctcatacgggctgcagga

SEQ ID NO: 84568 - DNA, 601 bp, Oryza sativa
ttttagaaaatataaaaaaatcctccaagcctcatttgactttcatctttgcacattttaattgttggaggctttcacattgaattttaattattcttttgcacaatttcgaggatagattttagagtcgatttgggacgcgacaaacctaccccccttaaacggaatctcgaccccgagattcggaagaactgggaagagatcaggatgggctgccttcagctcgtcttcgcgctcccaagtagcttcttcttcggcgtggttgctccactggaccttgcaaaaacggattactcggttcctggtcctgcgctccatggtgtccaggattttcactggcctctccacataggtcaggtcttcgcggacttcaatttgctctgagttggcctgctcggatggcactcggagacatttcttgagttgcgacacatggaacacatcatgcacgttgcccaaggaggcgggcaactccagctggtaagcaacttctccgcgtcgagcgatgatacggaagggacccacataccgaggtgcgagcttccctttcgtctgaaacctgtgcacgcctcgcaatggcgtgacccgaagggggtgcagg

SEQ ID NO: 84569 - DNA, 761 bp, Oryza sativa
cgactccaaccatctcaaacttcttaatttgtatcactgctatgctattgccattcttcttcttctttagctttggataataaatactcctactatgcaataacaaatactactagcagagtctatcttgttaagccgtgagataattaatccccaaatgggacacttgccaacacatttggctaccaaattggatataattaaaaatgtttatattttggagcaaagagagtagtacaatctaaaagggagtcacaaaaggattggtttctttggaatatttttcatgtggctttgtttgtaacaaaagagattgcatctaaagttctcaaggaaagttgagaatttttgtacttcaatggaaataaacagtgagattatccagaacagagattttcttctatttgattgatttgattgttgtctcccttttctctattcttaagtttcctgttacttttccaaacagagacaccatatataaaaaaaaattaagctgaagttttactaaattttagtgataacaaaaagagaaaaaaaagtctttatgcagagaaaaaggagaacaacctaacaagttcttatctgtaaagttctctcttgaaagttgctatttatgttatgtataaggtgaagaaaatattattttaatctttttaatccttttttctgcaatttttttgctttccttttttttgcgcttttttattacttttttaatcttcacgcatgtttttcaaatgttttgtattgaaagtttt

SEQ ID NO: 84570 - DNA, 502 bp, Oryza sativa
accctcggctacacccaggagcagctcaacaccgtcgggttctgcaaggacgtcggcgccaacatcggcatccacgccggcctcatcgccgaggtcacgccgccatggttcgtcctcgccatcggcgccgcatgaatctcgggggacctcatgctctacctctccgtcaccggccgcgtcggcgccaggaccccgctctggctcgtctgcctctacatcgccgtcggcgccaactcgcaggccttcgccaacaccggcgcgctcgtcacctgcgtcaagaacttccccgagagccgcggcgtcatgctcggcttgctcaaggggttcgtcggcctcagcggcgccatcttcacgcagctctacctctccttctacggcggcggcggcagcaacaccaagccgctcatcctgctcgtcggctggctcccggccgccatctccgtcgcttcctcggcaccatccggatcatacgcgcaccgcgctcgccgaccgcggcgcgccg

SEQ ID NO: 84571 - DNA, 1343 bp, Oryza sativa
tacccaaagtaatgatgacaatatgagtatgttaaatttccaaatgctgaaatacaagttgtctgataaaactaaaagttctgaaactaatgagtttgtaacattgttgtcgaaactagcttttctagccatcacttgtttgattttgtcgtggtttgctccagccattcaacataacagagttgattgttcctcctgtacaaatgtatggacatatagttacaagtcgtatttaaagtaaagaaagtcaccatgtaaaatgcagagctattttatctagttttctgctagcatgtatagttaccaaaacttcataatttcttcaaataaaggacattgccagagtctgcagtgcaactaattttagtatctaacatgattaaattgagttagaagtcatatgccataactatcatgccactgtatggacatgtgtgttctttggattgatggaaacataaacaaatgtgattaggctcactatatctgacattttttaagccatgcccctgttatttactgacttgtgagacccactgaaatatatatgctttgttacatatgtggtggctatatatagtactgtgttgctaatcatttatatggcatgcatgcttatcttagttagctcagataaacaaaacaaaggcctatggggcagtaacagaagcttatatgccccatatactaataaactaaacaggcaactgtttttgtcagcaaaggggacgtgccaaatactaatacaatccaatgagttaagtagcaaaagtaccagatcatacctggatgctacaccaaaccccgagctgatttagatatttctttcattcattcttccattttctcctctggcctgttacaggatttggccatacacaataagaaattattttttttacaaacagaccatgagcaggaaaacatattgtaaaattttttgcaaaagatcatttcaacatagcagcttgctgaagatttgtaattacctgatcagttcgggaccgtacaaaatttctagcaacattcctaagatgttgtgaagaaatattttgccgggtagtacttgttgttccttgcaaattagcgctgttaaaaagtgctttcacaactgtgttgttctgaatgcttcgagccttctttgttgtgtcatgtggttctctattctcagttggacaatctattgccagatcagacttcacaccataaaacaagaaatatatatattatgattccacatttgacatatataagatatcaaatattggtgaatgtgaacattttggcaatcattacctgttgttccgatgctacgctttgcgtagtaatcattttgagaatat

SEQ ID NO: 84572 - DNA, 647 bp, Oryza sativa
gacccagaagtacaggcaactgggcttttcatacttgttaccaaggttgacgatatgactggagaagacatagcagcatcccctgttttgggtaccttcgaaaatgggaaggtatatgttgcttcagaggcatacgaagatgaaatcactgacttctcgaaaacccaagtacagggtacagatccttcccctataatagctggtgaacagttggtaacaggtatctccaagccaccgtgaataatcggtgacaccatatttgtgttggtgacagctgattcaggtgatccagtagacaaactcagctgaagatccaatttatgagagtttgtcaatggtgaattctcagcaccaacaggggatttcttttgacaatgtaccatatcattgccaaggcaaagctcaaaattcaggccaagatcagctgatgactcctcatcagcctctttcaatgaagatggagacattgcataagctgtggcagaactaactttgctattgtcagatgaacttggtgagtgccctaaacccaaagtaagtaatgggtttccagtaccttctggtcctgccatagcacttcgcttcctttttagtgtttttgagcttgcaatagaaaaactggaatacgttgaatagtcaattgtagt

SEQ ID NO: 84573 - DNA, 1532 bp, Oryza sativa
agtctacttcccctccatcttccttttcttttccaaaagggtttaattaaatcctttttcctttagaccaaaaatctaataatcttagaaattcaatatcttcccaaccgtaagtccgtttgactctgttcaacttccaaaattcctcgaatctcgagatctatctaatggcacgctgagaggtcattaatagggccttattttcgccgtttgttgagttgtcccgtttcgcgtgtagtttcggagcccgaagacccgcagtgcgaggatttcgaggatcaagctcaagatctcgagcaaggcaagccacctttgaacatcttgagcctataattgaacttaattatgttgcttgaaaaatattatgcattgataggatcacacttaatctgctgtcccgtctgcaaggcagattggcggacctacctattttgttgcattgatccttcctctgttaattgctatatcatgttcccttgtaaccacatagtcgtgcctcggtaatcgtgcactctgcacgagtatcgacggtcgccttcaaacttaaaatctgaaaaacatattgggtaaaacttgggttttacaaaagacttggaaaacccgacacctgggtcggtgcttgcgaactaaatgaatttccaaaaccgcggaccggggaacgtaccgggtgtacggtttcccgctcttgcacttaaggatcgtttccttggaatttcatccgaacataagacaagtacgaccacatgggtggaatgggacacccctggctgagtaactagcttatcaggggagccttgatgccgagagacatgtggattcaccggggtggtgtcggggaggacccccgggcttcctggcacagtatggtctgggacctaacctgttgttggtctgggacccctctcgtcggcatatggtaaacctgtgtcggctttcgaaaatgccttgtcatgaaagcttggaggtctcccgacgtggctgatccccacgggctgggtgatccaggttagtaatgtcgtgtgggtaaagtgtacccccctctgcagaggttaacaaactattcgaatagccgtacccacggtcatgggcggatgtgaggtgattcctagcgtagttttgttttactactgcttgtgaaattgctgttgtggaaaggggatcgatgtttggaaaatctgcagctgatgggatcagctaggctcgggtggccgtttgaaagttgtaggcccgggtggccgtttgaaagttgttggccgggtgccaatcttgaacaattcaaaagactgatacattgcacatactccgaccggacgagacgcactgtctcatccgtgtcgtttgagaagcactcacttagttgatttcagaaaagagttcaaataaaatcaattgcaaaaacaacagcctttccttgaagcctgcattaaacacttatttctcatggcttgctgagtactcccgtactcacccttgctctatataaataatcccccccagttgctggagaagatgaagcggatcccgctgacgag

SEQ ID NO: 84574 - DNA, 654 bp, Oryza sativa
gtcatcctccctccgccctgtcgccgatttggccgctagccggagcgccagctcgctggcttgaccgtccaaagtcggttcccctctcccaaaccgacattgccatcctataaagcccaggcgccctccctctcttctcctctcgttgtcccatcgcctccactccattgtcgccgcctcccgtgctctgttcgccgtcaccgtttgtcgtcgcgcgtgtcggaggagccgacacgagcgaggacgcggaaggggactccgggcgcgccctcttcttcctcttccttggcccgaggccgaaacgatcacgtttcgcgccgtcggctctcgtcactgcgcccgcccgcacggtagtgcatccctccgttctccctcctcgttccatctcctccccttagactcgggtagtagcacgagtagcctcttcgtagctagccagcgccgccccgacctttgccgtcgctcgccgtgtgctcgccgctgtcgccgcccgagctcggaaacgcctctcgtcgccggccttcctcgatgcgtttcctcctaatccggcgcaagggacggattcccgtagccgcgtagatgctctcgccgccgggaatcggcccctcgtgacctcgtcgccgttttccccttttctctccgctggtggccgcc

SEQ ID NO: 84575 - DNA, 531 bp, Oryza sativa
acagcagaacgcccttgcatggcttcaagagaccacctttgaagaaatcaggtcgttgaagaggaagcatgacaagctcgtgaaggcattctttgatatcagccagtgctccaatgtcatcaaatgtcactcctatttcattggctggtataaccgttggtcggatcttcttttcatactcattgtctggaacgacctgtaagttaagaatagcaaaattttaaacatgtaattaaactaggaaaattacttaattataacttattgtagttgaaacaatgtattaccatctctgtctcatcctttgcttccactgtatctttcccaaggtcgttgctctcttggaatatgcgtaatccatgggataagctgtgaaagtgccatgttagcaaaagcgagataaagcaacaatggaccacctcaaactcaaagtaaatttagctaacctctccgaagatatgacaagattcccgtttctgtatttagggttcttgttattcatcagatggtaagagacagatggggttataa

SEQ ID NO: 84576 - DNA, 606 bp, Oryza sativa
ccatgagccttgcagaaatcggtgctcccctgcgcactcttcgcgcagccctcaaacttgcacctcttgccacctccatggcgcacgcagtactctgtacgccctctagcactcttggtgcaaccagaaatagcacacctcttcccaccaccatgagcaacacagtattgagttccgccatgcacgctcttcgggcacacaccaccaccctgaaataagcatcgcttgcctccaccgtggcccttgcaaaagagagtgctgccttcagctcctttgttgcaacccgagaatgtgcatcgctttcctccaccatgcgccttgcagaactttgtgcttccctgtgcacccttcgtgcattctggaaattggcaacgcctcccacccccatgagagatgcagaagcctgaatgaccttcggcgctcctgatacagttctccttctgacatcttttgccacctccatgcctgatgcacaagccagatttgccacgtgcagcccgggaacaaccatcatgactgcagcggcgaccaccaccatgagctatacagtggtctgtgcgcccttcggcactctttgtgcatccaagaaattggcatctccttcct

SEQ ID NO: 84577 - DNA, 584 bp, Oryza sativa
tgcctgcaggtcgactctagaggatcccctacctcacgcggcgtactcgttgtcgatgatccatagtcttcgagcaggtgcaagactgatggttcgtggggatctatgtcgattaccccaacgaatcgatctgaaatcagcgtcgctccttgttccttgtgttcatccctgatggggatgcgtgactgctggaccttagaaggtggcgtcttcatggcgctgagaaagaccttgcagctcgagaggttgtgattctttgtcttgtgaattggacaatagacatcacgagttggagaggtacgctgaattccacgctctttgcaggcacgaatttcagcatggacgttgagaaagacccaacaggcttgcagggtgtgtttcctggttttgtggataggacaccaggaccttgtcacctcggaagtaatcctcgtcggctcgtgattcctgtcggaaagacaaggcttggccgcactaggatccttctcgggctcggatgttgtcgacgttcctatctccgcttcggcgggaggatccttcgacatggagtcgcctgggttgtagccactgcattctcgtttccg

SEQ ID NO: 84578 - DNA, 587 bp, Oryza sativa
ttctcgatgaggagccccttctgcaagctgtagctgcctagctccacctccgacctcaccgtcaccgccttgccgcgcaccgtcgcgtagaagcggacgtacgtcgcctgcccctccgcgagcaccatctccggccgctcgtcgtcgtcgacgtacacggcgccctcggcctccgcctcggtggcgccgaacgggaacgcgaccaccagcgtgaacggcgtcgcgcgggcctccttggagatcgtcccgccgcgctgcatcgggaggatcgtgttctggaacacgtgcacgttgatctcgttgagcggcgcgtccagcttcacggcgccctcgcccctggacaccaccaccttggtcgtgtcgaacaggttgtaccagctccccggcgggaacatggcgctcaccgaggtggcgccctgctcgagcaccggcgacaccatgacgctcgcgccgagcaggtactgcgtgctcagcccgtagcacggcgtgaagtccgggaacgagaagaacaccggccgcgccaccggagcgccggtgagatgcgcctggtagttgagcgtgtacaggtaagggagcacgctgtaccg

SEQ ID NO: 84579 - DNA, 704 bp, Oryza sativa
tgtacccattacagatgcaaatactattatgccctgaaaataacaggttattcagttagctccaatagttgtcatgaagcaataagaagcaggtaatctgaaatctgaaaactctggaattttgtctagatcattttagtatctctagcataaagcacagcttaagttcggagtaatgcaaaactgataaaagagaacagattttaattaaccgagtcattaccactggctgcattcgtctcttcccaattggatagctatacttgttgggctttttcatagcatgtgcagtaaaccagagtatgaaacctgacaaaagatccagtagggagtccagtgtcgatgctattactgccatcgataaactttcaactgatgcaagaactttcccaatgaaaagaatcagattgatgatattcgacaggttgatggccaatcgttcgccctttgccatttgcctcaactcttcctaacaaaacaacatgaagatatacttcatatcactatgtgtatagaagacaaaaaaaaaaagaaatatacagcatccaatttatagttacaaatctggcaattgcatattgcattgaggaaatgtgttctcttaacaagattttacctcagtaggagcattctgatctaaggaaccaatctcattcatggtttccatctcgctgaaatccttcaggagattttcctgcttcttg

SEQ ID NO: 84580 - DNA, 657 bp, Oryza sativa
cgtccagatctggagggttcttggtgggtttttgtggggtttttgattgatgggtttgtttctcgtctgtgattttgcagggacgggttcggggtcaagtattccgggttcctccacataaggccgtgtggtttctgtcgaggagatgacggattcgatcgattcgtgttcgtctccgtcaaatttttgcacaagagaaaaaaaaagtttcccccttttagagtttttccccttcagttttgtcagttttggtgaggaattttagagttcttttccggcaagagttagaagaagagagaaatggccccttccaagcagcagcagatgctcctcaagaaggtgatggcgaagaagcccaagacgaagaggctatccgggtttggccttaaaccctctgctgctttctccaggccccatgtgccgtcggcggcggcctccctgcagccaagccgtcgcgtccgcgtcgtgttcgaggaccctgacgcgacggactccgactctgacgacgacgaggacgccggcgccgcctcaaagaagcgctactttgagctcttcattggcaagccagcttcgtcgacgaagcaggcctctccggcgtccaccgtcgctgcctacgccaacatcggcaaggttgggagcacctgctaccgtggtgtg

SEQ ID NO: 84581 - DNA, 693 bp, Oryza sativa
ctattaaacatagtggattataggttacatttagatatttttctataattaagtcttttttgtctattcagttaaccgagaagactaaccgaattgatgaccgaatcttttagtcttagtctattcggttccgtctttttctaacccctgcaaattgtgtcctcgaaccgattctgagttgcgatgtcgacgtcaagtacgtactcctcgtcctcgtgctaatcgagtcggcaggcgaaggttatctcaagtctggaaggttatctcactgcaaattgctgtggccgctctgctccttgtccgtgctccgcgccggacgacacccgaaagcgacgcgcggctcccgtcacgtcaggtcacgtcccccccactcgtgagccgcgcggcgccaaatcacgccacgccgcgccgaggcccgatgaggagtcggccgccatgcagctgcagccgcgccgcgcgcgggcagagcacaagttgccgaacggcacaccacgcgacgccgaaccagccaaccaaccggaccccaaaacacagagcgggcgccgcgccgttgtcaggtcaggccagttgcattgcagccgcagcgcgcggtcgcggtccgcaaaactccgcaccgcacctttcgtgccgctcgaggcgctgacccgcgactgacgacgacacacgaccccattgccgcgcgacgaaacccac

SEQ ID NO: 84582 - DNA, 5866 bp, Oryza sativa
ttgaccgaatgtcggaaagggttctcagacacgaatgaaaaaactaatttcataactcgcctggaaaccacgagacgaatcttttcagcctaattaagccgtcattagcacatgtgggttactgtagcacctatggttaataatggactaattggactcaaaagattcgtctcgggatttccatgcaaactgtgcaattagtttttgtttttatctatatttaatgctctatgcatgtacccaaagattctatgtgacgtttttggaaaaaaaaaattgagaactaaacccggccttagatccaagggtgaaaatttttgccgtgtcacatcagatatacagacacacatttgaagtactccctccgtcccataatataagggattttgagtttttgcttgcactgtttgaccactcatcttattaaaaaattttgtgcaaatataaaaaaaataaaaagttgtgcttaaagtactttggataataaagtaagtaacaaaaaaataaataataattccaaattttgttaattagacgagtggttaaacagtgcaaacaaaaaactcaaaattccttatattatgggacggatggagtattaaacatagtctaataataaaacaaattacagattctgcctgtaaactgcgagacgaatttattaagaccttagttcccaaacaaaaacttttcaccatgtcacatcgaatgttcggacacatgcatagagtataaattatagaaaaaaactgattacacagattgcgtgtaaattgcaagacgaatcttttaagcctaattgtgccatgatttaacaatgtggtgctaagtaaacatttgctaatgacggattaattaggcttaataaattcgtctcgtagtttacaggcggaatctgtaatttgttttgttattatactacgtttaatacttcaaatgtgtgtccgtatatccgatgttacacgcaaaaacttttctcccctcgaactaaacagggcctaagtatttgggaacaaaatttctgaatttgtaatatccttttccgggcgatattatgtggacccagaaatttggaaaagtatttcgatttagtgaaattggttgatattcagtcaatataggttcaaatttctagtttttcttttgttagtcgaagtcaagagtactgaggtgttcctgctacttgcaatcttaacccgcgacagattctctgagaatcagcactaccctgatcatgagatttataaatcaaattcacaggttgacctgctgaaaaataagcttggattcgatgacgctttcaactataaggatgagcctgacatgaaatcagcactgaagaggtcattattctgatcttaccaccgtatgatcttaaaaaattcttcctccattttaaattacttgtcgctttatgtttatagtaagttaactgtatctatttttatcattaatttttagtcatccatatagtttaacaacatgagaattactaatccgtccaaaaaagacaaaccctaactatgaatctagtcacacatgtatccaagttcgtagctaggaattggtttttttgaatgaaggggtatatattatgaaagtatttatcatgatgaattcagaaatatagatatcgtgatatcaaacaatattagtttatataaattaatggtcaaatattagaatattgtaaatttaaaatgatgagtaatttaaaacggtgagtagtaaaatgacaaatcctgccgggtaacgttcttgacagatactttcccgacggtattgacatctactttgacaatgtcggtggcgagacactagaggcggcgctggcgaacatgaacacctacggccgcgtcgccctttgcggcgtcatctccgagtacaccgacgccggccaccgcgccgtgccggacctgctggaggtgatctacaagcgcatcaccatcagaggcttcttcgcctgggatttcctgacgaggttcgccgagttcaccggcgtcatcagtgactggatccgtcagggaaaggtccaggtgatcgaggacatctccgacggcctggagagcgtgccgtcggctttcgcggcgctgttcagcggcgacaacatcggcaagaagatggttaagctggcataggagtacacagccatggccggagaaaagctaatgggcatgtcagtgattcagagtcaaataaaatttaggtgagacttcagaaatttaccgacagtgaaacaaagttgttttcttcaactattgagcatgtcagtgactcggagtcgaataaatttaggtgatttcaggaattactgacagtgaaacaaagttgttttctgaggtagcatagccgcctctgtgactggattgaactcactggtcacaacactctgcaacactgttaactagtagtaccaatcaggtatctgagtgtcggaccaaatcagaaaaaagaacacatggagaaaaaggcaggcagcaggccttgattatcactctgcattctacaatccacctttccagcagtttgatactagtcaagtacacaagtcaagtctaagaaatgaaacccattttggcgttttgaacttcaaaaaaaaaaaaaaacaatgaaagcaccaggctctctgaacatcccaactgcatctactcatttaaaaattgcacataaaacaaaatatatatagtatgcatacccaccagaggggcaagaaaagggagcaagtaattcgctatgctcagcaatgggaaaagggagaagaaatcaaagaatacatgtatgtaatcaaaatgtgccagtttgcccagaagaatccaagttaatacaacgaaatctcaagcgctgcaggttggcaaattgatctggtcagtgctgtgattttctgaacgaataatggaccatcttggacaacccgcagcgcagagagatcaagaagagattattaatggttgggggctgatataatcctctaacataacctaatgagctattagtgctgtataatctccgtgtgctacggccgtggtctcctgtacggtgattcaactcaagtggtttgtgtaaaaagatcacctatctgaccattccatccatgtggaattgatgctatgtgctgctgcttcttcagctagtagatgactagctaatggcgcaacatcctcgaattttgatagtgtaacctaccccagaatcatattactgcaagtttcacaagcaatgcttgtcatcaaagccttcctgggtgagcaagcctgtgacaagtttctttagcctgtctgcaccaggccctgggcggagatcttgtacacgctcaacagtgaacgatcctttcactgttgtcgtgttcaacagatccatccacccacctgccacgaacccgtcaggttggcggcccaataattcctggtcgatcttgtctagtacaggatcttctcttccaaactttcttgcaaagggagcattgctgttaaccataccgtcaaagtcattgagggtgaggtagtgagggtgttgctttggtgggttgtcccaagaaatgaaatgtagatcatgattcacagtggtgttgcggaactctgggacattgcaaatgactgtgtggaagtaaccctctggtgaagaaagaaaattggcataatacatcaggaccgtcctgggaagattgtcccaaccccatatgcagtattcaataaattgatgagtaagcatcatccacgccgagcctagaacatgatacatataaagcatgtattagcattctgtgagtgcaaagtggatgaaaatttaacaaatatgaactccatgcaagataatgaaatttgcaaaataatgaccaaattatacagtcaacataactgttatgcacaattgattggccataggttcataaccagaaagggaaagaagtagcatggtcagtaatacaatgtcccgatactaaagattggccatagttttgtggtcagaacagcttggttcaaggtttcagcaagcaactggaaaaccatagttttgtggtcagaagtaacagtttggttcaaggtagcaagcaactggataaccatagtttgtggtcagaagtaacagtttggttcaagatttcaacaagcaactggactttgactgtccaacaaaagaaaaaaggttaggatcacatgatgttttcagaaatacctagtaagattagcagctgctttgtcacatacaacaaaacgtaaccaatatgagatgggcaagcatatattatagtataggtaaacattatcttagtctatgacctgtgaaatgaggctagcgcactacagttaagaaattggagtgatactatataagacaaaaacatcggtttcaccaatgcaagacaatctgtccaaagtgattttcttggttctggaaagtaaatttggtgctgaatgctgatacaaagcagcaagcaagacgtcattgtactggagagctgcaatgacgctattgagcaccatctcgactgttactaactaccttgctgcgagtgcatgctatcaatagatgccaaaccatagtcccacaccaattgatatcttccaactcgattctttagcacatggtaagttgatagaagagagttgacatcaggactcatggtcgaccaaaataaaaacaagaaataacaccaagaggtcagccggaaaaaaaatatttttccatgtctctagcacggttacatgcaagtaaaacttgattgcaggatgaacaattactcactaataaacatagcatgagacaacgaatgcacggagtaattaatttgcaactgaaatggcaaacgctcaaggtggtgcagataaccaaaaaaaacaagaagagaaagctcatgcagaagcatcaggttagaggaagcatttaccagtgaagagcttgaatgcggttggaacacttcttttctctgtaatccagaaaacatcagatttctgcaggctgtatagcccagggtcaattatcaccggctttgccctctgatacctacagagaaaattttagccacaagcagcttgcatgaacaaaacaaacaatactttcagcgaaattccaatgcttactccttccatccgatgtcactggtatgctcaataaagttaagttgccttggcaagtcagatagaacatacaacagatctgcaaagcacacaagagaagtaagattaacatctatacatgttaattctaacaaacatgtttactgaatttactcaagcctaatccaaacaggccaagaccaatgatctccacgagtaagacaaatcatgaaaaagaaagtagttgtagatcgaaatagaaatataaagcaagatcagagcccaggggagcagagaagtggaagcctccatataaagaaagaacagccaaagattttgcctaccccagataccacctagaaggggcaaaatcaatcgaatcttaccaaattcctagaccagttgggtaaacatgtcataaattaacaaaaaaaatatcactgcataccccaactggcaactgcaaacgtataaaaatcacctctttcccctccaacccttccacccaactaccagtcacaatttgaaatttccaatcccaatccccaatatgctctccagtgagccaaacttagaatcgaatgagcccaattcgatacgaaagcgcaaagatcgcgttcatttttttggatcggagctcgcgtatttgcgcgatccaatcgggggcgattggattgaggcggggtaggagatcgcatcttgggggcgcttaccgtcctgcgtgacgagggggtagtcggaggcggagaggttgatgaaccagtcccactcgccgccctcgcggaggaggatgaacggcggcgtgggggtgc

SEQ ID NO: 84583 - DNA, 651 bp, Oryza sativa
cacgctccgcctccgcgaggacgcgctcactgagcgggagcgagctctcgagggggccgaggccgcggcgcaacagctggcggtcagcctgtccctccgcgaggcagcgcaggaggagcaggcgcgccgcaatctggaaggtgcccgcgccgagagggccgtactgaaccaacgggccgctgagcttgaggcgcgggcgaaggagctggacgcgagggcgcgcagcggcggggcggccacgggcgaaagcgacttagccgcccgcctcgcagctgccgaacgcaccatcgccgatctgcagggcgcgctggactcgtccgccggggaggtcgaagccctccgcttggcaggcgaggtagggcccggcatgctttgggacgccgtctcccgcctagatcgcgccggtcggcaagtgggcctctggagagggcggaccgtaaagtatgccgccaaccagggaggcctcgcccagcgcctctcgaagatggccggggctctccaacggctccccgaggagctcgagaagacaattaagtcatcctcgagggacctcgcccaaggagcggtggagctcgtcctggcgagttaccaggccagggaccccaatttctctccatggatggcgctggatgagttccctccggggggcag

SEQ ID NO: 84584 - DNA, 753 bp, Oryza sativa
gataaaagagatagactcattagaaactttccatgaggttgaacctcatgttaaaaatccttcaaaacttctattacaaaaaatccttcaaaacttatatggattgaggcgttccttaggaatttcataggattaaataattttcaatactttgattcaaaggaccatatgaaaaacaaacaatataggatttgaatcctataaaattccatatgtgctcatagggatagggtgtgagtgtgtaggataaatatacgggcgttacgagcacatgcgtttgtactgtgtgtaaaaaaaaaagatgcccttaaaatgtactccctccagtttcattttaattgacgttttggacaatgacacggactacaaaatatatctttgaccttatttttctattataatatatacaatgaataaatgcatgtttatttttattatagtgctttaaaagagaaatctatatacgttgttctagtttctttaaactaaatatttttaaagttattaatggcaaaagttataaaagtttgattccaatcttgtccaaaacgtcaattattatagaaccggagggagtatagcatttgttccgttattaagtgatccgtcctccgtggtccgtacaatgatgctggaactgttcattgaggagcgatttcccccagtgttatacgaaatgaccgtaccagccgtttaatcggtcatatatatatagttacaagcagcaaaatcgttcatacattctgcgtttat

SEQ ID NO: 84585 - DNA, 667 bp, Oryza sativa
cgcgtgggcccgccacatccgcacccaccgtgagccgcgcgcgtgcaccgcgtccctcccccgaaccctagcacgccaccacgtgctccctccgcacggtgaaccgtgtcaccgacaagcgggtcccactcggggccacgcgaggtgagcccggtccaccggctccctctctcctcccctcccgcgtgcccttgggctgccttctcgggccggccggcccattaagctcggccgagccgcccctttctctcgggccgcgccttagctgcccgagggaagtctattcctcctccctcttcctttttctttttccaaaagggtttaattaaatcctttttcctttagacaaaaatccaataatcttagaaattcaatatcttctcaaccgtgtgtccgtttgactccgttcgacttccaaaattccccaaatctcgagatctatctattggcacgcttagaggtcaataatagggctttgttttcgccgtttgttgagttgttccgtttcgcgtgtagtttcggagcccgaaagacccgcagtgcgaggatttcgaggatcaagctcaagatctcgagcaaggcaagtcacctttgatcatcttgcacctataatttaaatctaagtatttcttttgcacaaaaatattgcataaataggattatcacg

SEQ ID NO: 84586 - DNA, 1509 bp, Oryza sativa
ccccccgcccttgccgacgccggccaatggagttgccccgactgctccggggactccacagacgccccgcccccggccccggcaccgctggcccctgggagtgccggccaactcgtcgccgacatccgcgccatcgagtgcgacgccaccctctccgaccaggaaaaggcacgccgccgccaggagcttctcggcggcgccgcgcccgccggtgccgacgccaatgatgacgagggggacgacgtcctccaggtcatcggcaagaacttcagctgcgccttctgcatgaagctgcccgaacgccccgtcaccgtcagtactcttgcggggcctttcccccattcttcctcttactacttgctttgcttatatgtacgatgatttatcttaacgctagggtgatgatgggggctatcctatcccctctcttcacacatttatattcattacttacattagagttgtatcatccctgattatccgtcaatcttattttgagtggacgctggcatttattcttttctgttggttcaatttgcatttcctgttatcgtttaaggttcctaactagtgaaatgaccatgtccaatttctacatgatattgtttgcttttgctactcatttcttatatttcttatttacgctaccatttgaattccaataacggaacaagtcttctaaaaaggcacccacataacctgcttaggtgctaggcttacatcctcccaccagaccactcttaactgattatcatgaaccagatcatcgatgttacgcacctcgtagagtgatgcttacatttctttatttctattaattgagactgcaatgcttgttacaattcaagtttaacttgttgaacacatcgattgcatgccctttctagatgataattgtttgctttggtaatgccaactggtatgtcactcctaattttcaccacatgcacacatttactatgcctagatatgtttgttttagctcataccaaatcccccgtacaattctgataatgcaaacagtattctaaaaagcaatccacgtaacctgcctaggctctaggattaggcttacaccgtcctgccttgccagcctagctcattacatcacccaagcggctgcctaatcagtcactagacatttgtatgtggtacagctagcttctattgccatcacatgcttgttcttctggattgatgcaataccttgcattgttaaaagtgctgtcttgttcttttggggtattggtttaaccttccagtttctgcacataattcttattttgatccatgcattgtaggtaggtaaaagttcttgctattctgtcaattcattggacccttttttttttgggtagcgtttctaaccatcagattctacttttgtcttgggcagacaccatgtggccataacttttgcttgaagtgcttccagaaatggatccacagcggaaaaaggacatgtggtaaatgccgggcacaaataccagcaaaaatggcagagcagcc

SEQ ID NO: 84587 - DNA, 596 bp, Oryza sativa
taccttgttttggtaaaatagttcatgttggctagtccaatgaccttcaaaggcacataatgatatgacagaaacctcaggtccatccttcatggttcctttgtacactactgtctcaggagatgaaccaataatgttgctaaaatcctcacaagctacttcaagctcttggcgacttaactttggcaggcttttcagcatatcagaatctggtgagagcattaagatattaacagcactattcaaatcatatcaattaattaaccgataacagcactaaccgatcagcactgttatctcatcactccaactttttgatctgttccacgaggatattcttatcgatggctttagcttgcaacttctggaagcagtaattgcaccagtgatcacaaatacaagcagaagaataccagttgaaatttctaaaatgagaagccatgttggttgtggtgatctttcatgtttatggtcagaggggggatgcttgaatccctttacgccacctcgctggccagccggagaaccacctaagacaaaatgagtggattcagccaatatcactacatggtgttatcgactagttacccaacaat

SEQ ID NO: 84588 - DNA, 680 bp, Oryza sativa
attcctgcagccctggttggggcttagaaaatcgcagctcggtctagcatttgtgcgcaagaaggcactacgcctgtttgtcaaatctaagaattgttttccccgatacaaaaattattagaaatttgtgttcacacatgacacatcccttgatgagctccaacagaagtaatatatcacgaaatcctactttactaaacaaacaggcagggcagatttggatgccatattgttaggttatagtgaagttagctgtcaatcaatcatggtgacaattttctcaattttaaactatatatatgccataatcctggatgcaccacacaactagttctttaaaagttgcatttgatgtaatgatcttatttaagagtttggtgcaataaattaaagaagggattaataggagcgatagttcagagtgtaacctctagcaagggagatgatgtccctccaatccatctgcttgctcacacctaaaaaataaaataaaataataaaatcctcaagtggttaaaacgagccatatcataagagattattgttttaccctcagagttaatggcaggggctcttaatacttctagggccttcctgtataacccctgtaatacacagctggtttgataagctcaaagtcccaacccacccagactgaaaaaagtttactcacagcatct

SEQ ID NO: 84589 - DNA, 581 bp, Oryza sativa
ccctccccaaattggcatggtgcgcacctcatttctcccctcccgtttcccgccttcctctctcggaccgacgcctcgccctccctccgttccctcgctcgattccagcgcctggacgcagaggagcagccgcgccgcgccagccgtcgcccatgccgtttgaccccgcgcccgtgagcccttctcctcgaagctccctcgccccagcactgctccgaggtcggttcccgaaccgacatagccaccccttaaaagccgcccctccccctctcgctcgatccccccgtttcgctccgagccgccgcgccattgcagccatgccctgttctccgtcgccgttcgtcgtcgcgcgtgtcggaggagccggcacgagcgaggacgcatgacgtggactccgggcgcaccctctcctttctcttccccggcccgaggccggagcgatcacgccccgcgctgtcggccatcgtcactgcgccccttcaccccgtcacggtactgccttcctccgttctccctcctcgctccatctcctccccttagacacgggtagtagcacgagtagattccccgtagtcagctgg

SEQ ID NO: 84590 - DNA, 2539 bp, Oryza sativa
  unsure (1)..(2539): unsure at all n locations
atcgagccgatatgccggggggcacgtgttggcttgcttacgagatcatcgcccgcacctggacctcgaacatcttcgtgagggttttgctcgttctcggaggactccggcggagatagaccatctggcaaggtcaatgtcaccgttggccaagaagatcttccagtctatggactggcgttggccttcttggtagtactcgtaccctgtgacaaatatcttaggaaaagatgtaatgtagcgaaagatttgtgaaaaaactgtaaggagtattttgtgaataaagaaatctatctttgacaaatgtctcttactctggatgtcatgtgtaagagtgcgttctcggttaacgactttagtcagccgtttgattcgtacactctccctagcccctagccttgtcgtcggaggagttttctcggaggataaggctcttggacctttgacctgccttggttgaataagctctgatcctagcccccagccgtgaagttgaaaagttaatttccgatttcacggcgtggttaatacgcacggtgagaactcttacacgaccagatcttacatggtctttcgtctctacaggatctgacaaggccttatcggctctgggcgtccccagccgaagatcccttaggttcctcgaaggccttgtcgagacggcgtaaagggacataaggacatgtttcaacgctaggtgtcatcagagtgagggatcatcgggcgaaacacgttgattgtgatatgggcctagaaatagcctttattgatactgtaagggtgctacaggtatgaatgatattgactcatacaaagaatttacgtagttggtcaatgttccaagaatttgctaattcgcgaccgtcgccgtctgcgattttgaatgcgcctggccgcaagacttgtgtgatcgtgtaaggtccttcccatttaggtgagagttttttggcccccccccccttgagncctttggcttttgaactcgtcggaggacatagtcgccgatcgaaagtatgcgtgcacggatgcgcttctcgtgataacggcggagggtctgttgatagctggctgctcggacggcaactcgttcccgatgcttctcgagaagatttacagcgatatctcgctgctcctcctggttctcgtcgagtgcttctgtactcgtgtactctgatgttgtagctcgcctgggagcatggcctcagagccgtacacgaggaagaaggatgtttccttattagacgttgtcggtgtggtgcgtacggcccatagtactgacgggagttcttcaacccaccttttgtcgtgtgacatgatcctgtcgtagacgcgggttttcatcgcttgtagtactatgccgtttgccctctcaacttgtccgttcctttagggttagagaccgagcggaagcatattttgacccccagcccgatgcagtagtcctggaaatcggcgctgatgaattgagagccgttatcagttatgatgcggtgtggtagtccgtatctgcaaaatatccctttgatgaatttgatggcgttgtcggccttgatttcccccgtgagtactgcttcgatccatttggtgaatttgtcgatccgaaaaaaatataaatctgtagccgccctgtcctcgtgggaatggcccaagtatatctagcccccagcacgagaatggccaagtcagagggatagtctggagtgcttgcgcgggtagctttgtgtgtttactgtggaattgacaggcttcacatcgctggaccatgtcgcatgcatttttaagggcggttggccagaaaaagccttgtcgaaaagctttgccgaccaatgtccgaccggcggcgtgtgacccacatatgccttcatgtatgtcgaggaggaggtgtctgccgtcgtcggtcgagacgcatttgagaagtaccctgtttggcgctttcttgtataaatcattgccgaccatacagtagatctttgctttacgggttattttctcggccactgtgtcgtcctcgggcaactcctcgctgctgatgaatttgattagtgggatgcgccagtcgtctgtggtttagatgtcggcaacggcgcgttctgcctcggtgacctccgagctaatgtcgggggtgttcgggctgacttcaccgctaacctctttcaccgatgacttcgtcaggatatcgagaaaagtgccaggctcgagcgattctcgtctggacgcacgtcgtgctaggtcgtctggctcgacgttgtccttgcggtagacgtgtcggacctcgatcccatcgaactttttctctagcttcctgacttttgcgagatacttggataactcagggttagagcatttataatctttgtgtacctggttcgcgactagttcggagtcccctttgacgattagtcgcttggccccaagtgtagctgcagctcgtaccccggcgagtagtccttctgcagtgttattggtcgccctgaagttgaggtggattgcgtgcttgaattgatcttcggagggagacgtcaagataaatcctacccct

SEQ ID NO: 84591 - DNA, 1292 bp, Oryza sativa
ctctgccgccgcaagaaaccctagttcatcaacctaggctcgcttttcggcgaccttctatcggcaatggacctcggcaaatcagcttccactagtgcaacgttgaagaaactccaggaggatggcgctcttcctggccatggaaccatggagagggaagcaggaggtactaatcctcagcccatattgggtcgcatggttgcgatcgaagattatgttctctgcggttttctccctccaccttccaaattcttctcctggttttgaatttctatggcctctctcttctccatttgaaccccaattccatcgccttccttagcatctttgtgcatctttgtgaggcctacatcggggtagagcctttccttgatctttttcgcttttactatgaactgcgttggatggaatccaacagggtatctggttgcgtcgggttccgacttcgggatggcctgaagtcgcgttacattcccttccagtgcccttcttctcacagcaagtggaggaataggtggttttatcttgagatcaaggactcgaaccctgacttcgtggttcccgaagatcaaccgaacaagattccgtcttggaccgcaaagccccccttgaccccctctcttcagtcgtttatcgacatcatcgacaatctctgagtacggggtttgtcgggatatgaagtcgttgcagacttcgttggtaggcggatccaaccgcttcaggctcgggcccatccagcttataactattccgggccagaggacgtgacccgggtttctcctcggggtatctttctcgcatttatcttgacatacttgtgttcgcattcctcttgacttatcgaaggttggttctcgattaacaggtctgagcggggaaaccgtggagcgccgcgtcggccaagtgatgatcagtggcccgaccacggcgagtgacatccctatgtccctttgtgaaaagggggcggcggaacgtgatgaagccatcaacgtaagtatattcgatgaacatcccgcattctcctttcgaaatcactttatgacttgattgagcgtaggcccttcctttgactgatatcatcggaccgctcgcggaccatcaggtggcgtcatctctgaaagtgaaggtcgtcaaggaggcgtctgatgctgccaccactagcggtggcaatgttctgacaaagccgaggaaactctcgtctgtaatcggacaacgtcgcaagggggcgaccccctcgggcatttattttatcggtaaatcgtgcagcaagaaggatttttccttactttgcg

SEQ ID NO: 84592 - DNA, 1486 bp, Oryza sativa
ctgtatggtaacacaataaaaaaaatgttagctgtgaacacagcaaagccttatgcctcacattagcaacagcaattatttccctcaacataccacacacttgatcgcattattttcactccaagagcggaatgaataagatctgccaagtgctggttccttctagagcgttgggggaaaccttctagtagctgatatataggcaatctctgtttaaatgagaacagaaatggtcagatatctttccattataatgccaacatgtttttacaaagataatactggcttcctcagtagttccttgtaaaaagtgctgtacagcatcctcagtgctaaatgctttcagttacatttcatgtcattatgtcccattacttcgaactatatattctactccctccgtttcaggttataagatgttttgactctagtcaaaatcaaactgctacaagtttgactaagtttataaaaaaagtagtaatattttcgacccaagataaattcaatataaaaatatatttaattattaatttaataaaataatttggtaatgtgaatatactatatttttctctaaacttagtcaaacttgaagcagtttgactttgaccaacgttaaaacatcttataacctgaaacggagggagtatatctcattatgaaatctgagcataaaaaaaatgaaaggtacacttacgagaaaatgattcatggttatccctaaatgcttcatcttcccattttctccaagaatggatctgccaccatccaatatttaagtatcatgtttacctttttcataaacttataccaaaataagataataataacattataaaaccaattttaacagcaaacttagaatatagtattaacatagctaatccagatttttgtaaagagatatcatcatccgaaaaagaacagagggactaatgcatattatataggatgcataaaattgagcatagtctttttctagaagagacatcaatttaaatttcacgcggtacattttaaatacttgaagcaacaggcgcacaacttttccttggaacaattaaatgcatctgtttatgtacatcagaagtttttgtatgtaacaaatttacatattctaaatctgtttcatcatcatggtgtgctttagtagtaaagacatgcacaaattagtaagcttgaacaatgttaaccagcaacaaaagcttcatggaagcctagcaggcaatgccattagctttttagccatccattgaattcatacatcgatatgttgcgtaacctacatatagttcctgtattttttataagtgttttgatgacatccaaagatcccaagttaaaaaatataccaatgaaaatcaacagtacatcttaataacattgaaagttgcaaatgtttagaaaagtttataagaggtgtaacttgtaactgaaatggaaatttataacaactagaaaaaaccttgagtatagcaagcagcat

SEQ ID NO: 84593 - DNA, 814 bp, Oryza sativa
tattcaggtttaaggtactgatctaatgaagacaatctatcatcaaattgagctttgatctggtattgccaatgccatattattattccgaggactttgtagtttgacctacaatatgctttacaataatccaatgtactactccatttaaaaaaaaaacctaatatagtattcagattcatggtactctagtactatatttgttttcctttcgaatgaagggagtattattatttgcccttatcaaattaccaaaatgcctctaaacttatcctaaggccttctttggttaatcccatcgggattaaggtgcggaattaatcctactcaatcccttctaatccctgtctcacgcggaataatagaacagtctagagtgagtaaccaaaggtgcttggacatgaataaaaggatagtaaaaaaaaactatcaactatgaaaataacacacgtgatcttttctgcttattcaacgtattattgacgtggattatttgctctatacttctaaaattacgggctcaaacaatgttcttatagtacattgcatatacaaacttaggccatgtttagttcccacgaaaaacttttcaccatatcacatcaaatgtttagacatatgtatggagtattaaatatagacaaaaaaaataattacacagattgcgtgtaaaatgcgagatgaatctttaaagcctaattgggccatgatttgacaaatatggtgctacagtaaacatttgctaatgatggattaattaggcttaataaatttgtctcgtagtttacatgcggaatatgtaatttattttgta

SEQ ID NO: 84594 - DNA, 564 bp, Oryza sativa
gtcaaatcccccccaacttagtggcttccccagtacataggctgatcctgcctttctttttatcttaagtataattacgccttcactaaataactatactagttttactcggtaccaatgtttatgttgtttgcttgcctgcaggaattcttggatcagttcttgtaggtggtgatgccaaactccctagtgccggggaggtactttctggtgctgccaaggtattgtattattgcccctccatgccctaactatcaacccagaatactactgctatattgattatatatcttataactcaccgtcacatgattcctttcccccctagtttgtcaagaagcatggaaacgaagggaaagatacatcgtctaacaccgatacacacaccgctcagctattatctcaggtcaaccatctcagacaggagatcaatctctaggatcaaggcctgttacagttgtcaccaatgctgctagatcaggtaagttcctgctgactagttactatgttttagaaacagacttatgcatgggtcacagatcatacaaacataaatttcacatg

SEQ ID NO: 84595 - DNA, 571 bp, Oryza sativa
atctctaatctttctttggtctaaaattattaatctctcaaaatttactgctgtgaggtaagtcttttccttttccatgtccaaatcaatctaggctatgttctggtatggttcaatcccctccccactgctaagtaagctaatgttatgctctcgaacttgccattgccagctgcacttgtagcagatgggttctgtccaggattgatattctagcactgactagctcgagtgttttctagtataatcggaacttgtattacaaattcccacttttagttatactgtgatttaaagacaaacactagtttaggtggtgtttggatccagggacttaactttagtctctgtatttagacactaatttaaagtattaaatatagactacttacaaaactaattacataaataaatgctaatttgcgagacaaattttttaagcctaattaattcataattagagaatgtttactgtagcatcacataggctaattatggattaattaggctcaatagattcgtctcgtgaattagtccaagattatggatgggtttaataatagtctacgtt

SEQ ID NO: 84596 - DNA, 1329 bp, Oryza sativa
cggtccaaccagccgtcgacctaccaaatttcttcctggtaatttcttcatacgccgccaacgccatctgtccgtacgctgctgctgccgccgtcttctccctacacacggtggagccgctttcctatccccttcacgacgctgtctccctctccgtcggtacgccctctatcctctcctttcagcaggaacatggtcttttcgcattggaaaagggttttggtaaaaagattttttttttcttcaaaatatggcaaatcatcagtttcatcctttttggggtttaaacctaaacatgcgacgaatttaggggcgggcaaatactcaaattccccacttattatattctagagttcaactgtcccaggccacgatattgattgacgaccgatcagggaaaatttacaaatcgtaatgtttcccctcaagttgtagtaatgacatcacatgtgaatttggtctttgttttatagggataccatggagatgggatttgatgagaaatttgcacttctgaggagcattgcggaggagtgcatatgcgaggatgagctacgcgtattactgaagaagaagcctaatcccatctgctgtgtttggtttgagccaacctccatgatgggcatagagcaggtatagcaacaacaataagaaaaaaggttatgtcggtcttagaaaatatatatctatactacttcctccgtttcataatgtaaaactttctagcattacccacattcatatagatgttaatgaatctagacatatatgtgtgtatagattaattaacatttatatgaatgtggacaatgctaaaaagttttacattatgaaacggagagagtacagtataaaagataatagtggtggtggtggttctgccattagcccctgatattaaggacaagttgggcaggctaggatgaaactcatcaagaggggtatgaaccaagaaatatcataaaaacataatggtggtactaatataataccagtagtatatttgtagtagtacaagaagcttgatttctatgccatggttcagacgtggatctctaatttttatgtgctcctatgcaaatccaattctctggttgcatttcaaacactgctcacagataactaggtcatggtctgttatcattttcagggtattatgaagacaatctatgtcaacaaaatggttagagctggctgtacagttaaaatattgatagcagattggtttccgcagcggaaccctagattcacctgtaacctaaacaaaatacaggctattatccgctacaatatcatgatgtggaaggcaattggcatgcaccttgacaa

SEQ ID NO: 84597 - DNA, 656 bp, Oryza sativa
cagctttcagacgacttagatcagcataatgagttgtcacaatggccagattaagcctactagcaagatacttcaagatgcttgttgaaagggctacaccgtccgacggatccgtaccactgccgatctcatcaataagaaccagagaatctttgacacaacttgtacaatcttgcgaagacgtgatatgtgcccactgaaggtagagaggctatgctccagcgacttcaatccagaaaagagtttgcatcaataagcatccccaattgattagagaaattctcttcaaaagacagagactacctggtgatctccgatatctgcaagaacttgatcgaaccatggaagcctaggggttcctttggctgggaagaacattccagcctttgacattagagaggccaaccccaacgtcttcatggtggcagttttgcctccagtgttgggtccagagatcacaattatcctagtatcggttctcacctgcatgtccagaggaataggcattggagagacaagatgttcatcagaaagctgtcctttccctactctggttgattcttttaccatactaagagactgttcaagaagtaaaggatgctgaaagccctcgataaaaactgagcattcactatttggatccagttgagtatcac

SEQ ID NO: 84598 - DNA, 1991 bp, Oryza sativa
  unsure (1)..(1991): unsure at all n locations
ttggaccagctttatcttgtttcctttgacacggacctttatttttccatactgaaccatacagctaccatcctccccaagtgtctcgacaacactagccatacttcctcctcccagcccctcaacgtacactttatctccgatttcaggaacatatgagctctcattttcttcatcaccgaaggtaaaatcagttggctggtgagtagcagccaatgaagcagtggcagcttctgcttttctcattagtgaattgtactgttcaagttctgaattcttgagttgagattcaaagttcttgattatttggtccatctgagacttcacaaactgtaactcttggggcaccttttcagactctgttgcccttaaagctgctactcgactatccaggtcatcatcttcagagcgaatcttcatatcaaaatattattaagtaagatttcaagtgaaatcatcaaagaggatccttctcataatactgtggaaaagtcaaaagcagatcaatagagtaaaagagatgaacctcattgtacagtctctcaacgtctgaaagaacagatgctgcttcatttgcctgagactccagaagttttctttcatctagcaaagaaccatagagtaaaccttggcgttccttttgtttgtcaggcaaaagtttctcaacccattcttgtgcacgagcaagcactttctgatcaaaaccaatggacttggcaatactcaatgcatttgaattaccagtactgccccataagatctgatatgttggttgcagagtttccaaacaaaattccattgcagcattctcaaatcgatcgtcaacagctttcaaacgacttagatcagcataatgagttgtcacaatggccagattaagcctactagcaagatacttcaagatgcttgttgaaagggctacaccgtctgacggatccgtaccactgccgatctcatcaataagaaccagagaatcttttgacacaacttgtacaatcttgcgaagacgtgatatgtgcccactgaaagtagagaggctatgctccagcgacttcaatccagaaaagagtttgcatncaataagcatccccanaatttttggggaatttttttaaagggggaaagggggaaaaaaaaacttctcttcaaaagacagagactacctggtgatctccgatatctgcaagaacttgatcgaaccatggaagcctaggggttcctttggctgggaagaacattccagcctttgacatcagagaggccaaccccaacgtcttatggtggcagttttgcctccagtgttgggtccagagatcacaattatcctagtatcgtttctcacctgcatgtccagaggaataggcattggagagacaagatgttcatcagaaagctgtcctttccctactctggttgattcttttaccatactaagagactgttcaagaagtaaaggatgctgaatgccctcgataaaaactgagcattcactatttggattcagttgagtatcactatccctgtcagtaaaggctggcctcacagcatttatccataaagcgtatgaacctctggcacaagccaggtcaagttccaatattttccccatcaaatgcttgatcttcatttcggagtcagctatgcttgaagtaagtagacccaatattgctaattcttcagctctttcatcacctgagagctttacttccatgttgttcagcctgatggcgtcccttggctccataaaatatgttgcgccagagccactggaactcaaaacaattccaccaggaaccagatgcttgtgtgaagctttaacaccgacacacatcctagaacggcgcttagtgacaacagggctatcaatcccaccaccctggaagatctttgtggatgtatctctcaacagagattctaacatatcaatgttcttccccctctccttgcggattgttgctagtttatcgctggcccgatcaaggaccacagaa

SEQ ID NO: 84599 - DNA, 699 bp, Oryza sativa
tttcttcttttcgcctataacgaagaatacatcctgatgtaccaggtttgccgggcagttcctgtgtagttacagcacattgcctgtttatgcccttgtcactcaggtaatgccctgtttatatcccaaaagcttcagattgcataccatgaaattgaaatcactcctaaaggattggcattttgattagcaagatcaatatagatgaattgcagaggcgagataattcccattaccttaagacatactacctttattttcaaatatataacgcaccatagacacactacctttattttcaaatatacaacgcaccattcgccttattcaaatacttagtgctaatatcatttattttggtgtgacttgttttatcactaaagatattttaagcatgcctcaattatttacatatttgtactaaaattgttcaataaggcgaattgtcaatgtccaaaatttaacggtatcatatattctgaaaatggaaggtctagtatttaattttgaaccccaaaaaaaaaagattgactaatctcactgtgctggtacgacaacagatggggtcaaagtacaaggctgccctgatcccgcgaggatcagagagacgatgcatgggtgggggaaagacgcgaggaggaggaggaagaagcaccgcggcggcgacgacttcaccatccgcacggagaccagcaccgt

SEQ ID NO: 84600 - DNA, 692 bp, Oryza sativa
atcacctctctgcagaatgttatattgttaaatcaaagattatccatgcaaaacccaaggagacgtatcagcaaagtaccacctttagaacatcagcctgaattagcaacaacccagcgcctgtatcatgagacatctcgctgctgctttgaaccgcttggcgcaaactttggtacaagcagaagcagggccagattgtatcctgagaaaatacaaattgagttccaaccaaaagagaatatgatgttgaatgtaacgaaattatggtaatagattatgtagaaaggttaggagtccataagcatggactgccctagatcatgttatggccaacaggaatgacagaactggctagatcaagacatcaagtgacggcaaacaacagtgctcaaactgtagattaagatagcaaagctgaagccagtgtaaatatgatgcaagcagtcctacatgtttgcaaattcattgaggctgaatgacatggtagaattgatagtcagactgtatatcaattttaaaaaaaggaaagggccacaatgtagagatgagcatacaatgatgatgagatacaacattcacgtgcagcaaatcctctaatcaagtgttcaccggctccagttgcacaacacccaactataaacggtgtgccaaagggccctttggatgaggcccagcacccagacccatacata

SEQ ID NO: 84601 - DNA, 502 bp, Oryza sativa
agtagaaccatccatgatacttgcatcgcattccacatgaccactctcagtcaattttgaaccgcgtccagcatttgtgatgggatcatcctaatcagccatagatgagaatggataaactaagacaacttttgcttggaacaaacaccattagccctttatctacatacaagtacactgtatcaccctcgattcgcttatatctaggaggtctgcaaaccctgcttatatgatctatagaaccactcttcctttttccccccttttgacatatcaaaatgtggccatatatcatacaccatcctatttgtcacccattgtaaaatttgaactaaactgcatagtacgtgtagacattgtaacaatacgtagaaagagatgatccaaacctccaatacttgaatggcagctgcaaccgcatcaaggcttgtgccatttccctgcaaaagtattaagagatttaggaattcaccactgcgaagctacatggacgccgctcgag

SEQ ID NO: 84602 - DNA, 1584 bp, Oryza sativa
tctcccgcacatggtccgccgcgcgccagctgcaggccatcgggggaggcctcacggtgccccgcgcgaacgacatcgccgccaccggaggcctcgcctccgccgtctacgccatgggcgccgtgctgttcgtcgtcacctgggcgctcgtggcagcaatcccatgccaggaccgcggcctccaggcgcacctcacagcggtgcccaggaccttcccctgggctggccccctcatcacactcttcgaccgcatcctcgacgagtccaagaagaaggaccgcaagcactcatgcggcctgctcaaggagatccaccagattgagcgctgctcgcggcagctcatggaggtcactgatgctgcggagttccccttggccgacgacaaggattccgaggtgcaggaggccacgcaggagctggtgcaagtttgcgggtcactcaaggatgggctggaccctcttgagcgccaggtgcgggagatgttccacagggttgtgcgcacccggacagaaatcctcgactacctcagtaggccgcacaacgccgggtgaggactcattgcttgatccaactttgtgtgaaatgcagccgctccaccgaggtagcttctctgtaaaagttagcatctacatatacatgtctctgcatgaagaaggcctggccttagttatgatacatttgagttatttctttcattttttttctctccttttgtagcttgtgaatccttacttgagcagttcttcgtactaatggtctaatatcatttatttcattcattgcttgtcctggtaatgttgagcactctggttggtttgtttccatgattagtctgtggattaggtttatattgtaaaaaggcgtgggcgggagtaatttatacaatcggataggttagctcagatattgagctgtgaggttttgatatactgctattcccaacattttgtttgttgatgttccaacaaatgtgtatatgatcggaagaaaaaagaatacagaattttattgattattgacttgtttttgttctagttcaaaaggccgaacaatgctccttttctttcttctgccctttgttttgttgtgcgtttagatttgaaaatggccacattcatcgtgtgctccgttgacacagtctatgatcaataacgcaaaacaggaaagcccaatgggtattacatttgggatgaataagtagaacatccgcttgcaaatgtctgcttctgtgtcctttattgagcttagatcaatattagaacaaattgtttggtattctctatttagtactattagttatataatcaacacacatatactcttctttcttgcaagaagtattgctttgttggaatgattatatctatgtagaaggttcaattttaaggttacttaacttacgttcaaaacttatgtacacatttacatttttgttgtatgaaagttgtattagggataggaactagtatcactaaatgggatataaatttgtattgttattgtcacttattccctccgtcccaagataagtgccaccgtgaactacactttcgctgcacttattttgggacggagtgagtatat

SEQ ID NO: 84603 - DNA, 1644 bp, Oryza sativa
cccataatataagggattttgagtttttgcttacaccgtttgaccactcgtcttattcaaaaaattttagaattattgtttatttttttgtgatttactttattatccaaagtacgttaagcgtaactttttgttttttatatttgcataaattttttaaataagatgagtggtcaaacagattaagaaaaactcaaaatcccttatattatgggacggagggagtaacaaactgatatgtagcagttcgcggatgatgatggtaacaaatcgttcgtgatgtctgaccacttgcataatgcatactagtgctaacttcgtaactactcctgttatgttgctctgtacagctgatatgtgggtgttccatagtcagttttaggctgattccacggaaaaaaaaagttttaggctgattgatgggaatgattcgccataactgtagatgtctcttgtgcagtaccagagatcaatctaatggtaacaggctaggacgagagcaattttatcgtgagaaaaaatggtggtgattgatgcaagaaaagaaaagaaagtgaaagtgtgaaacttgaaagtgagagtaatattcatacagtagaggcagcagggaaaaagaagagtgatatattataggctgtgctgcctggcccattgactgaagtgctataattttggaggcccaaacgaagcccgtctgagtatcctcgtatcctggggttctgttcttggcgtggttgatatgattgtgctggtcaagctctccagtctccaccatgctgcgggccaatcatcaggaggtgtcatccaagatccagatgcagaatgtactacccgtctttcttaaggtttatatatacagtagtatagtatatataaacctttccatttgtttatttccaatgctatatactggctacttctacctctcttttctaatgctagcacgttgtaaaatctgctccaaagtagtagtaatatcttaatgaactaaggctgattgttttgttgcgcttttatttgctgagttattggattcctttgtcccaaaacattcacatgatcatcgttggtgtacactagtgatggtgtgcaaacgtggacgactttgaccaatctaccttttgtcccagattcagagcatctagttatgcactttaactccggtgggtgagtgacttctgagtagtcgtactcgtgtcacgtatgcttcccggtcctgtgccagcgctgtgcaatttaataaactacactttgttttgtttttatctgattaagtgtcgtgctatgccgaacgatggaaacattaattttgggtttatgctgtgacaaagacagttgtgatgatgtagcactaactgatgatgatgatacatttgacatgcagttactctgtcccgaccgaggaatcgagtagtaactttactttttatgaagcaaaaccattctaactaagcagagaatgcatggaaaccaaacaccacgcgcagatggcatcctcttaattattattactagcacaaaacataaacataaaacgatcactaattactccataagttaattaggcgtcggcggcgaagccttggtcgtcgtcggcagcgttgaggaggtcggaggagcggcggttgggagcggcgcagttgt

SEQ ID NO: 84604 - DNA, 2182 bp, Oryza sativa
tgtgcaaagatattgtcaggaaccctgaattttgtggaaagcttacatttccagtgtctcttaagcaggtaaccactgaatccaatagcaaataactacaatacgtaattcctattacaatcattattccctgagcggtgctggagttcccatcatgttcttttgtatttctccaacctttaatttcacaccacactgttagtttacattggtttacactagcagacagtagtgccatttggtccaatgctacttccaggttagctcttctagagtaaatgagtgaaagacaaatatgcgatatacatgtgtggcctgccccatggggcttgggcactgaacaaaatttggacctcggggtttttacatttcttgggacctggctgagactgaatcttatgcgtaacctgttttccaattatcgtaccaatcactttcttgatgaaataactctgcattgatgagatgttatattcaagtttacccctttggtctcatctctttatccttgttttcttgttgagatatgatatttcctctgtcttttaacaatgtttttcatctcttgtgcacagcctggacctcgagatggagtaatccaatgtttcataaaaagggacaaatcaaaactaacttatcatctctacctgtgccttagctctggtaagttcctgtaatctttttccacttacccattattgctctaatcggcactatttttgatattataacagatctgtttgttggcagataaactagacagtactcataggagtatttgttttgttactattttagtccttaactttgtcaatccttatcctagcatccagtgactgtctttatctattcttgtgtaaaacctccttgtagaatcaatttttgacttaatgcttggcgtagtagaattttggtggtcattttcagtaattttgaaaaatctgttttagtatgaaattttagtctgttcaaaagcgactggaaacgaacgtactatagtataaaccgattcaacttgctgtaagaaagtgagcttgttgagtgatcgaaaagaatatgattactcacgcatgctataagcaatatggtaattattgccctcggaacagtcttccataaactttcttctcgtccgttgattgctaccatttttgtaaacgacgtatactagtcctattgtctctctgaaagcaatgtatcttggtaattgatatgtagatattgcagttatgcaaacactcacctatcatttaatgcgtagggatgccagcactggtcttttgtggctctaatgatgctgcttcggaacctcccatataacatgatttttaagttaaagtaaacacgtgatgtgccgtagttccatgttttctgctgtataaaggacttcttcgacacaattttagagattacctacagcattttcagataactcgttacaatactctgagtagtatattgaagagaaagctagaaattgcactaacaattttaattgcatcttgtagctgtgcttgatgagactggaaagttcctactatcagctaaaaggagccggcgaacgacacacactgactacatcatttctatggactccaaaaatatctcccgatcaagtagtggctatattgggaagttgaggtaaagttcctttgccatcaatcttcttgcacccacattgtcacatacacgtggtcacagatacatgcataataatctgacatacaccatggtattgcaggtcaaatttcctcggcaccaaattcatcatctatgacacgcagcctccatacaatgctcggacactttgctcacaagaacggacgagccgtcggttctcctctaggaaagtttccccaaaagttccaacgggttgttatcccatcgtgcaggtgaattatgagctaaatgtgcttggaacccggggaccaagacggatgcaatgcgctatgcattccatcccagcatcagcagtagagcctggtggcattgtgcctggccaacctaaagagctcctcccaaggttatttgaggagtccttccgcagtatggcaacttccttctccaagtactccatcacagatcattcgacagacttcagtagttctcgcttctctgagtttgggggaggggctctgcaagggcaagagcaagagcaagatggcgatgatgtgaacaagga

SEQ ID NO: 84605 - DNA, 586 bp, Oryza sativa
aatatatagaagctgtaaaggaaatgaaggacaggagataagcaatttttagtgcaataccaggagtgtagaagctcatgtagggtaagacgctagagtagaccccaggctcttcaaccttcttcacccgccttgacttgagctcgatcgtgaataatccaacacctgtgctcatgaatatgacacccacaccctctgcagagccaacaacaaatgcttcatcaccgcgattggcaacaggtaccatttgctccagctcaatcacccagcactgtacccattctgcagccccttctgaactggcattcctcgacctcacataaaggctggatccctgaatgcaggcataacccagtgagccgttctccatctccatgaggaaaatgtcatacacatctcgtatcggcgggtcaatcttagataagcagttcgcggcccagttgtacttgatgattgcattctcattccgaagcgtgaagtagatttcatctccaacaagggcacctcgcctgggctggacataaggtgtacggtatgattcacctctagtaatggcttgcaaacgctcttgccaggtttgataacc

SEQ ID NO: 84606 - DNA, 670 bp, Oryza sativa
catcacatgtatcctcccagtcggcatccatcaagggagaaatatccaagtctcctatgagttttatcatccgatgtcatcggccagacaacttggaataggacaattgccaatcggcctgtactttgccgacaagatccaatgcagaggtgacatctcctcaactttaatgatggatcggctgttgaacatccctggacctccgttgggcagcatcgagaacataaagctggcaaggttcaagagtagggcgtttgacagatggtgcggtgaatggaagctgcatctgttccatcaatcggcttccatgtacatgatagacttattccctgacagtatgctgagtgcactcttcctacactcgttgatccctgttacttgactttgctctcaaagttagcacagaaatcaattcaacttgattgccatcagaagtttatggaaatatacaggtgcaatctacaaaagttttaaagtcttttctacttgcaatattttgcttctgagtttctgattttgcttgttcacatttttcatcattcccacagagaaattcgtagttcaactttggaacggactcttaagcgcttgggagttgaatatgttacaaaagaagaaatgcaccaagttgaggctcagagcatggaagctaaaaacgccgagtggacac

SEQ ID NO: 84607 - DNA, 647 bp, Oryza sativa
taataacttgaataaatttggcttgggataggaacgaagggagtatataattattttttctagttgcacacatacaactattatcttctttttttccgtttacatcacatgcgtactcaagtgcttctcctaatacacgttcagggaaccggagatgaacaacaaatcccaacaaactgaattttattcaaatccacagcgattacaatggtaaaaccaagttacaacacaataattactgtattcgagccagagaaaattgtccgacaaatcaattgcagcacggttacatctctgctagctcttctgccgccgtcagctaagttagcttagctgcggcgcttggtcttgcggtggtggtggtggtggtcgtcgtcgtcgtcgtcgccggcggcggcggcggctttggcgagctcgcactggtcgatccactcgctgtagacgtcgatgggctcggtgagcgcgtgggcggtggtggagtagcgcgcctggcagacgaagcaggaggcctcggcgatcatgtgcttgatgtcgatgctgcactccaccgcgccgccgtggtcgcagaacgggcagctgaacgccgtctccagcttcggcgccgccttcttcgccgtcgccagcatcttcgacacccgagacttcct

SEQ ID NO: 84608 - DNA, 644 bp, Oryza sativa
ctatagctgctatttaaaacattggtaataacccaataaaaataaaccattaaaagaagtgttttttttatacagagctatgacatccttgtcggcgacacgagcatctcatcaggaaggtacaaattcgtggagttctcgcagccgtacaccgagtcaggactggtgatggtggtgccatttagcgcggacacgtgggaccgttcgtggatcttcctccggccattctcgccggcgatgtggctcctgatcgccgccgtcaggctgtacaacggcgttgccatctggctcatggagcgcaggcacaacggcgactaccgcggcggcgtctggaagcaggtgaccatcgtgctctggctctccctcgccgccctcctctcgccgggggagaaggagaggcggctgaggagcagcctctccaaggcgtccatggcggtgtggctgctcgtcgccgtcgtgctggcgaccaactacacggcgagcctgagctcgctgatgacggcgcagcggctggggagggaggcggcggtgacggcggagtcgctcaggtacgtagaaaaatctaattgttgtatttttgatgttttctgatttgttacatcgaccctctcaagggtatatgtataggagtacatagagtatat

SEQ ID NO: 84609 - DNA, 714 bp, Oryza sativa
tgaatttttattatttctaattgtatttttatgtggactctaaactcatctttcaatattctttaatttttagtttcgaatttcagttacttctaaagtgtattcctaagctcttcttcccatgtttttcttaatttcgaattttagttatttgtaaattttatttttatacggactgtaaactctacttttaattttatttaattttattatatttattccaaatttgagttatttttaaattcctatatgaactctataatctacttataatatttcttattttttaattctgaatttctatttttttttcttaattgtatttctatatggactctatactctacctctaatattccttatttttaattccaaatttctattattttctaattgtatttctatatggactatatactttacttctaatattccttatttttaattccaaatttcagttatttcctaatcgtatttttatgtggactctatactctacttctaatattccttatttttaattccgaatttcaggtatttcctaactgtatttttatatggactctatactctacttctaatattccttatttttaattccaaattttagttatttcctaactgtatttctatatggactctagtctcccctctaatattccttattttttaatttcgaatttcagctatttctaaattgtatttctatttgga

SEQ ID NO: 84610 - DNA, 502 bp, Oryza sativa
cgtagtaataataatttaaacccaaaactgtgtaatgataactctgtaataataagtaaaaagggaatcagcggcatgacttaccaggatgccattgctgaagcgcatgaggacggtggagacgagggcgtaggcggcgagctcggtggcgccgatgtgtccgatgaacgcctggctgatgacggtgacgccgaaggaggagaagcgggcgcagatggaaggacccgccaccacccacagcttcttgttctcctccaccactcgccgcctcaccgatccaacctcatcctcctctgcatcatcatcttcctgatgcttgtaggtagccggcttaggctccaacagaggaaccgtcagcttctcatcatcacccggcttctccattttgctaattaattagtggcggcttgtagtttgcagcaatggagatggagtggtggtgcttcagattcagtagcaatggcgctgctggaggaaagggaagcatcaaggatgctcaagt

SEQ ID NO: 84611 - DNA, 563 bp, Oryza sativa
gaatactctcaggctgctgcatatacatatgctgagttcccagaatactttacctggcatggtaatggcaaatattgggctgcacagaaaaattgccgcaagaaaattggaaggatagcacatgtttgtcctgcccaaggagatgtctactaccttagaatgttgctgcacattgtcaaaggagcaaaatcctattctgatctgcggaccattgaaggacatgtatatcctacattccaagctgcatgtcaagccctaggccttcttggtgatgaccgtgaatggtccttcgcaatgactgatgcgactcattgggcacttccctaccaactccgtgagttatttgtaacattgcttcttttctgtgatgttacacacccactgagtttatttgaagagcatctgtcttcaatgggtcaagatgcagcctaccaccttaaccatgccacactaggtataaattcttctgcaccttcagtcatacaatatgtcaagtcctatgttctttccgagatcgatagcatacttagaaatgttggtcgtactttggcatattttcattt

SEQ ID NO: 84612 - DNA, 1821 bp, Oryza sativa
aaagcaaatgccaagggcaataactgattgttcccatctaccccaattgctgttagtatttggccctgatactttccagtcaagaatgtcccatcaatgcagagaacaggaggatagtacacgaatgccatcttgcatgcatgtagagctaagaacgtcctttgcagcacacttttgccaggatgttcaattgaggggaatttcttcactgtgtaagagctcccagggtttctttgttggataacaccaagcaagcgtggcaaattgccatacgaggtttcgtaagttctaaatctcatctctattattttctgtttggccctccacaccttggcatagctaatagtatacttgaatgtctctttgatatgtcggattattgactttggttcatatgtcagattatcgatgacatgcacatacatctcagatgcaacaaatgcacatgtaatgttcttgtggtatttctgaacaccaggtagaaaacatgtatgcttggtaatgactgacactgtccagtaatccttccattttcccttataagcgtgcactctccagggacactcatctttttccttaacacacctaacttcatattgcgaccggttggacttggcaatacaaaactctctatgaagtgacactgcaaaatgctttaccgcctccttcatatcttctgctctagtataaatcgctccctgaataacctcattttctttgtgctcccatctcacactatcctcttcagagatgaccagaccagaaaaatcctcactagcccattcggctggattaatatcgggatcctcatcatctgacgaatcatcttcctctacacgctcgttgtcagaatcctctctctccatttcatccacaatgccactgatagtctcctcctcgtcagccactccactaggttgaatgcccactggagctactacgccaccttcctctggtgcgttgacctcttccacggaagtctccttcacttcagcacttggtccctcgctatcatccatgttcatctgcgcacttggatccttcaggtgaacaaacggaaccatagctagaggccacccgcgttgcaatgcattctccacataccatctccacattcgagagtttcgaactggcattagttcccaataaaaactctcagttgcccgacttactacaatatagattgttatgtcatttgtctgtggatcaactctcaagcccctcatcaaccatccttttatagaaggtacactcctctcagccggtctatcaattccccttggtgttacaataaattctgacaaatctaccctagtcggcccgtaacggacgtttcctgggccatggtaaacttgaaatgtatgtttgttggacatatctgtcaacgaaataactagatcattcgttcatgtaataaacgcctacaacgttgacggagctcgtggctcctcaccgggagaccgctctggcccccctttgccggttcggccgggggcttagggtgaaatcccaagctctctcggtatgtggaaagatcgcgagccaggaaggaacgcgagacacgggcgatgtatacaggttcaggccgcccggaagcgtaataccctactcctgtgtttttggtggatctgtgtatgaacaagttacaaagtatgaaccagcccttccccgctccaaaagtccaagatccgttttttttttcccctttctaagtgggcaaggtcctccttttatatctcaaggggataccacatgcacctctccctttccaaactggacttttcttctcttcataaatggacggaaatcggtacggttgct

SEQ ID NO: 84613 - DNA, 2352 bp, Oryza sativa
atcgcgcgcgtacgtgcggttgcctactagtacaaacctggcggatgcggcgtagaggaagcggaggaagacgacgacggcgccggtggaggcgccggcgatcgggacgacgccgccgcgcggcgcctgctcgatcatccgctccagcaccggcgacgccgaggccttcgccatcacatcacatcacaccaccagattccaaacagaaaaacaaagcgaaattcatcagaaattcgaaacaagaacgagaaaaatcgcatcgaagcaacggcgatctcttccttcgcttacaagaacagacgagtgcgcgcggatgccgctcccgtcggcggtgacgacccgcacgtcggccggcgaggtcgggagcgcactgaaggccgtgctgagcgccatcgaaaccaactccccgagtttctcgtccccctcgatcgatcctaaaatcctttatgcttccttaacaagaggattaaactaaagaaagtgaacaaagagaaagcgaaagaattaaagaagatcaagaaattccaattccaattccaactccaacaacagtagaacacatcttctgggttctgggttacgcctttttatataggagggattggaacgatcttccgaatcatacgcacacgcatgcgcagctacgcgcggcgtggaaagcaactgaagacttctggttctgagggcgttttgtttagtgtgacgagaggggttagcttaggatttaatttaatcatttaaaatgggcttttataattaacacatgtgggtggtcgttttatgaaccggggatgcaacgggtttgccgtgtcagcgacagattaggaaggaagcggtgcgaacaagcagccattttctttttttctaaaaaatataaaataaaggacatttgtttaaactgctgacttggaaccacgtatcatttttgtggtgttgttggctaacattatagtcggtggcggccttggtctaaaaagtttgagtagttgctcccttcgagttgataatacttgtcgttttagataagggtgaggtcaaactttaaaatctttgattatgaattattttaaaaatatttgtctttcaaacatagtgactacatgtatagattaatcttaaaaagtactttaataagatcatatattttttaacacttttatacatattataatagaaaataatggtcaaagtttttttttggagaccgtgccattattcaaaacgacaaatattatcaacctagagggagtataaggattaacacgtgatttggtcgctaaacttatgaacacttagtatttacttgtatatagggtatattataagctttttcaaaaaagaaatactcatacttttgcttttataaattgtgacaaacacgcttcaatattcctctttaactgctacgggcttaattgcatcttatacagctggaactagctctccgggacacgcggagtgaggcctagcggtttggggcctgtctagttcgcgaaatgaaaatttttgagggtcatatcggacgtttgaccggatgtcggaaggagttttggacataaataaaaaaactaatttcataactcgcctggaaaccgcgagatgaatcttttgagcctaattaatccgtcattagcacatgtgggttactgtagcatctatggctaatcatagactaattaggctcaaaagattcgtctcgcaatttcccccctaactgtgcaattagtttttcttttaatctatatttaatgctcaatgcatatatccaaagattcgatatggtgtttttggaaaaaaattttggggaactaaacggggccttgtttgatttatcttacaactggagataaccctatttgttgtatgtagtctgaggtagtgaggtccagtggattgtgctgagctagctagctaacttcggcgcatgtagttaagagttccagtgggttgtttggtttgtcgtcgtacctgagcagagcaagccattattctcacatgcacgaaatcaggaatgatctttatttaatttgtaattggcagaatgtggtggttgtttgttgaaatagctgacttggatctatgtatttttgtgttgttcttggctaacatgtagtcagatggcgttctggtagaacagtagcgaaagtttgagtactagaaggctagaagctaagggttaacacatgatttgatgggaaaatatgcagtgaaaacttggaaactaccgttggatcgagaaatagacgttcgagattcgtccacgtcaccatgagttaaaatttaactcgcggattcactcacggattcactcatgagttaaaattttggttagagttaaattttaactcatgg

SEQ ID NO: 84614 - DNA, 1692 bp, Oryza sativa
tgcgcggtgtccgtggactcccactagttggtatagtggagttcattttacatgggacatgtaggtattttagggatcggttccaggcagttcttccctatatgccgaacaacaacattttattcggaactttcatgcagaaaaagctagaggagtggcgtaaaaaggccatgaaacatcgagctctagtgcaaggtacccaacagcacaggtttgagatactctgtcaagataaggcaggcacgggtatataccgcaagagagtgaagcaggaatgtgttctcaaagccgacggcacatgtcattgctcatgtgcaaagccgaagctgctccacaggccatgcacccatgtcattgctgcggcatcggagtgtggcataccagatggagtatatgtgtcacagtactcagtaagcaagcaatatatcatacatggagtggagagatttatggcttcagcatagctggggagttcacagagactaacgatcaagtaatcaatattcctgacccatcgaagctccgaggtaaggctggaaggaggaagactcgtcgcatccgcaacgatatggacgagtcggaggcaggcagggtgaagcgctgcagcaaatgagatgaacgtgggcacacctacaagcattgtcctaaagacaaggaaaatccaagtacggcggaggcaggactatcaggatcagcagcagatagagctcgccctacgggtgaaggcactacctcaacttgaccccgtcctatacatcgttgtgccacgttcggctacgtggtgtagttcttgtgttatatgttggcatgtggctttgcttgtaatttggttcgaacttatcgatgtgtttatgtttcgtcgtgtaatgtcagacttcggcatgtaatgtctttaggtcgcatgatgtaatgtcagacttcggcatgtaatgtctttaggtctcgtgatgtaatgtcaaacttcagcatgtaatgtctttagttctcgctatgtaatgttagacttcggcatgtaatattatgttctggtatattattgaactctacttatatgttaaatcgcaccccccttccacgagtaggcctcttgttgtgcccccccataggtacttaaaaaaaaccacactacatcgacaatcaatttacatgcattttatgtcttagcttacaagggtctcgttgtcgatgtgtaggtttcgcccaattcactacgacacaggccacccacttctcccaggctacagggtcagcgtctcaggcagttgcatcgacctcgcactctgcacagttctggcagtacaccgggacttcgtcacaggcagccgacacgtcgagtcggggtccaccactggaccatgccgggacctcgtcgaagtacagggtggcttccgccttgctcttcgacatgtgcgacttcgacttccaggtcacgacagaggacgtcatcggcccctcacagctgggaggcgcaccgccggtgcagacgcaggactagtcgccctccactccgcggctagacactcgtgctacccgtgttgtgccactggatcgtttcacgtactcccaggaccacgtgcgagaacaggcccggaggaccaagcttggttgcggcgcggggcagagccagtagagtagacttctctttgtttatttactttacatgctagtactgtatgcttgtataatgaatac

SEQ ID NO: 84615 - DNA, 1694 bp, Oryza sativa
aaggtcttccaactgcatttgtacaatttgctgcaaatttgttgttttaacattgatgatgaatgatggtcaccctgctggtttcagttcttttgccatatggatgagaattgtggtaagcttgtatttgactattattgtttttattgtgcaggagttcagcagatatgaccgacaaattgcaaaatctattggtaaacttatgccgactactgacagtgtaaagtgagtatatatataaaacatatttttaactgcctagatccgtatagctcaatgcacataagcacattcaaataaaaaagatctacatctattctcctttttccatcatttgacgcgtgataagaactaattgccttttggtcatatagttgtttttgaagggttttaaagtgagtatttgatttgaatatttatttaatttgaaatctacccctaaacatttgttgcagagcaagggctggtgagcttattaaagctttggatggacaggattgcccacgtccaattgcttgccgtatatttgcaaacaaggtacttttatgtggtaatggcctcttttttcaaacgagtagcatcataaatatgtgtgaaatgtcaaaaagtctgagttgaacgacatgaccatgcaatatttttatccatatgttcaatataagtacgaacatacttgctaatataaacttaggcccaaacacttgctttatgaactgacttgtcggtcaatagttgaaagtcgaaacatgaaccatcaaatacctgttttatagtttagataattggtatgttaactgcctacatgatgaccttacaatttttagacacatttttttaatagaaaaaatgtgtctagaatatgtaaagtaatagcatcatgtcaccatttaacataccaatcatctaaacttcagttacatttttttagaaacatggatttaccacttcactttttggctttgcatagtctctctattgtagtgtatacctctgcagtactggtctgttgttgccaacatgaacttaagtgtgctcacataactctaactagaaatttttggccttctcatgtactagaattagagtcctaccgggctgtccattttgacatactgaattctacttgatattgttgacttacatagctgacctgatattgatttgcagattatttcaatcgtcaagagtagaaatacaaaggacaaaacatttggaaatttggcctttgcttgtggatatgtcatgcttctagtcaccagccaggtatgtttgtgttttttagttttactaggcattacttttgttaataagtgcatatcgaattgtgctcactttctggacatttaccgcactcagttttctttcttatagctctcttctgatatttcagaaggcatatgttgtgatcatgaattcttgattggtggaagtatattgatacttaaaattagtttatagtaggaaaagactatttcttccttacatgacagctcatccttaataagtggaatggaaacccacagtaactaattttcgttatgtttcatgttaagtttaaaagttgaagctgcttttgacacctcatttaaacatgaagtggcatgcaatgatgaactattgcactgttcgtcatggttagaggaagtggatattaagtgtccttaaatttgatggcaataaacagtggaaggtta

SEQ ID NO: 84616 - DNA, 6907 bp, Oryza sativa
gcacatgcacgactactttctgtcgcaccgatgcaacctcctttattcgcgtgcgatacgactgcggaatggctgacccaccatggcccgcatacgtccaatcttactttcggcgccaatcaggtgtacctaccatggtccgcaacgttgacatgtcaaggatatcactgcgatttttggtgcctatataagtcgccataacgagcgatgcctcacaatctttcataactcagtcacattcagtactctcttcctcattagcttcattataaatcccactagctttcgtcaatggctagacgcctgggcgttaaggatccgaactggcgtagcgatccttgtgtatacctactaccaccttagtgctagcggcctctctgcctatgcggtgaccgatgccaactaatggcttcgaggaatcctgatattcgaggaaggcgcttttttaggtgccctaactatgaccgtgaggtatttattatctgtatatgcttattcattctgtatgggcaaatgttttattcttcataatactactctattcgtcagacccgcactacggcttgcggatacatcgagtgggtcgatacagaaaatccagttctcgacctaaccacttgtttacaagaaggacgctggtatttcgcatccaaaagtactaagcaatacttgcagagaaaagcagcttacgaacgacaatgtcgtgaacaacagtgcgactggcgggtgctaactacggcactccctccatggaaagcccgtccaagatacagatgcggtgatcgttatcaggttcttcgttccataaagcctacgactttgggtcgaaggttctttgtttatccaaatattcttgacgacgatttcatggtaagaatattttgattataatgaatgcttattttctcacaacatttactaactttgttcgcttcacatctattcgtttctcacaagaaccaccaaggagatgtcaatacagagaatggatagacagttctaactccacctagccgtgcggtgtagcttgaactaccagaggaatataggattactaaagcgcggtttgagagaggagagagattctcacataggggttagctattatcggacaacttgccatattgaaatttgtaatgtcatgcttccttgtcccattactatatcgtcgttgtgttcaactcttgcactacctccctcctagttcgaatctaatattatctatgtaaccgcaatggaaccagatgtatcatgttcaaattctactactatatcttcatgttacataattctccttgtttaagtgtatataatgtttctatgaccgagactgcgataggcctatatcaatttcgtacactaatacgtcgaataagttacagattaatatcttacttaacagatgaaattgcgaaacaacaaacttcaatatatttttaaaacattattaacaagttttaccaataaataattatttaattattatgaacatagcagagaaaaagcatttggctgatagattttgcatctaggccccttgccgcccttttaagttgcatcaatcaagacaccatgcccaaattaaaacaccataccaattatacccttagcatgcacacattctcccttgctacattaaatatattccaatgaaattcgtgtccatgcagttatatgatgattaatttgagaaaatttagatttatttatatgatgatcaatttgagaaattttggatttaattatatgatgatcaatttgagaacaagggagtactaggtttaaagtggagttgtggagctgtggagctgcccaatttggtagggcttcaactcctaaatttaactccaaaagtttggtatcctaaatttaactccagaagtttggtactctggttagctccacctctctacttcattttaacatagcactctagccagctccactccgttttttgttggagttgaaaccgtttagttggactacagctctaggagagatggagatggagctagagttgtgtcaaatggtggatcgatcgggtttttttttcaccactttctttttttttttttggcaccatatagttttttttgggtaagtttatgtacctaaagtttataaattcaaagtttacatacctaaaatttataagttaaaagtttatatacccgattcaaattcaaaatcagatttaaatttttttatataaaatatttctatacataaagtttgtaagtacgaagtttacggtatatatttataagtataaagtctatgcacatagatatacttttatgggtattcgagattttttttctattttttttattttcttcctaacttgtttttcttttttgaaatttatgatgcagttggaagggaagaagggggactagcgtgtgttaggggtagggacatggggcgattgctgtgggcgatcaccagctcattagcccttatctctttaatttattttgtgagtacattttagccagctccatattttttatgtgaaattgaagctggagctatgctgaatgggttcttcatggaatttggacggctagttggttatttggtttgggttaatgtggcttgccatttcgcagtcaagttgcgatcgatgcgcatgcattaggcaggtgagggtgctgacgccggcgagcactccgtgccggtgccgtcgcggattatcctaaagctcaggtgtagacctgcacgacacatattgctcggatccatttgcgccttttgctgggcgaaagcaacatggaggatgcatggagctgtattcttttttgttatttggacaggttgtgccaaccaagtaagatgtcatcatcagaccattataataagtgtggttaattagtagcgagggcactggcatttcgttgtagatcagatcaggcgtccgacgcgcactgatgaaggtcacggcgacggaccgacggtgttcgggattttagtcccaatctttcacggtacaacacagcagcccgactgtatatgtggttatatatctccgtaaataaattaagcaaatggttgagctgaaagaacaggaagacgtgttaaggtatgaaaaatgttatgatgttaataccttaaaagagataccaggccacgtatatttttttatgatatgaagaaaagagaaatagacgagggaagattgtcgattgttggttaacaggcgatcaatttccaattatgaattgttcaaatagttaattgaaaggccatatttaattgccaaaattttattttagatcacccgtaaaccaacactttggacctgttgattctgccattgttgcattttagaccatcccaaacaacttattaagcacatgtcgacggctttaaataaataggcgaactttcccatctatgtgcatgccatatttttcctagatcagagatttgacatggatgaatagagagttggatcatccaaagtccaaaatggtaaaatggcaaattatttgtcgaagatgaaaagattgattcaagaatagtccaaactaaaatattggcaataatagatggtctaaattgtagttcactcttattcaaatttatttgagatagacaaataaagaaattgtcaatgagttgtctagacgtcgccaaggtataacatagaaatattataaatagctatcgtgtactacctccgtcccaaaaaactcaattctagatttgaacctgaagattcatgtgtccaggttcaaattcagaattgtttttttttttcggagggagtaagttactcatgcctatattgtcattcttgctttatggtgatttttttccctttctttcaacttaccagttttgtgtgtgatcaaattacactaaattggtcgcgtgcatcacacctgtcctatatgcttcgagcatatacattaggggtgtgtttggataatggtaaataagggatgggattgagattgagaaatgaacgaagggttaggattaaatgaaagagggagaatgaacggttaggattcaaagatgggtaggaaatcatttccctttcccatttgccatacactgtctaggtcttatttaaaacccatttacaatgtaaaaaatatatgaaatttctatgaccctacatgaaattcttacgcttcaaatccaagtcctaatccacccgatttttcaacaaaaatcaactgctttgggaagttgggatacccgactcgagtcgagtcgatcgcatctgtagttccgttgcatctggattctctggaaacagaagcatatggaacggaacggaacgaaacgaaagacgctgacgtggcgcccgctgacgtgcgtctatataacggcgaggagcttcctcttcctcctctcttttctcctccaaggtgaccacctcctccccaccgccccccacatccggttccccgaggttgcagcctctgcagccttgcgaggatcagatgaacccatcgtcaccagacgaattctccagtacgaacgatcggacactgaatctttgctcaattccgtgctgttttgattcctttactggcagctgagccggccctcaatctggattttcccggaggatttttgggggatttttttttcttttttgtggggataaggagttcaggggtgagggggaatctggtggaattggatcggtttttctgatcttgttgagccgatctgtgtgggataggaaaggttgctttttgttgttgttcttgggttcttggtttgataggagttggggggattcggatgctgtaatgggggaatttgaggcggcggatttgggagattttgtgatgcgcgcggggatcggggatggtggaactgtagactgtgtggccacgatcatcggatcatggatcgatcctcttgtttccgcttcgctcttcttctcatctgttgatcgtgtcggagatgagcggagagaaagatcattgtggtggagactgatctgtgcgttgatcttgctttggtggcatgatccggggtcaatccatggatttgtcttgtgcgtgctagtctcatctgcagttcattctgatggcattctttttgtgggggcaaaggctttgctaatttactactgaatgaaaatttttattttttatgtgttgtttgtgttgtttctgctattaactgtttttagtagtattgagttccactgtaagatggttcctgatctaacaagggttcatgtgtgttgttgtttttggattgaggttcaggctttctcctgtccatgcgctatctgacgaatatgtcactctgtctactgcagaacacagcttagaaatactgaactgccaacatgatcgaataattcaatgcttcctttaatttaacctccattgcaaatgatttgcttattagtgatgccggggtttgcactataatgtgaagtagtagtaatttgcctctcttcttttattcttgtcagactgagtactctgctcccataatcctatttatccacacagcgaggggcactgcaagaagcatgcagtgcccaatggacgcagctgcaagtggaacttcgcctgtgatgcagttccatggcattgttgatgagccaccctcccattcatctccgctgcacacggcgctggaacgttcgcagcgccattgctatggtcatgaaaccccaggagaattcccccttgctgtgagcccctccattgtgctacatgtgctctccacctgcgagctagatcctaaagatctcgctgcactggaggcaagttctacagctatgctctctctgtctcaatgctttagcaggagctgctgctactgatgagcttctcatatgtctgtcgtttcaggctacatgtacattcttcagtaaacctgcaaatttcgagccaaactttgctctatcgcttccagaggttgcggcatttgatatgtgccataaaagacccatggttaagctaatggcacagcaggaacgggagcaactgaagcagaggtgtggtggatcttggaagcttgttttcaagtatattgtggctagagaaaggaattactctcggattgtcgccgggccgggccatagtattgttgtcaccacaaagggagatgcatactcatttggggctaattgctggggccagcttggccttggggatactgaagatcggttcaagccatgccttattaggtaatgtgttgatattgataaaatatatgattgtttaccaatgtagtaaaacgttcaccttcttgttaggtctttgcaaagcatcaaaatcacacaggctgcagttggatcaaggcagacaatgcttgtgagtgacacaggaagtgtctatgcatttgggaagggtagctttgtgtgggaagagctttctgatgcagctgatcacattaccactcctaagatagtggagtcgctaaagggtgtgtttgtagttcaagcagccattggtggttacttctctgcgtttctatctagagagggtcaggtttacacgatctcgtgggggcgaaccgagaggcttggccatagttcggatccttcagatgttgagcctcgtcttctctctggaccacttgagggtgttcttgttgcacagatttctgctgggaattgctatctccttatgttggcctaccagccaactggaatgtaagtttttgctcttgcgccaacttttcatttattcttgaatgataatctttgaaacaaatttgagtgcttggtatttggagcttctcttgagacgattaacagtgctaactactttgcaggtcagtgtattctgtaggctgtggtttaggaggcaagcttggtcacggatgcaaaaacaataagggcacccccaagttgattgaacatttcctgacattgagctttaatccggtttcagttgcggctggcacttggcatgct

SEQ ID NO: 84617 - DNA, 2087 bp, Oryza sativa
attaggggacgaagggagtagcatatatgaaataattatttcttttcccaattcctacctcctcttcagctgcttccagtcctccttgtacccagaataaattttggaaaccagcaccatagagttgctcacaagcggccaatgatctgaccgaattacgggcaaaagtgaacacaactaataaaattacacatccatgaagggcaacacaagaatgcattactgaattgactttctcaaaaggtaaacaacgcgataaagtattgatatgcaattatgcatatcaaattcagcattgataagatagtgaattacctcagtcccttctggcaaactactatgatatctgtatctttagaaaacttctcctcaacttgttgtacaaagttcctagcaatttgatctacgatcagtcaatcttactgttctgaaaatagcagatgaaagttctaaattcagtagatgttgagcgtacttgttaactgtcattgttgagctgccactccaccagccacctagggaagtcatgggagttcgatcatttggatgtcccgaattgtaggaggggtgatgtaagagttgaaaaataaattcacaggctcacagaggatagaacactaacataaaacagaaagctacacatgccttggttcaagtaattgtgtttcatgaactactactgtggttagtatgatggtaatctaaaagacgtatgtaaactggtcaaacagcccagagaaaatcatcattgcattatccattctagagtgtacacatggaaaacattccatgttacaatctcctgtgcttagtttaatgatgaacaatgagaacaaggtttgtaaagaaagcattcaagaacaagagattgacagtcaggtttgcatatggtgaccctgtttagcatacccatcacatagttggtgaatttcttgccggcgccacccaaatcaaacgatgtatccacatcaaatacaggaatccaggtagagcctttcacccaggcctaaaatgcgccaattcaaatacaatcaaggacaacgaaaaacaatcccattccgcaataatcaaacacccctttactttaagagtcttgacaggcagcgagacacaaccttttgacgctcattcgagggcctaacatcaaggaggaccttgtcagtgagcttgaatgtatagccagcttccctgggtgtaagagtcttgatcttctgctccctaatcttcaggcagagcatcattcccacacacacatgaacagcagaagatcagcatttcaatagccatagatcacgcaagatgatactgaattgaaacccaaatgtgggggaaatcgtaagaagaatttgcaggcagggagggttagggtaaggtgaagggacacaccagagtctcccatcgcctccgggcggcggccatctccttggccagcttcacctcctcgtcctcgccctcctgctcccctcccacggccgctcccatcctcaccactccactccacctctgcacccaagaaaccactcacacagttgcagtcaccgctcagtggaaatgagagcaaaggagaaggggaggaaagccaagaaaggaaaatggccgcacctttgaaggaaggagacgagggcggaggcgcctggagcggcaggaagaggaccacgccgcggccggggtggcggcgccggcgccggatacgcggcgcgcgaggccgagaggtgacggtggcgcggccatgtctgtgagatggccgtgttctttcagaacggaggttttttttagcttctagccgtagctttatccccccaatccagttccctgccctgcaattggatgatgggggtgcaactccagacttgtgggaccctcgacagcgctaagccagattgcgatgtagtggtattttctcagtcccaaaatagatcaacgtataaatacgaaaggtgaatctaaaatgaccttttttaaaaaatgaacacgtgataaatgtttatttttcacaaaaataagctacctttttaaaatgggaatgctatgagacggctgccatttgtatcatgtcctaactgatatcaggcgacacctactaggta

SEQ ID NO: 84618 - DNA, 2561 bp, Oryza sativa
tcattcatgatttaattttggtctaagtgtgttacttttatgtgatatgcatgaatctggacattgggcattagcagtaatgcttaaacgtataattgtggctatccatggcgcacaaaaaaaaaaggatgcacgcattgattccatgattttgttataaaaaaagttaacatgtttaataccgcatacagagaacatatatcagttttcaaatattgatctatatttctatttacatagattgtacagaagaaatatttataaatttatatgagtatttgtgattttgtgtaccatgaaatgttatattaagccaaaaggacatctgatttccttgaatacatgggaggatgaactaaatgtgcttagaaaagtttcttaattaacataataaaaatctgccatactaggcaaagtgcatgcatggcaattacccttgatcaatggatggttcggatttaatactcatcttacctcatagcagctaagtggagcaccctaaaattgctcatataagtttagtagtctaatcctttttcttctattgaattaaaattcaggccctctttctattgataggtgtactttcagggtcatcctggactaatttaaacatttcaatgtacgaattttagattacacgggactacgggaggatgctaagtgttctatggtactcagcatgcatgatttgatgcatgatcttgctagatgtgttatgggtgatgagctacttctaatggataatggaaaggaatacaactctggagaaggcaattgtcggtatgcattactaatcaattgtgtcgggcaaacaaagttctcctattcatctactaaattaagagctatgcgttttttcaactgtgatggaattcagctacccttatttacaaaatctttgcgtgtcttggacataagtaagtgttcttgtggaaaattaccttcatctattgggaaattgaagcaattgaagttccttagtgctactggcatgcaacataaaacaattcccaagcatgttatgaaactttcaaaacttatttatttgaacataaatgggtctttgaacatttcaacattgccaacatcagtgaacaaactgagatgcttgctacacctggacctatctggttgtagtaacctttgttcattgccaaactcattcggtgacctgacaaatctcttgcatttgaacctagcaaattgttatgatcttcatagtttgcccaagtcttttcataggctaggtgaactccagtatctaaacttgtcacgctgtttatcattaaatttaatggttgacatcaatgctgtgtgctgccttacaaagctacagtacttaaacctgtctcgttgctcaagtctcatccacctacctgaaacaattaggggtctaaaagatctccacactttagatatctcaggatgtcaatggatagagatatttccgaaaagcatttgtgagatcaccagcctcaaatttctgctaatacaaggatgctcaccctggttagagaagcgtgtgagggagtctcagttcaagaatgatatgctagcattgcccaagtttattgttcaaagagcagcttttggcatgtgtagcaatatttcgcggcttcaatctgtacatcctgctgagctagaaattgaatgccttgagaatgtaacaagtatcggagaagtggatgttgtaaacttgacgtataaatcagcactatcaaaattggcattggcatggactcctgcagctgagcgttttgtggaggatgaagatttgctgcggaagttacaacctcctgacactctaaaagttctccagatacaaggctacatggcgacatcatttgctagctggatgatgaacttggcatcacgtctgccttatctagtccgaattgagatggtagatttaccaaggtgtgaatatttaccaccatttggtcaattacaacatctggaactgttgattcttaggagaatccttagcctcaggaaactgggaggagaaatttgtggtggtaatggagcattcaggaaattgagggaatttacattggtaaagatggataacctaaatgagtggatcaccaaagtatcggctaatggtgaattcatgttccccagtcttcacaagctggaaatttctcagtgtcctattttaaggttaaatccatgccttcctagagctcttgaatggagaatagaagcaagcgatcaaattatagcagatttctatcacacaggctcgtcatcgtctttggtactatcgaaaatgcatattagaagctgccgcctgctgcccaatgactggaaactgcttcagttccttcctgatcttcaggtgttggaacttacacactgttggttttacgaattgccaaagagcattgggtacctgacgacactccgatcactgcggatagatggctgcgatagcatgacgaaactatcaaaatggttggtcagtctgtcattgctacatgaattaattattactggttgtttgaatctggtatatttgccggcatttgtacaaaagcttagtgccttgagaaatt

SEQ ID NO: 84619 - DNA, 2881 bp, Oryza sativa
cctgcagccctgtggctctttttatttctgcaatatagaccaaatgattttacatgctgtacaaatatgatgttgtgaacctgccaacctggtttcaacaccagttgtgtttttaagttgtcaatgaacacattgtaatttttacttaagtggttgggtatagtgttagaattggttgtgttttgcaaactttcaggccttcatgtggttggtattcctgtatagctcaacactagtacaattaaagattatcggagctactccttaaatgttccgtgatttgctatgtcatcaaaatgtaatttccgagcacccgaggcatcttgataaagtctaggtaaaggacttatatattacactagaaaatctccatgtatattatcatcaacggttgcttaaaaaagctctattgaaaattgaaatcattcaggcttcacatgtagctggtagatgcggcttggtagcattttcaacgagttgacagatgtgtgggtgtaggagaccagacatcggctcggctccagagttgggctcaggctgcagcgtgctattggacacgcatcattattctacgcagtgttgcacaggctgtggcgtgcggcactgccgcggagaatttttttccttcatgaacaagacaataacatgctaatgcagaaaataaagtcgttttgtggccaaatttgcgaggacgagatagctgcaatgcactctggcgtgcactagaagcaagcctggtttctgcaataacccgaacgtgtagtggcatttaccagaagtactagacgcataatgaaatcatcaaatcatctcttactagttactgtttactactactgattgtcacctggtgctctcgctgctactacgatcccatcaatccatgatagattgaagagcttcatgaatcaggccacgagaaaaaaaaaaaactaacaaggcgacaggcgaattcacccgaaacctaatccccaaccacctctcgcacaacccgccgcgatgggcggccgcagcggagaccaaatctggcacgatcccgaaaccccccaacacgcgcgatcgaacaggagcagcaggggaggagatcagccgggtggggacgggggcgcacctgctgctggaactgcgcgagcttccggcgctgcgtcttgagggtgaggatggccctgtccacgtccgtcaccttgggcttcttcacgaagatgttccccatggccgcgtgctgctgctacctacccggcgccctcttcttccttccgacgcggcggcggcggagatggccggagaggggaggtggaaggggagggggaaaggtggactctcgaggtcgaggaggagacgggcacggtaaccgtaagctggggaagtcgggaagggaggtttggggatgatgtggatcgggttgggtgtgcgactcaaagcggatcggatctggatttgttgttagtgggctagcgctcaaagcccaggagagatgggaggcccatttctcagatcgacgttgggccgcctggtacgccgatgctgtcgcaaaaggaacgaagagatattatttaactattttgcttgtaactgaaaccacgtgccatagatataagacggtatacaccgtgagagatactccctccgtcccataaataacgaatctagaaccgaatatgacatattttaatacgatgaatctagacatatgtatgtctagattcgtagtactaagatatatcacatccggtactaagttggtttttatgtgaccgagggagtaataaatagttaaacgtaaatgtcaccaaaatgactgttactaataaccccatccataatttttttcacctaacatagcaatgcaaaactaaaaaactaaaataccactattttattaaatcctatgcaactatatccaattttatttactcccaatacaattattatctactttcacaaactttgatgtgaaaataaacttttttaaaaacacagcacgaacgcaaacgcttacaacgcgcgtatactcacccgtataaacgtgaacacacactttatccctatgagcttctccagaggactggacatatattttttgagattaaagaagccaccacatccatctcgctatcgacggttacgtcatctaccattgaaaaaataattagccttaagtctaatacttaaatttggatgggttggtttcctcgcaataaacctaaccagttgagctacgctcactttgcaacataaaatttattttagaataggttgaacaagcttgttattacgggactgagggagtactaattactgtcaataaataatttgggcacagtagattttatcatatctttcaatctttcatcacaatatatataaataaaatggattggccaaagtagcatctctcgctcacgttgctccagcctaggggcaacgcgagcgccccccgcgcaccgaccaccgccataccttcctcctcccctctagctcgccatcgctcgagtggcccaccggaaagccatctggccgcaaggacggcggcagcggggcttcttcttcaccaaaacagcgtcagctggggcacccggcacccatggtaaaggcggctagatccagcaagggcacgccggcgcccacagtggaggcggccggatctggcaaaggcacgtcggcggacgtcgtggcagcccctacaaggagtcgaaggtcgtcgagatggccgcaagcgaacggtaggcaacgttgagtaggccatgggcgacggtggccggcggcggcatggacgacgacgggccttcggcggcggtggtggaggacgcgggtccggcacggccgtgcccggatctggccgtcccgtggctgattccaacgctcccgcgatggcggcacg

SEQ ID NO: 84620 - DNA, 727 bp, Oryza sativa
tcgcacataatttctccgcacaaaatgacttatctttttgttgagaaaaatgaaaagtttattctacttgggtagtagtactatggtggctgatctttttttttctcccttttagcggttcatgagagacgcgcacgaattgatgattagttgcttggttggatgaataatttgcagtttacaaagtgtggagaaaggttccagtttgagatgaacacggaatgtgtcggaactggaattggatggattgtttatagggcagcaaccagctaccaagtgattgctaatcaagctactcaattccattcctttcatttcaatgattgagcaataaccatatgccgaataattttgtaaaaatggagcagaaagtgcgagacaaatacacacccaatccatttgttcttcgattctttttccctcaaccacctcacatcaccattattgttacactattccttttccaccacttatcctcccgtttgcaattaaaaagaataaaaagggaaaaacaattgcgagaagagaacagcataataataacatccacaccttcaattcccaatttttttctccatttcttgctaaaacagtagattttttttttaattttgtttgcctctcagaacctaacgatcttggccgcgcgcaccaccgggttgtccctggcgatggcgtccctcgccgccgacttgtagtcgtagctgcagccgtggcggtcggagta

SEQ ID NO: 84621 - DNA, 589 bp, Oryza sativa
aggtcatttcgttaatttcaaaatacgtcgatctaatcatttgaagatgcttataagtgttaaaatgttgtgggcgtctatccaaaatgtcgacacacttcacactacactagcccaagatagccacgaaccggagaaagaagaagatatttatcgcgaggttggctacctgtgacgtggccgtggaaggcgcagtcggtgggggagttgtcctcgtcgagatacaggctcccgcaccgcaggcatcgcttcctatccttctcctcgctccgactgccctgctccaccgcagccgctgctgccgcggccgcgccgtcgcctggagacgcgccgatccgcgccgtcgcaggccgacacggcggtgccgcggcgttccggtggcgagacggcccgcgcggcggcagtaccggcaccgtgcgggttggtgcgagagctgggctcgccgccatggcgtgatgaggcgacgggattggcatcttgtgctaatggagctcgcactccacacgcacacacagacattcccgctgagaattgctgcctcttttcaggttgcggctggggggtaatgggccaaatacaaacggcccaa

SEQ ID NO: 84622 - DNA, 560 bp, Oryza sativa
ttccgcggttgtcgtcggctccctccctcaagcgagaaaagcaagaagcgcgctgcctccgccaaggctgccgacgaggcctccaccaaccgcacccgcgctacctcccgacgccaacccctccgctggatccccattgctgtatcgttctcctcggtgaggtggggacttctctagggtttggggattaggggatttatagggttcctctgccctccctgcgtataggaacgaatcagaatttggtttttctttatttttttctttacttcatgcgatgggattttgcatggtggttctgctccagatctggaagcttcaatggcatgggtatcatgtgagaagctccttgctggtggatgccccttgttcttctgttccagatgtacaagctacagggcgacacgagctcctgctccctgcactccataggttagcctgcatcgacgaggaatacttgaggacgccaggggtgaagaagggtgtagcctttgggagccttgccgccagatccgccgtatccagcggccccgcgcgtccccgacatccctcttgccgtg

SEQ ID NO: 84623 - DNA, 700 bp, Oryza sativa
aattcctgcagcccatctgtcacacatccaagaaatagcactaccacttaatatgctgcatggtccattgccatctgaccttggcaacttcattcctaaccttcagcaactttacttgggtggtaacatgttgggaggtcatatccctgattcattgggcaatgcaactgaactgcagtggctagacctatcatataaccaagggtttactggccgaatccctccttctcttggtaaactccggaagatcgaaaagcttggtcttgacatgaacaatcttgaagcaagagacagttggggatgggaattcctagatgcattgagcaactgcacgcgtcttaagatgctctcactgcaccaaaatctactgcaaggtgtcctgccgaattctgttggcaacctctcctctagcatggacaaccttgtgttgagtaacaacatgctttcagggttagtgccctcgagcataggaaatcttcataggttaactaagtttggattggatttcaacagttttactggtccgattgaagggtggattggaagcatggtaaatttacaggctttatacctagacagcaacaacttcactgggaacattccagatgccattggcaacacctcccagatgtcagaattgtttctttcaaacaatcaattccatggtctcataccatccagcctaagaaaacttcgacag

SEQ ID NO: 84624 - DNA, 1539 bp, Oryza sativa
ttttaaagttaagtttctctatttttgcctcataaattgaatcatcagtgaaagaatgccaacattgggttaccaggcgtaagcacctgagatagagtaacagatatcataatgtggagaaggcacctctgttatgctgtttatatacaaggatttgtaggtacaaactgaccttaacagatactgtgcgcaatgcacacctacatctttagatatcagataatcaacaagcaccaagtgatcatagtgcagctgcagaatgacattaaaataaacaaatactattatcctcaagactcatattgtagagtggaatcagaagaagaaattggaaatctacagaaaagtaatggtgcatgagccagcaaatgcatgagactttattaagtttgtaatgtccctttacacattgtataaccctccatatgattgtctgaacttgaaagaacatggaacataaataagagtgtcttatttatttttttttgagtacaagctacggtaagaaggaatccgcaaccaaataaatagtaaaggatgcccccctatcttaaacagttttgaacactgctgattactaaagcttgctactatatttttactacatacagcagtatgcctgtgcagagaaatgaacaagaactgaaatttaaaatgccaccaatccaccatgcagagagttgtgcttcttataaacctagtgacatgaagtaaaagtattttcactgactcaccaataaaagcaagagatggaaaacatgaactgggtcaaaaatgctcgagaacagtttgccaccaatcagttcagaagcccatctattctccatgctatctctgcaagttcagaaaaaaaaagagcataacttttaactacacccagatctggataactttctaagacaaactgctttactctttgcttacattttcgaggaaatgagtggagcatcaagaagttgtaagagaacgttgaacagcatgtcatcctaaagtataaaggaacagatcagtattatgttaacacttaacactaggaaaattaacaaacttagctgacaaataacttaagcatctagatgaattggtttggaaaaacagaaagtgcagagaagacaaatacaactggaataaaagcattagcacctctctgtaataactaacatgccttttcactggggcttatgccaaacataacaggcaactctatagtagtgtagagtaatataaatgtatgagaaatatcctactgtaaggaaacaaattatgtccacaacaacccacttccgaagacaactacagcatacttgcaactactgccaaatccaagttaccaaaaactacttaaacaaaaccaacaagatgaaacatattttctaccttgaacattgatcaaggttaattagctaccaggcaattgtaacagatgcatacctcctccatatataactgcagaaagcacagagcattgtctgtagatgatttgaagccaaaaatcttatctaagaaacatctctgaaaccagtctgaaatttctgataa

SEQ ID NO: 84625 - DNA, 731 bp, Oryza sativa
catgtgatatacgtcttaagtgcgctacagaggatatacaatgatttgaggtgatatattacttatttaatttttcataatgctttgtttcttctatttggttatgatgcataaaggataggtgtgcaagctcaggtggtgtttatttttatacagtgaaatatgaataatatagatcttaaattatttatttaattatgaatacattaacaattcaaataaacttttaaaaatcatatatgacgtaagaatcataattatttagcttttgtaattattgattatttttatattatgttgttaattagttaaaaattataagacggaagagttgagcgagagaaaagaagaagagaaagtacgcacacatataattatgttttatacattttatagtgtttatttatatgttatagttagctataaatttagtcataaataaattgaaagatatgagcggattgaaaattagtagtataggccgtgtttagttctttggccaaaacttttttgaagtatacgggcacacatttgaagtattaaacgtagactaataaaaaacaaattatagattccgcatgtaaactgcgagacgaatttattaagcgtaattaatctgccattagcaaatgtttactgtagcatcacattctcaaatcatggcgcaaccaggctcgaaagattcgtctcgcaatttacatgcaaactgtacaattagttcttttcatcca

SEQ ID NO: 84626 - DNA, 530 bp, Oryza sativa
ttttatgagtttgccaatgtgtttatcaagggggagattgtaaaatcaaaggtgtttttgattattattttgtgatgaacaattgggcattgaaagttattggttttgttatttggaatttattcacgaagtggttttggagatgattggatttacaggtagccgatccccgctgtcgccgtcgtcgcactcacccgccgccagctgccgatgttgctgccggcgttgctgctgatgttgctgtcgacgacgaagcggtagtggacgtcgttgcgctcgagccccacgccaccgagccccaggatgccgccgcggagccccggcaacatcagcccgaagtgcttcagtgggctgtacaccgtcacgccggcgcatagtagcggcgccgcctgctccggcgctagcctcgccgggattttcaccacggcttcacggcgacgacgcgggcgcggccatggacgacctggcgctgctgccatcggcttcacggcgacgagcgctacaaggaaaccccgtccctctgctccgcc

SEQ ID NO: 84627 - DNA, 543 bp, Oryza sativa
cagctggatccgacattagaggaagttaagaagctatgtaatacttgccgtaaatttgctagaacagagagagtcctttttcattacaatggtcatggtgtaccaaagcctacagctaatggggagatttgggtatttaacaaggtgaatgttgcaaagacactgcataagctgctgcattgtttatccatgtgtgtttttgacgaagtgccctttttttactttttgtgcagagttacacacaatatattccgcttcccattactgatcttgattcatggctgaaaacaccttctatatatgtttttgactgctcagcagctggaatgattgtgaaagcttttctggaggtatggtatagttccttctaatttttatacgtacgccagatacttgaagttgaaagtgataatgatgatttcctatctgtttctattgttagactgtttaatatattcactatgactactcatgttcactttagcgcctagactggagttctagctcgtctgcatcttcatcgaaggactgcattctccttgc

SEQ ID NO: 84628 - DNA, 612 bp, Oryza sativa
taacctctgcagagggggtacactttacccacacgacattactaacccggatcacccagcccgtggggatcaaccacgtcgggagacctccaagctttcatgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaaatcggtccttaagtgcgagagcgggaaaccgtacacccggtacgttccccggtccgtggttttggaaattcatttagttcgcaagcaccgacccaggtgtcgggttttccaagtcttttgtaaaactccagttttacccaagttgtcactcagattttaagtttgaaggcgaccgtcgatactcgcacagagtgcacgaatatcgaggcgcaactgggtggttacaaggggacatggtataacaattaacaaaggaaggatcaa

SEQ ID NO: 84629 - DNA, 797 bp, Oryza sativa
gattaattaactgaagatatagcttggaatgttctcacagccaattgacaaggtatttggacttgccttaacaaactagccgtgcttgcccccgacattatatttgcacatcttcttctgtgcacaggtgaacaaaattctctgccagagtcaatacctgacaaaaacaagcaaaggccaacccacacttgagcacaaatgttagcattacaaatctcgtcgatccctaccctagggtagttctcttttagaacaataaaaatggtttaaatgtccggcctatctgacatatggatacctgcaagataagctccatggacatagccattgtagcgctcgctcgtgtgctcaccggtgaagtacactctcccaaccggcgccttgtgcacagaaacagcaaaaaatacacacaaccaaaattaatctcaaatccaaaccgcatcaatttgtgaattgtgattagcatttggttggagtagtagttcgtaccctgagctggtcatactcgtagcgactgacgccgatgggccagttggagaagctgccccggaagaacctgtcggaccaccatctcgggacgaggatgtcggtggcgtcggggacatactcgtcagggaacatgcacctcacaacctccatgatctctgccttggtctggctgtaccgctgctgctcgatccgcctcgactcctcgtcggtcaccgtcaccaggagcacattggcatccgggtattgcttctcaaactcctgaagaatgttcagatcatcgcaatgtactacaattcgatgtgagtgga

SEQ ID NO: 84630 - DNA, 801 bp, Oryza sativa
ttaaataaaacgaatggtcaaaagttacaaccaaaactcaaaataacaagtattttgagatgggggagtactaatctggtgtcacatgccaaaggttggtttattttaatacatatggagtaactgccctaatcagaatcactaccatttttccaacaaaaattctgcacggctccgaggcaacctgcaccagcatctggcaatcgcaagctcaccaaataattaacaaaacattactgcgagaagagattctaaacaactcagtaggcaccaaacgcacgagcacggaggactaaaagcaccagtgttaacttactttttggtactgaatactgatagctatacactacaggctaattctattaaggttgtgtttagatccaagggtgaaaattctattaaggttgtgtttagttaaagggtgaaaagttttgacgtgttacatcggatatacggacacacatttgaagtattaaatgtggactaataacaaaacaaattacagattccgtctgttaactgcgagacgaatttattaagtctaattaatctgttattagcaaatatttactgtggcaccacattatcaaatcatggagtaattaggcttagaagatttgtctagcaatttacacgcaatctgtgtaattagttattttttttcgtttatatttaatactctatacatgtgtccaaacattcgatgtgatagggtggaaaattttgctaggggatctaaacaagccctcagttgagtaagttaaagtgaaaaaaaggttgttgcaatattgtcaacaccta

SEQ ID NO: 84631 - DNA, 926 bp, Oryza sativa
agggagtattaccaattcattgccagatcaagaacattatttcacagctttggtttaatatgtcaactgcaaataattgaaacaaataagtaccaagagtcaagaagtatacccccaagacaatgggcagctacactagtttgttgatgatttagaagctttctggatctccaaagttatcgcctcagcaagatcagatgcctcatactctgctccaaagcatcgtgctgtctccaagcatggatctagcaagtacctgtatatttatacagtcaagtgcctgacacattacaacaaggcaagctatatagaataataccgtgcgtgcttacatgttatgagagctttctacaagatagtcctgaccaatgtcatcaacctttttgaagaaaacacggtattcctgtgcaatctgtcttactgcattgatggatcccgttagtcctattattcttgggtcaaactctgccgttcaaagaaacaaactaatcattcccaaatacagtgaatttgaaggttccaatagcatgaaaaatagagagcaacttaccactaagatatgccttaagctgagcaggtgaatcacgttgaggatcaattgtgataaagagtggtgtaatcttggtgccatattttgactctatgaaacgacaaattaagaactgtaagaaaaggaagatcacaaatgtaatacaaacaacagagttcagataaatctaattattataaggaaattatagcatacataaaaattaatattttatagggagaactactaccaatttaaaaagcccagctaacagaatctacatcagtgaaagctcaatgctttcgtgactctcagtaagccacgtaagcagataatctccagccatttgatgcaaacagaaggaaatataaaccgccagattggacaaagacactag

SEQ ID NO: 84632 - DNA, 881 bp, Oryza sativa
aaccaattttcggattcggaaaaattcggtcggaactatccggaacttttcggattcggaaaccaattcggattttttttctcggatacgaaaacgaatacagtaagggtgatatccgatggaaacgtaaactgtcggaaactatctgggatttttcatcggatatccgatattttagcaaaagagagatttttcagccaaaaaaataaaaaaaccctaaaaccctagccggccgccttcgcgccgcccactgccagccgccgcatggcgggcgatagatccgcgccgctgcggccgcctgccgctggccgtcgcggggctgagcgccgaacacctccgtaggacggcagatccggcccctcccgagggcggcgccgctggatccgccgcctgccgctgtcgcccaccgacgctgtcgccgcgcatcgaagccgtcgccgtagtcgagcccgctgccgccgcccatcgccgtgacccggccgccccaaggccggcgccaccggattcgctcatcaccgtcagttgcacgtcgtcgcctcgcgccgccgagccctcgccgtcgcctcacgacgtcggatcccgcggctccgggaccgccaaccctggatccagccaccacgaggctcgcgtcgccgttcgccgcacgccgtcgcctcgcgccgccacgccccagtcatcgccattgcctcacaacgtcagattgggccgctccggggccagcaccgtcgaatccgctcgccgccgtccgttgcacgccgtcgcctcgcgccgcggagcccacgacgtcggccaccccgaggccggcatcgccatccggcgcacgctgtcgtgggaggaagggtggcggctaggagagtgggactgtgggagtggccgggtag

SEQ ID NO: 84633 - DNA, 1235 bp, Oryza sativa
accttcaacacagccgaggaggcggcgctggcctacaaccaggcggcgtaccgcctccgcggcgacgcgggcggctcaacttccccgacaacgcgcctcccgcggcccgctccacgcctccgtcgacgccaagctccagacgctctgccagaacatcgccgccgccaagaacgccaagaagtcctctgtctccgcctccgccgccgcaacatcctccgcgcccaccagcaactgctcgtcgccgtcctccgacgacgcgtcgtcctgcctggagtccgccgactcgtcgccctccctgtcgccgtcctccgccgccaccacggccgagacgccggcgaccgtgccggagatgcagcagctcgacttcagcgaggcgccgtgggacgaggccgccgccttcgccctcaccaagtacccgtcctacgagatcgactgggactccctcctcgccgccaattaacaccaccaccacttcttggctagtactcacgccgtcgttagcctaatcgtcgccgccgccgccgccgtgcagatgggattttagacattttgcaccgcacggacgggcatggattagcagttttatagtccctaatccttttggtttggttcgtttgtgtacgtagatcgatctctctccggacttgtttcctctgtagatgctagggttggttggtgttcttcctcaaccggagacgccgatgctaccggcagccggcgtttttgtgtccggcgtgcgtctccggtgggccggtcacttggtcggttactccggccgtggcgtccattgctctttaagtctgttattaccttctactgctgatcttacaggttgtaaacagtagtagtagcattattattattattatgtcttgtaatattattagcgtgttataagaacttgtaatgtgaattacctctactactactattattattatttagcgtcgctgttaaaattgttgtgtgtaatctttttctgatttcaccttccacttgcgaagatctgcctgttgagttgcttgtgtgtgggggcaaagaaacacttcgctttccagaaaggagaagacgaacaaactcgtctgtctgactgtctctgcatcaacgtcactggatttcggctagcggatgcagatctcatctcaacggcgcgaagctttgggcgaagatgttcttcaatattttccgcttaattttctaccatgttaatccgaaagcgacgctacccgtggacc

SEQ ID NO: 84634 - DNA, 553 bp, Oryza sativa
gtgcttgtatgtcgatgacatactgatctttgggaccagccttaatgtgattgaggaggtcaaagactatctgtccaagagttttgaaatgaaggatttgggagaggctgatgttattcttacatcaaactacaaagaggagatgagggtgggattacacttgtgcaatcccactatgtggacaaggttttgagtcgctttggatatagtgactgcaagccagctcctactccttatgatcccagtatgctattaaggaaaaaccgaagaatagcaagggatcaactaagatactctcaaatcattggttcattgatgtacttggctagcgcaacgaggcctgacatctcatttgctgtaagcaagctgagccggtttgtctcaaatccgggagatgatcattggcaggctctggaaagagtaatgcgctatctaaagggcactatgagctatggaattcactataccgggtatccaaaagtactagaagggtatagtgactcaaactagatatctgatgctgatgagataaaagccacaagtggatatgtgt

SEQ ID NO: 84635 - DNA, 643 bp, Oryza sativa
aacccaggtatcatgtagtggccactctcgattatatggaagaatgagcaactgagtaactcgttaaggtactcctttcctacatcttccaatgtctgatcctctccaggtgttggaacaaggccttgtgccatccaagcaaatataagctcttgctcagtgaacttatagcctcttggaaatatggcacaataggtgaaacatcgctgcaagcttagagggagatgctgataactcaacaacaaaaccggcataacgtcgtcaggctcttgttttagttcccatatgtttctattcagaaacttgcaccaatgctcctcctcgtggttttccgaaaggaatctccccatggtcttggcagccaaggggttgccatacaacttgagagctattttcctgcctattcgagccaagctgtggtcctctgtgatgtttgtgcactgtaggaagaaagcccaaaattcattatcatgtaaaccgtgcagtgtcaaactgtcaaatgtgcccatggccttggcgatttttctctgtcgcgttgtaactaaaaccatgcttccagacatccccgcggagaagggaccacaaagcttctcccagtggctgctgacccacacatcatcaaggacaatcaagaacctcttcc

SEQ ID NO: 84636 - DNA, 643 bp, Oryza sativa
tacttgggaaattataggtcaaaaaataggttctatgcgacatatgagtagcttaaaaaaatgcataatagaaaaggaaagctaaaaaagatctccgaatttcctataaaaccagataatctagcttaatactaccacctaagtttgcaatcaggctgttcaaacaaatcagagaaacatgtgataactctagtgttgtgacactagcaagataatttaaaaatatataacttgcctgttctagtacagtgaagagcttcttagacttgtcggtagatcggtgaggcgaatagctgcaatatcaagtgctgccctccctgtgataggcacttctgcattctcatcaccatttgctgcagttgatttatctaggctagaaccaaaaccagaaatagaaaagttggttccaatcctggcaagagtagcccttaaagaagcttcaaaaactgaggttctgctagttaggcaatcagcaactgtaagaatctgcaaagcaccctggacaatagaccattcttcctcttcagagacatcgaccaatcgttgtgcttcttttttctctagtcctgcttcctttttagaggaatcactatgtgcagtattatccaccccacatacaatcctaagggattttaaagtttct

SEQ ID NO: 84637 - DNA, 543 bp, Oryza sativa
tacacagcttcaccccctatgcgtaataagctaaaggtgctcaagagatgtgctaacttacttgagccgggcccaggtaatacaatcttggaatgtctcacacttctctctctcgagacattcaataacgcgctcaagctgatccctagcctgtgcatcaccagcagttcttgctacagttgcatatccaccaggattcgataggaaggcatttacttcagtgggggtcttctcaagcaaaccctcaaactcagacctagcccaggttaggcaatgatcaatattatgaggaaatgaatgtacagtacacatcggcgcctgcttttcaggtggatctctggatgcgccatagttctctgttaggtgaggtatgaccatctgtgtgttacatttagcacccagagtcccagattccaagagtggcttctggaaatatacacatcgggagtcaatatacattcttgcggtaacattgtccaacgcattgacaacagcatccaggctctcccaaaaggcatcgttgaacacattttcagtctcagg

SEQ ID NO: 84638 - DNA, 5333 bp, Oryza sativa
tgtttcaggttggatacacccctgactacctcttcctcctccagaccattttacgtacggatccacaggtaatttattggttaagctattttgtgctagggtgaaatattctgctttgttctgtgggttgttgatttttatttgcaaaatttattatttactgtatatctcttttaccagggagctgtcaactttgcgctcatgatgtcacaaatggaggggggctgtccagttgattacaatactataactgatctcttccttcaggtatccttttaattcatttcaatgcatagtcggtatgtaatacctttgcttttttaccatgaaattcagttgtgtcttgccttaccatgcccattttttaacagagaaacatgatacgtgaggcaacagctttcctgctggatgttttaaagccaaacttgccggagcatgcttttcttcaaaccaaggttagcagttttttcccaataagttcggccttttacctttgcattgccatgttgctcagtggcttcttttacctttatactgttgtgttgctcagtagtttctgtttgaattgattgtaggttttggagatcaacttggtcacttacccaaatgttgctgatgccatccttgctaatggtatgttcagtcattatgatcgccctcgtgttgctcagctttgtgaaaaggctggcttgtacttgcgagctctccaggtcagtacctttttggtgttttggtttacttttttttttctttgcctgtctgtttaattaacattatattgtgatgcagcattacacagaattaccagatatcaagcgtgtcatggtgaatacccatgccattgagccacaggtttgttatcttaagttatgctttgttgcctgtctattattactggctggggtggtccatttacaccattattgaacaggcacttgttgagttctttggcactctttcaagagagtgggctttggagtgcatgaaggaccttctgctggtcaatctaagagggaatcttcaaattgttgtacaggtatttttgctacgtttagtttgaccttcccttttttgtcacttctcacattggttctgattattatcgaaacatgtgtcatatctgcaggctgccaaagaatactctgagcagctaggggttgatgcttgcataaaactgtttgagcaattcaaatcttacgagggcctttactttttcttgggagcttatttgagttccaggtagttaactacacctgatgttgatatgtgcgaagcaattttgtccttaacgtggcgcaccttaatatcgttctttacattcaacagtgaggatccagatattcatttcaaatacatagaagcagctgctaggactggacagatcaaagaagttgaacgtgtaaccagggaatccaacttttatgatgcggagaagacaaagaactttttaatggaagcgaaactgcctgatgcccgtccgctgattaatgtctgcgaccgctttggatttgttccagatttgacccactatctgtatacaaataatatgcttcggtatattgaaggctatgtacagaaagtatgcaactcttccaattcagtgttattggagtatcatcattctcatgtgctatgtatttaaatgcttattttcctttatattgtaggtgaaccctggaaatgctccattagttgttggacagctacttgatgatgagtgccctgaagatttcattaagggtttgattctgtctgtccgttctctccttcctgttgagccactagttgatgaatgcgagaagaggtatgattctttatattatcttgtattccacagccagcttaagggcatgtgcacatgcacacaaacatatgcttttttgtttcgttgctgatctcatcttttatatttcttttttcaggaaccgcctacggctgctgacacaatttttggagcacttagtgagcgagggtagccaagatgtccatgtgcacaatgctcttggaaaaatcatcattgacagcaacaataatcctgagcacttccttaccaccaatccattttatgactctcgcgtggtcggtaaatactgtgaaaagcgggatcctacccttgctgttgttgcttacagacgtggacagtgtgatgatgaacttattaatgtcaccaataaaaactcactgttcaagctgcaagctaggtatgcaaattgtttttattcttcataccttttaattttatttcttctgaatctttaaatccatctattgattgcttacatagaaatcgatttgaattgccaggtatgtggttgaaagaatggatggtgatctgtgggataaagttctacagcctgaaaattaattttaaagggcacttattgaccaagtgggttcttccggtttgccttaaaaccagaacccccagcaagtgtctgctggccgtcggctttcatgacagctgatcttccccatgaactgattgaacttcttgaaaagatcgtccttcaaaattctgctttcagtggaaacttcaatctgcagaaccttctcatcttgacagccatcaaggctgacccatctagggtcatggactatgtaacaggctggacaactttgatgggcctgctgttggagaagtagcagttgaagcacagctgtttgaggaggctttcgctatcttcaagaagttcaacttaaatgtgcaggctgtcaatgttctattggacaacatccgaagcatagaaagagctgaagagtttgcattccgtgttgaagaagatgctgtttggagccaggttgccaaggcccagttgcgtgaaggtttggttagtgaagcaattgagtccttcattcgtgcagatgatgcaacacatttcctcgacgtcatccgtgctgctgaggaagctaatgtatacgatgatctagttaagtacttgcttatggtaaggcagaaggcaagggaacccaaagttgatggagaactcatctttgcgtatgctaagattgatagactcagtgatattgaagagttcattctcatgccaaatgttgccaatcttcaaaatgttggtgatcgtctgtatgatgaagaactttatgaagcagcaaagatcatctatgccttcatctcaaactgggctaagctggctgttacccttgttaagctgaagcagttccaaggtgctgtggatgctgctcgcaaggctaacagtgctaaaacatggaaggaagtctgctttgcttgtgttgatgccgaggagttccggctagcacaaatatgtggtctcaatattattgtccaggtatatatacaggaccaacctgttagaactaaaacatatttcagtacaagtcttttcttatctagattttttctaacacccttttttttgtataggttgatgatttggaggaagtaagtgaatactaccagaacagaggatgtttcaatgaacttatttccctcatggaaagtggtctaggactggagcgtgctcacatgggcatcttcacagaattaggagtcctctatgctagatatcgccctgagaagctcatggaacatatcaaacttttctccacacgtctcaacattcctaagcttatccgtgcttgtgatgaacagcagcactggaaagagcttacttacctatacatccagtatgatgaatttgacaatgctgccaccactattatgaaccattctccggatgcatgggatcatatgcaatttaaggatgttgctgttaaagttgcaaatgttgagctatactacaaggcagtgcacttctatctgcaagagcatcctgatctcatcaatgaccttctcaatgtactcgcgcttcgtttggatcatacaagagtcgtggacataatgcgcaaggtttgttttttatggcagggccttctattggtctatcagttttgctccgtttcaaaattttgaactatttcattattctttgtacaggctggtcagttgcatcttgtgaaaccatacatggttgcagttcagagcaacaatgtctctgctgtgaatgaatctttgaatgagctttatgttgaagaggaggattatgagagactccgtgaatcggttgatatgcatgacaactttgatcagataggtcttgcccagaaggtaaagcgattagatgattgtactgcttattgatgttatttttccttttttttttattttgaataactaatggctggaatgccttgatcagcttgagaagcatgaattgcttgagatgaggaggatcgctgcctacatttacaagaaggctggcagatggaagcaatctattgccctgtcgaagaaagacaacatgtacaaggattgcatggagacatgctcacagtctggtgaccgcgagctgtcagaagatttgcttgtctatttcattgaacaggtttgatttaagcccataaatttctatcttatttttgggtggaatatttagcatgtagtatgctgcattaccttgtaacattgccatctcttctagttatatccaaaccatcctttttaatgctggttttaagggcattattttctggtcgatgatttttaaaaactaaccatgtagtgggggcgaatatgccttcagaaatccagtttctggagcattgccatctaaaaatagaccagctggactccaattgaagtgaaacaagccagctcacctgattttttattattatttaggcataatctgtattgcattctgatgagtaacatctataattggtattgcaaggaaagaaagaatgctttgcttcttgtctctttatttggtatgacttgatccgtgcggatgttgctcttgagcttgcatggatgaacaacatggtggactttgcattcccctatctgttacaggtatcttgtttccgttcatgtgtttgggactattcatttacgtacagttttccataacaacaaagcttgcttcatgtgcagttcattcgggagtacacaagcaaggttgatgagctagtgaaggacaggattgaatcacagaatgaagtaagggctaaagagaaggaagaaaaagatcttgttgctcagcaggtaatctatagagattgctcttcttttggttattattctgttattatttagtaggcagcatgacgagtggtattacattgtatggtgcagaacatgtatgcccaattgcttcctcttgccttgcctgctcctcctggtatgggcggtcctccaccgccaatggggatgccgggcatgcctccgatgggcggaatggggatgcctccgatgggtcctggacctatgccagcatatgggatgcctccaatgg

SEQ ID NO: 84639 - DNA, 585 bp, Oryza sativa
ttcgtttgctcggacagggtggcttgcagctgcgttggttcccatgccaatggcgttcttcctaatgtggaaattgcatgatgtaaacactctggtagcaggaacagcactaattggtctaagctcaggcttcatctttgctgcagcagtgtcagtgacctctgagctctttggaccaaacagcattggcatgaaccataacatcctcatcaccaacatccctcttggatcacttctctacggtcagattgctgccctagtgtatgatgcaaatggcctaaagatgtcagtaatagacaaccgcaatggcatggttgacactatggtggtttgcatggggccaaagtgctactcaaccacattctttgtgtggggttgtatcacattcctggggttggtgtcaagcataatcctattcttgagaacaagaacagcttacagtgctgctggtggtcagcaagttgtaaacaccttagcgaagtttcgacttgacagaactccttgatctgttccttactgctatgaaaccatggctactttgtacaagttttgattgagttctaggtgaactaggttagtagataa

SEQ ID NO: 84640 - DNA, 1558 bp, Oryza sativa
catcacatatatactgcagcatgtctttccgcagcaattatgctgattcttgactggtatgtcgggcttgtccatcttcagaaactctgcaggaaactcgtgcatattactgttggcttagtatacttccttatgtggcctttgttcaggtaaaccagatcgatcgagttccagaccaacaatatactagcagtatctttaattttgtcatgtcatagccataccaagtgtgtttctgccttcctgacaacgtactcttcctgatgcagtgcggatgatgtctatgctccatttcttgcttcccttgtcattgcattcaacatcataaaggttaccttgattggacttggtattgtcaaagatgatggcgtcattaactccatgaccaggaacggagaccgcaggtactcatctcatttcccccctttgacaagctagtgggcaaagaaagatttggcattcttacgcattactgcaataaaaataataataatcatagttgtgttgcttctaccacttgattcagtaatccctttttgtttccagagagcttcttaaaggtccactgtactacgcttgtgctataacactcgctactgtaattttctggaggacatctcccatttcaatcgcagtgatttgcaacttgtgtgccggagatggtacggccttagcttcatctaatctcctgcagttgaaaattttctgctgatactgacactgttctatcgattttggactgctcctttcattcaccgagtgaaaagtttcagacgtcaactgacttctctacactgcttctttcaggtgtagctgacatagctggaaggcgattcggacatgtaaagcttccttacaaccctgataagtcttatgctggatccattgcaatgttcttagctggtttccttgcatcaatcctgtaagtaacaagttggagtatctaataggctaccctacatttctattgaagtcttggtagctgttaatctgaaactgctggagtacttgctaggtacatgtgctacttccacctctttggatttgtcgaggagagctggagcatggtgatcgcctttggtgtgacatcgcttgctgctgcaattgtggagtcactccctatcagcacacgcctggacgacaatctgactgtgccactcgcctctgtcctcgttggtgtccttgttttctattatactggggccagaaacctgtgttgtatgagcgctgacagcagtgacatttctgcacttgtgcagaatcagatggtcttggacaggttctagtgactactgactagtaagtagctgccctgcagagctgaaaagaaactgatttactaatatcagatttgattaatgtaacaaggatcgatacaagctacaagcatcatagttgtatcttgtaatcaagaaaaacaaaagctatctgatatactagtaaggcaaaagttgagtagaggaaaaacataccagagagctgtctacactccaaactaaatgtctattctgtatatatggtggttgtgtgcaagctgccagcgctttttgttttccct

SEQ ID NO: 84641 - DNA, 636 bp, Oryza sativa
ccttggttgtctgacttgttatctggcatggtccaatcggccacgaagtcggcgagtacctgagatttgatggctgttcgcgacacaaagtggatatcaaattggcttagctcgactacccatttcgcgatgcggccgacaacgtctttgtttctcacaacttcgctgaggggaaggaggagacaactgtgactctgtgggcttgaaagtagtggcgtagcttccttgatgtcatgatgactgcgtagagcagtttttgaatctgtgggtatcttgtctttgcatcatggagagcttcgctgacgtaataaactggtcgatgtactttctctctctcgactacaatgacagtgctaacggaatatggcgtagcggcaatataaaggaataattcttcattaggttggggagcaacgagtacaggtgggtttgataggtagcgcttgagtgcaataaatgcctcttcggcttcccgtgtccatacaaatttgtcttgtttcttcaacaaagcgaagaaaggctgtcctcgttctcccatcctagtgacgaatctgcttaatgctgccatgtatccggttagcttttgcacctccttgagtcttgtgggcgacttcatgttctcgattgctttgatct

SEQ ID NO: 84642 - DNA, 716 bp, Oryza sativa
ctccacctcacggtatccaaaccaagagccatcttctcttttcaaattgaatgtgattgtagggcccattttcagaccttccacctaaaacataatacatagaaaagaatagataagtgcagagagctagcagaattcaagtgggcacttcagaatatcttattcataatggcttgttcttatatggatgacaaataatccaaaccaatggaagaaaagtaaataaagcagcagtaattcttaataagaagatagaaatataatgagatataacttagttatggaaccttggaatactgttgtccatatattgtgcaaacatttatctcattactgtgcttcaggtccagcattttgtttctcacataagtagcaagggatgtagtatgcctacaaaagaacatcagggtgtaaactatacatcatggatagggtgctaggacccaaactgtcttacgtaccgttcaattgcagaggtagtgagcatttcaatgatcttaaacccatgtcggagagaagctatgttcaagaacgagattgttccatcctctagaacctgttcgatattctttcttttttgaacaaagtcgatgtcagcaattgaagcagctacggttcctggaatttaataacaattccggaggtaagttaaaaaccaggatatagaaaatagattactcaaaaccaagtataacgagctgtgaccacaaacctcc

SEQ ID NO: 84643 - DNA, 1128 bp, Oryza sativa
cccgtctacggacgcaggctagaggtggccaaacgggcggcccggcccggcacggcacgggcacgggtccggcacggcccgtttcggcacggcccgttaggcacggctgatgaaacgggccgtgccgtgtcggcccacgtgccgagccgccggcccaagcacggcccgtggatggccgggccgtgcccgtgccggcacggcacgcccgcggcccacgggccgttcggggcacggcggcccgtgaaggcaggccgccagcccacagtgcatgcacagtgtttttttttttaaaaaaaggaaaggaaatgtataaggaaaaaaaaattaaaaatggaaataaaatgtttaaaaaaaagtaatgatttactaatgttaaaaaatgaaaaaatggtatttaaaaaatggaaataaaagttttttaaaaaagtaatgatttgctaatgttaaaaaaaagaaaaaatggtatttttttgttgtgttgaaaaatttaaaaatatagattgtgattcattattttgaaataatttaaaggtaaatccacacttgcgaaaatattgcaaaagaatttgttaaaaatagtaatgacctttattaatgtttatatcattacaggatacaatgatacatgctgcctcgttaaaaactttgtcatgtaaaaactcataggggaaaatgagaaaaccatgacaaagaaaagagtacagctcaaaggtcagaactacttctaacaaaattctactggggttggtctggatccaggtagagttgctcgaagtgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaact

SEQ ID NO: 84644 - DNA, 696 bp, Oryza sativa
aaatactggtgggttagtatgaagcgggagattgcggagttcgtagccctttgtgatgtgtgccagcgtgtcaaggcagagcaccaacgaccggccggacttctccaacctctccaagtaccagaatggaaatgggatgaaattgggatggattttatcactggacttccaaaaacccaaggtggatatgattctatatgggtagttgtggaccgactaaccatagtagctcggtttattcctgtgaagaccacctatggagggaacaaactagctgaactctatttcgctaggatcgtaagtctgcatggcgtccccaagaaaatcgtatctgatcggggaagtcagttcatctctcacttttggaagaagctccaagaagagttgggtacccgattaaatttcagcaccgcgtatcacccgcagacagatggtcaaaccgagcgtctaaaccagatcctcgaggatatgcttcgcgcatgtgtcctagatttcgggaaaacatgggataatagtctcccctatgccgagttctcctacaataacagctaccaagccagcatacaaatggcaccctatgaagcgttgtatggacgcaaatgtcggacaccgctattggggaccaagttggggaaagccaagtgttcgggaccgatatcctgagagaagccgaagctaaggtcagaaccatttggg

SEQ ID NO: 84645 - DNA, 743 bp, Oryza sativa
ccgcgcttttcccggccaccaaccatggccgccggccgccattcccgtcgccgttccgccctcccccgtggccggctccctcttttctcatataaaatgggatcctcatcccccgttctctcgttttagccccctcccgagcctccccgtggtccctagccatctccccgccgccctcctctctctcccacgccgccggccgcctccagccgcctgtgccgcctcgcccgcgcaccggccggccgtgccgtcgcctcctccagcgtcgcagccgcctcctcttccccggcgccacctccgatttgtggggaaatcgccggaacggtgcccccgccggcaaccagtggcattggtgccactgtactccctccagccggctcctgtacgtcgccggtgcgccgatcgacgccgccgtctcctccttcgacaccgcggcatcgcctccttccccggcatcacctcctcctcgcccgaagctcgccggagtggcctcgtcgtcggcgtccagtacctcccggtctccggtcggctcctgtacgtcgccggtacgccgatcgacgtcgccatctcctccgtcgacgtcgcagcgttgtcctcacctccagctgctcctcggtttcgccggaacaccgccgtgtcgccaccaacccctccacccgcctcgcccgagtccctccgccgcccgttcctcctcgcttgtttaccggtcagccgcggcaccaccacctccggcatcgcagcgg

SEQ ID NO: 84646 - DNA, 1277 bp, Oryza sativa
taaggcatgctctcgttgtggagaaatcggtcatgttgccagctcgtgtgccactacatgcgttcattgtgaggaagaccatccacccgataggtgtccaacgagcaggatcacttgtttcttttgtgaaggaactgatcatgtaccaaaagattgtcgattcagttttctgctgacgaagaagatggccaaccaacccgtcagttccaacggagagaagcatcaaggaaacacaaatcctcgccaagattacagtttcagcctaactccagtgccaggacagaggaaacaaaatgagaaaagaaaatgccgagtccgggaagatatctgttgcttcaattgtcaaggaatgggtcatttcgccgacaagtgcccaaaaccgagaaacgtagctgccagcacgtcagtccacgcaaacccccgcaatcagaagcttgctcctcaacgaattgtcatccatgcatcccgaagcagtcctatagcccgcgttgcaacagctccaattccaatgagtgcactaccacaaggtgtcaatgctcaatttcagccccagccaccagctgacaagacagaggccagtatctgcgttgtacctttggaagttccaatacagcagctgagaaatcaagtacaagatgaagaacccgagtgtaagaaagttattgtttgttacaactgcactgaagaagggcattactccaaaaactgtccccaaccaaggcaaaatcgacctccacattaccgccaatttacacgaagcagacattccaatcgtattgtggtcactggagcaaacgccgtacccgtaaggcctcgtgttaatcagaacccatagcagaaacaatgcaccaatgctcctcctgctgcacctgactcggcaataaatcatagcaaccattctctgcatcgacagcctcagcaaagaattgtcgtagatggaagaagttgtgtctctccccgacctactccaggccgagccaagagcaatcaacctccggagggcgataccaagcagaagaccgtcatccgcttcaaccagcaatcagaaggaagcttctcctgtgaatgatagcattatgtagtcctgtcacatcatcacagaaccaatcaaggatgcagtcactagaacaatgccagctatatctctccagaatcaaaatgagcagccatgtttgtggttttcagttcgctacttatcatggtgtaatcgaaagtttgcagcaaccatgtaatacataaatatattcatgtctataaacagtgagcttgctatgctt

SEQ ID NO: 84647 - DNA, 880 bp, Oryza sativa
gtcgccgtcgactcggggtgagccgtggaccgccgtttcgtttccccctttccctcccctctctcggccgctgctccgccgtgccggtggtcgccggcggcgaccatcggggcgagggcgctgcctcccgccggccgcgccgccgtggctgccttcgggcgcaccgagtggctgccgcgtggggcccggccgtcagccgcccgcgccctcgggtgcggctgacgcgtggggcccgcggcgccggtcggagtgagccgcgtgcacccggtccaccgtggaccgtgaggctgccgcgtgggccccactcccgtggacccggtccgcgcgcccctcccttcggctgatgcaataaatccaattttaaattaaaatttaaataaagaaattcgcaaatattcatttaaagagcatataaacttcaaatggctataacttggccatttgaactcggaattggaccgttcaagtctctaatttttccttaagaagtcaagaacccatttttgtgctttgttaatgctttttatatggagtttgttagagtaaaagccttttcttttccgttggtcgtgtagacgctgcagcttcggaggatccgctcttcgtggaagttgaagccggcatttgggaaagcgagcaaggcaagacacatcatccttgaacatattgaatcccaatttatgaaattattttgatttaaattattgcatcattgctttatttaaattcccgcgttatcactgttttatttagccatgcctatttacctttgttaatacattattattgttattgttattattaccttgttcaccctaggaaaataaaaaccccaactagtgggtactctactcctggttccactagtatgaatttaggt

SEQ ID NO: 84648 - DNA, 739 bp, Oryza sativa
gatcgaccatcgtgaactatcattaagccatcatgaaataatagtaaatcattagttatcccataagtgtactaatgtttctaagcagggctaagcaattatatctaatatctagttgaaccaatataaataaagctcaactagtcaaattaatataacccaaggtatcaaggaataaggtaatcaatgtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttctttcgcgaaaacggactctccggaaacgacggaatctaagcaaaaagaagcaaaatcaccaaaacagcacataaacaagcatgaacagtacatgtggatatttttaatgtgtagatcttaattttagaaaaatttagagacttgaaccaactaaatcggagctaagatgaattagttatgaatttttaaagattaaatcggattaaacacttaaatcgattaaaattgaattatgacgcaataatgaattatttttgaaaaggaaaaagggattattgcgtcagcgggctagggtttggtggaccgggcgcacgggcggcggttcacacgaacggacggccgagattgatccgatccaaatcggacggccgagatcgatcggg

SEQ ID NO: 84649 - DNA, 1069 bp, Oryza sativa
tttcacacaaatatcatcacataaccaactaggaccagtggaaccaccatgatttcttattccaaatgctctaagattagaaggtggctgaagaccttcaataatctcagatccactattctgctgctctgcaccccaaactagttctagtgtctttagattccttttcaacatcaattcagcaccatttgcttcttccgttgttgctatattttcaagattatttatttgtagtgctcctccaagctctttcaaataccccaattctctaagttcaaacccagtgcgctctttcttaacatggaattcttgcagcctccgtaaatacttcatctttccaatcccacgaatattggaacaaagttcttttttggcaaggaaataatgtaaattggctagacgattaatgtcgtcaggcaaaatataattaccatggcctaggtccaaaaacttcatgtgataaaatctacatattgtggctggcaaagacatttctaagttatgaggtacttcaagctttaggtatcgaaggtgaatcagttttgaaaagttgaaagggaaagatttgatagagtttacaaacataaatagaacacgaaggcattttgttttttttgaatatatttttgaaaaatatagccatattgtcattgtatcgtccaaaaaacatcaaagtccgtaaattttctatgtctatttttctcttcaaattttccatttctctctcaaaactttggccatatttatgatgtacagtgatagatatatgtcgaatagattgtgggatgttatcagatctaaaactttgtggacttatatttagagaacttttacggtacattctactgtaagtatatacttgcagtatatagaaaggtaagtttggtatttgtgaaaaatatagaaagggctgtttagtaatttgaatttgagatttatttgcacccggagttaattctcggacgggttgtttagttggtattagttctggatctcgtagtacgttctgctagagcagcagcgcttctttgggaatacattgtgcgtggcggcgaaccgattgtcgacg

SEQ ID NO: 84650 - DNA, 1409 bp, Oryza sativa
tcaattgaagcttgttcgcaatatgagggtgcagagcgacgtgtggtttgcggactacctccttcgagttgggaatggcaccgaggaggtgaaacggatatttgcatgtcgtgcaaagagaatgaaacggacctcgaaaggctcatcgatactgtgttccccaacctaaacgataatcttacgaacccaaactacatcacatgtaggaccataatgtccacccggaatgagttcgtggatcgaattaacatgaaaatgattgggcggtttagaggagaggtggtgacatatcatagctttgatcgaccagaggatgacccttataactattacccgcctgaattcttgaactctctaactctaaatgggctacctccgcatgtgcttaagctgaagattaactgccccatcatgctattgaggaacattgacccagccaacggactttgcaatgggacaaggctggtggttcgtgagttcggaagaaatgctattgacgtagagattgtggtagggcagcatgctggtaagagagttttccttcctcggatacctcaatgtccttcggatgatgagatgttcccctttcgcttcaagaggaagcaatttctggttagattgagctttgcattgaccatcaataaggcgcagggacaaacaattccaaatgcaggcgtctatttaccagagtctgtcttctctcatggtcaactatacgtcacgttgtctagagcaacctctagaacaaacataaaaatactatcgatgccggtagaagacaagaaacaaaagaaaaagtctaagcgtactggcgtgaaggacaatgagaagaaaggaaagaaattgtctaaacagacagcagcatacacaaaaaatattgtgtatagagaggtcctcacagattagaaaaggtatattatgtgactattaaccatccataatatgcttgcttaaattccattctttctgtaatttttatattccaagtctaacatttcgtgtgtttttttcttggacagcagtaaacattactttcggtgggattttggcacggactatatgcaccattacgggtattgtgatactactttttttctggatgatattgatctggagcccttgcctcgcctgtaatccatctcctagggtggtcagcaaggaagagcaaaagagggtgcagtggccaagtgtagcagctttgctgctctcccctgctgtcgaccatccatctataccaggccactattagattcacatggacaaaaaaaaataggcaaattttgctacaggacatcgcgacttcgtgggtttagctgtaggacactgcacaaagtcacttttggggaaagacactctcaaaatgtggttatttgccaggggacaccgcaaccaataaaatattaatttct

SEQ ID NO: 84651 - DNA, 866 bp, Oryza sativa
ttatatttcacatctttggtgaatataatgatcttggaatatattttgtgcatagagtttacatctgctcggatttagaacctcctgtacatgtggataaaatatgcaagctagagaaaaatgttattgctaaccaaattgtctcgagtttgcctagttttgattggaagaaacaggttgttgtaaatggactacgcaaagagcaccatatggaaaaaccgaggacggttttccgtgaagaaggggaggatgatgtgaccatggctaccacggatgcaaccattgctcacatcatggatgaacaagaagatatcgagatcaagtactccaagtgctggaatccgattcggccacctactacactgctgatttcaaacggccaccgaatctgcatacgacctccgttttcggcccgggagtacttgatggaaagctctcggagccctctttctaacggatccagcctcttctctgaattctatctcgtgtggccagaatcacaggaacaaggtgttgcatcacctataatgggcctatgggcttgtaacttcatttgggaacccggcccaggtggggcccatgtggggtgcgccccaagctggtggagcacgacctaggcacccctaggtcgtcctcccacccctatatatagctagttaccccttcagggtttctcgggttttgttagattaaagtttagccattgctacttgcttgcagcgcgcgtgtcggctagaccgtccgtctgcttgttcttcggaaccccaacttatcatttgtattaaattcctatttgccatatcagattgcttttatcttgttcttgcttgtttcttcgatttgcttgcaggaatagggttgatctg

SEQ ID NO: 84652 - DNA, 1034 bp, Oryza sativa
aaaaggaaaaaaaaagaaggaagaaagaagaaagaaagaaaagaggaaatactattatgtttgagctaaacttcatatatcagagttgtgcatgagttgttcctagtgctatcttggggtattgtttgtgtctaggctcgcgtctctagtacgttctagcctaagaccagcacggtcttgactttgaacaattattcaactttgcattatctgatttgagcattggctattcctttgctacatattaaagcctacccagagctccacatatttgattacagccgtaccgcaagtgtttgccaaagcatcgatacatccaaccttcattggggtgcttggttgagtcggtgtatgtcaccattccacttgcattggtaagatcttgtaagagcttggttaaaagcttgagtgtgtgcgatttttgagctgccactacctagtagttaataggaacgcgcatatttttgtgtatgtttcttgttttctactaacaatggcagggatatgcaagataattggggatagctgtgctcaacatcgacatcttcgtcgagacacgaggagggatcaacatgaccattataaggtaagtgatgatgttctaggtaagatcaaatctgcactgccttatttcgagggaaactatgatcctcgtgcttacattaattgggagctagcggttgatagtgaatttcaaaagcatgtcttgtcggagaaacaaaaggttatgtgtgcctctagtgttttaattaaacatgcttctaatgattggaaacatctttgtaggcataacaaaataccacaatcttggaaagacctgaaacgatatttcagagatatttatgttcccatgtattatgctgacattttgttcaacaaactgcaatgtttaaaacaagataccagagctgttacttcatactatcatgatatgcaagcttgtttattacgtgtggtttagatgaatgcgaagaagctaaagaattgaggtttttatgtgggcttaacaaagaaattcaggacatgcttgattg

SEQ ID NO: 84653 - DNA, 1748 bp, Oryza sativa
catcagtatgctggctggtgtagggcatggttaaaggtttcccacgttttccgagctgtgaatatacttctattcagacgaattgcgaccagtcataattggcatcactatcagtctacaacctgctagacaacctctgtggtctgtgcatcagtattgtagaacacgctgaggcacataacagtttaatattttaatggagaacaaacgttattacaacaagattcacctttcccttgttcggaaggcaagttctatgcctagtcaaaacatagaaaattcaggtattagaacacatgaaagataactaggccctgaatgagcagaaagatgaacgggccaaggctagaatgggccctcgtgcacaacagatacaaagcattgagcatctctcttcttttgaggaaagctacagacatttcaaagttaagaactgttctctcaattagaagaaaaaaaaagcatgcaagaatttagctcaatactccgttcgtttttaaatgactgatagcaggcacgattcacttttgaactttgaccactagtatttttgttatatatttacaaacacaagaaatgatgccatgctattaaagtgtgttatgtcctaaatataagaatcaaacttttgttcaattaggtctaacaacttaagagcaaataatggtcaaagtttaaatgggaaagtcaaacatgtaaattatttagacacggagggagtaggagtaggctataaacgtatcaatagcaggttcacatatatcctccagtccccaagagaaaattgtcgtaccagcagtccccaagcattcctaacacagctccaagttgagaacacagttcttggttgtcttgtttagatttcaattcttccctgatgtcttgtgcacacatactgagccttgactttgcactttcaatgttctgtgcgcgaaaggcctggatatgtaaaagtcagaggtattatcaaaatatatatagagagcattaataaattaatacagagcagaggatgaaggatatatgcaaatttcaaaggtaaaagaagctgagcgtaactgaccctcatcgcttgctggaccagaaaagcccctctctccatggagacatcctcgtaaatgaccttggtcttgttgtcacttgcggcttccccatcgcctgcagcatgtgatctcttgattcgggcatggccatcaatgaagcggtcgacaaggccttgaagctcatcatcgggctcgatcccttggatgtcagcaccacacaatggacagtccttaaagcgcaatatgcatgccctgacaaggaaatccagtgttcagaaggtatatactattgacggacggaaggaattactagtagaaagctagtattgaaatatgatactacgcacttgcagaacttgtgggagcacggggtgcatttgctgctttgatgtagcagagcgtggcagaccatgcagctgagtgggccaagcttgaaggtgttggagtcatagccaaaggggcactttggtggcaccacacgaggatcggtgttagcattgccagttttttcattgtcgtcgtcgtcgtcgtcggtgtgattgatggtggttttgttgtctgatgatgattttacggggcatgtggcgccagcggaggcgagtttggcaaaggggcatagagagctcataatggggttggtcgtatctatcgtaggtggattatttacctgcatgaaagaaagattggtggcaagcagttgagtga

SEQ ID NO: 84654 - DNA, 2911 bp, Oryza sativa
attcctgcagcccctccttgcttcgagtatgctggaatgtacattttgtaggaatatggctgtctgaaggtaaatgtagttcatctaaaaaaggaaggtaaaatagagttaacaaaatgagcttttattttgaattcatttcgctgtcttcccctcctgatcccgaagccttttcctaggggcttagctcaatttgtcactgtatatatagatcgtccatcttgcaacaaggcttgaaagtgttactattaaattagttagtttttttttgatcggttcgatgcgatcagtgcaattcttgcctatgatgattgaccccgagataaacatcaatagttgtttatctaagggctgtgatctctgggtttatgggcttctgtagttaaccatttatttagtccaggaaaccccaggccttgatgatagagtccgtctgtgttgagtgagtacttttgttaataggtgggctcaaaggagagtaattatataagacttacagcgatgtgataaaaggacatcgaatgaacattatgaaccctccgtcccaaaatataaacatttttagcatagtaataagtcaaacatttttaactttgattattaatagctaaaaaaatagaaaagatcaatctttaaaattgatgttattagatttattattaaacaaactatcataatatacagctctttttatttgaaagcattcggcaccaatactcaattaactcataattaagcataaaagtagccttattcggatcacgccacacccagacaattcgcccattgccaatacaccatatgatggattccttggttttagttagtcgctgctcattctaatatcttacttttataggtattgttggtcaaagtagcatctcggagattgtgtcagagagtctaaaagagtttatatattgggacggagggagtatcaaactatccccatgttgacgaaaaaatcgaacccaccggtctaggagatctgcttagctccagtgcaggtccaaaagttgttgagatgcgggcgtgccagtcagtttgatcctgcaactaacaagatatgtaaatagtagatcaaaacagccgatcggctgacaagccgatggggtagttccagccgatagctgataatagccgatgccgatactagccgatagcgatagggtttaagcaatcggctatatgtccaatgtagataatgatataaaggcaatcggctgatgtaataaaataacaatataatcgagtagaaaccaatcggctagaaacaatatataataagcactgatcggaaggttaaagaatacatcggctggaggtccgatgtcataaaatcaacaagattatattaaacaattaaatcttattgcgatcagctaaatccaatatgtatgcaatccttgtaagccgatgcaacgtccagataactcatcggctgaaaccccgatgaaacccttattggcaatcaagaagtaggctagagattatggttctaagcacgacttagtagatcaaacttaactgatgtagcactaagtatgaaaagaaacacaatatctagacaatcaaaccgttgactgattttcagggtggtagatgcctaggctaatctaatctagcaaggcgatttagccgataccggcagaaaccctaaagcgagagacagccgatagagctaaattgagatgctaggactagattaacatagacatatgataaatagcgaggcaaatatattatccaaaccagagtaatccaagaggtcgaatgtcctgatgcagccttgaacgacgccgatgtagacgatacaattgcctggaccggcggaacattggacttatcccttcgccggagatcgaagatgatgcagccctgcgttgggtgccaagttccaccggaacgtaaaaacaaaagtagaagtaaaaagggtggcgatgcgccgaattgtattgatcgtagcgatagattacatagaccccgggtgtacatatttatacccatgggttgatacaagtccttgtcggaaaagaaagaaactttcctaaagataaaaggaaaatataaagtccttataggatactaaacacattttcctaaagataaaaggaaactaacaaactattcctaattaatagataacttgccatgccgcattctctttgaactcggtctcttctgaataagtttcctttagtagatcaatttccttaaccaaatatagcaagaatccgacaaataacgacttgacaattctcatcgggtaatctcaggacttcaaagccgatgctgactctaaaccgatgactactccgggcttaccaaatttcactgttaacacatgccccccagttttggagtatgagaattcatgcttcaaaatttcttgtcttgataactccaaaaccaatcttcctttgcttcttgcaatcggctttcatgagccgatactgatgtgctccaccatgctgaaactgatgcgcttgccccccgagccaatattgttgttcctccgttaaattctccaccttgaccatgatcttggcattgacttcttcttcagacatgtggataaaaaattcgtggtcccaccaagcgtgccaatttgtgttgacgaaaaaatcgaacacaccggcctgggagatttgcttagctccagtgcaggtccaaaggttgttgagatgcgggcgtgccagtcagtttgatcctgcaactgacaagatatgcaaatagtagatcaaaacagccaatcggctgacaagccaatggagtagttccagccgatagccgataatagccgataccgataccagccgatagcgatagggtttaagcaatcggctatatgtccaatgtagataatgatataaaggaaatcggctgatgtaataaaataacaatataatcg

SEQ ID NO: 84655 - DNA, 987 bp, Oryza sativa
ccgtgatgacctttcttcaataaggactatagccggtggtagtgtcgccaacacaattcgaggtctcgcagcaggttttgggatatcaactggaataattggagcttgtggagatgacagccagggcgttttgtttgtcagcaacatgagctttagtggagtagacctcacagattaaggacaaaaaaggggcacactgctcaggtagtctaaaatctgaagccaatatctatctattttttgcccttattttgctgcttagtggataaggctgaaaataatacctattatagtgtgcatgcttggtcgatgcaagtggcaatcgcaccatgcgcccttgcctatctagtgcagtcaagctccaggtaacccttgcttgatgcagtcttacactgttacttttctcttaacagtcgtaggcttgatacgatcatttactcattaacaggccaacgagttcaaaaaggaggacttcaaaggctccaaggtggtccttttcctcttacgccacattctgtgcacacaaattccagcatatgttaccatcacacaaaaaatcttactatgtcataataaatatgtttattttttgacatggaatgtttttgtcatcatgatgtaatgcagtggttggttgtacgatatgcaagacagaacatggaacagatccttgaagctattaggattgctaaacaagaaggtctctcagtatcattggatttggctagttttgaggtctgaccgcagctcattggtaccgtaaggtctttttttggtacaggcaccagtctgattttgtttatttattacacagatggttcgtgactataggacacaactcattgaccttttggaaactggcaacattgacctttgctttgccaatgaggatgaagctagagagcttctagggtgataccctcatcgccttattgtttcagatgttcttcagtgagtgatacctattatagtatatctgatgtgtgc

SEQ ID NO: 84656 - DNA, 934 bp, Oryza sativa
attcctgcagccccacttgtcatccaattgtttttgtagaaagtcgagaaccgagagacgctgcaaaagtattacagtacatgataaaagtcagtcgtcgagagcaccacaaataggagcgcatggatgaaaggcagtacacaaggataagtagtagctacccgctgctcaagactggcctctccagattccagcttcaaattctcaaggcatttaattgcttcctcaaaaccctcaactgccatgctttcgttcccaagatttctatcgacatccgcaactttggcaagagaagttgctacatcaatgacctatatccacaagtagacagatcatgaacagcaaaagaaaaaacactcaagaatatgtctgttccatgtagcagctaaagcctaccacaatcttacaaaatgctttgttatcttcttttggttctactgacattaaaatttagagaagataaagggcttgtttggtttgcaaccattttgtgtgttgtacaaatttctgtgaagttgttcatttggtttgtagccaatactttttatgtgtacgcgttttaattggttttcattaccaaaattttggcagtgccaattttttggccacagactaagtaatgaaataaagccatcatctcaatggtattgacaattttattggcacggttgaattgggaacaagcataaatataggttaaaagatctgtagccatcatttatggcaaattgccaaacttcctagtatggtctggcacttgctaccacagacttcagacaacaatttgcttcagagaaaggaatacaaaaattctgtgtaggaaccccttttttacatccatttttctctgcctactagtatgtattatgtgcaatgtcaatcagtaccaggaccatgaattatgggataaaatagctactggtccatgtgcaat

SEQ ID NO: 84657 - DNA, 595 bp, Oryza sativa
ggtgcggacattgggagttcatgatcttgtcgaaggtgttgacgcgcgaacgtgtgtcggaggttggcgcagtagttgccacaagttcctcgggcttacgcttgcgatccttgtgatgagtacttccactccccccagtagtcggcgtatctttcttcggcttccaagtggtgctcgactgcttggacgtggaaatagcatcttcggctttggcatactcattagctttttcaaacatctgcttgactgtcctgggaggcttacgcccgaacttgccgactagatcttcgtggtgaatgcccttggtgaaggcggcgatgatgacgtcatcggtgatgtcggagatcttattgcgttgttcagagaaacgtcggatataatctcgcagggattctctggacttctggacaacgttggaaagatcaactgagtgccagggcgttcgaaggtgccctggaaattggcgatgaagtgttcgcgaagttccacccaagatccaattgtgccacggggtaacccgtgaagctaggaccgggcagaatccggtagggccacaggcagattattcgccatgggtttgctatctcctcctgca

SEQ ID NO: 84658 - DNA, 2712 bp, Oryza sativa
tacatcttcttcttcttcttctacactcgcacacaaatttatatataaaacaagatttctttttttttccccgccacctacaccctttcttcggctacactttctccgcacgaccatgtaaatgtaatggggataccattagtatattattaataattaatttacgacctgtgttgtgttcatcctcatgtctgtcacaccttcttctttaacttcactatactctactgtgtccttgtatcagatgccagggttctcattattcatacttactaccttattattattattattattattattaactgccacccatttctctgcagcatcatgccctgatggttggcaaatcactcctgctctcgacaagtgtttcatctacatacctacacccctttcttgggacagatccgaggctctctgccgcaacaacttcaccgctcatttggctgccctatcatcacttcaagacctcaatcttgcaaagtctctctgtggaccttccccctctggatgctgggtcggaggtcatcgcaacaacactgcctcggcttttgcttggaaatggtccgatgattcatcttcttggaatgatactgccttccctgctgacccattgcgcgccaactgcagcactactgggtgtgctcttgctaccaccaatgatgcatgcactttggttaccaatacccatgccgcacttaccgcaaaaagatgcagcgactcacatggactcatctgtatgatcaatcatggtgagtatcccttttgctaatactggtgccatctgtataatctattatctctttatcacaaatcattatttcctctcaccatatgcaaatatgtttgttctgtactgctgatcaactctactttatgtcagaagaccgatgctaccatgatcactgccacaaggagtatttcatagtgctcgtcgttgtaagcggattcattctcttgaccactctagcagtagtagtttggctacttgtctataggcgaagcaagaggaggagaagatcgcgtgaaggttccagtacttcagctaccgcgttagttccaccgctatggaaagtgttcaccagtgaagaacttagatcaatcacaaagaacttcagtgagggcaaccggcttcctgggaatgcaaagactggtggaacctatagcggaattttgccagatggatccagagtagcaatcaagaggctgaagagatcaagcctacaaaggaaaaaagatttctactctgagattgggagagttgcaaagctgtatcatcctaatttagttgcagtaaaaggatgttgtacgatcatggtgaccgctttattgtttatgagtttgttgccaatgggccgttggatgtttggctacatcatgtccctagaggagggcggtgccttgattggccaatgaggatgagagttgctacaactcttgcacaagggatcgcgtaagtcatcctagccatctgtacagaatctttgattacttgcctatttttcacaaacatgttactctacttcttactgagatgtttaggtccctctaacatagatccatgcataaacctagcttgcgtgcactcgtgtgcatgcagatttttcgtaccgcttgcatgcgcctcctgcactaatttatatccagacctatttggaactcatttgggttaccattttaggatggtttgtctttgcattaaatttcaaggtttcattcagagttttgttgtttcccgtcattcagctcccatggttgatcattatatgtttttggttgcttattaattgacaccggtgggctgcataaatgtacgtggtagcatgcatgggaaaccactaagtatacttacactttaattatgtcataataaagacaattagagaagccacctgttgtcttacggttctatcgctgcaggtgcatgattctagagttctcgaattatattgatggcttctacatccatataatcttttaaagctatattactcaagagtgttgtttgggttcccgtggaactaaaattaggccaaatgcgtatacgtcaatgcaagcccttatggcgttgtgttttgttttgctactattagttgctatttacttaccagtgctcattttgatccagatttttgcatgacaaggtgaagccgcaggtcgtgcaccgtgatatccgtgcaagcaacgtgctacttgacgaggaatttggttcccatctgatgggggttgggctgtccaagtttgtaccatgggaagtaatgcacgagaggactgtgaaggctgcaacctatgggtaccttgctcctgaattcatatacaggaatgaactgacaacaaagagcgatgtctacagctttggtgtgctccttctagagatcatcagtggccgtcggcctactcagtctgtcgagtctgttggatggcagactatatttgagtgggcaacacctctagtccagtcacaccggtacctagagctgttagacccactgattcaggagttgccagatgtaggtgtcatccagaaagttgttgacttggtctatgcctgcacccagcatgtcccttcggtgcgaccaaggatgtctcatgtggtccatcagctccagcaacttgagctaaagtcagcagcatcagaacaactgagcggcacaagcactagcgctacatctccaatgttaccattggaggttcggactcctcgctgaa

SEQ ID NO: 84659 - DNA, 4380 bp, Oryza sativa
taatatttggaacatgtgcttctatcagtgtgaaacattagctaaaatgttgaatcattcaacttatatattacaggtggtaaagtttacttactttgatgagcatcggtcatcatcccttttagctcggtcgaacagcaatatggtcagaaagatcacatagaagtacggcaggaactacacgaaagcagggaccacagttattaccatcctggctaaagtcgagataaattgtaatcagggtgtgcttacatgatcaaaaagagctggaactgtccagaaaaaagcagatagaatctctggaacatagtgaaaatgacgagacaagccccacctgtccaaatggaaaatgagggtgcatgctcaaaagccattcattgcctctattgaaacaaacatggtacaaatcacttttgatgaactatgtaaagaagaaatgacgaatatattaaccatccagaagtcaagagaagactgctttttgtttctccatttgtagtctgataggaagcaacaatctaaagttccaccaaaataaagacgtcagcaatgttataaacatgctatttgttaatttggaagcagctaaatatttaatgcttcaaccttagatggagctttgccccatattgagcatttcccatttgtccgacggaattcttggcgctgacgaacacagtcatagtttatatatatgcaccatattccaaccaggaaaaatgaaaatggtaacttgcacaaaattaacaaaaattcaatttaaccggtaaaacaccaataccaaataataattgggtaaacctaacacagttatccaattccatttaacacatgaaagaaaaacattctgaaagatgaacctggggacccaaattcacagggtggttgacaaggtacattccaggagaggtgtatattgatggaacccataccaagcatccccagcaaatgtagaaaccagctggtaggaaatatatgtcagcaaaatagtgcatgcttgcaaattaaaagttgagtgctgtatcaattaatcacacgacaataccaatccaatcctggcttctcatttcaaacttacatcttcatggattattagaataaaataccttggcatcatcaaatttgtcatggtggttcaaatagttcactttatttacatcttccagggattattagaataaaatacaccttggcttcatcaaatttgtcatggtggttctaataggtcactgtaaactaagaaactaagtatctagtaatcgaacttgtacaattgattcaagtgaggtcactaagtgcgtttttttttataattgggggtggtatcaggcctaggacagctagggcctcaggccctagggcttgagatttttgtcatggcatccatatgttagctactaggtgcagtgagatacccatccaatctgatctgtagaacataaatccaaggtacatcttttgcccctccaaaaaaaaaatccatgccgataccttgatgctaatgtgtccttacgcaatgccctctcttacccaccccttgctttgatgggtccttatctagcaaatagagttggtgctgccgccggcggcttctctttttgcaaaacatgtaacttacaccgttgtgttcgatccacacaactaattaaatgcatctacgaggatcagtaactgatgaacttgttaagatacactgatgaaagcatttctgcaatgattgactgaggtttacagggtcatgtatcttcaagtttacatgcaaaacctctttgaaatagtaataactggtaatggcccagaagttttatgatgatgatgtggtaacctagaaaaatcaatattaacagtcttcacattttgtcgtatataaatttattaagttcacttgtgtattactttatttaactttattattatttggggggttggggggagggggttgtggttatcttcgcaggtcaacttagcttgtctcactatgagacagttgagttaattacaccatttaagcacttgcatacatcacggtgacatcctttgaatgtaaggagctactattcttaactttaaagaacatgaataaatttgtagaattaacctacatacagcatttcattttggagaaaatttcttttcaaacatcatattttgaaacgttaagatgcatgtaattaaaaacataggagctaccaacctctatcatgagcaatgtccatagtgcaccagtatccagattcccaccagaagaacttggtgacatagatcaacatcaatgcagtattcacaagcattgaatctgcaactcggccattcatttcatactgcattgcaaagttcaaagaaatcaactaagtttagtggataacttaatcatataatgttaacaaaagctttctatcttttacattcccattgtactattttagagcacataagtgagttctatgtacaaaagtactagatattggatagcaaccaaagcatagatgtgcctctaagttgcaagctagcatatcaccagagtattatagtattctgacctgctttatgcagtaggttacagcaagaacagcccaggacatcatcccaaaacggcagtttgtgaacactttgatatcaaagtgcttaccaatgcgaggatatagttccattccctggaatgttacatgttatatacacaagtaaagaaaaattcatgtaaaatcaaaataatgaaaatacctccccacaaaaaaagagaaaataaataataaacactatcactgtgtatcaattatcaaatataaacacaggtgaagaatgtcatcgctaatacaatactaatgatagaacaagtccatataattgatcgatctaattaacccatcacatgcaagaaatgtaactcacccagtagaaatcaattatcacattccctgaggatccagaatcagatgaagatggagcaagatgaccctaaatggagaaaaaagaagggtagcccatcaataaacgaagcatggtacatatctacataaagaataacaagcctaataaataagctcacctttatgtacagaaaaatacagaacacaaagcttccaaatacaagagcagagtatatttcccccaagtgatcgtatactattgcagggttaaaaattccaaacctgacagatgataaaatggtttaggcgaatagtggctatacaaatgataattgtacaataaaaggctttgaatcaccatggtgtagcttacaaaaagggttgtcacaaacacaatataaaaataaaataaatataatttgaaaatatgcagaacaagttattaatggtttcctgattcctccattgtgtaatgtaccaaaatcatgggtgaaatattaatatgttatagtgctcatcatatgctaaggtgcatcgaagctccttcatcaatttgagcctcgtgcaaggcgtgcattaatccaggataacaactactctactcaaatttgaaagggagaaaataatgcaacaaacaagcccatgtttaagtgctctaagttgcctgtgtgtgcttttgctagagttcactcccaagtcccaacttccatggtggtgcttttaatgagaacggatagtacccaaaagcatccgcagtggatagcatgggcaagatggtaagaaggtggggaccacacggcttaacctagcaacttcaggtaaaaaaattggtgccaagctccaagagttgatttgtgtttgggtggcattagtaactattttaacttcaaaataaactaaggtatgttggaatgtttgtgggacagtatggcaccttgagtcctcgagaattaaacaaccacaacaggcaaccaaagaagtgtgtatgaaattgtcctgtcagccatcatgataatggggaagctatagttgctacagttgagaaaatgctgtttattaagcatggtattttaaattagatcgaagtcaggagaacataatggctatacattcaaagctacttttcacaatcactagctaacaaattccggctgaccactatcatataaatagtatagataggcatagttatcgagggaacaagcaagcatggacagacagacaatttgctagatggctgaacagagaaggcaggtgaatgttgagtgtcgtaatcccaagttttgaactgtatcctcaatcagcaggtccacataaggaaagaagactatcttaccaccacaggctcaggtatgttatcaaggtcactgcatatgcttgtaagccatttgcctgaaagaaagagagcaaaaaaaaaacagagaaaacgataattattaactaaaaggacatgagcaaaaaatactatcacaatagtctttttcttttttcgggggggggggggggggggggg

SEQ ID NO: 84660 - DNA, 5102 bp, Oryza sativa
cataacatcattagatggcgtactgtacatacatgcacggagcaataggagtagataacatcatttgtttggagccgacgatgatccgcaacacgcaaagacgacgacggcggaggacgacgtcgacatggctgcagcagctgccggcggacacggcaaccactcccactcccacctactaccgccactgctacgtttcccccacgtcttctcatggcgaccgttcttgctgtcactgtcactgtaactgccatggccgccaccaacctcagcgtccacgagctcgtacctcaccgcccccttgctcggctccgacgcgttgtacacgtacccgctcgccgcgccggccgcggccgcggcaatgctgcggcgccgccgagcctctccgacatctccggcggcatcgatgtgttgttcgcctcggcgtccagcagcagcgtgtcgccgtccacgccccagagcgagactttgccgccgccgcctccggccagcacgaggaggcgctcgctggcgcctccgccgccgctcgttgtcacgccgcaggccgcccatgactcgacggaggcggtgttgttgccctcgggcagctggagctggcgcgccggcccccactgcctcgccgccgggtcgaaccagctcgcccaccccgttcgcctctccaccacgtacacccgccgctccgaggcggcggatgacacccccctcgacgccaacggcgccggcatcggcgggcacgtcgcccaccctgcaccctcgtcaagaacctccaccacgcccgcggccgccgtcgccccgcacccgccgccgagcacgaccacgtggggacccaccgccgccacgaccgggtcgacacgccacacccgcggaggcggcagctcgcgccacgcggcgccgaccgcgtcctcggagacggccatggacgcgagggagagcgcgtagacgcggtcgccgccggcgcaggcgcaccgccggacggggagcgccccggcgacgcgccacccatcggaggcccacgccccggcgcgcgggtcgtacacgtgcgtggagcggccgacgccagcggcggcgccgtggacgtgcgccacgaggcaggggaggtgccgccggcgccggcggtggcgctggtgcgcctcgcgcgcggcgcggcgccactcccgcgacacgagcgcgggcgacgcggtgagctcgccgtgcggcacgcgcagcagcacgcactccagcaggtcgccgtgcagcacggagtcggcagcgtccgccgcctccatgggaatgggatcctagctgcactgctgctgcttgaggatcagtggatgaattaatcgatcaccttcttttgaaatgcaaatgcattatttaactactcctatattaacgttaatctgttggtcgaatcgttgatggcgccaagtacctaccaacccgactacgacctaacgaatgatgagtagtcttcccggggttggtgaaatatgtaagacgtgttgctgacgagtgtgtgatgccattccacaccagagttacttggacgaaattgaaacaggacatgcacgggagaaattgaagcatgactaacctttcctgacggcttcagcaattcatcacctaaaatatatcagatgacaacacaacaacacacaatatttgttaacgagattcagtcgaaacctaatccccaaagctctgattatgaacgctccgttcaaccaacataacacctagccgctatgaatccatagccacaccatcatcatcttcttgcgtatctacgctacattatagtcgttatagttacattgtggtgcccaccttacctataacagagtctgactctaactctatcatatacatattccaacttctagtgggactagtatatttgacacctattctaacaaacttcacattgacaaatatacgtcacctagaagtaatagaatcaccatattgattcacatgtcctccagacataggttggttctttttgtagtttcactgtgagccgattgacgagactgcactagactcgccgtcgttaagagactacgctatccttgtaacttcttacttttaactttatctgcaacagtgcttcaccttctctcttactatcataatcgttttgccaaacgaaattggactgctccttagctgccacatcatagattcctcgaagattatattcacctccatctttcgtcttaaatttgattttatctattctattctacggccagataacccatgtcatgactaaagaggcaaatcaaagtcaccaaactattgaagagaatccttttcttccatgttgttttatgaactgagctaaacaaatccaacatctatccttttcgcatccttatattggacccatgacactttgagaaaaatcaccgttgtttctcttcagttatggtctaactccatatatctcaacacgacgtcgagtctcagatatattatgttttcgctagataattccatatacaacctgactagtctatcgccgtcagtctactcgtcatatgtctcaatacgatcgactttgccccttagtctaaacagctgtacttgatcccatcgttcgatccatccttgtctgatcgaaaaccacgtacaactcacatgtcgcagcctgctatgtgaagctttctggaggtgtcaaatctccatgcactagttgctattctcaacttaggtctggtttagtttcccaaaattttttaccaaaaatatcacatcgatctttgacacatgcatggaacattaaatatagattaaaaaaactaattgcatagctaggggaaaatcgcgagacgaatcttttgagcctaattagtccatgattagtcgtcataagtgctacagtaaccaacatatgctaatgacagattaattaggctcaaaagattcatcgcgcggtttccaggcgagttatgaaattagttttttcattcgtgtctgaaaaccccttccaacattcggtgaaacatccgatgtgacactcaaaaattttcttttcgcaaactaaacaaacccttactctattagtttgcaaattggagactttggatttttggaatgtggactaagttatgtactatatgtacttctattttgatgtggtcatgactcgtcagattatgcgtatgtgtgtcatgtttggacatgtacgtgctgaatggagaatggacattgtggtcttgtcatcttgtgaaatgtcagaaattcaaatacgatggccgtgtttagtttcaaattattttcttcaaactatatacttttccgtcatatcgaactttcctacacacacaaacttttaacttttccatcacatcgttctaatttctttaaacctccaattttgacgtggaaataaacacagccgttacttgttggcttgctattgcattgcattatttaatgcctatatgatatgtaagagtatgattataatccattcttgttgtttacttattgaaaattgattgctctattgttgaagtgtttatttgctgctagctattgttaagaattattgctctatttctttatttgttgttttagctcattttgttaatcaagccgagcatattcttcgccaagctttcacgagccaatccctaaacatagccaacaaaaaaaaaatatttgttgcggcagggcgagagagggtgaggggaagtgtgagattgaatttttcattttcatgggtttcctaaattgattttaacactgaaggcatcgaaccaaagtttccattgtccaaacttaccgaactaacactagaacttgcccttatggttttgtggtccacaatgcatctttcatagcaaaaacgataaaaacaaatctattgaagtgatatatattggctaaatgggaagcacatacatacactttgagaacttgcgaagtgatgttgtctatataccgtcgctaaaataaaataaataaaaaaaaaagcaaatgcaccagccgggaatcgaacccgggtctgtaccgtggcagggtactattctaccactagaccactggtgcttattgcatgcgtagtctgtttgattttagatgacactgcaatcgacaaaattcttacattgttcatgctaccaccaccaggaatcagatcctctaaagtcgaccaaaatgacttgtgtctgcagtcacgtgcatctggccactcagtccctatcgaacggtggagccagaaatatctgctgtcccactcggcttgctgggccggcccaactcagcaggacgcacgtaagagctttggctgctgtaattttcctggcgcgaagcttcactactttggcgccggtttgacaacaagagcaagtttaaaaaaaagggaggaaacaaaaaagaaaaaagttcaaaggtgtatgacaagaaaaatggaaattgttcaaaggtatatgactgttggaattaatacacgggctaaggcccattcgaagattaattctttggaaaatcacaaaagcccacctcataagatggcatgcatgtggagtttagtaccaccttgcttattctaggaaagggggacctccttaaaagggaggatgccctcctagccatttgaagcatgtgtggtggagagaagaggggaaacacacgcgctcgctcacctcgccgcagtctccttttgcagttttgttttgctgcaggaaattcggatttgttttgttttggaaacattccgaaaatccggtgcgtgaaaacggcgtgtagtccggataagttatgcgcgacttatccggttcggttacgtggagtggagatcgtgcggacgccctgatcaagcgacctatctctatataaaccgagctgccgccttcacgcaacatacgcgaaatcaatctagggtttgcctcctactctgtgctgcgccgtcgctcgtagactactccatctcgctcaccgacgtgcaccggcgatcgggagagcaggtctccggaacctctgccttcgacgtcctgcaccgggagaaggcggcaataaggtttttgggaagcgcttcgcgcgactgctgcctgttcgtccgcgacggctcaccttcctctccgctcgcgtgctgcgcgccttcgtcgacgcct

SEQ ID NO: 84661 - DNA, 7001 bp, Oryza sativa
ttattgttatctttcccttattattcacaaatgattatattctacgtgcagacttttcgaatttttgaaatgatttcggatgcatgagattggtgaaggagcttttacatcatttggagtgtgcacagagctgattcactattgcttgagttgccgaggtacctggtgttcactggatattttagggcgtccaaaacaattacagcataaaggcttaaacacaagttcaaataaatatgtttgggtacatttaggcaatgatgttaaaaccttgctttttatcttgctacgtaccattgcttctattatcagttgtctgatgggggtttggtattctcttttcctcaagtttctaggaaatttatttcctttttgcaggtgttcatcctcctttacagctagcaaaatgtgtgtggttagataacatgggaggttgatatatattgtgtatactttgctatgtccagatttactgtagaggggtcacatccccttctaggttagctttttttttttttgacggagggagtactacgttttgatattatgttaaatggagaacgcttatcaatgatagctaatttgtgtttaataaaatttttgcttaagtgatgtttgtgtgcatggctgcgcgcggcgtgatgccgtgcattcccttagtgttgtcactttactttatattgacctttaaaataattccaagtttccaaacgtaccggcctcacagcgcaccttcaaccaaagtgctactcttgctccaaacttatcatcttttccacattagtgttgtcatgtaccagatttgtacacaagccaatatagtacaccagattccttcagcattaagaggcaaaccaagactatttcaaacctattatttacgtaatacatatttctaaaagagggcagctagcgcacgggatgccgttcaagactaaagtcacgagataattaaacaacttgataaattaatagatatttccaaccgcgtcacctggtgtccacgcgattcctcgttgctttccccagccggattgtcacgcccagaaatttagcccaaatttccagactattttgtgtattaaatccctgtccaggactagccagggtacacaaaacgacaagtaataaacagttccaaacgtaaataaagcataaaatacttacagaagaggcacttatttctcacaccgaaacaaaagcagcatcagcgaaaaaggcgatcctagcagggcttcagctccactccacaggcaaaactcaactggggtctgagccttggtcttctaactttgcctctagctcagaagcactacacttctgaaaaaggggaataatagcaaggctgagtacaaccaccgtactcagcaagccacaccaatgatgcagacatgtaaggggaacacaaggacggtttgtggctatttgtataaaggcggttgtaaaatattttattgagtaaaatagtaaaactgttgagtaattaaaataacattaaatttccactgatcaacgctgcaccacgttgaacaggcccaaccaacccacctgaactacagtgcattgagtcgatttattaaggtgagactaatcacggtgaatctggtcgactgcccataactgcgggcacgcgggcacggctattcgaatagttttactctggccagaggtgtacaactgtacccacaagacaaatccccacgatatgtttccgtgcgccgacatgccaccacgacataccggaaagaggccgtgacaggacccttctcataaccccctctaaccgatcgcaccacacctcagggttcgcccccgttcccagcaggcaacgggcagccccctctcgtgccgcggtgaatccggaagccgatcaaccggacaccccggccgacccaactctatcacgcccaccctcgcctgggtacgtcggctagaggaaagctacactacaagcccagccgttgcccacgttggcttgtggtaagcacgataaattcttccaaggtttcccgcgaaccggtccttaattgccatgggtgcgactagcaaaaccatgcacctacagcccaccatttagtcgcattttagttggataattacgaccatgaagcatggccagatgtctcgagcacgcagctcattctgttactgaaatggtctaatactgtaattatcccatcaactgagctagtggtaattaagcatggctaagcatatagttccagctaggtcacataagtaacatgagctagttgatttattacccaaggttgacaaaggacagatatcaagtaaacatagcacaagcaagcagataggtaatacccagatcccatgtaattagcaaaatatgcatgtttatttgcaaatagtaaaacaattgtaaagtaggctcaatatgctcaaggggaatgtgtgacttgccttgcttcttcacttcaaccttctgaactctgatccttgcgaccgcgaacttccgaacaacggattctacacgctagcatgcacaacgaggaaaaactctaataaaaaccagggaaacagtacataaaaagtaaacaaacatgtagatctcaattttagatgaatttagcaagttgaatggcccaatttggagttcgaatgaattagatatgaattttagaagttttgagccatttaaatgaatttctagaattattaacgaattattgtgcaattattaattattttctcaaaggaaaagggacgcgctgacgtcatcaagggggaggggcggcgcaagcaagcgggccccaccggtcagcgacacaagggcgccggtccaccgtggtctgggaccaccgaggcggtccaccgccggtccacgggaaccgacggcccggatcgacccaagccgatcgggcggccacggggtggcgcgctggggcacgggcgcggctcaggccagccggccgagcgacggcgagcggcggcgcggccaccggcgcgggaagctgtggcacacgcgggctgcggcggcgagcggtgcctaggcatggcggcgacgtgcaagcggcggccagtgcggcaaagagaggaaaagaaaggaaggggaggaggagggagatgctcaccgagatgacgatgaccggcgcggggaaggacgacgacgaccacggtgatggcggcgccggcccggcaagcgagggggcggtcggggagcgtcttggcccgaggaaggagagagagagggattaggccgcgcgcggcgaccggagacagcgaggagaggccgccggaggcggtagaggtggtggtggctcgggttggcggctgaaccggggctccggtgatcgtttggggatttggagtggcggccggtgtgcggggcagcgcggcgaagccgagggtggcggcggatttgcgtggcgatggctgaggcggtgaggagtggtggcttgaggcgacacaggcggtggtggagctcgggtcgatggtggaagcagtcctcgggcgatggaatggacgggtggagtggcggccggggcgtggcacgatgcggcgaacccgaaggcggcatcggcgcggtgcggcagcggctagagtggcggtggcgggcagctggaggcggtggaaggggcggcggctcggtttcatggtggagatggaattccgacaatggaatggggaaacagagtggatgccgaggtagggcttggctcggtgatgccgaaggtggcggcggccctagcgacaggaaacggcggccggagctcgcctgaggtgggtggcgatggggagcagcgtggggagagcggggaaaagcgcagggagctcggggtggaggggggaaacggaagaggggagcacgagggtgctttatatagggctcggggaggcgggatcgggcccgagaggggtggaaaccagccggcgacgtgggggagagagagagagatgtgggaggcggcgacgtggccggattttgcggggagagtgggggaaaacggcgcggacgtgggcgacgaccgcgtccacgcacgcgcgggagaggcggcgacgtgggatgccgacgtgggcgaagtggagctcaatttggcgccaaaaattggggaaaagtgggggaaaatgtggaggagttggaggggaaccggtttcacttggtttgggtgcgagggcgcgagcgggagggcgccggatttggcgggacgtgggcggcaaccgccgaccatggcggcttcggcctgggaagccgaaggtaggaggagggcctgacaggtggggtcgccgggcccacctgtcggggagggagagagggaggagaacccagggggttatttagactttgcgcgaggggaaggaagataggtcgatggcccaaggaggaaggaaggaagaggggaggggacgggccgcagggagggaaggagggctttgggccggaagtggcccaaattgaaggaggggagatttgattgtttttctttttattaaactagcaaaaatgcccgtgtgttgcaatgggtgaaaaaattttaatgataatatacgtttttcatgcataatcatgtgaagacaatgtttgtattttaatgagcagcttgctttttttataaacggtgttttttttttcttccacgattttctcaaaccatttttcagaaatagcgcatttctttctaatagttttttcctagcatgtttttttttccattttttagtgatgacaaaaaccatatttttctcctcttttttgttttgcttttctcgcgtgtttttttgtcaattttttctgacaattactttctcgcgtggttttttttgcctgtttttttaaatgttattttttgcttttttccaatacatgagaatatatgacgaaataaaagccgtgtagtagatggtaaaaaattgatggatcctacccgactcaagcgtccatcaatttagcttttttctgacagatttttcagagcggtttttttaatagatagtgttttttcttgcgtggtttttttaaaccatttttttttagaaatgacgcattttttctgacagtcttttcctcgtatgtttttttaaaaagtttttgctggcaatggaaataatttttcacacgtgtttttttattttgtaagaagatggaaaaaaaaccttttcagcgtgttttttgcgcttttttctgacttttttctcacacgtctttttgatcgtttttattttctcatgcattttttatttttaaatagttagattagattagagatagagaagagatttatactgattagaaattggactttgtttcgccctttccatattttcttgcgtgcattttttattttatacgaaccagctttttttttttacgaaccatttttttgccactttattagagaatcggacaaacttttttagatgttttttcggatttttttcgcctttacaggaatcagacttttttccatttttaaaggaatcggatctagcgttttttttcaccagttttttttttttgccttttataggaattggattttttttcccgtttgcatctacagttttttttcgccacttaggggaaatagacttctgttgttgttttttttgtttattttcttttttgtgtggcttttctttttctttttatgcacctttctacctttgttatatcccttttatttattgttttttttaaaaaagaccaaaagcaccttattgcaagattatagggactcaaatgcaaatataaaaattacagggactcaaatacaaatgtacaaacccaaaaattaaaatcatataaaaatggaatgctctcgatatgtaggttccgtttttgcaaacagatcttcaatccagcacatcaattttttttcaccaagatgtatggaataatggtatagattgaaaccgagagaagtggtgcctagtatctcggacttaatctgagagaagtgggattcggatctagagtcggactttttgaatcgcaacaagaggagtcaaacttttttttatttttatcgctatttttttagggaccgactcggactttttttgtcgctattttgttttttcttttctttttttcgcacgtttttgttcgccggttttttttatcggacaaattttggtttttttttcgcccatttttttttgccttttttctggatcggacatatttggtttttttttcgcacttttttttccctggttttttttggatcggacaaacttggtttttttcgcccggtttttttgacggacgatggaagcacctcttattttttaagtagtagagattggttaaatgaactttgtgctattcaaattatttctcgagctccgaaaattcgtgaaatttcagagagtattttagggcacaaagaatattacaaaatattctcggccaatgatttttaaaggaaattttaattctcccattatttcactttattaaattgctttaacttttatttaatttctagaaaatgcattatttaatgatttttaatcctgaacgaaaatcggggcgttacacggatcctcctcggtctcacgcgcctccacacgcgataccttgtcggtggagcacactcgcagctagccgaagcagcagacagtgccctcttcctccaagctcctccttggtattgctccctccacgtcttgaaccaacgcttggcgatgcaaggagtgacatcggttgcagcagtagtaggaaacaaggatggagccgaggggaagggataaaaggagagaaggcatgtggtgcttgattcctcgtagctagccatacctcgcagccagccatgatacttgatacctcacaggtaccaggtatcaggtttaatacctgtgggtatcagccatgataccatagatattaagcatggtacctacaggtactgggtctgatacctgggtatcagcggtaataccacatgtatcaaacttggtacctatggggtaccgactgtggatgatacatcgcacaacatacttgcacacactccggcaatgagcatggtggctcg

SEQ ID NO: 84662 - DNA, 1088 bp, Oryza sativa
agacgaccaatatagagagaatattgcccaccagaggtggcaaaaatattggtggtagtgaagatagtgataccaatcaaaagtgatgaagttgcacaaccgtgaaggcaaagaaaccagtcggcagcagtcaggtcagccagcaatgaagatgaaggcgcccagcgataaagttgtgtagccatgacaacgaaataatcagtcggtgacagacgatgcagttggtgaagaagatgaagatgcccattagtggcgacataataagccatccataaaggcgaggataccggtcggtgatgacgaaagcaagccgacggtgaagatgtagacacgcatcaaaggcgatgacgaaatccaccaatcatgaagatgaagaaaatagtcggcggcgacaaacgcaaccgatagtaatgatgataagcagcaatcatagatgatcaaatataatgacgaagttgcccatcaatagcagtagagtgggctatgttgaagaggctatgttgaatagggatattgatgaagatgacgatgtcgatgatccagtcaatagcagtgtagcaaccgatgataatgacgaagacgctcatcagcgtttgcatagtaggtcaaccgtgaaggcgaaataacaagtcggcaatgacggaagcaactggagacgaagacatagtcatccattagcaacggcagagatgtcagggccgatgaattagaggtgctggtgatgaagtcaatgacaataatctatcaaactgttgagaagatatcgaagctcgagtagtttttttggcgcgagagtgtgtataacgaagattgatgcaaagctccttgatttataaagatggcagtagaatttggtgttatagctgttgcagattcttcacttggaggaaagtagatgctgttgcccaactcatcaaaactgaacttattggttgataactccaaactcccgaacatgtagattaaatttcaaaattgatactggaaatatttggagtagattgtgacggcgtgaagaagccaaaattgccggtgtaataattggagtcgctgaaattaaatgacggttctgaagcgtagacgaagat

SEQ ID NO: 84663 - DNA, 1836 bp, Oryza sativa
gtcctcttctttttttttccttcacataacatgtctaattccgatcatgtttattgcagcgtcgttacgctcacgtccaggtgagacgtggttacccggacttcgtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcccccctgccgaccactcgtgagttcggattgttcatttctaaatttttatgataattacatcatcgagccatacaatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttccaacaattatgtcatttatcttgcataatataggacaactactgaattttttatttccatcttgcataggctgatgcggcacgggatatcagtgccgatatcaccgcagtccaggtgaggttgagtagaggtttgcacttgactgacgttgagcagaggtcgaccttcgaccggatgcaggagaagatgcgtgcggtcatgcgcgtcttctcctgtcgcagcgccgtggacgtcgtacctccagctggtccggtacacccacggcctcgcggtcctaccgtcggagcaggacctcgtttgtcttcgagcgcccctagcttcggagcagtgcgacctacagcaccggtttcgcacggtacagttcagcctagatattagttcttttttgtttcagcttttgcacgaatgtgtcaccattttttaactgcacgtttcctcatcgcaggacctcgtatgccttcgagcgcgttcgcaggcacgaccggcgcttccgcgagctccgcaggggcgttcgccacctcttcgggcgcgttcgccagctcttcctctcacggagcgtcgatccctcgcccacacggtacttaagattttattaatactgttaaatacctgtacgaaactgatggtccttgtccagcaggatttgcagccgggatcttcggtactggggcctcttcgtctcacgccggtaggactggtcctactagccagttctacgacgacgacttgcacggtgcagaccaccaggacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacgtagttcttttcattcgtatggtgcttgaacaacttatgctcacaacaacacactttcggcgcttcacggtagtgccat

SEQ ID NO: 84664 - DNA, 739 bp, Oryza sativa
atatgtttctgatcaacctatttgatgcaggtatggcgtacgacacaccggcgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttgaactcaactttgctttgttttgcacttatgtttgaagtttgctctatacaggttgcgtgcggcaggccttctaccactttgtaggcttgttgaggcggcggcggacgaccgtgacccagcgaagcggtgggatgcagaccggtcactccttgccgctcttgtagaccgctggagacctgagacgcacacgttccaccttccctgtggggagatggctccgacactgcaggacgtgtcgtacctgctcgggctaccgctggcgggagcaccagttggtcccgtcgacggtgtttttgggtggaaggaggatatcactgcgcgcttcgagcaggtgatgcgccttccacacctaggaccgaccaccacccttcctccgtactctacagtcgggcctagcaaggcttggttgctccagttcactgtaagtaaataagttgttattatcatacatgcttatttgcgaccggatgagtgttttgtactaacatttcattcttaactgtaggcggaccttctgcaccctgacgctgatgatta

SEQ ID NO: 84665 - DNA, 811 bp, Oryza sativa
aggaggtacctcaatgaagatgtgtccttctgtcgggacatcgccatcagccaacacaaggattccatcaagtatctggagatggagatcgtttcgccaagaacggtgaccaccaccatacccacctccacctctgcagatcctacttcataccttgaatgggttcgccgcagcagagaacctcagccgacacggcgacgctccgtgttccaccctggttcgtggagaatcactacatggagcatgcctatcccggtcacttcatgggacgactggcgccgtgactgcactgctgaatcgcgtgaagtccatcttgacaccaacccaagtcaccattacgagttgcttcatagcctcatgctcagcaacagcagtgatgaacacagggaggaggctcaaggtcaaggggcaacctcttccttgtccctaggtcgcctgcgtttgtgttacccggccttgagttgcatcgatgatgatgttgtttacctcttgggcaacgctgctggcaggggtgctaagacgggaggaatgatggtcgctgttgacgtcaggaacaaggagctgcgaggagtggccaagcttgaccccgaaaagaacaccctctactccatgcgatgctaccttgcaactgggatctccaaacgcctcaacactaccacaggtacttaattaccgctcgtattccagaacaaatgcagcaccatgtgcatatgggtaataaaatgccatttaaggatctagggctgatcattatagttctttgtttatgatggtccgaatgaccaaactaggactagaatgtagtaacttt

SEQ ID NO: 84666 - DNA, 1529 bp, Oryza sativa
aacctgttcatgatttgatcgagctgcgacaattaactgaattactactgaatttgttgctgcagctcctactacaacatcagcatcacgtcgatgagcgtcggggacaagaacttgccgttggggttctacgccattgctgactccggcacgtccttcacctacctcaacgacccggcctacacggcctacaccaccaatgtatagtactaacttgtcctacatgttcactgacagttttcttatagccacttaatggatcatgtctctgaaactctgatgtgagctagatattgattatacttaagacttaagaaagcccaagttggtgactggctttctttagtttttgtagaccaagtcagattaatcgggtggagtactatatagaatggtcctgaagagttgatcaaaaatgcaattacaaaaagaatgcaatgaacagagtgtacaaagttaaatgaggtcaacttgctcatcatttctgtttattcattctgtatcgcagttcaacgcgcagatcagcgagaggagggccaacttcagcggcagtactcgttctggtccatttcctttcgagtactgctactcgttgaggtaacaattctgcatctaagcctctacaaatttaagttgcaagattgtttcatctcgcaagtcgcagcacaaatcgttctgatggtgtttgggaaaatgcagtcctgatcaaacaacggtggaactgcctgttgtgagcctgacgaccaatggaggagccgtgttcccggtgaccagccctgtttaccccatcgcggctcagatgacaaacggagaggtaaattacagaaaagatcaccatgtagtcagtagtcatggaacaagaagcaccaattgcatcgtcatctctgaatctctctgacatttagtactagttgaagttgattattcaactaatcgaatgtgattcttcttaccgtgacaagcagattcgtatcattggttactgcctggctgtcatcaagagcgatctccccatcgacatcattggccgtacgttgttaactgtgtttttctgcttgctgcacgcactgtttcagtcttcagttaataatgctgaatgtgttgcgtgcagagaacttcatgaccgggctcaaggtcgtcttcaaccgtgagaaatccgtcctgggctggcaaaagttcgactgtaagttacctcattcatctcgatcccctgcagctagcaagaattaacgatgacattttttctttctgcatctgatcgatcactggctcactgctgcgaatgactgaaattgaatttgttcaggttacaaggacgagaagatgacagacgacgggtcgagcgtcgggagcccgagcccatcgccggggccgaccactcacgtcttcccgcagccgcaggagagcgactcgccggcgggcagaacgcccatccccggcgcggcgccggtgccgcggtcgagcagcgcggcagctggcggccgtgcaggttccggctcctgtcgtccatggcgctcttgctgctggct

SEQ ID NO: 84667 - DNA, 746 bp, Oryza sativa
actcatcaggatcctcctcagcaagttttctaatcatgtcaagagctttgcggattagtttcttcttgatggtcttcaggctgctatgttgttggagcatttctcgtgatacattgagaggcaatgtgtccgagtcgacgagaccctacagataatagcttataggtttaggctgcataagtcaatgaatggaataccgtgtcgttcatgaaatagtaatctagtaccttcaaaaagctgagatacttcggaagaagctcatcaaattcatcagagatgaaaacccttctaacatacaacttaaggtttgacttgttagagttgtagtaactctcatagagatcatgtggagccttgggaggaacaaagagcaaagctttgaactcaacatctccctcagcagtgaagtggctccaagacaagggcttgtcatcaccaaagtcctacaaaataatttgatattaaatgaggttacttgctttcttctgcaaggcttacataaaatgttatgctcctgtaaattcatcactgcagtctgtgtaccttagcaagtgagtggtaaactttgtgtattcttcttcagtaacctccttagggctacgaagccatatagccttcacatcattcagaagctcccactcagtagtggtttcctttactgtctttgtcttgggcttcttctcttcactctcttctgtctcttcttcctctgtagactcaggggctgccaagaaaagggctgcagg

SEQ ID NO: 84668 - DNA, 1692 bp, Oryza sativa
ttcagcacatatattacaagcaacagtagcagtagtgcagcacaccgatgactcgtgaaaaaaagaaaacaagagaagacatctgcaaaaactagctgggatggattggggcagagcttctattagtcaggaacgttccaacactgggttgatcgttgaggacgaactatttcttttgctttgcacgatagtcagcagctgctgctttgatggtagacttggcgagtgaggttggctttaggacgctcttcgggttcaaggcctgccgaatcttgaacactgcccatgctgtcccgattgcgtggcctgctgcatccatcccttcattggtcgcagccgcggctttctccccatatctgcagagcagacccaatgtaagagcttaagaagaatctctattgatcatttgatcaattccactacataaggaagaattagagaaaaaggatgtgcatatgatgtgcttcagatatggatgtaggacacgtaagaagtagtagaaatctacatataaagagaggagaaatgagtggaaaggagaataactcgtacttgtgggatacaagaccggtagtcacagttgatgatgtggacagaacattcgttccagccacttcgactgcgtcgcaaatcttccctgttggcatgaattaacgatatgtaagaaagacaatgttaccataatccaaagtgattagctccaacgagccaaattaccataagaaattactgcttcaaagaatgtgttcgggtaaatctgtatattttgttaactgttatactgaagtagatatatcgcataagagatataaagtactatttcatcggaaagcatggcggcaaacagaatatgtccctaaatgtatctaacatgttgagctaaggtcaaccagcatcagaaatgaaaaatagcataatcagtggttggaagtacaaagtggcagcagctgatttaatatgagctgatccagaaggagcatgccaaattaaacagaggaaatggagagccaagaaaaagaattgtatttcattccaaatttaagtcaccagagtacatgcttcttatgctaacttcagatttggcaaaaatttgtatccatcaagttatgcaaattcacaggatatatgcgaccaaaaaacccaagcaaagccttacctacgtcagataattatgacttatataatgcaacccacagggatattcaaattagaaacagaaaaaaaatctgctcatgagtcatgacacaggtgttgtctaggtgagtttaagaataacataaatttattaaattatgaaaccaggtttcatgtctgaataaagcaaacatatcaacactcattataccattaaaaaaaacaataatgcaaagcagacccattatgtaacactaaccagatacaatagaaaagttaaagaatcataccgaatccatcaagcgaagcaagaacaatctctccaggtaacaaattaaagaacttcttgccagcttttgagttagctattgagtttgtaaaatagccagtaacctttacaactccggatagtattccagttgccactttctcagacatttttgtcaccatcttgaccctggcaacaatcacaagcatgaattccttgaagcggaaaattgttaatgcttgatttaacacaatatctccctgcaacgtctattctcatagacactaaaa

SEQ ID NO: 84669 - DNA, 559 bp, Oryza sativa
cttatgtttttgaactgtggggaattagaaagcccaaatgcaatagctagcttctcacaatggactccaacaacttcttccttttcttcttcaacatctagagttccaatgccaatgtcaagcatagaatgtcccatcttaaacatcatcgactttaattctgctactgtatcctccaagccaacattatcaccatttgagaacacatacaccttattcctgatttctattgaacagctctcgacctcatctaaatttcttcctttgttgggtgtcatctcctctggcacatcaacagtttttccagttagatcttgcagactagaacctaacctttggactctgggatctccaggatcaatcgcagacagttctctagctgccaggtgagccagtcttacatttccatgcattacagctgcagtaagaaatgtgtcccagactgttgaattgggtatcaaaggcatctcgtcaataagctcatatgcttcttttagtctccctgaccgaccaagaagatccaccattgctgcataatggtctaattctggagttatat

SEQ ID NO: 84670 - DNA, 3654 bp, Oryza sativa
  unsure (1)..(3654): unsure at all n locations
cttcaccggcgcaatcccggacagctatggcgacctcgccgcgctcgagtaccttggactcaacggcaacacgctctccggccatgtccccgtctccctctcccgcctcacccgcctccgcgagatgtacatcggatactacaaccagtacgacggcggcgtcccgccggagttcggcgacctcggcgcgctcctccgcctcgacatgagcagctgcaacctcaccggccccgtcccgccggagctcggccgactccagcgcctcgacacgctcttcctgcagtggaaccgcctctccggcgagataccgccgcagctcggcgatctcagcagcctcgcgtcgctcgacctctccgtcaacgacctcgccggcgagatccctcccagcctcgccaacctctccaacctcaagctcctcaacctcttccggaaccacctccgcggcagcataccggacttcgtcgccggcttcgcgcagctcgaggtgctgcagctgtgggacaacaacctcaccggcaacatccccgccgggctcgggaagaacggccgcctcaagacgctcgacctggccaccaaccacctcaccggccccatcccggcggacctctgcgccggccggcggctggagatgctcgtgctcatggagaacggcctgttcggccccatcccggactcgctcggcgactgcaagacgctcacgcgcgtccgcctcgccaagaacttcttgaccggcccggttcccgccgggctcttcaacctcccgcaggccaacatggtggagctcaccgacaacctgctcaccggcgagctcccggacgtgatcggcggcgacaagatcggcatgctgctgctggggaacaatgggatcggtggccgcatccctccggccatcggcaacctcccggcgctgcagacgctgtcgctggagtccaacaacttctccggagcgctgccaccggagatcggcaatctcaagaacctgtccaggctcaacgtcagcggcaacgcgctcaccggcgccattccagacgagctcatccgntgcgcctccctcgccgccgtcgacctcagccgtaacggcttctccggcgagataccggagagcatcacgtcgctcaagatactgtgcacgctgaacgtgtccaggaacaggctcaccggcgagctcccgccggagatgtccaacatgacgagcctcacgacgctcgacgtgtcgtacaacagcctctcgggccccgtgccgatgcaggggcagttcttggtgttcaacgagagctcgttcgtcggcaacccggggctgtgcggcggccccgtggccgacgcgtgccctccgtccatggccggcggcggcggcggcgcggggtcccagctgcggctgcggtgggactcgaagaagatgctggtggcgctggtggcggcgttccggcggtggcggtggcgttcctgggcgcgaggaaggggtgctcggcgtggcggtcggcggcgcggcggcggtcgggggcgtggaagatgacggcgttccagaagctggagttctcggcggaggacgtggtggagtgcgtgaaggaggacaacatcatcgggaagggcggcgcggggatcgtgtaccacggcgtgacgcgcggggcggagctggcgatcaagcggttggtggggcgcggcggcggcgagcacgaccgggggttctcggcggaggtgacacgctggggaggatcaggcaccggaactcgtgaggctgctggggttcgtgtcgaacagggagacgaacctgctgctgtacgagtacatgccgaatgggtcgctgggggagatgctccatggcgggaagggggggcacctcgggtgggaggcgagggcgcgggtggggcggaggcggcgtgcggcctctgctacctccaccatgactgcgccccgaggatcatccaccgcgacgtcaagtccaacaacatcctcctcgactccgccttcgaggcgcacgtcgccgacttcggcctcgccaagttcctcggcggcgccacctccgagtgcatgtccgccattgctggctcctacggctacatcgcgccaggtaaccacccaaaataatttctccatattatttttagcctatttcttattactattctttttcaatgcgaaccactacagtactgtagtactaaatttaccgaaatgaatctgtttgaaaaatattgaattccaagacccaacaagtttatcctgatccatgtgttgaaagaacaaactttttttttctgatccatgtgttgaatgaacaaaccttttctgtttaaccatgacaaggaacaaactttatatctggaccatgacaaagaacaaacttttaatgtgcttaaaataaataatggttctaactataactaatataattgaaatgatctgatacgattatacgaagtgtcattgaaaaattgtaaactttacgtagaggcaataatagagggggcccctgcatggagatgcagccacgttccatccactggaactgcactagtactgtactgcagcttgtgctttcctctgagcacaatccttgttgccttgtgcacggtcaactggggagaggacaaatgttacctttgggccaaagtgtgaacttttttttttctgcagacagcaaacaaaagttacagctacagttcttgccgttgcatggctgtagcagtgattgtgattaatggtcagttcagttttctgctctgtttctttggattctacagaagcagatcttgcagccatatgtatggtcaatggcaggcaaggcaatttggctacctttggattaatggatagtctcctgcctttggagtactagcattcatattgtgtcgtcttgttgcctcgtgtgtggcacactggcactctcttggataattggaggagatactgttctactgtagctgtatcacgttcgtatcttggctgtatctccatggtagatctgctccttattgacttgtcagtccactcttaaatggtgttgttggtgaagtacgtagcttcaggataacctgtctttcaaacgattcgagtgtgatgcactaccctgaaaaatgaaaattctgtctagtggctgtggttacattcagttatgcaaatgtgcagctctaatggctgtagttacattcagttatgcgcgttgggaaaggatcggtacactaatatctttttgattgataatctaaaaatggtatgttaggtatcatctaactgattcatcaatcctatgtactatttgtgtttgcagagtacgcatacacgctgcgagtggacgagaagagcgacgtgtatagcttcggtgtggtgctattggagctcatcaccggacgccgccccgtgggcgggttcggtgacggcgtggacatcgtgcactgggtccgcaaggtgaccgccgagctgccggacaactccgacacggcggccgtcctcgccgtggccgaccgccgcctgacgccggagccggtggcgctgatggtgaacctgtacaaggtggccatggcgtgcgtggaggaggcgagcacggcccggcccaccatgcgcgaggtcgtccacatgctctccaacccaaactcggcccagcccaatagtggtgacctcctcgtcaccttctgaaccccaaacttaacggtattg

SEQ ID NO: 84671 - DNA, 728 bp, Oryza sativa
ggaaattgacttcatggcatctgctgtgggcacgtgtagattaagctggataaggagaagaagattctctccattcgggataggggtattggtatgaccaaggaagatctcattaagaaccttgggaccattgccaaatctggaacttcaggtattactcctttgtactgatttctcttaaagttatgtgtattctcttgctaaaactttagtattatctatttgtttgtaaagagaattttaccaagtgccatttaacttaaacttgagtgataccaattccttgaaatttttgcagcttttgtggaaaagatgcagactgggggtgacctcaatctcattgggcaattcggtgttggtttctattcagtatacttggttgctgactatgttgaagtgatcagcaagcacaatgacgacaaacagtaagacaccactgaaatacagcggctacatattgtgtttttggttcatcttcttttccttcactggcatgacaacctacttcatgttctgctgttgcactttttctctgataggcatgtctgggagtccaaagctgatggatcattcgctatctctgaggatacatggaatgaacccctgggccgtggaactgaaataagactgcacctccgagatgaagccaaggagtacgtggaagaagacaagctaaaggtattaccatcattactgtcaattggcttcatgctgtgacatcaaatatg

SEQ ID NO: 84672 - DNA, 2266 bp, Oryza sativa
caatccaaacttgtccgaatatgtccatttcaatatgtgtggagttgtaattcaatactactccagggagttggattacagttctagaagaaaaagaaaaggaaagcggtttcagaattgttttggacagcagaaaatcgccattgacagtgcagtgcagtgagatgagatccggatcacacgagttgcagggagttgtacgtagtaccgtgtcagttaagctggaccgctgacggattggtgctggtacgttgctggccgttggatgatccacaagctagacaagccacaacttttgtggcagggcgacagaaaggcttgccagtaccaagaagcacattcaattttaaaaactatttttccttttaaaaactgtagtatgcatctttataaaaagataactacagtagcatataaatttataaaaagctgtaatttttatttctcagataagttcatgcctaagttaccaacccaacccaacaaatacccaagtcgttgtaaaacaagcccacatgtcatctacacgtaagggataaaattttttgctattaatgcagttttgtgaaacacctagttaaatttgtactccatagcaaaagttagggttccattgaaacacgtgattataaaacacatagaaacagaaaaaagaacacgtaaatacgattgaattgctcgtgtaaagttcgtaggatggcattgcgaactcgcttgctaggggagagccaattcgcgcgcttttgaagacaacaatccattctttttaaacctgtatattttaagtaaaattagtgaaaaataagtcctcccacatttcattttaattcaaaaatgaactaaccaacaccatatattagtgaaggaggaagtatacttttaattcttttgatctggttattatggttgctcgatgaattggttgtctcgttccaactcgaaggaaaaaagaaaacagtttagagtgagttggtatttttttttctatgggttggatatgaaaatttggggtgtgtttaattcacgtcaaaattagaagtttggttgaaattagaacggtgtgacagaaaagttaaaagtttatatgtgtaagaaagttttgatgtgatataaaagttagaaattttttttaaaaagttggaaactaaaccaggtttcctacgatcgactcctgtagtcggtaatccccaggatcttcaatccttttgtttttcctcaaattaaaaaaaagaccctgatagttttgaccaaacaatttcggtttagctaaaaatttgctcaaaatcaaacgaaagtttaataaagtttgattaaaattgaaagcttatgtgtgtaggaaagttttgatgtgatgaaaaatttgaaagtctgaagaaaaagttggaaactagaccctatttagatgggactaaaacttttaagtccctataacatcggatgttggacactaattataaatattaaacgtagactattaataaaaaccatccataatcttagactaattcacgagacgaatctattgagcctaattaatccatagttagcctatgtgatgctacagtaaacattctctaattatagattaattaagcttaaaaaatttgtctcgcaaattatctttcattttatgtaattagttttgtaaatagtctatatttaacactatgaattagtgtctaaatacatagactgaagttaaatccctagatccaaacaccacctaaccaagggcgaacatgatctccgtgctagactaatactaagccaagtttagatccaaagtttttcttcaaactttcaacttttccatcacataaaaacttacctatatacataaactttcaaatttttcatcacattgttttaatttcaactaaacttttaattttggtatgaactatacacccctactagttcaaacgtactcctggtaaacagcagaaaggctagtagccgcccctggtggcagcagcccagcagcccgcgatcaatcaatggaggaagggaagaagggaaggctctgtgtgtgtgtgtgtctgccacacacgtctccggccatctcgtcccgtcccatcgtctccgcgcccggtctgtcagtctccgcctcgtcgtcgtcgtcctctggtatctgtacatgccgcattgaccacgccaacctaacgccgtcagtgactcccacagcttctgcttctgcttctgcttctgctccattccttgcagcctgcaggccgcgcgcccgccttccttttattcccgccaccac

SEQ ID NO: 84673 - DNA, 899 bp, Oryza sativa
ccaccaggagtactaccagatggcggcggcggcggcggtggcgtggccaaggagccggacagcccgcaactgagcatcatgagcggctgcagctccctcttctccatctccaccctgaaggacgacgacgacggcggcggcgtccgcctcgccggcgccgcgctgcccgccacgccggtgtcgctcgccgggatcgccggcggcgccagtacccccggcggcgacgaggtggacatggaggtgcggcagcagagcggcggcagcggcgacgaccggaggaccatccggatgatgaggaaccgggagtccgcgcttcgctccagggcgcgcaagagggtacgtacgtatatacaataccaaatacgtataattatacgtatcatactacagtatttatgtacgtatgtgtttataacgtacggtatgaattactactgatcatcaacaaatgttctcatatgtactctctccgatcaatattacttgtgctttccgacaaagcaattccgttctattaaacgcaggccaatttaattgtctgaaacggccggcatgtacttaattatgtccggagggagtaattaacatggaaatttctcttttcaaaaactgaatataattagaatttaattaaaactggatctttcacaaaaataaaatgctgctaataagtcgatcacttataaggtcattgttggaatgcgataatttaattattaggttttcaatagaagtttgtagcaggcgaaattatataatttgcacattgaattatcagtaaattgcagtcacgtcgttattcatcgttaagtttttgagctgagctgaactggttagtttacacaactgaatatatatgagcaaatttcattacatttcataaaggagttagtctatat

SEQ ID NO: 84674 - DNA, 580 bp, Oryza sativa
tccattagtaaggacagctgatacacgaacctgcagtttcaaattccacatatcaagtaaatgaattaaacaagatacttctcacttaagcaacaccactctagctgctactcacaagtgcattcatagcaccagcctttttatggtgttggaatccaggacgtttctcacgagacacatagactaaacgaggaagctcattgccttcggtatcaaggcctccactatgaccaaggaaaacctgagcatgaccagacgtcaagagtaagaaaattgctggatcaataaccacaccacaatggcaatatctaagtgatatttacctgaatcattccaggatggtctctggtattgttaccaggccaaggtgtgccatcttgcataatccatccttcctcaggaactttctgtgccttggcgacgagagcattaacacgaactttaaattcttcatattccctctggattttggttttgcaacagacattaatgcgagattacaccaaaaaaaaaacaacaaaaaaggtcacacatataaaccaaatttaccttcatggcacgacgatctttaacaaaagaa

SEQ ID NO: 84675 - DNA, 588 bp, Oryza sativa
caccacacatccgttgtcactgcactattaagtgcatctctttatagctagatcatcaaggatcaagatttatctttgtgatgatgtgtttgaaggttgtatcggtgaaggatctggcagaggattcgccgttgccatggtacctgcctcttgattccagccagttctcactcaatggcttccgtctcacccgagtcggccgcttgatcactcacatgctggttcttaacattttactgatataccatgtactccaatctagaattgtagtattatttgtgtcgaactcagttataagttactactacattttaagaccgagcgagtactgaagtaaatgaattgttggtagagtgcaattgacgttcttaatttacctctaaaaatctttaggttaagacgctcgagtgcctccatgttgccccacaaggcagcctgagggtcttcagctttcttgagaccgtggcccaagggcttgtgaaaggcgccaagtaagttgatcggcctcgagcaaatctgaagcaagaaaattttgaatttgtgcccaaattatatcaatctcccaaacagttatgctgctgaatgaat

SEQ ID NO: 84676 - DNA, 565 bp, Oryza sativa
ctaagtagagcaattagcaaaccatgatccgaaaggagagctctgaatcgtagggggatcatcacgccttcaatggctggaccttgacctgatccagcacggggccgcacagcgagacgccgtcgctcaccttggtgtggtagtacgagctgtagaaggtcaccctggtgcgcacgccggcggcgacgaaccggaagctcgccggcttgaacccgccgtttccgacggactcgaacggcaccttctgcgtcacgttcccggcgaacgccttcaccagcatcgacccgtggcagccgttcttggcgtcgccgacgacgaacgataggttgtaggcgcggttcggcaccgtgcggatcacctgcgcgatggcgctctccctgccggcgacgagcttcacggcgtactggccccgcgggacggagaaatgccccgcgttgatgaagcggacgggctttgagcgactcgatgattcagccccggagcgggggacgtcgcgttcttttgctttggcggaaggaggacccccaccgtcgagttcttgaacacctgcggcccgatcttgaat

SEQ ID NO: 84677 - DNA, 655 bp, Oryza sativa
tatatatagtacctttatggagtcctagctcctaggatcaaccgatcaagcatgtcacttgtgagttgcgaccctatattaaaaatctgcttcaggagtttatgacattaaacaattgttcatacggagactgaaaatgatgccctgtgctgagagatcccctcataatttccccaaaacgtaaccatgtgtgaatagattttgagtaagcagggttgcagccacgagtgagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaatccatggctcctttgccgacgctgagtagattttaggtgacgggtggtgacaatgagtccgtgtcgagcgctgatttttt

SEQ ID NO: 84678 - DNA, 1520 bp, Oryza sativa
ttactgtcttagagaagtaccatcggtcaattttgagagtaccctcatcagtaggctcctgcttggtgccatcaaagcacagattagggtggcatgtccagagcattctccagtttcttgacacaaggctcgctctagccgcatctctgagtggcataaaagatactataagctgctgaatatcctgtcattacaagagaaaacaaacgaaggcatgctcaatcaatttgtaggtgctttgattctataataatagaactcatccgtgcaataaggcccaatgtttcatctatgtgaaaaatcacacaggcaggcaaggcatggcaggtgttgatagatgataggggaaaaaatgaacttttttttttaccccggatagagagaagtcagggaaatttagagttttttttgggaatacgcaagatgcgcatctttgtattaagagaaataaagagtatttacacgaacccaaacaagaaaataagagggggacgggaagataggagaaggacccaaagatcttaagcctattctcacgccagcatatggaaacgacctaaaccaagacctaaatgattagcaccggtagcaccgcatgtgtcaaccgccagagagttgcttccgccgccatagctcgggctatctctgaccagggcctttgctgagagttgaaaaccctattgtttctctctttccagattgtccatgcagttagagttgcaattgtgtcaaatccccttctgctagccgctcccactttaaggcgggagttgcaaagccagagataaaaggagtcttcattcagggggagacactgcggtagaccaatgctggaaaggacagcccatcaaagtggcgagactctgggcaagcgacaagatgtgatcaatagtctttcatgttgatcacaaaggacacatctatccgggtgaggcaaccccctagaacgcaggcggtccgccgtctagtagcgcctttttgtgaccaaccaggcaaagaaccggcatctcggggagggggggcgaaggtcttccagatgggctcggattggaaaggaaccctacctagaaagagtgcccggtatgccgaacgcgaagagtagactcccgatgcttcccacttccaaataaaagagtcggggtggtcagagagccgcacagaggacctcaggatgctccagagctgaaggtactcaagaatagcctgcaaacccagcgcccctgtgcagtctctaatccatctcctgtcttgaagggcctcggcgaccgtcctgcgacggcgaagacgtgccgggacagccgcccaaacagccggagcaatgcagcgaatggaggaaccctctagccaaatgtcttcccaaaaaagaatggactccccattgcccagaacgcagactgttgaagccgtcgcaaagtttcgctcgttcaaggaaaccgggatgttgaggccgtgccatggcttatcggcgaagtgcgctgcaaccagacccatctcgatcttaaggcgatgcccatgcgatc

SEQ ID NO: 84679 - DNA, 1413 bp, Oryza sativa
tagttttttagctcttttttgccccattggtcttggctgttcatcaagttcatctacatataaagggctactatcctctccttccttctccttgcctaacccctttgttgctattctttttcttgctgctttcaggccattgttgtatgtgatccactttgcttcagttttaactgtgttccatacttccatcaacacaaaaggacctagattgagtttctcattgtcttttatatagaatacatgggccttctcaatccacatttgatcattatagccacttgtataaatcattctagccttcaaccaagcactatggaaaaggtcagtccacttatttaccttatgaaagcggtccttgatttgcttggcatttcttctcctatgacttggtgtagtctcattgtaagtagcctcaacatcagtccaatattgttcattcttcctatcagcaccaacggttgagtccgttgaattgagcagccaagagctcatctgtaaatgttaattagcatatattatcacttggactgttatggtaagtaaaaaaactataaacacagtgaatttacagtgagactcaccatcctaacatcttcttcttgagtccaaaagattcttttctcagtcctaggtgtctcatcaccactgtcaacattaacatatgtattgtccctagctgaaataggagtcgagtaatcatcttctgactgattttggtctccaacaaaattaaattgttgagacaagttaggctggatcaagtttatgaagcctccaagaggtgttgcattgtttcccctgccatattttacacatatatatgagcaatgaaagcaactagggactaatgttatgtgtaaagtaggaactaatgtttgtttcagtgcttcatcctctttgatgttatacagtggataaaaactagttacatagctttattaaactatcaaagaaatctgcaccagtgcaatcaatctttgcatcaaccacaatactgaaactcatgacagtgtatcccaaatcttgtataagcgagggaagtgcaaataacatctaaaattaattcctagccatatgattcccatcattgagctcatcacagaagcaaagttcagagatagtaccatgttgcaggatctgaagattaagaactccatggttgaccactagggctttggccggcgttgccgaagaagccgccggcactgccgttgaagaagcagctgccgtcggtgaaggagcttggtggtggactagccgcgccatatctcgaactccggtgctctggcacacgcgccgccaaccctgaactgctctgctccggcaccatcgacgccgcccgagctcctccctgggccttccgcatcggcgccgccgcaccctttcgagattgcgatgcagctggcttgc

SEQ ID NO: 84680 - DNA, 727 bp, Oryza sativa
tttccttttctatcaatagtggacaaaggtgagagctgatatttattatatcctgttagccattcagaaagtgctttccatgacattccaaacgaaatgatatttttctcatgttcagtcggccatgcatcttcagtttaactaaacaagtcaaaaaaaaaaaacttatatccaacataagatatatatgccctatgagcataaacgcactcagtgataaaatatactagtaagaggtaaagctaaggtgaatgctgacaagagacaagcccatctgtccctcaaagataacaaatactactactgactgaaacaaaattaaagcatgatagccacttctgaatttctgaatggctgaaggggaaaaaaattgaacaggatactgcatgctgatcgagttgaacaagtaagaaaaggtgttcatctttgcagagacaagatctaacacatttctaactgcagaggtagttcatagcatccatcgatcacctacacacaatatcctctctcatgcctgacccctgcacaaacgcacaccggattgcaaatacacataatttagatctttctaatgattttgtatcgtcagataatcttgcttgttttggtcgaccttcagaattgagttgatgaagttcgtcgcagtgagctctttgtaggcatcaccagtgcagcaacctcctgtttcagctgtccaagcaaaagtacaagtgctcgtcacatgaat

SEQ ID NO: 84681 - DNA, 1687 bp, Oryza sativa
aacttcgaagtagactctggactgggacagctcaatgcaaaaactgtgtcagctactcagctctttgataattatccaattataatcaagctgtaatgacccagaagagcagaaatgatttaagccagtctaccaagtatatccaggagattgatatgcgatggtgtccaaggggcgatatatatttatatattatatattatacatcagatgatcagcacaagccagttcagagttttgagaggtatgttacataaggagaaaggagtgagtagatagaaatatagatatatatgtagatagttcaaccaaaaagatagagcatgtagcaatataagcagaaacaaaatgctctatagattaagggttttctatatatatagagagagagagagatgtcagtcttcttctctaagaacagcaacactgatggacaactcgatcgcagcacacagcaagaaagcagagcagcctcctcctccttctgctacaactatagcagtgatcaccatggccgtcgtcgtcgtcgatctcacagcttcctccggcacaacgggcaggatccatgcttgatcaaccagccgtcgatgcacggcacatggaacacgtgccagcaatccggcaagctcctcaccttctcacctgtctggaaatcctgcagtagtaagaggagccaaatgtttcagaattcacaggattcagtaatcagtgagaattcatgcaaagatctggcacatcaatgagaagcacacggttttgatacgagacagtgataaattaaatatggatgcaatgtactctcatcaattggttgcaaggtaatgtgcaagcaataatgcagagatgttcaatttaggtacagtgagtttgagaaatggtaaaagtttcagacctggaggcaaactgaacatcccgagaggtcaccaatggcgttcctcctgtactcctcagtgatcctgacctccgggagcttgtcgatggatgcccgtggcatgccgttggtgccctcgatctcgaacaggtcaggggactccctgaagggcgatgaatccactgcattcatctgaattcagaggcaatctcgtcagacaaatctgtaactgaagctgctactgcatatttctgaatcagacgcaaccatgtatgcaggggcagattcatgagacgaccaaactgacctggctccggaccacccgctgcaccgccggatcgaccttctcgcggacaagcctgccggtcaggaggctgtagatcacattaagctgcattttgtgcagagagatttgtgttaggtttaacaagccaacaaaaaaaaattagcaaaatgtaaggctgtgagcacgtatatatgacagatgaagcagaagagatgttcagagatcccgtttgtgcagatatttgttgcacaatctacctagggagcttccccccccccaccccccctaaaagtggtactgagaatacatgagcaggttaattagattgtaaagaatgcacaaattgctttggaaaacatcatctgaactattcttttttgtacgaaataatcatctgaactttcaagacagcaaggtttgacaagttgtatcatctcataaaagaggcagttagctttgaccctttgttttaaaataaacacaaacaggttatatgaattaagcaaggcctagttcatataaataaatta

SEQ ID NO: 84682 - DNA, 573 bp, Oryza sativa
catcaagcacgtaaaacatgcttccttgcaagttgcacattccaagaggataaaaaaactcgtttaatttactgcatgtgccagaattggaggatgggaaattgaccccttttaagctagtagccgccatgatctattcacggtttttactttcttccaggaccattcaattcccttttctacgtttgctggagatcgttgatatctgaatttttaaggtgaggggcaattaatttacagttcgcaatacctatttagatgtgactaaaactttaagaaactatcacatcggatgtttggacactaattataaatattaaacgtagactattaataaaacacatccataatcttggactaatacgcgagacgaatctattgagcctaattaatctatgattagcctatgtgatgctacagtaaacattttttaattatggattagttaggcttaaaaaatttatctcgcgaattagcttttatttatgtaattagttttgtaagtagtttatatttaatactctaaattagtgtctaaatatagggactaaagttaaaattagtgtctaaata

SEQ ID NO: 84683 - DNA, 705 bp, Oryza sativa
ctgcagcccttgtaccaggctggatctgttatcctcttttgtggacagagtaaattcggacaagaagctactagcactgtcgattttgttgtgaatcaatctgatttcaccattcagacgctaaggaatgttaccgattacttatcgcttgcaaagacaatcagtgtggcagcactctatcttccttcagatgtacaagggcaaattgacaatttgaaagtggacttaaataaagcggctgatactatatcccaaaagacatcagaaaactacagaaggataagaaaagttctccataacttgtacgtttcaaactattcttgccatgtttacctctggtttcttgactttgaaagtcactgactgaataatagttcatgtgactatatagtatatttatctgtgggcctatatcttttcttcaaaatgacggcactgtgttgctaagaagcgtaatcaaaattcaaaatggttattatggcattgcattcatttatgctagcacattattagtaatgctatgccttcaactgaaaatttgaattcctgttttactacaggtcagttgctttgatttgcatagctgcgttgatgcctgttcttgcattcttgggatatggtaagaatttcattctgttagtcaaactgatgccctttttgttggttttgttatctcagatgtgttaacactcactacttgaacaa

SEQ ID NO: 84684 - DNA, 736 bp, Oryza sativa
gcctctggcttaacacttggcctcctcttgatgctttttgcggaccgcccccaaagggaggaggtgtccgagctgccatcagggtcaaggatcaccccagtagactgctctccatgacgagctcagtctctatggtcattcagactagtatagcaattgcctgtaatagttaggaaaagaagaaggtgaagcactggggcaaagccccattttgcagtggagatgatctaggtggatgagtgcttccttccgtggtatacatggtatgtttcagggaatagttgtaaaggctaatgcctaatggcaaacaaaatttgggcaaaaccccactatgatatgaagagcaatgttctgtatcccctatgattgttcagctggacatgtttctttcttatgtacatgtcttgttctgtgtgtttccatattctgttggtgggggggacattccttgtacactagatcagcctgatgtctatgctggaggttggaacagattttgcaaccatgtcaattgatgcagttgagcaagcgggaggttttcagaaaaaaaaatgcacaattttcagctctggtcgtaagggttgtacttgcacagcagtaaacttacagcaattctaatgtcctttttttaaaaaataataataataatggttacatcttcggcctctgttagcaggcgcacaaccaaattcggatgtccttttgtcgtaatattactagtatttgcttcattgct

SEQ ID NO: 84685 - DNA, 1420 bp, Oryza sativa
ctaactaaaaggtttgtgattgaatattaatatattttttctatttctgcaggtgaagtattatgtgataatgtgttgataaattgataaatcattggcagggtcttagacgagagtgatcctgacatacaatcaaaagcattggattgccttttaaactggaaggatgaatttctgacaccatacagtaaaagtctcaagaatttaattgactcaaaaactctacgtgaagagctcactacatgggcagtttcatatgattccttgtctatccagaaagaccacagaagtagtgttgttcctttggttatccgtgtattgacacctaaattaaagaaatttaagttgcttggttctcgaaaggtccgtatttacttagctaattgtttatgtaccacaatggttaaaatggatatttgttttttaactggcacaaactaacacctgtatatcgtgctttgttgtgccagcacacaggggttagccatcgaaaggcaattctccgattccttatgcaatttgattcaaatgagcttcagctctttttctcgttacttctgaagtccttgatccctgggaaccttcgacttgaaatatttgggtctcagtctgacaacctgcttggaaatatttctgacattgtggaagcttcaacagagatctgtttagagaacctaacatggaaaaaagcaaatggttttcttcatttggttgaagaaatctttggtacttttggtatggcacttataagtccagttcttgatgttctattgctcattgttgttcgcttgcttgagagttgcatgcggaatctcagaagtatgaatgaagaggactatcctagcaagcaatcaaatgaccctgatgacgaatgttctatgactctggaagctggtaattctatgagcctgaaagaacactcaaaagatctgccctcagcagaccataacaaggtgtgtaaatacttgtgtgttgcaacggatttcaaataaacatcaaattttctaaacttagaacttgtatggccacagatatccttttagtatgatggatatcaagaaataactcatatgatttgcaaccaaacattaatctgcaaacaactctacagaggttgtggttgagcgatggccgatggcagactcaccattaatagaactactttttaagttagcccaactatagtgattatgtatcgtgattcatgcaactagtccaaactagttaagtctattgtagttcattttttcttgtgcttgatatcaacaaaacgtctcctatcgggtatgataatatatccacgtcgccaatcttaaacaacagtgacaggtatcggcttggatccgtaggcatgaaggtgcttgaaactgctgtcctatatgccttggaaaaagcatggtgctctgactgttcccacttc

SEQ ID NO: 84686 - DNA, 708 bp, Oryza sativa
aggttttgaataatttagaacaaccaatcaaacaaatatgctgttcattgttgaattctgtttgtgtcaccttctatcatatgttctatgaaatttcagttttgttgggaggctatttcgtcatgcacttgaagaatcaaggcccaaatccgttctagttcattcattgtcagtgtgcatatctctgttggatccaaaaagattggcatcagcttcctatcaagcatttagaagcaacttaagtcacggggcgttggtcactgccagtccagagactgttgatggcatgcttgagagcctaggtgagttctggatatgtctttgtgcttttttttgttaggaaaaaatcttctttggttcatctatactcgaccttatcatatgttccatttctagggtatcttgctacctgccctttgcaatgttaagtttttgtatattggttataactgaccatttttgtaggcaatttgctgaagttattggatacttctgatgctgaaaatgttttgcctacgacatatggatgtttacgcccaccccttggaaaacatcgtttgaaggtactggatgatgcaatgctcatttacaaattacaactgaccatttatccatttctgcattcaatgattatttcttgttctgtacaaagtcatttgcttaatggatggatctatgcatttaataaacatatttaaattgcctaga

SEQ ID NO: 84687 - DNA, 12085 bp, Oryza sativa
  unsure (1)..(12085): unsure at all n locations
ttcttttagatgtcttgccttgttgattaaacttcctttgccatctctcaaggacaatgcaaatctgatcaagaatgtacttatggacattgcacagagagctgggaattccaatggtcatttggtcacatcttgtttgaaactgcttgctgatctacttaggggtttcaggatttcactttcagatgatcagctccagattattgttcatttccctatttttgttgatctccagacaaacccttcacccgttgccttgtcgcttttgaaggcaatagtcaaaagaaaattggtttcccctgagatttatgatattgtagttaggataggagaattgatggtaacaactcaaactgaatctatacgccagcaatgcatccagattctgctgcaattttttctaaattatccactctctgagaagcgtttacagcaacatattgattttttcctgacaaatctaaggtaagaatatccgtagctacttacctttggtattgcctttgtgcgttgtaagctaaccttatgcaaatttgcagttatgagcatccatcaggaagagaagctgtgcttgagatgctccacaatattcttaccagatttccccagaggatagttgatgaccagggtcaaacatttttcctccatcttgtagttgccttatcaaatgaacagcaccagaatgtgtcttctatgatccttagggcaatccaaaagttgttggggcgcatcggtgatcagggaaagaattctatatttgaatatactctttcatggtacacaggtgaaaaacagaatctgtggagtgcttcagcgcaggttaatatcagaactactttattttcccaagcactacattgcacgatttagtgcgggcagttgcaaattgtgccctggatttgctttcacattttgggagagcattgaagcatttccctcatattattttattgcatttatacaatcttcgtttcatgaactgagaaataatccttgtaaaaaaattttcaggtcattggtttacttgtaggggatcgttcgttgggaattggcaaacaccttaacaacattttggctaacgctaagcaaataatggaatgttctgtcattgcttctggaggacaagtagatttagctgatgaaacttgcctgccattttggaaggaatcgtaccactccattgccatgatggagaggttacttgcacgatttccagagttgtacttcaagcaaaatatggaggtatgattacttgtgagctgtatttttaaactgttttacaagaataaattctggcatgattttctctgatagtttgatgcaatgctattctccattaattgcatgctgagaaccatcatagtacatagatgactcttgatatgcatctgttagccttctattcaagtgcacttggatatggtcattgcttcactagtgttccctttgaactagctctgtataacattcagattatgttatttaaatctagatgatgactagcctttgtgtttgtgccttattattactgtatttccgtagttacgtcttttttgtcccatttaatgatacttagtattttttattttgatacttctgatttgcgagaagtggttgttaacagtatgtgtttgagacctgcaacttccttttggttgtgcaatcaagtttgtgacccaattctacctgcaggaaatttggatgatagtttgcaagttgctgatccatccccattcaatgttgcgtaatatatccagctctcttgtggcctcatatttctcttttgtagagaagagtaagcgtgaaaagaaatttgatggcaagtcctcactgcttatccaaccaagcatgctattcctaatagctgtttcgttgatgaaacaattgagagcagaactaagtgatactacagcgaacaatctaattgtacaaaatctttcgtattctgtctgtaacttgcatacattggttaagcaaacaacctcgccacaccagttttggtctagccttagttcttctgatcacagtgcattccttgagggttttgaattgtttggttcaacaaaagcaaagaacgcatttctcatctgcacttctgcatctactgatgtaaatggatctaaccttgatggaggtgaagagcttacatctttgttagtttcttcgctcctgaagaggatgggaaagattgcaatgcagatgcaggatacgcaggtaagcagcatctctcaacatgaatattattctcagattgaacttatactttgcatacaatacttagagttgtactttcactatgcatgtgcagatgaagattgtattcaattgcttcagcatgatttcatcagcgcttggtgctgaagtatcactatcctatgctaacctcttcttgggccccttatataaagtttgtgaaggatttgctgggaaagtcatcagtggtatgatctctgtcttcattattccaaactgggaaagcttcaaaattgttgggattctttgttaagtccttgtagttgtatttatgtcattaaacttatccgaagctatttttattatcagatgatgtcaagcaattagcagacagtgtccgcgacaagttgtgtgacctgattggcaccgagaaatttgtagaggtttacaacagtgtcaggaagggcctcaaacagaagagggagagcagaaagcagtcagagaagcttatcgcggccgtggacccggcgcgccatgccaagaggaagctgcgcatcgctgccaagcaccgggagcacaagagacggaagataatgaccatgaaaatggggaggtggttgaggtaattttggtatcatgtgctatgtagaatcaatttgtacagcgctcatttccgcactgcaagttcttcgcgtagaaggcctgcacgaaattttggcatctctgcagaattttcccatagtccaatgtgttggtagatctgcttaatgtaaacttcgctctcacagcagagtgaactactagtagacagacatacaccaccatatgacaaaggaaagagttgcttattagacgtgtatactgttaggtacagacgtgctcgtgttttttgaccttagtctatagtacaagcgcattgagatacggagatcatatctcgtctcttctttattgttttttggggtgtaactctatttatgcggagaacaaagctgacgctaacgcgaaccagatttatgtttttatttacggatccggatcagctgcagtcatattattgactaagcaattgttttacagtgatgatgatgacctgtcagtacttctaatggaaagtgcagccagattaatgccatccaatatatttcttttgaaatgattctcctcttgaacagtcttctcattcaaaatgctacctgcaagaacacatagcaccaatctcatgtggtgtttgaatctcctaaagataaagataaagtttaagtgtttcacgtaaaataaggtgataataacgtgtgattaattgagttttaattattacaaatttgagaaatggattaatctgatattttagaacaactttcatatagaaagtttttgcacaaaacacaccgtttagcagtttgaaaagcgtgcatcaaaaagtttatccaacttttgttggagaaaagaacagagccgtatggtaataatactacgtgcacctgtttagtgggaaagccagtctaatcggtttattggcaatgagccgatgatagcacatgtacctatcaactgaagaaagccattccaaaaacacctacggattaaattatgaaaaagaaaacgacttttctccatcgaactatttcgctagagcaacccattaaactatttttgacttatttttgcaccctaaactcctaaaaaaaattccaacttcttaacggttttttctcaatataagttgtattttgcactaaaacttgatatgtgatatgtgcactataactatggacttttttttaaaaaaaaagaactatttatgtaagttagaagcacctgcgactgatttaagcatccatattttaaagtttcatgcaaatagtcacgaaaaaaataaaatatttttaaactttgatagcgttgtcatctgtgtctaaaaatttccagcttacagtacaactcgtataaaagaaacaaaaactaataaatgctattaagaagaaaagtgaattgtttttaacattcgctttgatcgtttagggctgaatgtagcagttgcactgctgcagccagcaatactgatcagcgccattcttgaagctaaaatgaaaaggcaaaaacagtttcacggtttaaaattgttcaaaggagtaaaatagactctttccactaagaattgcctccaaattaactcaatggtgcgaagtgagcttaactcgtctatgatgacttcatcaatctcaagatatgctaggttcaaattctagatttaatacggtgtttgtatttatgactaattattttttcagtggtggacgacgtaaccgtcgacggtgggacgtccgtattaacttcatcaatttcaagatgtgttggcgtagtccggaggtactcatagtgataagatgtgtgcgcgtatattcatagagggaagagtgtgtccatgttgtaaacgcctacatttatactatgttgttttttataaaagaaaaagattaactcactgctaagtttggggggagcacatcgatcaacatctccggtcgtggccggtctccagccgagacgacccttccatacgtacgtacgttgattagttgaagccagccagccagccaagattattgtcgctgtctgcccactgctctgccttaccacccccggccccgcgccgtgccaccgggctcacgtcgctgtgctagctacacctaccagctggccggccccgccgttgccacgcgacacactgtcgttccctgcccgtccggccggcaaacgccctcgcagaattctgatagtaatacaagtataaaacagagcattggaaaatacagaaaaaacacaggaataactgtttgattggaccacagaaaaaacacagaaatcggatgagagagatagactcaaaggaatttttccaagaggttgtacctcttgctaacttttctctaaaatctctatagtattagccattccatgggaattttaaaagatagtataggattcaatccttagtttcaaaggctttaatggaatttcttccatagaattaaaatcctttaaattttctacacttttccaacaaatcaaagggtgcctaagccacccccgtctctacgtccgccgtcaaagtcgccccgccggtccacgccgacgaccgccaacttctacacacaccgcagctgcgcagcatgagggtatagctagcttgtcagatcttgtttggtccgtcgtccatatacgcttgtgtgctctaatgtacttgcccgactcctactttttcgttctacgtacgcacgttttctaaatagtttacgcattacgttttatgtaaaaatatttttatataaaagatctgattttgaaaaccatattaatccagtttttaagttttttaatactttattaaccatacgtcaatccgtcacactgttatatatgtgtgcttgagagctaaggtccgaaccatcacgatacacaggaccggcccttagctagggaaaactattttaaactctcgaggagatatttacttgttgtttctatgtcattaaaatagttataaaagaactgaaaaaaattgaaagatgaattaatatgtgatatatcattccacaagtatgcaacttaaattcaacttaaaatttgttttttcctgtgacatatagaagttgaattttcagttgcataattatgcagtgatatatcatatactatatcttaatacatttttctctcttttttttaattttttcataactatttgtgtgacgtactccctccgtccaaaaaaagacaaaccctgagttttcgtgtccaacgtttgattgttcgttttatatgaaattttttataattagtattttcattgttgttagataataaaacatgattaatactttatgcgtgacttgtctttttaattttttttcatagtttttataaaagagtttgtcttttttttttgggacggagggagtataagcaactagggaaacgttccgttgagtttaaaatccattctcctaagctagcatggatcgatgaggaccccacagcttttttaaaaaatatctctatggaccttatttttatgtataaataaaaataaataaatgacaccacttaaatacatagtagtaattgatttaaatttctggctccgtctggacaggagccgggccacttgtactgcacagttctggacttctggtttagcagagactcgccgcgcgcgcgcgggtggccgtcgcgttgccggccgtagctgtcgcatatccgggatcgagacgtgcgtgtatgtgctactgctgcatgcggcgatgtttcctgccgcgattttccaggcaaagtccccccgcgcacacccacactggcacatgtactacgtcgccgtcggtttgaacgcggccgtggtcaccgcacgcgcgcgtgcagcatgtcgccatgcattcacagctactagctactatacagtatacacacacaattccggttgataaagcgctctgcgtgagctgagctgagctaggcgtcgcgcgcgatgtcgtcgctgtacccgtctctcctctcgctgagcgagagccccgccgagtaccggcaggtcggcggtggccgctacgcgggggaggacgtcgtcgacgacgacgacgacatggctgccgtcgccgacgctgtgtccagctacctctccttcgacatggacgacgtcgagtattacacgccggaggtgggcttccactcaaagcagcacaacccgccgccagttgctgcggcgccactggaagccggaggaggcagggagcaaagccggcgggaagccgccgtcaatcttggcaagatggacaggtcagtcctatgaattctctgacaaaacaagtctcccttggttagctcgatcgtgatgcagttttagacgagtccagcttttgacacggctgccttctttgcaggggaccggcgccggtgagcggcggcgcggcgactggcggcgtgccgaggagcaagaacggcagcaagatcgcgttcaagacgaggtcggaggtggacgtgctggacgacggctaccggtggaggaagtacggcaagaagatggtcaagaacagccccaacccaaggtaattagttaacccatccatccatccttccatcgctcgccggagagcacatctcgccgccgccacgccatggttggttgatcggcgtccgtacgtgcaggaactactaccggtgctcgagcgaggggtgccgcgtgaagaagcgggtggagcgcgcccgggacgacgcgcgcttcgtcgtcaccacctacgacggcgtccacaaccacccggcgccgctgcacctcaggccgcagctgccgccgcccggcggctactcgatcgccggggcaccggccgtggtggcgccgcacggccgcctcgggctggaggaggccgaggtgatcgctctcttcaggggcaccaccgccacctcgctgctgcttccttgaccggccagtccgacgcggcggcgccggcggcgacaactgactagctagtgtgagtcctgggccgtacaggaatggacaattagtttgtctccgatcgaggaccaaggcgacctgaatcaaaattacggcccatcgatatatagtaggtcgtttaattcatcgaaattagacgaatttcatgtacaattattgcattacagtattatttgaaacagtattgtatatatttgctatacaatttgatggatcgtatgtctttagcagttgtaagtatattaatctatagatctagtagttcagccatgataaacctttaattatttgtctagaaacaacagccatgatagacgctatgggtcataccattttttaattagtgagataggagatttaattacctcattcgttgcatggagtaaaagagaactttccttagctcttatgattgagtcaacagcatgcacatatttgatccttagaacaaaatttcgacaatcataaacacggatgatagaacggtcggttgatcttttatgctagatgaaaccttatgtgttgctgtacaaatattatatgataacggtaacaataaagtataagatatatttgagttccgctatacgtacgacgtaactttatatactttgtacaatttgcatctttaatcgatattcgtaaaatgctatgaataattaaaacagtgtggtttatgataacttagattatatatattgcttatcgaaaggaaaaaactaacatgatgtggctttacatagaagaaaaataaaataaacatttttttgcggggataaaataaacatttttgaccatagaataatcatccaaggcctaaaaacaattaatgtggtgtggcttaacgagagaaataacattaattatacttagcccctattttttctgattaagatatagattcaccttggtttatgctggcacgcgttttaaactattaaacagtgtaattgttcaaaactttctatatagaaattgttttaaaatataaaataaatccttttttaagttttaaataattaaactcaattaatcatgcacagatggctttcttgttttgtgtgtctatacttaatattcatcttgggtggatgcgaaagagaccttagtatgaatgaactatatagctacatagaatgtggaataacacatagccatccaatcgagactcaatggcttaggtcatgtgctacaacaaatttagagtaattaacttcacaaaatctcacatattttgcttcaagttgtacaaaactatatgagttttgacgcgttgcattggaccatggtattatagttctatagtttcacaaaacaacacattatttattttatctgatatacatatgaattcaaaattgagtaaagtgcacgagtaacccttaaacttgtaatagtgtgtcattaggtccatcgcccgcagaatttctaggtcagcctaggctgccattgtcaaggcccctcctcttcctttgccaacaggcgacccaaggtcactctggcgagcgccccgtgcgatagcgcccgcagttataccgagaagaaggataaaaaattggtaaaaagataaaaagaaggagaagaaaagaaaggaaaaggataattttaagtgggtcatagccttggggaaaaaagtacgaattacccccccccccaaaaaaaaactatcgtggtcggccaaattacccccataaacttgaaaaccagacattgctcaccctaaactttcaatatcggacgaattaccccctagacctaaaccagaacggttttatatacattttgagagtttggggacctaatatggttttgtagaactctaactataatatccggggttacgttctatgaaatttacttataaatttatagcacgaacatcgtttgcggtacactagattacactattgttacataaaattatcttagtcgactcaggttgtgttcggtagagctggtttccatcttttaccccttgttttccgtagcatattttttcaaacttctaaatgatgtatatatatatatgtatatatatgtatatgtatatatatgtatatatatatatatgaaagtttcttttaaaaagcatattaatctattttttattttttatgttttaagataatacttaattaatcatacgctaataagtaccccgttttacgtgtgggatgagcatatcccaagaacaagtacaatagtcgatggattggcgataggtaggccacgtagactgcggtgcaataggttttagctttacgtgattatataagttaattaacgtaactaagctatgtgttgcaagtctctgaaattaaaaaggatgaatagagatgagatgccgtgtcattcatatattgagtaaagttgtgctatttagtgacctagttttaaaattgcttttcatgtttttctttttagttatattaacgtacattcggacatacaccctccgtcctaaaataaattcaattttatacatgaatctggaagaatgcgttgaaatacatccaaaatcgtaacaatcattttatgtatatattagtgcaaacgacaaataaacacaaaattcaaaatataattatacgaggagcgactatgcgtgtcaaattaatccacaatcatgcatattagagtgaacaagaggcgactgtgatgacgctctctctcgtggcccgatcttctggtgaggggataactctcgctttgatcgagtgcaacgtttgcgacgtggctaccaaccagaacaagtccaggatgccatgcaatcgctacaccacaaacgatgttgtaccaaccgtgacacgcggttgatgatccctgcaatgcaaacgagagaacactgcaataacaagataagatgcaatctaaatattgcgaataggtaattaagcacaaaggaatagttgcgattgaagtggtagatctaatcgacctggcaaatcaacacaccaactattgggggctctaaatctatagtcgctggctaatcgagcgaggactagagacaatgtgaatggcacttggcaaaattcaactaaacaaaacccaattgttctagagggtgtcatggacatttatagagaaaaatagatttagtgtttagtgctaactagtagaggtagagggagacacttctgagataggtctagtctattacaaggcctaaggcccaagttcggtttcagcaatagcactgccttgttttgacgattcccgttgactcggaatgaatttggatatgagactggatgcgtttgaaaggtgatgagagaagttttccatgaagtccaagatcacccaaatcggagttggcataaaggtgctaggtccgtttgaagtcagtgctatctccggaggacgaactggattgcaaaactcattggactttaatatcttgtagactgccattcattcgatgtattctttgaaaatgttttatacttctcatgcttggttttatgcatatagttgatggtcacatcagattgggtgaggccaatctaccacgccgcagtatttgagtcaccaagttccacaccattatccaaaaaggcaccgttgagttcttacgtctcatgaccagcaccctctatctctaaatcctggcttcgccactagagagagaggaggaagaagaggagggagtgagaacgacatgcatggccccatcattntttttaattatttttggtgtaactgacatgtgggtccacggtttttattattttccaaattaaattgccacgtaagtatcacgccaataccatgtgggagaacttagttaaattagccacgtaggtgccatgtcagccaaaaccggggataatactgtcaaaaaaccttatttatgctggttttgtaagttgggggacccgttgtatctagttttttgttcaaggatgaaaatagtatttggtgtcatgttaagggaccttaagtgaacttattccaaagtagtaagacacatttgggcctttggcccaacctaacgattgggttgatcaggactcatgcaggccaaagttgaagggtaatctctttttataaaactcatgcattttattgatagataactaggtggaaaaagtacgaattacccctcccccgaactatcgcggtcgtccgaattaccccccgaaccataaaaccggacattcttcacccccaactatgcaaaccggacgaattacccccctcaaaccaattcagagcggttttgtccaacgtggcgcatacgtggcaatccagtcagcgtttttttaaataaaaaaattgtgggacccacctgccatactcttctcttcttcctctctctctattctctctctatcgctttctctctctcgcggctcgcggggacggcaaggacggcgacagcgg

SEQ ID NO: 84688 - DNA, 1123 bp, Oryza sativa
attcctgcagccctcataggacaaatcaaagtacttctgtatatatgagggggtaaaaattttgaagtagaaatgcactaattctgaaatgacagctaaaatagaatggaggagccgagcaagtatcatgttcaacagaatcaccaaaaatagcttttgtggtacaaaatgaagaatggacctctgtacaccaatataatgaagacatgcccggatgctccataaaatctgaaagtatttgatattgtagggaagaactagttaattgtatttagcaaatcctagaaagcatagccagtacttgcatgatcatatcgaatactcgatgctaattgtgttcttgcatagttgtctcttcttatgatgaagctattaattatgttggtcaagtgcaatatcttatctgtggtaacccccatcagctacctcactgtcatgcaggaaagtgtctcaatcaagcaattgaaggatttaaggtctttatgtattagaattgtttccttggcacttaaccagtatgggagtaatgactttggagaaaaattctggaatatcttttttacttctgtgaaacctctgattgactgcttcagacaagaggcgtccagtagtgagaagccaagttcattattttcatgcttcatggctatgagtcagagcccaaaactagcatcattactgggggcacacaaccttgtaccagccattttttctatcttaactgtgaagaaagcatcaggatccatcacatcctatgcacttgagttcattgagaatctgatcaagctggatactgatttagagcagcatggagatcattcactgaagaaaattcttgtcccacatatggatgttcttctccatagtctcaatgattttgttagttatcgcagagaacttcacaggtatatttcgctttatttaattttggagtttgttgtttatctatccattattagtgaaacccctcatgtgtgaggctaaggcctttgaaactattttttattttgtacaaatgtgctgcatttgcaattctttataaactcttcactggttctatctgatcctctatcttcatggtctgactatcagctagtattatgggccataacccagtatgggg

SEQ ID NO: 84689 - DNA, 664 bp, Oryza sativa
ttaggaaaaaatcttctttggttcatctatactcgaccttatcatatgttccatttctagggtatcttgctacctgccctttgcaatgttaagtttttgtatattggttataactgaccatttttgtaggcaatttgctgaagttattggatacttctgatgctgaaaatgttttgcctacgacatatggatgtttacgcccaccccttggaaaacatcgtttgaaggtactggatgatgcaatgctcatttacaaattacaactgaccatttatccatttctgcattcaatgattatttcttgttctgtacaaagtcatttgcttaatggatggatctatgcatttaataaacatatttaaattgcctagatttgtttaggtttagtcattttgttttgtagatttcagtctcggaccagatggagtacagaaaagaagggacccaggacctgtgccagtctggtccacctaattggattgggtctggtaaacctaattggattggtgctgcaattggcccagcagattgggcgtcccagtatgatagaatgtgtgactcgaaccgtttaaggccatttaaccaattaattcacagaaatgatgttgccgccagggattgaactcacggtctacagctacggcatttacacctaaactagttg

SEQ ID NO: 84690 - DNA, 1373 bp, Oryza sativa
tacatttaactagcaagaagtcacagtattcaactacattctaaatgcatggtccacttacatcagtattggttcaagtgacaatctcgccttcatatttattctttttagaagtccggagaatattttttcacagtgcaacacgatttgaggcaatgtttgtaccaaatgtattgtctcttcataaaaggagatgaagtcatctgcagtattgagctcctgaaccagtggaaaagaacaatattagaagagctgatagactgaatgcacatcactgaagacttatacaatttaaatgaactaaacttggatccctttccaaacgttaaaaactaattttagaacactacaaatatcgcacagagagaccaaatggtgtgcagctaactatcatcttcagttcatcattcaaacttctacttatctctggtcaccatcatccaaataacatccatttttttctccaccgctaaatgctccccaaaagatcccaacaaacttataaaccaccaatcttaaaaggtagttgaaatagctcctcaacccccaccaaaagggatgtaaagcatttatttctgacacaaagtcagcatcaaatcaaaacagggaaaatgtaaaaaaattgtacgtccaaatatctagcttgctagctaagagatcaaaacattatcccatggaaaatggtgcctgaatattcatgattgaacaatatattagaacccttattctaatagctaaataaacctatttttgtttcagtggagtcaagtgtataattctaattctaacatataatagcagttggacgttttcaaacaccacaagatcacaaactgacaaacatcatgttcacagtttgccaatgccaaaaggacaaaactactcatgacacattataatcccatatacgctgcaaaatttgaatcacatataacaagaaaattccaatcattagaagaaaaataaggcactgaactccgacatgatcacaaccatccatttattctttcaatgttcacagttgttattgcagcaattccaattgctccatttcctaacagaagtcaaagccattaaccaacttatccaacgtgtttccttaatctcacaactgacaatgtaagagcttcaccagagcgaatgattaaagtgaaagtccctgaaaaatacatgtctatatctgcacctaatgaccaagttcaacccatagagttccagtaacttatgcacatacagaactcatggccactctgaggacttgttcggattaaagggtttacaccagattttgtaggactccatgattcttttggatttgctactattcacattcggattgtaggaatcacacaaaggaattttggagttctgta

SEQ ID NO: 84691 - DNA, 1189 bp, Oryza sativa
tgggcctgatgtatccactcaaatcttcatcaggtacaacctctagaggggcttggccacagagcatgctcaccaccgaagacattcttggcctctgaacaggtgatgtgtttgtgcatagaagagctacattgagcatcctaagtgcttcttcttgagagtagtgagaaccaagacgctggtcaacgatttccagtagtctcccttcctgcttcaatctttcagcctgtgggcagaaaataaatccagttagtagattcgtgtttaaaatgtgtagcaggactatcagcagtttacttggtgatattaacatgcaatgcaaggctaaatttcttgggtaattcgcctttcagatgtgaaacactttcagttagcactaggcaattctttcttctggcatgaagaatattggtttgtttgtgggctaatcctgatcaagagaaaattgtttatgggcacacctagttcattgttagcctttgtttgacagaatctcagtagctactagacagactgattatccattgttatccgttgggtgagtaccaagaaacttggtcttatttcattggctatagcagaatagctgccattcaaatgatcgattttggaactaatgttgttggtttatgttacaattgacctttattcctatcataacataattttgaacagccaatccaaatcatcaattactcagcatattatcagcctaaaatgtgacagagctctccaaagttaagcaaactgactttataaaagataacatatctatgacagaaattcgtcccataagatcatacccaattctatggggctggacggctggttatgaattcgagtcctaaaagacaaaagcagtaacagaaaaaaagaagctaaaatagcatacccagtcagaagatggagatattcgtcatctgacatgctacttgtattgctcattccactaacaatctctaatgtcaccactccaaaactgtatacatctgctttacatgtcaagcaacctctcgtggcatactcaggtgccatgtatccactggttcaaataaagaacggtatcagatgttggataataaagatttttacaatatacaataatagaaaatgaaaggtgaagtagccaataaaaatatagaatgacagcttacactgttccagctatccgagtgctcatacgcccacg

SEQ ID NO: 84692 - DNA, 1623 bp, Oryza sativa
tcaagagcatgaaccggatgaactcctccacctaacctctatctagctaaccaccaagaaccctaattaattactactgccagtactactactgctactttctgttcgagatcgatatcgagatgcttgatcgatgcaccgcatcgcatttaaaagggaagagatggatgaactactatttgtgacgtacacatatatagtagtaatttaattagcgttagttcgttgtcgtctcggctacgtgccacaaggcctcctttgtaacgcaggaattttataggaattctgtgacgtgtgtttttagatgtggggattcctataaaattcgtgtggaacttctctgcctcctatatatgtagaacttaaaaaatctatgtatatgtgtgtgtggaatagtatgttttggaccacgtgataaaattgcagagtgtttccttgcagattatggttttcttttaaataggtgagtatgataagttcccccctctatccatgcttatgaagttcagtatttcgacatctaaattatcaagaaaaaaaaggacatgtttgaaataagaagggaacttaattttgtttgaaatagggaatgagcttaatttggccatgtacatagcaagtgacaaaagacatgtgtcttccatgtaatcgaggagaaaaaatagtaccaatgaaatggaaccatggtcaaccggtgtgcttggaaaaaaagcgtaccggaattacttataaaatgagccttttgctagcatttctgcatttggctttgatgtggtgtcttttcttggactaggagcagtagcatttcgaagaaatctatgatatgtggtagcaatagttgaaagatgttaaaattgattagatcttgcatggtctttgacagtatatattctcacggattcatggtgcttaaatagaaacccgtgtagaaaggtagaaaatcaagcagtgctgctgaatgtttcacatctccgattttggtttcataagatcaatttcaggttcagtgagtttggatgggctttaatttgtgttaggctcttgtttggatgggcgtggatggaccaaggctaagacccatccagtgatccagagagactttagggagcccaaatccaggcccaatccccaccaaaatgaacttccaatgaacaaaacatgacttctttttggaaaaagtacacccaaggtccctcaacttgtcatcgagttacaatatcggtcctcgaaccacaaaaccggatataacgcatccctcaacttacaaaaccagtgtaaactaggtcccaagacggttttgagtccggttttatcccatgtggcagctgactcagcgtggaacccacgtgggccccatgcgtcagcctcttcttccctcccctctccacctctcttcctctctcctctcttttccaatctccacgggcggcgcgcggggagtagctgcacgggcggcggccggcgggcgcaggcggcgtggggaggagccgcgcgcgggcggcaggcggcaggcggcggcgggcggtgcacgagctcctcgccggacgaacgctagaccggctccgccatgtcggccgcgaggaggtggcgcgcctcgtcggctcgctcagtcggagtgccgcc

SEQ ID NO: 84693 - DNA, 503 bp, Oryza sativa
cctcgcaagcctcacaaggctgctaaagagagaaacttggcacctctagaactcttacactcagatctctgtaaaatgaatggggtgttgacgaagggtggaaaacgatatttcatgacgttgattgatgatgctactagattttgctatgtgtacttgttgaaaacgaaagacgaggctctagactattttaaaatttataaggcaaaagttgaaatcaacttgacagaaagataaaaagacttaggtctgatcgtggtggagagtttttctcaaacgagtttgacttattctgtgaggaacatggcattatacatgagaggacgcctccctattctcctgagtctaataagattgctgaaaggaagaaccgcacactgaccgacttggtgaatgccatgttggacaccgcaggactacctaaggcatggtgggggagacattgttgacctcgaatcatgtgttaaacagagttcctaacagaaataaggacaaaacaccat

SEQ ID NO: 84694 - DNA, 590 bp, Oryza sativa
aaactaattaaactagataattaattagcggagggagcaattaaattaaatgaattaaaatcgtgctagtagcttacggctcggttgtcggtggcgacgccggagatgacgaacatgaggtagaaggtgatgatgaactcgaggacgagcgactgcacgtcggagccggcggggagcgtgccggggaagtgctcgtggcggccgccgaacatgagccggagcgtgccggcggcgagggtggcgcccagcatctgcgccgccgcgtacgccggcacctgccgccaagggaacctccggcacgtcgcgaacgccagcgtcaccgcggggttgaagtgcgcgccggagatgtgccccacggcgtacaccatcaccatcaccgccagcccccacacgatcgccacccccgggaacgtgatctgcccgttcttgctctggttgatcgtcaccgccccgcaccccgcgaagatcaagaagtatgtcccaaagatctccgcgatgatctacaccatgatcgatcaatgcggcgcccgccattgtcaagatcaagaactctcaagatcaggaggaagaagaagacatgaaatgatgat

SEQ ID NO: 84695 - DNA, 525 bp, Oryza sativa
aatctcgctctaaaggccgaaaaaatcagcgctcgacacggactcattgtcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagactcactcgtggctgcaaccctgcttactcaaaatctattcacacatggttacgttttggggaaattatgaggggatctctcag

SEQ ID NO: 84696 - DNA, 755 bp, Oryza sativa
tcctgcagccccgactcgttcccgtccggaaatcatcacaggtaaacaccttgcctgaaatcgtgttgatccaaatagctctgatcaattgtctaacctttgtcagtggatacattaggaccaatgattggtgatgaagaagaaattccccgtatacaagcagctgaagactcgcacccttctatcttagtcaagtggtgggacgatgacaggcaacctcaaggaatcataataaacaaacaaaaagaagatgaggaagtatgcttgctgaaaaaggcactcagccaggccactcgcattgtgaatgtaagtccatttacgcatagctttaattgttccccttcatattttgctgaaaacgccggtaaattcttattgcagagaatccatctcaggaatgaggcaaagaccacgacacttgagaaattagttccccatcttggaactcttgaagccaccaaaagccagttacatgaggtcagagagctcgcgaggaaaactgagcatgatctgaggaatagaatctctgagcttcaaaaatctaactatgaattgagtggttcatccaaaggtaaataccatatccgtctgacatagaaaatcaaccaagggaggagcaggccatgggcatggcggatgagggggagagagtcggtataattgttgatgaaatggagagggaagattcggataatgaggaagccgacgatgacgcatcatccgatgaggaaggtgatgtaatggccactgattgg

SEQ ID NO: 84697 - DNA, 716 bp, Oryza sativa
gaggccttcttcaaggagtgccccccccctgatgacaagcagcgcaaggagctcagccgcgagatcggcctccagcccctccaggtcaagttctggttccagaacaagcgcacccagatgaaggtaatatactcatccgtgcatccatcgtatatcttacacgtcatgtgaacgtgcatcggttcataatgttgtgtttataaatgttaatggtatgtgtggttgcacgggtttgtatgttgcagacgcagcatgagagacacgagaacaatgcgctgcgcgcagagaacgagaagctgcgggcagagaacatgaggtacaaggaggcgcttgccaacgcgtcctgccccaactgcggcggtccggccgccatcggcgagatgtccttcgacgagcaccacctccgcctcgagaacgcgcgcctccgcgacgagattgacaggatctccgccatcgccgccaagtacgtcggcaagcccgccgcggccgtctcggccgcgtacccgccgctgccgccgtcgaacaggtcgccgctcgatcatatgggcattcccggcgctggcgccgacgtgttcggcgccgacttcgacaagccgctcgtcatcgagctcgccgtggccgccatggaggagcccgtccggatggcgcagctcggcgagccgctctgggcgccggcgctcggcggcgaggcgctcggcgaggagggggctgcagga

SEQ ID NO: 84698 - DNA, 651 bp, Oryza sativa
tatatgatccatttcgtttactacatcacataattaacctataagtgtatgtataacagtacatatatcgcacaccacatcctctcactatatataaactacaccaagcacaacagggataatattgcagctagctctagctacaaattaaacttaaagcatgcagcatatacatatagatatataagtacatatatatatcatcatatgctacgtttttattcgatcgttgaccacattgatctatataatatagatactgcatgcaaattataaatgcatgtaacgtagctaattaagctatagagcttgattaattaggcttggcggcggcgggaggtgtaaggtccggtgaacctccggccgccggagccggcctggcgctggcagttgaagtagacggcggcgacgggcgcgccgaggttgtagcggcgggcgaaggcgcgggtggtgaagttgtggcgcaccgccggcgcgtacaccgtctccctccccagctgccggaacagcaccagcaccatcctgtggatccccgtcgtcgggttcgggctctcgtagcacaccacctccctccctgcatccgtatcgcaaagcaaccgcgcctctcagatcatatatatcgccaattcattaaatattttatatataacg

SEQ ID NO: 84699 - DNA, 538 bp, Oryza sativa
ttgaaaaaaaatacaatttcaaatttaatttctacaagttataataaaaataataaattaaactctaattagtatacgtattccctgtcaaatttaacatggccagagagactaagggggtgtttagatggggctaaaactttttagcccatgtcacatcggatgtttggacgctaatttagagtattaaatatggaataataaaaaaactaatttcataaatgagagctaatccgcgagacggattttttaagcctaattaatccataattatcaaaagtttactgtagcatcacattgtcaaaatcatggcgtaattagactcaaaagattcgtctcgcgaattagtccaagcttatggaatgggttttgtaattagtgtatgtttaatactctaaattaatatccaaacatccgatgtgacagggacttagaataagtccctgaaaaccaaacagcccctaataactgactgcacctagcccttttaggctaggtaagcctagcagtagttcctctcaggaaatggtagttatta

SEQ ID NO: 84700 - DNA, 671 bp, Oryza sativa
gcggtagttaaatgccacgccatgtttgctagcaaggcactatcttggcaaccacaacatccacacagattgatagccaaatggaggacatgaaaatgccatatcttactggtgggtgtcaactgagtacagcttctacagggcattgcctagttccatctttaaccataaacatcagaattcaagatacaaatcacacatgagcagctctttcctttcacctatatgttgtttggcctcagaatagggaaacctacctcctgttcctttcataatctgtccacatcttcttcgcaatataatctctcaaagcatcacccatgctacattggttgttcagttcttcgacatcattgccataagcatcatccccactgggtaaaactacagttctacgggatgaaactggcattgcctggttaaatgcccacccatcatcatcatcatcatctttttggccctgcattatattgtgcagcaccactgctgctgctgggattttcgcttgagtttctatctgatagaatgttgcgacatttaaaattgggaacctcatcttcaatagcgctgtggcacgctttatgttgttgcgcagctttgagtgacgaaggttgaacaactccttgtagtcacttggctgacaattgctctgctcctcctcttcaatatgg

SEQ ID NO: 84701 - DNA, 711 bp, Oryza sativa
tctcggttgtagaaacattatatggacttaaacaaggagaattatgtaacataaagaaatagtagtacaatttgaacatgatacaactatttcctttgcggttacatagatgatattagattcgaactagcagggaggtagtgcaatagttgaacacaacgacgatgtagtaatgggacaaggaagcatgacagtagaaatttcaatttgccaagttgtccgataatagctaacccctacgtgaggatccctctcctctctcaaaccgcgctttagtaaccctgtattgctctggtagttcaagttgcacaacatggctaggtagagttagaacccttctggtgtctatccattctctgtattgacatctccttggtggttcctaggaggaaataatagatgtgaagcgagcaaagttagtaaatgttgtgagaaaataaggattcatgtaatcaaaatattcttaccatgaaatcgtcgtcaagaatatttggacaaataaagaaccttcgacccaatgttctaggctttatggaacgaagaacctgacaacgatcaccacacctgcatcttggacaggcttaccatggagagagtgcctcaggtagcacccgccagtcgcactgttgttcacgacattgtcgttcgtaagccgcttttctatgtaagtattgctcagtactttcgatgcgaaataccaacgaccttctt

SEQ ID NO: 84702 - DNA, 1457 bp, Oryza sativa
aggggtttaagccggcgggcgagtggataattttggtggtggctttgcgtggaccgggtgcacggtcggagagaagatattttgctcccgggccttggaccgttgggtggacacggcaagcttgctgacatgtggaccccactctttcctcatgggccaggcgcattaacgattgggccggccttgttgggctagcaaacagaggtagactaccggattgggcccaaattacgaagcggattcttaaaaaaaaacaagggctttaatgccatttctaaccttaccatttttgttatcaaaattgtgtaaaaacgccaaaattttggctacattgccaaaatttggcaacaaagtgaattttggtagcatatatgttgccaacaaagtgaacacatccaaaatagctatattgccaaaatttagcaacattgccaatcttaccaaaattttagcaataccaaaatttggtaaggtttatttttacatcaaagtgaaaaggctccaaatttcttccgttgattttcagtgaaaggattccctacagaaattctgaaattattttttgagatgctaacttggtagttatttttggaagtaaagtaaggcctttgatgccattttccaccttaccaaactttgataaaattgtaaaaaagtgactccatttagtttcctaccaaatttaagtaactataccaaaattttaaaatgctaaaatttgataattttttttttcatcaaagctggattgacatatgtacaagcagttccccaacacacacatcgacttcataaaagtacagccggtttgaaagactaaaacaaagcaaccagtaattaagcaaataaaactaattaaagcaaggagaacccagattaacccactactaattaactgcaattatatcacacgcttcagcttcaagcagcggcggcgggcttggtcttcttccccaacacctcgaggatcccctccctgccctgctcgatgccggggggctcgacgccggcgtccttgagggtgacggccttcctggccgggtactcggcgacggggtcggcggcgacgccggcgcggagcgaggcgtcgtcctgcacgtgcgccaccttgcggaacagcgacccgccgacgaaccgctccgcctcgtcgagcgccatgtccggcgccgccacctcgggcaccgtctcccgcttcttcttgtcgagccgcacgttgggcgcgtgcgccagctgctgcctcgccgtcgccaggcccagcgacaccgacaccgcgatcatccccatcgccacgtacaccggcacgtagtcccccgccggcttcttcgccgccgtcgccgctgcggcggagagtgagcgggagcggccggggacggacaccgccgcggcggcggcgcggaggagggaggagactcgcgaagccatcatggtgggagctaggcagctagcaagtgatcgag

SEQ ID NO: 84703 - DNA, 676 bp, Oryza sativa
taaatacaactccatcaaattgactaccattttctgaacagcaagcttccctttcagtcttctcttctcccacgtggaaggatcgttcagtttgctcaaattccgtggtctctgcttctcgtgaggtctgcaggaaacatcaatctggataaatggtcaacgtgaatttttactttccaccagaattgaagggacaggcccacaataaaacatttataccaaacatcaagtccggaaatagcaatttttacaatgtttatataagtagtaatgaatttttcttgttccttaaatggaggctggaacgtgcagaaaacatgaaagttcttgcagccattcagagcaggaatcaattttggcaaaatgcaattattatgtcaaaattcgcatagctagctactcaggcatacaggttgtatctgtagagcatgcgggcggcctggtcgacggcgagcttggccatggcgtcggcgtactgtatgaagacgtagtcgagaccgtcctcggcgctgatgcagacgaacttgccgacgccgaccttcttgtgcacgacgtactccccggcctccagctcccgcgggtccacccggtgacccaacgagctccccgccgccaccacccccttcctcctcccccctcccccttcgtctccgtccccgtcgctctccccctcctg

SEQ ID NO: 84704 - DNA, 593 bp, Oryza sativa
gttagcaacactaacaagaaaaatcaacattgaaaacaaagaaacaataattaccagatgtccagtatgagcactgacatttccaccttcatgatcactggaagaacccaggtgaaggtatgagggaaaataaatcaaaccaagtctttaagaaacaaatatataagtcaaaacaaggatggaatacattacgtgtggattgtcacatatagtcgcatcaactcgagcattttgggatcatcaaacccaagcatgtgtgaaaagtttgctgcatagtccagtgcattatcagctgctatagttttcccatccttgaagatccttcagtgaaccagaaaatagggttactattgcagttacaaaatttacaggattgcctggaaagtaaagatgttggatgcattggtaaaaaaagctacctccggtaaacatacgaagccactggtggaaggcgagctatcaaatttaagcaatcttcataggtaggctcccagaacctattaaaatagcaacagagcagtcaataacatggacaaatctattgaacaattaatgcaactcttgaggcagtataaatcccaagcatactttga

SEQ ID NO: 84705 - DNA, 3624 bp, Oryza sativa
ctctctcaaaccgcgctttagtaaccctgtattgctctggtagttcaagttgcacaacatggctaggtagagttagaacccttctggtgtctatccattctctgtattgacatctccttggtggttcctaggaggaaataatagatgtgaagcgagcaaagttagtaaatgttgtgagaaaataaggattcatgtaatcaaaatattcttaccatgaaatcgtcgtcaagaatatttggacaaataaagaaccttcgacccaatgttctaagctttatggaacgaagaacctgacaacgatcaccacacctgcatcttggacaggcttcccatggagagagtgccgtagttagcacccgccagtcgcactgttgttcacgacattgtcgttcgtaagccgcttttctatgtaagtattgctcagtactttcgatgcgaaataccagcgaccttcttgtaaacaagtggttaggtcgagaacaggattttctgtatcgacccactcgatgtatgcgcaagccgtagtgcgggtctgccgagtagagtagtgttacgaagaataaaacgattgcccatatggaatgaataagcatatgcagatagtaaaatacctcacggtcatagttaggacacctaaaaaagctccttcctcgaatatcaggattcatcaaagccattagttggcatcgatcaccacataggcagagaggacgctggcaccaaggtggtagtaggtatacacaaggatcgctacgccagttcggatcctcaacgcccaggcgtctagccattgacgaaagccggtaggatttgtaatgaagcaagtggggaagagagtactgaatgtgactgattctgaaagattgtgaggcctcgctcgttaaggcgacttatataggcaccaaaaattgagtgatatccctgacatgtgaacgtggcggggcatggtgggtatgcctgattggcgccgaaagttacatgcctgattggcgccgaaagttacattggtcgtatgcggcaaatggcgggcaaatactcgtatcacacgcgaataaaggaggctgcatctgtgcggcaaaaagtagtcatgcatgcgccgaaaggtatcgtgcatgcgccgaaaggtatcgtgcacatataacaacaacgtattcattacacaagcatacagtactagcatgtgaagcaaataaacaaagagaagtctgctctactggccctgccccgcgccgcgaccacgcttggtcctccaggcctgtgctcgcacatagttctgggagtaggtgaaacgatccggtggcacagcacgggtagcacgtgtgtctggcggcggagtggcctgcgcctagtcctgcgtctgcaccggcggtgcgcctcccagctatgtgaatcgacagatgttgcaaattattgtggacaggtagattttaatgcaacaaatcaaagcgtagtgaaagatcttaccggtgaacagcagctggacggtcatcggaaacggtactggaaagagctgacggaagccaaactgccacatcacacggaaaggggcgtgaggctcaacgcagatgtcgaagaccatcggaaccgtagtcatccagtacgcctggtcccttgtgcagagtgtggacagacccaacggcgcacgagcctgggtagccgcggcactgtagggctcccacacgacgttagtcggcagaaggcggtcgaactccataacaaactcaggatacgaccgcctaacctggacgtgagcccatcagcgctgcaatacgagacgatcgatgtgatgtacaatgaacttagcaatgaacttaacaataagagaagatcgatgcaacgtacctgacgacggcaccacagagtacccatcgtagggtagtcgacctccggtcgctccacgtacagtgactccccgtatgcgtgttggtccacctcagggcagccgatcgcaatcctctcagctacccagatagaaagaaagagagggcacccaccaaaggtcgcgctgggatccgtcttcgtgcaagcctcacaaaggccacggtacagagccgccaacaacgcggaaccccagctccactgaggcacctcgcctaccgcggtgtcggcgatgctcctggcgtagtgcacgagtcccttgtcgaccgcgtgcccgtgaccgccacagaacatcacccagccaaaaagctagagcaagcacgcctccaaacagcggctgtaggagtactcgtcggcctccgcctatagctgctcgacctgcaagcgttcgataaaatgttaggcaccttaccttacgactaaatatgtagtacgcttgtcatttcggtacaaaaacactcacggtgaactgaagcagccacctcctcgtaggtccggtgttgcggtggtgtgccaacggctggagcgggagatgtggtgcgcgctgtactggtgcgaaacgtgccgtcagatcgtccttccagtccacacacgtggtcactggcccaatagcgtctcccgcgagcggtagcctcaacaagtacgatacgtcctgtagggtaggggctacctcaccgcatggcaagtgaaaagtgtgcgcctctggcctccatcggtcgaccaaagctgctaggagggaccggtccacattccagcgtctggccgggtctgcgtcgccggcggcagcctccaccagccgacacatcggtaggaggccggcctcacgcaatctgcaataacaaattaatatgtcattataaaaattattacagcgcaactaatttatagtaatacactgttcgtacctctcgacaaaggagtcgtgaactgtatgtagctcaccgcacgtccgtgcccggaacgtcccaagctgagccccctgcaccatagtaaggtgagaccggtgtcggtgatctatcgccgggtccaacaactcaggtgtatcctgacgtgccatctctgaaaaatatagtgtttcatgttagaacaattcaaaaattagtaatgtagaacaaaagataacttgtaaaattatgaaaaagtaataaaatcataagaattattatgtacaacaagagtacagactatttaaatatagcaaacgttactaagggtacataacgatgacgtgcaatttaacatatatgtagagttcgataatataacataacaaaacataacattacatgccgaagtccgacattacatcagcatacctaaagacacgggtgcctaagtctgacgttacataacgagacctaaagacatgacatgccgaagtctgacattacacgacgaaacataaacacatcgataagttcgaaacaaattacaagcaaaaccacatgccaacatagaacagaagaactacaccacatagctagacgtggcacgacgacgcctaggacgtggtcgagtggaggtagtgccttcacccgtagggcgagctccatctgctgctgatcctgatagtcctgcctcctccgcacttggtttctccttgtctttaggacaatgcttgtaggtgtgcccacgttcatcgcatttgctgcaacgcttcaccctgccagcctccgactcatccatatcgttgcggatgcgatgagtcttcctccttccagccttgcctcaaagcttcgattgggg

SEQ ID NO: 84706 - DNA, 1162 bp, Oryza sativa
aattatccagaatctacgcaacagcgaaatgtgaagctctctagttaagatatcatttaccacacgatgctaagcagcaaaaaatgactgcacatcatgtcttattaacagaacccactaacccagctcctttcgacttttcgacttattcagcaacacgcgtagcacatcatgatgaagctcaatggagcacaatcaataaggtttcacaaccataattaactcatctgttatgcaaacacacattgcagtaaagatatagcaagcacttcagtgggaaaaaaatttctactcatcatggtttagaaatcagaacagtaaactcattgtcatctaagtcaaaacaaagccagttctaatcaaaatcctatgtaactctttctttaactttacgagagaattatgtcgtgcaaaaatattagtgccgttgatatcctggagcaaattggagcataaagaaactggccttttgtttcagctgatcagctcaaacctgctgatacgcatgtatcttgcaaagcacagctaattaaaatcaaccagcagaatctacgcaacagctaaatgaggaactctctagcttaagataggacttatgagatagccgtaccacaagctgctaagcaggaaaaaattgtttatccatcatgccttatgactgttcagcaacaaaatccccatatagagcttattttgagtttaagactgattcagcaacacccatatagcaatatcaaaaatatcagtacctgtagcaatgatgaaactaaactagaacatcagaaacaaaaatcatatgtatagcaatatcatcacaaaatgcaactccgatgtcaagtgcttctgtcccttcaagcctagctccaagagcatcaacatattatctatcaaaagttcaaaagccaggcaaggcacatattcaatcattttcaaaaagggatagcaagaacaaaaaacaaacttcagtgctgatcgatcatcatcggaaacatatcaggaccacatgacctatttggtgaacaaaaaattgctcaaatccacaagttcaccatttgggtcatgtgcacctgaaccaaaaaaggctacctgtttctaactagagtaacgatgtaagcagctcaatgtaagtaaggaacgcaacgtttatgtactcaattcgcag

SEQ ID NO: 84707 - DNA, 1341 bp, Oryza sativa
ccatttcatccatttcccctttcacttttccaccactttgaaccatcccccaacctctctctcctcccggttaacggccttgcactcgccgttccgaccatttccctcactccctcgacctactaccaccctcccttgttgcgccgcactcgggaacatactccgccgccggggttgtcgtctcccagccaccggagcaccggcgccattctctacctcctctcggttccctggaaagaggcagagaagtagatgacgggaggaagaagagaaagaaaaataaaaaggagtagagaaggattgagaaaaacaaaaagaaaaaaaatcgaagggtagaaccgtacttacacagttgtttctctctccaatttcttcggatataataaaataatctcgcgggtgtccaacagctaattaccagtttttgtggtgtcctatagcaaatacacgtttttgtggtgtctcacagctaattacacgttttttgagtgtcctgtagcaaattttgccttctgaaaaagggcgggttcatgagatatttgaccatatttattcaatggttgccgtcaattcacatatatgcagtctaaatctatgatcttaagaaaataatattggctttgaattagtctgcgaattagtttcgatatctttagacaaccttgaggacctggaccactttcagaaataaaatgtatgaatggtccaaatatatgttgtagctaaagggcagtggcagccaccagattatgtaatggcatgtttacatgtaacacataaaaatttaagatgttcaatcccatttcagtaattgatgtatgtgcagcacagcagtgtagttaattttagaaaaaaaatactttaccctgaaagccatgaacacatatattacccaagaacatctgctccatgtactacatgatttcttgcagtgtatgaagcgtaatgttctgtttctttcaggtagctttaaatgacagaaacaaaagtaattagtttctcaataatttggtcatcctcaacggatgttgtacagtatagttctttcttcagcgcaccagaatttgttgagtttccaccatcatatgtaacactggccagaaagcttatgcataattctacccaccttgaaacccaaattttcaaggtttgctagacgaaaaacctccattgcttgtcaaaacacatggtaagtaaactattgaagcctcgagatgcctcatgccacggagtaattttttagtttgatcccaaaaaacaactaaatgtattaataaagaggtgaacattttctgttgtgaaactgaatagcagctaaatgtttttggcagcagggcgact

SEQ ID NO: 84708 - DNA, 1158 bp, Oryza sativa
tggtatgccacactccgctgcggcagcaatgacatgggtgcatggcctgtggagcagcttcggctttgcacaagagcaatgacatgtgccgtcggctttgagaacacactcctgcttcactctcttgcggtagatacccctgcctgccttatcttgacatagtatctcaaacttgtgctggtgggtaccttgcactagagctcgatgtttcatggcctttttacgcaactcctctagctttttctgcatgaaagttctgaataaaatgctgttgttcggcataaagggaagaactgcttggaaccgatccctaaaatacctgcatgtcccatgtaaaatgaactccacggacaccgcgcatcacctagttgtaaacttctgccaaatttgttgttattattctatatctagcaccacctgtgtcatacgccttggcccatttctcttttggttcatgtagaatccactgagaaaatttccgaatctccactccagttcttctaaccaatgttggactatccgttgggagaggtccaagagcttgaggagggtcagcaacggcggtcgatggagctgctgcacgctgatcactacatttggctgtcaactcatctaatctcttccaaagctcattgaattttttctcctggttttgattgcatagcctcttgaacatgttcatgagctccttgttcttgaattgcttgaagaaattagctcccatatgacgcatgcaccacctactttgtacatcttcccactcaccaggttatcctcattccatactccaaaactgcaactcttctatcgctcgcagaatgcaagcgtgcctgtcatgtatcaggcacacatttggcctcataccaacaacttttgttttaaccaatttcaggaaccagtaccagctgtcggtattcttactctcaacaaaagcaaatgccaagagcaatacctgattgttcccatctacccctattgctgttagtatctagccccgatactttccagtcaagaatgtcccatcaatgcagagaacaggacgacagttcacgagtgccatcttgcatgcatgtagagctaagaacgccctttgcagcacactcttgctaggatgttcaattgacgggaagggtaccgagctcgaattcgccctatagt

SEQ ID NO: 84709 - DNA, 6383 bp, Oryza sativa
gcttagtgtgcaactgagtgctctagtactaggtctttggatagaggaggaagtttttgtgcaaggctagagtagtaatggcgaggtgtataggttagaaattaccttcatttgttgtgtgctccacgaaaagtgagataggcgttaggtggtgacagccctgtccatccttcgtatctctccatgttcgggtacatcatagagcttaacggtggacttgtcctagcagaccatgggaggaccggtgcctgaagcatttgatagattcttacctttatcttaattaactaattaaaagacatatgaatcctctctagccactttatcttaggttgttgtcattggatagaatcttgatcatagataatacacacatgttccttgtgttcgatacccttcgaatacactaaggggaagtgttacaacagtgttccgtgctcttgtggatttatccgtgaacataagaaataccaacactagttaaagaacataaagaaactcaaacacttactttaataaaggaagcatccatcgaggtacaagcgagagaagaaggcaaacaatcccggctttctctagaactccgttagaagaatgccaacactccggcactccatcaaattcttggaggaactctgatattttggagcactccttctggagctttccctcactttctactaagccaacatactaaaaataaaactacaagtgtgttgtactatacttgagctgaaagttgtgtttgttgaagtatgtgaggtctcctcattttatagcttccaatgatggttagaatagcggttaacccctcacaactgtcattgggacttcatcagggctatccacgtgtaaggtggagatgaggtgggacaggatgggttcggccgacccctgggccccacatctctccaccaactttctccaatagcttacaggtgggcccctatggtggttaaggacggttggtcccacttttggtttcgactgacttttgggccctctgttgacggtcattatcgatcagtttcgactgtcaatattaccaaaatagagaactagtgatgcttgcaatgcataaatatgttagaataataatattccactagtattaggtctactaaccttttgcagagaataacaataaagtggaggagaatcgacatcaactcaaacgataaatcaattggacgatgtcgagaatcagacttatgcatgaatgggccaagaactcagaattgacacgatgaattgggcaaaaattcacaagtctacaaagtgaagcaaaagaggaggtcgtcagccgaagatgggctggtttgggccagcccatggttcggccaaaccagggggttcggccgaacccccatctccaccgttgaggccaaggttcggcatggacgtccaagattgcaccccaatgacggttggagggtacttcggacaatcccccttctacaaccgtcataaccacctctatataaaggcttcactctcttcacttcaacacacacctcaagcaagagctctctcatttctctcaagtttagtttagtagtatctagctggtggaataggaatagagtagaaatcaggagtccggaagtcttcggaagagttcgggtatggctctagtagctttcctttcctcttttgtaagctttgtacttttattagaatactcttctatatacatttatggtattgaaatactttccgagtatatgagtacctactttacattatgttcatattatactgaatatacggctagtttatctgggagatgatttggtgcgggtataatgtttgcttatgcaattaatctttgtcatgaagatgatattatagtagtatctggtagtttaggcgtggtgtctagatcacgggatatcattatttggggttatatgctgtggatgagaggtgggccgctgatggtgacagctcagtacgggtattcctccgcacatgtatatactaagttaattccctggggagggtattcctccgtatttagccccggttgtatggtcatgacgggctgtcgtaagaaactcggcagtcaggggtggtttctcgaagtaccaggagggcatcgaatagagggtattagctagtatatcggttaactagaatgtatgtatactatgatattagaagtataggaatagattttctttctcttttcttcccacttagcttagataatatattatgacaatgagtagctaatgcttgtgtgtcactctacccttggattattttaacccctgcttagaatatgattatcacaagtaatatataaactattagtcaagttctctctacatgatcttcccacggaataaaataaatacgacacccttggaatactctcgggtgaaatgctacaatggtatatccgtgcgcttgtggatgaactctgtaaccataatatatcagaagtatttctgcgccattactgggaattatatttctagtcatgacgttaagaaataccgacaccctccaatccttgtactagcgtatgattggttaggggttcattttcatcgcatggcgggtgtattttctccttaaatgacctgcatacatatatttgtcaaaactagtagaagtggttagtagtaaattcgtaccactaagttttgataatatgtttgaaatcttttacccaggagttgatggttaaagtttgcacttaacaaccgtcaacataccctaataatcttattgtactactagcttcgactttaaatttttagagctacacatacctagctctaaaatttataggaggtcgaaatctgccaaaattaaacctaaattaaggaaaatttggatactaaatgattgcattttagataccccacttttgatgcaaaattttgtcgtgacacacgaatgcctaggagattggcttagctccagtggaggtgctaaatcttgatgaggttcgggcgtgccagttaatttgatcctgcaactaactggatggaaatatatcaatgatcaaggagctgatcatcaacttaggggctgaacatcaacttagggagacgatcaacttatgaagctgattttgataaggttttgatgaattgactataggttccatttatgtaaattaaagtgtatatcggttaactaatcgatacatctgatagctgaagtccacaataatgataactcatcggccagaactcctatgaacaccgcataaaaaatatcggcttactagaattaaacttattagcaacaatgtaataaatcggacctaaccaagaaagtataagatcaaagataataaggacaacctatttggctaatagatctacacaaacatgatggacatatcgatcaatctaaagctacaatatgattaaagaaatagaaacttaggcagaatatcggacctaaccgagaaagtcctaactaagctgatatgattctaaacaacgatgcagttaaagatagaatcaatatatctgagaggcaacacttacttcaacttgaatagaatattagacctaactaagaaattcaagtcgggcccttaattaacttgtatagatggaatcaactagatcccgggtagttacaggcttacagaagatcaaatccattctgaaaagattagaggaatgttattcttaaagatattttttattgaaaatgttggaggactacatttcatttcattaaggagaaagaaagaaagaaagttgatatatatatatatatataaaatagtcccccgcaaaaaaaaagatttataagatcacttaggggtttttaccctccatttcttattcctattaggaataactcactacaacaaagctaacaactcttaaagaaccagatttgtacataaactattttaccccttgtgaatggatgatactccatattagaaagacattgtgtaaagtagagtttgtttgctaataaagcgaagataaaagaattgatgctatgattgttatgtttatggtacctcacgtcactacctttcatgtgtagttggcatttaattttgttataaaaatcatgtgtaaggtgcatatgatcacgataatagtagataaggtcaaccgttatacttttagaatggattaaccaaataatcaacaaatttggtacagtataatctaaagaaaaagcttaactttctttaaaaacatttcattgaaagtggtagcaacataaacttagttttctttttgggtggatgacacaatcaaatgtagctatagaagatagattttgaaaaaaatattgatatccccaccaaaaaatgttggataatttccatctttatttgcataagtattgctttgaataagttcaaaacaaaaataagggaatcaaaattaagcaagttccaacggtgcaatcaaacatgcatgtagcttatcactggtagtttaattattatgtcatcacacaataagttctcaacatacataaggctgaaaataactaaataagcaaatatttggatgtaactgcagcaagatcatgggagagcttggtagattcaatgctccatgcgcttcatcactttataattctttgcacccttgatacgaatgctctaaccccaggtggtgttgatggtatgagcttaatatcctcaagggatttgcagattggagccaacaacgtgagtaatttactaaccctttcatcacctaaccagaaatagattgtgatcttcttaaggtaatcagcggtaaattctttaaccagcgggggtgccgtgggtggctcttggaggcaatattcgcacacttcctgtaattgaaaatgggacgttaggttttctcactgtgcatgggaacaatagatcatagagcaaaagaggattgatgaatcgccatattgagcttcaaagtgagatcctctagcagtggtgagtaccaaaggaagtggagtaagggagagaattcgttggacatgcaccattcaccaagagtcaggcttattaagttgtcgaacattgggcttgtccaaatttccatttcaaatttatcctgtgtatatggggaaaaaaagaaacaatgtcaaatgagttaaagatataaagttaaagcagcatatggaaagttggtttggtacattgagacttcaaatgcccccataagcttcttagttcaacatagttgtcaacttctttttgtgtgaatgacctcttggaacaaacttagcctttatgttcctttgataagatagttttgggtgaatgacaagaaactagagtactcatgatgaaccaaacatattttttttagagaatacaatactatttatcttcttaacccctttcctatcttggtgatgtactttcatttagataagtttgtttgtttgtttaaatcccattgaatctcaatgttttaccaacaaagtgaagataagcatgcatgaaaagcatctatacctctcttaggggagcaatcaactcgatgcttcttgcctttgtaaggccactaactataccatggttgatctcttccccatcttgttcttccccctcgtccatgtccgctaaatcatcagtagaatgaaaaaactcatcaagtataactattgccacctccaggcatggcaatgtcatgatcataggagctctgtgttgagggttctttatgcacaaagacattaaacttgaactagatatgagaagatcttcaaatagacaacaattatcgatatctaggtgcaacaaagaaccagatgagatttcagggacctccaaagagcagtccctaagctccaaattttctagtgctgggcatgaagagttgatgggatagaagacattggcatcaatacaaacattgttaaggaccaaaaatttcaggcatatagaagtgaagtccacaaccccatagtccaacttgaaaggttcacaatctatatcttcagaaaactcaaccactttactgcttctcttaatagcatatgttatccaagagccagcatctcttgtatctgcagagtggaggcgcaaagcatccaacaaagaagagccacgttggcgcaacattcggttgacaaagttgcagaacttctggcctctatgccttccaaactgatttacatcaatgttcaggtatgctgatgaggtccaaagatgtctccatcgtgtggataacatgcctgtgtacacaagctccaaagctggtaaggtggacattatggcgtatagcaattcattaggaagattgctgattctgtcgatgctcccattcctcgtatttatcgagcttccttgatccaacatgtggcctgcatctgatacaaaagtgatttttccttttttttttgcataaagtagaacaacatgagaaagtatcaacattcaaaataaa

SEQ ID NO: 84710 - DNA, 831 bp, Oryza sativa
gtcatcgacaatggctcgtagaatgtctcggtggcggcgcttcacctcagatgaatggcgatggctcgatttcttcaaaggactgccatgcatgcatgtctttcgtgttagagaggtccatgcaattggattgggactcactagagagggagaaatcaaagatggagctcggcggccggttgtagaagatgatgctgatctccaagatcattgcgccattggatggggtacttgggggtatatggagagaggtcaacatgaagctgatggcgtggtggtttggcttgcaacagtccactgcagccaaaacgacaacgatgtcaaggcggcgacgcgcagagtgcgctccaaggccggcgatgacacgtggcgttcccgtcgatccgctacacgagaggatggaatcaaaaggaaaatcttcggcatgataaggtgagtatggaacggtggtgaggcagagatggagatagttctacggtgatggcgggtgttgtcttcttcatggcctgcgacagatttgagggcgacgaagaggttgagggcatcctctctcggttcacggtggggcggcggcgggggcgcatcgccggggttcacctccaacgcggacgacgcacgacggcttggccacggcggagctcggtggcggcgcaatgagaaagagatgaatgaagaagaagaacagagaaagaaagattgacaagtgggcccatgggcaaacttgtctttaaccaaactttctctctccgtttccaccggaaataataaaataatgcggctggtgtccactagctcattaccactttttacagtgtccacgagaaaatacac

SEQ ID NO: 84711 - DNA, 4670 bp, Oryza sativa
tctccccccgagcggctgcggcagcgagcagcggcgacggtgtcggcgtcctcccccgcgagcggcgacggtggatctcccaccaccggcggcgtggctgcgtcctcccccaccaccggcagcgcggcgacgccctcccccaccactggcggcggcggcggcgccctcccccatcaccagctagcggcagcggtggcggcgcccaacccaatcccgagcgacggcgacggactcgatgtatttggtgtttttgggtgttgaagtttgggtttctcttttttttttcaattttttcgatcattcaaaaaatcgaaatctgattgggatttgagggagggacgaaaatatagagggggtgacgaatggaagaatacgaatcttttaattagttaagatagataagagatatttacggactattaaagcgaatagaaatcgaacttttttgccgcgcttttttccgccctttttatttttttctcgttcgttttttattttttactaaccgtttttttttgccacggaatcgaacagaccagatatgaattttttagggacgggagtagagacacatatgtatacaaagtttatataaaaaacatataaaaaatataaatgtatacaaagtttgtatatatacatagtattaagaaataaaaaaaccgaaaaaacaaaaaaaaggaaagaaaaaaactgaaaagaaacgaaaaaaaggaagaaaaacaaaataaccgtgcgtgggccggaataggattttttttttccttttttacgggatcggatctatttttttcgccactttttctgtttttcgaatctgacttttttttcccgtttcctggggaatcggactacggttttttttcgctatttttttgtccgtttctttttttttcttttttaggaatcggacttctcttttttttttagtttttttcgctattttttattatttatgacggacgatggaaataaaaaaaccgaaaaaacaaaaaaaggaaagaaaaaactgaaaagaaacgaaaaaaggaagaaaaacagaataaccgtgcgtgggccggaataggatattttttccttttttagggatcggatctatttttttcgccactttttctgtttttcgaatctgactttttttttcccgtttcttggggaatcggactacggctttttttcgctatttttttgtccgtttttttttgtttttcttttttaggaatcggacttctctttttttttagttttttttgctattgtttattatttatgacggacgatggaagcacctcttattttttttattttttaagtagtagtagaattaggtatatagatgaaagacaaggtgcttcaggaattattgttgttggtgacaaaactagaagctacaggttagcaagatcaaaatggtactacatgtgttcttactcaactcctatagtcctatgtagtgggaggcctgaccaaaatggtacatggatgattaggggaacagtgcttgatatatgtaaatctagccttatccagcccaagtaatgccctagttaggctaaacccccaaaaaaaaaatggcccaagaggtgctgttgagcctggcttgagaagggaattttggcatgaaataaaagcctggccagaaacatatttggaattgtttagtgcaaatttaggccccgtttggtagagcttctaactccaactcccaactccaaactccaactccagtgagagctgactcctctaggagctgaggtaggtaaaaaagtgtttggctaaattattcagctccaaatttctacatcctttgtcgccatttcatcgaacaccttataggcatcgccttgacgttgccgccgcagccggtcaacccgcgagccaccgccaccggcaggcccacgcatctccgccgcctcacaagccgccgcacaagtgccgccgcacaggccgccgccgtcacctaggctatctcctgccgacgcccccgcacgcgagtcgcctgccgacgccgccgcccgtgagccgatgccgacgccgaccgcaacaccgcccacagccgctgccaccggccacctgccgccaccgatgcgccgcggcccgcgcttgctgcccccgtatgctgccgacgcagacgccgccacaaccggttgtggccgtcgtcggaggatggggaagaagatgggccgccgccacctactggccccgccgccgacgctgccgtagcccaccgccaccagcctccggccacgcgtgcgcgccacgcgcgctgcctgtcgtcatcccggccatgccgcccgtcgtcgtcccgcagccgccgccgcccaccgctgtcgggtctcaaaactaatgattcggaaaccgacatgtttagattgtatcaagccctggaccagtagattgatacaggttcaataatctggatcgtctttgcatacgtttagacatagctttgaaggagatattattacataaagtaatagggtatttacaagattgtggctaactaatacaacagatgctatagaatgacttaactctaatgtttggctatagacttaaaccatctatctaatctagacttgagaattaggttgaaatgaaactaacttatatgattaaactcccagcttcggcacaaactccaaatggactctgaaaaagggggttgaagcaagggtgagtacaacatactcagcaagctattatatttaatcaacgatgaatgtatgaaatgataatatctgtgtaaagctaggtttatacttgcaaaaagcagagaatgtagaagtagaaaacctgtaatgttttaaatgcagcagtatttaataaaatttccaattaggtttctatccaagatgccatagtgagtcccaatgcccgataaccgcgagcacggctattcgaatagttttaagaatattcatactgcagtagatgtacgctttacccgcaatccatgacgtgccaagcaaattagccttgtcatggcaaagtttttcagttactaatatcagtggtacctgttccatgaactctagtccccatgcgctctgaacgtaacgttatcagcagcgagaggagttctggcgttcccgaggtctttagagagaactgattatatgacaccatgtcatcgcaatcagggttcacaaacagattatagtacagattatagtcatcataatttatctcaaatatttacctgtgcctcggtaaatattacaatattgcccttcgcggcataaatttgcctcctgcgcgaggacttaagaagaaccactatacagaggtaccacctttgctagataacttaatcagctaggtctatgcccatacgagaattgcggtcgtactcgtatgttcttcacatgtactaggcagtcttatgtcggttggaacagtactagccacccggaaatcaaccatttctaccgtactgtcccaatctaagtttattaaattttatgcataatctaactaggcagggctaagcaaaagctagcatatctggtttgctatatgttcaggttatgcattcaaaatcatgaatggctaatgcacaagatactggagatatagaatataggactattatgctcaaaggggaggaataataacttgccttgctccaacgcaaataaatccaagataggcaacctgattatccagtcctcgaaacaccacaggttgcccttcaaaagataatagactctactaagaaagacgaagacaaagaaccaaattcaatacaaatcatgaaatagcaagaaagtgataaagcgcaagaagggctaggcttggggtataaatatctctgttaaaggggtatagggttctaaagggttggaggctaaggtggagaggggattaggcaactaaggttgcttatattttatgtgaatgcttggttgctgaaaggataggatgtatattggataattgaactgattcagttggtatatggctagtattggctagtggtaggtttgggtagtataatacctagggtttggttatatttaaaccgactgcggaatagggaagcatatcggctaggctctgtataggttctaggagagtaggtggctgagtatagtggataggcgatattggtaggtggggtatttggatgacggttgggttttaactagcaaggtgttagctagggtttagttgtttaggccgatattgaggtaggataaatatcggttagggttttgggtgtttgctagtcatcgctagagttggacagtatagcgactagatttggtatcatttctagccggtgtcgatagacatcatatcggctagaacaataggaggtgggtgcaggtttagtggggtggaagtgttactccgataaccgtgggcggcggagcgattaggatcacacagagctcgagagctaattgtgtggtgtgctatggaggtcgatggaatagtgaagctctgaccgctatcgaggcgtggggtgccaggagcagcacttcgaccttgggtgtggtttatgccgggctttacaaccaacggttcaacgttgggatctgtagaccacgcgaacgtccccatggaaggcgtaaagttccaaccggcgactttttagtggctaaagggtattttgaaataaaaggagatatttgaaaagcaaatgacatttatataacttaagg

SEQ ID NO: 84712 - DNA, 598 bp, Oryza sativa
ccgcctgcacgaaggccagcacctctttcttttgcaccagccagcgttgcacccggcccttgagcaccggtgtgcggcccggcgaccccagccccttgccatgcaccacgcgcacgcagcgcaggcccgtgcggtgcgccaggcggatgaactcgcccagcgcctcgcgcgcctcgtcggtgcgcaggccgtgcaggtccaactggcgctggatgctccaatgccctccgcgcagcttgcgcgtcacgtccagcccgatgcccgggcggcgaaagctgagctggtcgtccacgtccagcagcgtggtcacgtcgaactcgtcgctcagcgactcgcgcagcacgcgctcttcgtccagcgcgcgctgcacgggcaggggctcgggtggctcgggcgtggaccagcgccgctcgtgtccccgcttgagcggctgcacggggcccaccgcatcggcgaacaggtggcgctcggcgcgggcgcgccgctcggcctcgcggcgcaggcgctcgcgctcggcccgctgctgcgcggcctcctgcaacgcacggcgcaggggcttgaggtcggcgaaggaacgggcggtgagggcagcgttcat

SEQ ID NO: 84713 - DNA, 618 bp, Oryza sativa
ggcacggacttaagtttgtacgttgagaaaaaccggacaagcttgcaaggtgtgcttgctagtcctgtggatgggacaccaagcttttgtcccccggaagttgtccttgtcggctcgtacttcttgtggaaaggataagatttgaccacattaggatctttctcaggcttggatgttgtcgattctccgttctccacttctgcgggaggatcttttgacatggagtcaaccggggtcgtaaccacgccgttctcgctcccgataattgctgggccagtcgagattggcattgtggtgtagagcgggaagacgatttcgccgacttgagtccacaccagcatcgtcgaagttgaagctccttggttgatgccagtgttgacgctatcgtcgagaaggcttgaaatcataatagtagaaccttgagcaccaagttcccctacctgatgcgccactgtcgacaagggatacccgtagaccggatataaagggtattggggtccgttggtacgaggatcgacgtagtacgacatcaagcaaataaaagataaggattatactggttcaggctccttggtaggtaatagccctaatccatttgatatgagattatatgatgga

SEQ ID NO: 84714 - DNA, 557 bp, Oryza sativa
ggtgtctcctaattggatgttgtcggtgtggtacgcacggcccatagaacagagggatgttgtttgacccacttcttgtcgtgtaacatgagtctgtcgtaaacgcgggtcttgatcccttgtagcactatgccgtttgcccttttgacttgcccattgctctaggggtgagaaatcgaggcaaagcaaatcttgactcccaatccaatgcagtaatcctggaagtcggcactgatgaactgggagccgttatttgttatgatgcggtgaggcaatccgtatctgtagaatatccctttcataaacttgatggcattatcggccttgatttcccccgtgggcgtcgcttcaatccacttggtgaacttgtcgatggccacgaacaggaacttgtagccgccctgtcctcgtgggaatggtccgagtatatcgagcccccaacacgagaacggccaagtaagagggatagtctggagcacttgcgatggcagtcttgtgtgtttgctatgaaattgataggcttcacaccgctgcaccatgtcgcaggcgtttttgag

SEQ ID NO: 84715 - DNA, 592 bp, Oryza sativa
ctatagggcgaattcgagctcggtacccttcttgttggctttgcgcaccatgactgggttggctaaccactctgggtggagaacttatctgatgaagccagctttgagaagcttgtcgagttcttctcatatggcttgtttccgatccggtgcaaatcaccgcagtttttgttttactggtttggcatcgggtcgcaccatgagtttgtgctcgatcacctccctagggactcccggcatgtcggacggctgctaagcaaacacgtctgcattgtcgcagaggaaggtgatgagcgcgagttcctatttctcatccagtgacgccccgatcttgacggtcttgtcggggttggcactggagagcgggacgatcttgattgcaccgtctggcttcggcgtcttgttggttttgctcactttcttgggcggctcagctatggcaggtgggttgggagtgtgctcgaccatgtcgaggctccgcttgtcgcactgcaccgccagtttcgcgtttccctgaatagtgattgttcccttcggtctaggcatcttgagcacttgatacgcgtagtgagatacggccatgaacttcaca

SEQ ID NO: 84716 - DNA, 558 bp, Oryza sativa
cttttgtactcagattatgtcgcaaggaatcaagataaatattatgaaaattgtttaaaaaatacgatataacatctatagcccccgactcactagtcaacggcgaaccagttgatgtagtgaggcaaaggaaaagacaaaatatcatataaagaataaaataaatgatgacttagctttgtaatattccccttggtgatggcatggacgcccatgaacggtggtgtgaccgaccaaccgtataggcgatgacaccagtcggcggcgacgaaggcaggccggcggtgaagtcgtagacgcccaacagcggcggcataataggccagccgtgtaggcggaggcaccactcggcggcgacggaggtaggccggcggtgaagtcgtagacgcccaacagcggcggcataatagaccagccgtgtaggcggaggcaccactcggcggcggcggaggcaggccggcggtgaagtcgtagacgcccaacagcggcggcataataggccagccgtgtaggcagaggcaccactcggcggcgacggaggcaagccggcggtgaagt

SEQ ID NO: 84717 - DNA, 778 bp, Oryza sativa
acggctggcctattatgccgccgttgttgggcgtatacgtcttcaccgaccggccgcctcgaccgccgccaattggtgcttccgcctgcacggctgacttattatgccgccgttgttgggcgtctacgacttcaccgaccggcttgccttcgccgccgccgactggtgtttccgcctgcacggctggcctttatgccgccgttgttgggcgtctacgtcttcaccgaccggccgcctcgtccgccgccgactggtgtttccgcctgcacggctggcctattatgctgccgttgttgggcgcctatgtcttcaccgaccggcttgccttcgccgccgccgactggtgtttccgcctgcgcggctggcctttatgccgccgttgttgggcgtctacgtcttcaccgaccggccgcctcgtccgccgccgactggtgcttccgcctgcacggctgacttattatgccgccgttgttgggtgtctacgtcttcaccgaccggctgcctcgaccgccgccgactggtgtttccgcctgcacggctggcctattatgctgccgttgttgggcgtctacgtcttcactgtcacgtcctgataaattcatcccgaattaaaattcattctctaaaaggaataatagaattaattaaaattcgaaaagaaattggcaaacactaaaatacgtacaagaaaaattcaaaagtggcccggagaatttttgtcaaattctccttggtctaaaaggagccctcaaattttagtggaattttcagagcacaa

SEQ ID NO: 84718 - DNA, 678 bp, Oryza sativa
tccccgcctatacggtcggttggtcacaccaccgttgatgggcatcgtcatctacaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgactggtgtcctcgcctacacggctggtctattatgccgccgctgttgggcgtctacgacttcaccgccggcctacctccgtcgccgccgagtggtgcctctgcctacacggctggcctattatgccgccgctgttgggcgtctacgacttcaccgccggcccgctttcgtcgccgccgagtggtgccatcgcctacacgctggtctattatgccgccgctgtcgggcatctgcgacttcaccgccggcatgcctccgtcgccgtcgagtggtgcctccgcctacacggctggcctattatgccgccgctgtagggcgtatacgacttca

SEQ ID NO: 84719 - DNA, 862 bp, Oryza sativa
cctggttctgctggttctggagttgctgcatcatcatgttcatcaactgtgcctgttgggccaagacttgagcgagtgtgggattctcggcgctgttgttattgttgttattgttgctgttggggccgttcccgttgctgcgagtgagcaccatctgacatagacaggagcacaagaagagaaacaggggagaactacttaggacagataattaaattaattaacttaacttttattgatcttaactgagtttcattattacaaagctgaagactctctcaccatctaactcaccaacttcctaacactcaaaagcaaataaagacatgcatttacatcccaccaatgatgtaaacgcacgcagaacccacacacacaaccaaacttaaacaagcaaactaacacaacgttctaaggcaacgactagcaaaacggtctaggtcttctgggcatcggagttgattgaaggctcgttcggcacgtccccatcatcttgagttggcccccactcgatcttggaatgggtacgtttggattcctcttcatcatcacttacattgacaaccggaggatccgctggggtagcttctttttccaccacacgaacctttggtgccaactgatagcgagggacgaatagagctctcttccttgcggtaagacggactctggccttctgcggtggtgcttctcccttcaacgcggctagctccttctccaaatgatccaccttgtcttctagcttgcagatcttccccctattccggtctcacgatcttgagcggctattacaatctcagcgcgggtttcatccatagcccatagcatctcaaccaaatgccttgtggtagcgtcgttctcg

SEQ ID NO: 84720 - DNA, 1900 bp, Oryza sativa
  unsure (1)..(1900): unsure at all n locations
gcgacgactggagcgacggcggcgcacggctggagcggcggcgacgacggcggcgcgagctacagggtgctagggcgctacggacgacgagaggcgaaggcgagggtggcggcgggtagaggaggacctgggggtgcttttaaaggggttgaaaggcggcggcgaaggcccacggcggctggcgacggcgatggaaaggttagggttcggggagagagacgaatccgattcgagatcgaatccacggatttccaaaccgaaatagatgatgattccaaaagagaaaaggtagaggggatcccgaagatcatttcccctctattgatttcaccggaaacggaaaggcgcggccgaatttggaaggagacggcggcggcgcggcgctagggtttcgggcggcggccagccagaggaagacgacgagtccgacaggtgggacccacctgtcagcgagcgggagcgcgcgcgcggncggcggctcggctgcgggccgacttgggccgaggagagagagagagtggttttgggctgactttcggcccaaaccaaaagagaatttaaaaaacctttttcaatttaaattattcattaaatgcaattccatttattaaaaatacttccttagctcaaataaatcccagaaaaatctaggaattatacaattaagcaaagtatttaatgaaattttgtctggcccacttttatattggaatttatttattaaaattagatcttctcttctaggctttttttaaaataaattctaataattccaattaaacaacgatttatatatttaggatttttagggtgtgacattcggcttcccaggccgaagccgccatggatggccgttcccgcccacgtcccgccgagtccggcgccctcccgctcgcaccctcgctctcaaaccaagtaaaatcggttccccactaccttctccaccttttcccccactctccccgcgaaaatcggcgccggttaactcctccaccaccccacgtcagcatcccacttcgccagccgttgccgttccgctcggctcgattctccctccccgagcctataaaaacaaacctagagctctctctctcattttccctcctcccccgagcttcccgttgcctccctcgctctccccaccagtgctcctctcgccgggactccagctggccgctattactgctcctgccgccgcgactccgcgcgaccgccatcagcggcttcccgtgtcgtgccgtaccccggcatctcctcatcttccctattttgtcgccggaaccacctcctcacggcgctcccactccccaccactcaccggcgtgctccagtcgctgcctcccgtcgcactagccaccaccgagccgcgccgacaccaccatcggcatcgccatgtcgatcttcaccctagcccctactccattttccccttgagcatgttgaaaaagcaaggcaagattgtttgatcgcgaggaaaagagttcggaagattgtttgaagaagcaaggcaagtcacacattccccttgagcatgttgagcctaatttataaatgtttttaccgtttgcaaataaagatgcatgttttgctaattacatgggatcagggtttacctatctgcttgcttgtgccatattatttgatatctgtcctttgtcaaccttgggtaataaatcgactagcttgtgttactttgttgatctagctagaactatatgcttagccatgtttaattaccactagctcagttgatgggataattgcagtattagacctgttagtatcatgatgagctgcggctcgagacatccggccatgtttcatggtcgtaattatccaactaaaactcgactgaatggtgggctgtgggtgcatggttttgctggtcgcacccatggca

SEQ ID NO: 84721 - DNA, 5139 bp, Oryza sativa
caggatcttaaggaaagattttggtgggcaagtatgaagcgtgaaatcgcagaatatgtagcagtatgtgatgtttgtcagcgagtcaaagcagaacatcagaaacccgcaggtttgctgcagcctttgaagataccagaatggaagtgggaggaaatcggtatggattttatcactggactatccagaacgtcgtcaggtcatgactctatttgggtgatagtcgacagactaaccaaagtggctcatttcattctggtgaggaccacttattctgggagtcgtttggaggaattgtacatggcaaggattgtgtgtttgcatggcgtccctaagaagatcgtatctaatcgaggaagccagtttacttcaaagttttggaagaaacttcaagaagagatgggttccaagttgaatttcagtactgcataacatccgcagacagatggacagaccgaaagggtaaatcagatactggaagacatgttgagagcttgtgctttagatttcggtggaagttgggataagaatttgccttacgcggaattctcgtacaacaacagttatcaagctagtcttcagatggctccgtacgaagcactgtatggtcggaaatgccgcactccacttttgtgggatcagacaggagatcgtcaggttttcgggactgatatcctgagggaagcggatcggactcgtcgtcttcctctggctggccgccgcccgaaaccctagcgccgcgccgccgccgtctccttccaaatttggccgcgcctttccgtttccggtgaaatcaatagaggggaaatgatcttcgggatcccctctaccttttctcttttggaatcatcatctatttcggtttggaaatccgtggattcgatctcgaatcggattcgtctctctccccgaaccctaaccattccatcgccgtcgccagccgccgtgggccttcgccgccgcctttcaacccctttaaaagcacccccaggtcctcctctacccgccgccaccctcgccttcgcctctcgtcgtccgtagcgccctagcaccgtgtagctcgcgccgccgtcgtcgccgccgctccagccgtgcgccgccgtcgcttcagtcgtcgccgtcgctcggggaggtcgccatcgtggtcgccaagtcgtcgccgtcctcgtccacccctccgtcgtcgccgtaggtcaccgtagcaccgtcgccgtcgtcaagccgaaggtcgccgccgccttttcctcgacgccgtcgccgtccgttgatcttccgccgccgttttggtcaccggtgagttcgccgcgtcgctctctacgtgctgaggttctccgttcgcgtcgtcgcgccgtcgttcgccggcgagcatgcaagcccgagccgccgccggtggtgacgtcaccgctgacgtcatcgtcgtcgtctcccgtggcccggccgtggaccggtcgatctcggccgtccgttgtagatagcatcgatctcggccgtccaaacccgtgaaccgccgccgtgcacccggtccaccgcaaaccctagtcgctgacgcaataaaccccttttccttttcaaaaataattcattattgcgtcataattcaattaaaatctatataaatgctttaatccggtttaatctttgaaaattcataactaattcatcttagctcggatttagttggttcaagtctctaaaaatatccacatgtactgttcatgcttgtttatgtgctgttttggtgtttttgctcttttctgtttagattccgacgtttccggagagtccgttttcgctggagaagaatttgaagagttccaaggccagtaaggcaagtcacacagatctcagacaaccctttgagcatgttgatcctatttaaagctattgtttctattcaactattgcatctattttcgaatgtcattgggtggaattaacctattctttgttatggccctttttgtacttgattactttattctttgataccttgggttagtataatttgactagttgagctttatacaatggttcagctagatgttaggtataattgcttagccatgcttagaaacattagctcactaatgggataatttatgattcactattatttaatgatggcttaatgatagctcatgatggttaatcatgattggttaattaattaatttgacaactaaaatatgataatggtgggttgtgagcatatggttttgatggttgtgctcatgacaattaaggaccggttcacgattttcggttgtgaaacatttatcgtaccaaccacaagccagcgtgggcaacggctttactttctgtatagtatggttcatagtagagcaccagactgtgaagtggaggagataagcccacgggggtcactggggagtccataccttgtttataagggggtgattatgatccgggaacggtgcactgctttgaattctattatatagagggtattgtcacaatctctattcgggtacttgtcaagtatcgcgacgcatggttgacatgatgttgagattgtgtcttgtgggtacagtggtacacctctgatcagagtaaaactattcgaatagccgagcccgcggttatgggcgggtctaacaatgtctttcgtgattagtttcacacttctcaccataataaaagatgctataactggcaataatttgtttagctcctggtttggaatggtgtattcctggtttggagatagaactgtgcagccgggatggttgttcagaacgattgggcctatgcaacagggtatgttgtatagcgttggattaatattgtttaattactacttaactattttattaaattctgaaatgtttgtaaatgccatttatgcaaatgaaaccatactatgtcatcctttgttatcctgtgcacttgcatatttgctgcgtggcttgctgagtatgtcatatactcaccttgcaatcattcatcagaggaggagttctacagtgatgctgatggtatggaggattaggtgtagccctggtcaagctgcctgtggagtagagtcgtttgtgccgtttattttaattttccgctgcttagatttttattgattgagaggaactatctacctctgtaacgacattttattcgcttattaattagagtaataattgtactctattatcaatttgttattgtgtgcctcggctgattcctggacgagggttcacacacatgtaagcgtttggaattttggatagaaattccaggcgtgacaccgaaggtagcaggagggcctgacaaatgggcctcgggcccacctgtcggctggagggaggaggaatgaacttgagggagggaggggagccgagcgggccgagcggcccaaaaggagaggggagaagggcggccgggccggaggagagaaggggaagggagggagttgggccgaacacggcccaaagacaaagaggggattttaatttgttttctatttatttaaattgagttaatgaactttgtattattataattacttattgagctccaaaaattcacgggaaaattcagagaatatattaaggtgcaaagaatattacaaaatattctcggccatgatttttaatggaaatttttaatttactcattatttcacttgattaaattgctttaattttatttaatttccagaaaatgcattatttaatgatttttaatcccgaacgaaaatcggggcgttacattagccgcgtggtttccacgtgtgcagcccgcgtggtgtctagtggagtccgtttgtcggccactcgcctcggttgacacacggggtccgcttccgtcgacccgtggaccatctctgtgtactcggtctaccgtggtcctttaggttgacatgtggggtctgcatgtcaacaagcgcagccttcctgtcttttctaggctagcgcttacacatattttatagttataaaacctaattacaataatccgtaaatctccatgtaacagcattaaacttcggatgatcatatcttggtcatacgaactccgaatcgagccgttcaaatctcttaatttttgttataacctaaagaaccctgtgcttttctttttatgtatcgttattgcttctttttaggcttgtagctttgcttgtgtgcttcgcgtagcttctgttgttccggaggttcccgaagcgtggttcgcggtcgtcgccgaaggtttggaagaccgttctctctgagcaaggcaagtcgcatcatcattgagcatattgaatcccagtttataaaattattttgatttaaattattgcattaccgctttatttaaattcccgcgttatcactgttttatttagcacttcctattaatccttgttatagccttatcattgctattgtttattatcaccatgttcaccctaggaaaataaaaccccaactagtacatactctattcatggttccactagtatgaatttaggtatatgcttcgctgattaattaggcaacattaggtgtgacggagctcgtggctcctcaccgggagaccgcgcaggcccccctttgccggttcggccgggggcttagggtgaaatcccaagctctctctgtatgtggaaagatcgctcgccagcaagaaacgcgagacacggcgacgtatacaggttcgggccgctgggaagcgtaataccctactcctgtgtttttgtggatctgtgtatgaacaagttaccaagtatcaatcagccaaaagtcccccttctaggtgggcaaggtcctccttttatatctcaaggggataccacatgcacctttccctttttaaactggactgttcttctcttcataaatggacggagatcggtacggttgctgtccgagtgcccttctgacgggacgacccgtacctacccccacttccgccggaaacaggtgcgacgtgggattatggctgtctgtggatgacgcgaccagcgtcagaccggtcacagatcagtcatccttgtctaccatgcgtcagcttagcaacgtgcatgtttgcccttcttcatgtaacatcttgcatgtaatggttgggatgaagcctggtataaatctaaccagggctaacgtgccatctctaagagataacacgctagctccggcttgagac

SEQ ID NO: 84722 - DNA, 3108 bp, Oryza sativa
tgttgttgcactttgtaaacacagagagaagtaataaagttgtcatctactttgagagttcttcgatttgtgtttcatcgggttcggcggtctaccagtgacataccaacggttcaacaggcgacaagacagcggttcgaccggcggcgtgcaagcggttcgactggcggcgtgcgagcggtccgaccggcggcggcgacaggattacgtcgagatttccatcgattcgagggtaacttttatttccgttaaaagtttttgggtttttggttttccctaccattcaccccccctcttgtaggcttggtttcttgtgttcgatcctacaattttaacttcctctagctaacactaggccctaatggtttagttgtttatctagatcttagttaatattcatgagacctattatgaaatgcaaataaaaaattcaaatgcacatgatggacaagtcaaaacatgttttatgcaagtatgcatgcttttactcgtgtttgcatttatgtcctaggttataaatgaaaaagttttaatttattctcaaattgtacttaggttcaagttagattgaccacacttaggttaaaaatggaaatttttagctctcaaaaatggaaaagttagcttccaactattttgataggaaatttttaaggtctagaatttgggtatgttacagtgttacccttgagcgttcgctcggagatctatttgtatctaacaatctgttatgagtattgatttcaagaaagtcatatttcagggctttgtcgcagattctacaattactcgattactcgagaacgattggacgactactcaattactcgagaacgattggtggagttcgacgaaaattatggaatgaagagatggtgaacctaccgagatgaaaattcttgacttcaacccaaattctcgattacggcaggtcagtaaacttagtcgtatactccgcaccttctcgctcgtccgagaatggtcaagcgagaacaacattgttattccaaggtctttggtcgagaacatcaactcgttcgtttacgttgatttcatgcttgtttatggcagttatttagactttaattcaaattcacttgtagaacgttgatcttttttcgatgatgttgagtactccatgtcttctcgaatgttatcaagaatgaccaagtgagcatgaaatgttggtagggaatgtcttctcgaatggtagacttttcacgcgatattaattaattataaccctcttgaaaccacaatttagagggtacacaggttagttaagtctagagaataaatgagaaccctgcaaagtaattaactacaaccatctacaggccgatggatcacacagatacacaaaggagagatcaaacagtatatccatctgagactctgtagttatctctcagttcagtagggagagagacatgcatgaatgcctatactgcgtcgtagctagctggtttcttttctgttttgatgcgaagtatgcgagcatgttcagcaaggatccacacaacggtcgtgagctcaccaccacgggcaagctgcttggcatgagaatcccttgtacatcggatggacacgttaatcagctgacgtgcccactccccgatgatggcatccgtcgtcattgcgattgatggaaaagagacattcttagcgaattccatcaaatccggaaactgccggtgaaatttctttagtattgggggctcgccgtcgccgtgttctccaactttttcaatgatattctttctaaaattaggacctcttatcctaggtagcagaaacatggctagtatagctccctctgatagaacattactcgtgtcgtaaagaacactcagaaagccgctttggggcctcgaatcgtccacctggaagtaatttccctcctcatcttcgttggcaatcaggatctcggcaagacgtttctctctcatcattgagctagtacgcaaggaaggatcactaccttctttctccttccatattccggcaagagcctcactgacagcttcatatcggctactgaggacgaggcccggtagcatcccgggccgcaccgcgacgaggaacatcatgtaatctgacaacgccttgatcacctccacatcctttttggacttgggcgatgcttcaatttctgattccgctgagaagaggaatatgtccgtggcgatgtgcaagataagaatggtctcttgtaaatcaggagtgaacttcagggcaaggtctgcttcctgatgagcatgtgtaaatggaggagccgccggtgcaggcctccaggcctccgtcactattatttgtcgtggtggtcgtcgttgtgggaagggtttcttcaagacttgccagatagagttgaacaactcgtccctgaaatctcttgaatcaatatgattgcccctcatgcgctggtattcgtactccatccagttctcctccggtgctaaccgcttgaacatgccgctcttccagttcttggtccttgcctcgctctcgtagcgagtgcactcgtgcaacaagttgtactgtccaatggtttgtgaccacatcctgtatctagttggcttcttattattgtcaaggatccgaaacagattcagatcagacacgatgaggcgacggatcagtcgccatttccctgagcacagaagtgcatgatgaagccacgatcgtggcctctcatcaaggaacgagtagaaccatgtcgacgccaccgctcggagaagccatttgatgtccaggacgaccatgccggccagcaggacataggtgatcacgacgtcggccgtcgcctgaccttccttgctgtggagccaaaacagcacgaatgccgccgtcgcggcgatcggagaggcgaaacggaggatgtagcctttccatgagtgcaccacggccgccttggtgtagatgaggtcgtacatgagggagagctccatgttgaccaccctgtacagcttctcatcccatgtagcagagagtgcttcttgttcatccgcattattttggtccagaaaatcgatgaaggcgtccttggtgatgtctagcatgtcatgagcagccagaaggatttgctcatcattcggctccctgcctcca

SEQ ID NO: 84723 - DNA, 1103 bp, Oryza sativa
aacacatcgggatactcccggactataggaatctcttccaaagtcaattggttcagacgtgaccttatagactcagaagataatgcatgaacagttacaactcgaccatcattactggtgagagttacttttctattagcacaatctatcacacctttatatctggctaaccagtccatccctaggatgacatcaaggtctttggattctaacagaataaggttggccaggaaaggtacaccttggatctctattctgacagaggggctacgttgtgaggagagtgcttggttactcggagtactaaccatcaaaggacgtctaagttcctttacctccatcccttgatttcccgcaaaactcatggataaaaatgaatgcatagcaccagaatcaaaaagcacggttgcaggaactgagttaacagggaatgtacccaaaatcacatctggagcaccttgagcttctgcagcagcaacatggttgacacgagccttggctgcgggtgcggaggggttgttctgggcagggacgaccttcacgcggcggggcttcggacacttgtcagcgtaatgtcctgggtctccacagttgaagcacaccccgggcttactgccttgctccctcttggcaggctgttgctgtgttggagatgcaacagggcgtggagcttgattgcggatgttgttgccagcattgttgttgaagaactatcgctgcggacgaacaacagacgaagaacctccctgtggcatggactggggtcccaaagtaaggcgtggcctttgactattcccctgctgtgccttgaaatgagcaatccggcgtttcttctgctccatgcggttgtatttgtcctcctggcgaatagctttatccactaacttctggaaatcatgataatctccagtcataagtgggtaggaaagttcatcattaagtccttttaagaacctctcctgacgctcttcatcagtgcgcacctcttccggagcataacgagccagacgattgaactcgtgcagatactcggtgacagtgcgggaaccttgtgtgagtgacctgaattccttcttcttgagagacaccactcccgagggtat

SEQ ID NO: 84724 - DNA, 726 bp, Oryza sativa
ggagttggctggaaccaaggcagcgatcatggtcttcgtctggttcaagatgttgacaacatgatcagcctgattgagtgcgtcttccttgaggagggtgtcgaggagagtgattgctgcaactgcgttctgctggagggtgcgaaaaaccgctgttccatcgacgtcttgttgcccgatgagttctctctctcgtcacccggattccaaggcgcgctgccgtcgatcttcagcctcctttgcaactcgctcgcgatcttgttgctcacgctgtagtcgttctcgctcttgtcgctgtcgttcttcctccagtcggcgacgttcagtctcttgtcgtgtacgctcttcatccgctttctcggcttttgcattgttcttccgttccgtggcaggcactaataaccccaaaaagaaaaggcggtaattattcttattacttgtctccaaagtggccaaatcaccggacttgtaacaattacccaaatcctcgtaatccaagaccttcggtgggtgaaaacctaccccaagggaactgaaggagccctcccactctttccgtgagaatggcccaagaaggtggagtattacgcccaccttccttgatctaaaatggatccgggcccaagcccgggctcgtctagatcttccagtgggagaaccttggctgtgaagacaccggcccaatcattacgaagtctcattaggattgagggatatggacccgtc

SEQ ID NO: 84725 - DNA, 720 bp, Oryza sativa
tcagatcaaccatcccggctgcatagttctatctccaaaccaggaatataccattccaaaccaggagctaataaaattattaccagttatagcatcatttactatggtgagaggtgtgagactaatcacgaaagacattgttagacccgcccattaccgcgggcacggctattcgaatagttttactctgatcagaggtgtaccactgtacccacaagacacaaccccacatcatgttaccatgtgcctcaataccaccacggtacctcggaaaggagttgtgacaataccccttgcataacacaatccactgcagcgcaccttcctggatcataatcaccgccttaaaaacatggcatggactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccatcaaaaccatgtgctcacaacccaccattaccaggttttagttggcacattaattaattaaccaatcacgattgaccatcgtgaactatcattaagccatcataaagcaatagtgagtcataagttatcccaaaagtgagctaatgtttctaagcagggctaagcaattaaatctaatatctagtt

SEQ ID NO: 84726 - DNA, 742 bp, Oryza sativa
tggtcacaccaccgttgttgggcgtctacgtattcaccgccggcctgcctccgtcgccgccgattggtgcctccgcctacacggctggactattatgccgccgctgttgggcgtctacgacttcaccgccggctagccttcgtcgccgccgagtggtgcctccgcctacacggctgacctattatgccgccgctgttgggcgtctacgacttcaccgccggcccgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctatgacttcaccgccggcgtgccttcgtcgccgccgagtggtgcctccgcctacacggctggcctattatgccgccgctgttgggcgtctacgacttcaccaccggcccgcctccgtcgccgccgagtggtgcctccgcctacacggctggcctattatgccgccgctgttgggtgtctacgacgtcaccgccggcccgcctccgtcgccgccgactggtgtcctcgcctatgcggttggttggtcacaccaccgttcatgggcattcacgtcttcaccgaccggctggcctacgccgccgccgactgatgtttccgcctgcacggctggcatattatgccgccgctgttgggcgtctat

SEQ ID NO: 84727 - DNA, 5041 bp, Oryza sativa
tggcatcaacatggacctattcgttcctcaatgataggccacacttgtgggttcatcacgcgttattgtgctctggaaagtggcgccagctccatcgttccattgtctccctggatccgtcattgatcctcgccaaggaaccaagtagctacaggaagtggtctggaaaaattgggcagtataacttgttgcacgagtgcactcgtgacaaggaccaaaggaccagggaatacttgagctctgtggtgaagaaagtagcatcggagggcatgtggatggagtacgagtaccacaacttgaggggtattcatatttcacaggatttcaagaagaaattgttggattgtatttgggactatatgtatttagcatacccagttgaagacatggaggaggtggaggaggaggagaagaagaagaaagaggcggagaagaagccaaaactgctgatgatgcttcctgagcatcacaatgttgagaacattcggaaattggaagaagctctggattttcttcctgaatttcaggagtccattcttatcatgcacatcgctacggatattgtcttcatgtatactaaatttgaacaaaatgcagcatcgtccaagtccaaagacaatgtgaagatgatcaaggccttgtcggattacatgatgttcctcgtcgcggtgcgacccaccatgctacctggtcttaagctgcgcagcctgtacgaagctactaaggaagctcttgccaaaatatggtctaagaaagaatcttcccgctgtagctccagaacaagacaaaagtgtcttgctaacatcttgcgatgcatggagaacaaaaagagagggacaaggccggataaatccgacaactggaggctaggctacaggacccggaactgggaaccagactatacaaccgatctttacaacgttagtattgttctgtcagatgggattaaactagctgatcatttgctgcaatggctacatggtaattgctgggtcaaatttcccgaatgtgaatactcttacgaggcaaaatttgcacagatgtttccgaaattgagggaaatcctgaacgagcggccgatgtccgaccaccccgataaatggtcgcaactgttggaacacatcttcttggagtgggtgcgtctgctgattaacgcgtccgtcaagtgtacaagagattctcacgccaagcagctcagccgtggtggtgagctcaccaccatcgtttggatcctggttgaacacgctggcttattccgcgttgaccgtcaaaagagatgaaattaactgtttgttgcttcctactgaatcgaggggttcatatataagttgagacgtctgtcttctcttgtggtctgtacctgtaaaactcaatttgtagatcacagcgttctcaattatatatactagccgccaacccgtgtcttgcagaggctatatatcacttatattataaatactaaattctgcattttcattatattataaattttagaaaatgtaatcatatgttactaattgataactttgaatttcgttattaaataaataaaataaaatactaacttaagagttcaagatggatacaactgcttatttattaacgaaatatagatacatcgatttcgactaaagatagacctcataatatatataatgcattatggatgatcttccgtaaatgtattatggcaataaccatatatcctataggaaaaaatataaagaaacatggaatatattgccagataaaatcataagttatatcgttgaacattgttagcaggcgtggaatttacgtgaaacatatggctcgattagctgacacagatgccattgttttcctttgactactaactattatataatacgtacagaaaaaaaatgacatgagtatgttacccacatagctaatgacctaaatttagatcagtttgaaatttgattccagcggttattttggcaacctgaaaatgcatggcatcgaatttgagtaattattgatgctgtgtgtggccgctcgatccaagcaccatctattaaaaatcactgtggaccatagaaaaaagttacagattgcatctggtgctggatcagggggcattgaagagaaacggcaccatgcattaaactcagaagaatcattggaacaatatatataaattaatatgttgatgacctcgggatgctagggaacatggtgattaagcgcatctctgcggagtagtaaccagtgttcccactctggtgcatgacatggaggttgacgttgcttctatatatcatgccatacaaaaacctacaatgtgattatggggaggatatcaataatttagcgttaaagaggaaataagaagaataagcaaattatattgtgcattctttgaaaaaaaatatgttgtgaagtattaaacattttttcaatttttagtttttaatttttatgattgtatattgccgcaacatatcatgttctttgataaaaaaatcagtctgtacgaaataaagcaaggatattgacatgtcctgtattccaatatgtagcaattacctagagaaacgaaacattgtatgtcatgtgaaatcataagatgatccatatctcccggagcattatgaggaagagtgaagtttccactgagttgatgcagatgccattgtcttgcctgagagaagaaaaaccaggcgcacatgatgtaagttctagagcagcttcttgtgtcgtcaagagtcaagacgtacctataggatatatataaacggaaaaaagaagggtatagtgtttcctgcacttgcagttttcacatcatgatgctgatgatgctgcgtgatgatgggatcgatcgaattcgagcgtcgatgccgcataaccaaacaaagttgatatacgaatgaaaagaaaaatcaatgcaagtgccgtggaggagaaaataaatcaaaccatggatttaacaccggaggaacgtcgattacacactagcatgggataggtcatctcaattgggcagaaaccctcatctgtgtcgggaagggctcctgtcacgaaccaaaggtcacagatgtgagaattcatctatgttgggcatttggccgtcacggatgatagctatgtcaatcggacaaaaaaataaagcctgtcaccgatagttttgacccagcagatgagtcaaatcagggccaaactagggcccgccaccgatgagattatccgtgatgggctcatactttaatcacgggattggtatggcgcccatcacggatgactcactcaataaggcttgtttttaagcctgtcacggatgactcatatctatcgggcttaaatttgggtccgacacgaatgaaatcatctcaatcggtcttttatttaagcctgtcacgaatgaatattttaccaaaaaaataaaatttaattttttttgccagcctcaggcctttgctagccatgctggctgcaaagtgaaataagcatatttatatattctctttccaagcaacccattcacacatccattcacaaatcaaacacagtgattacatccacattcacatatccattcaaatatatgccattcacggcaattcacaaatcaatcataggctgtcccttcaaacttccaacttttccatcatatcaaatgtttggacacatgcatggagcattaaatatggacgaaaaaaatctattgcacagtttgcatgtaaattgcgagacgaatcttttgagcctaattacgccatgatttaacaatgtggtgctacaataaacatttgctaatgatggattaattaggcttaatagattcgtccggcagtttataggaggaatctctaatttgttttattattagtctacatttaatacttcaaatatgtgtccatatacgtcaaaatttttttgccaaaacaactaaacacggccttatatttactgatcacacatccattcagcgacatgcatcttcaagagtcaagcatcagaacacgcaaaaccgagttataaattaaacaaatttatatgtaattagtatcgcaagtacatatagaaacatcagaccggattggattacgtatatgtatatacatatatacatatacatatatataaatgtatatatgtatatatatgatatatatatatatatatgtatatatatatatatgtatatatatacatacatatatatacatatatatatatatacatgtatatatatatgtatatatttatacatgtatatatatgtacatatatatatatatacatgtacatacatatacatatatatatatatatatacatatacatatatatatatgtatatacatatacatatatatatatgtatatacatatacatatatatatgtatatacatatacatatatatatacatatacatatacatatatatatataggtaaattaactggtgctacatggtgtatgggctccaagatttaaattgagaatatacccaatttgaatgactatgaaatttttttaaatgtttagatatgaacattaacttctttactaacaagttcaaacaagtttgaactgagtttgaactttttttttgttagattttggttctaggtatataacttccaaacatataattcattaggtatgtaataataaattgtgaaataaagttgagtttgagttgttttgttgttaggtatttgtatgaatcaaattcatatacctaggtatatactcataatttgaaaatttttaaaaatttgagagaatttgtgtgttttataccttggagcccaggcaccatggagtcccatatgggtatcctatatatatatatatatatatatataggtaatcacaggtctttgataagcattgtaaaatgttcaaccatttaaagacgagcaagctatgaattcactctaaagcttccattgattcctaagatttcatctagtatgaaacatgttgtatcctctctaatgacttcgaagttgtctgtgcatccactacttgctttcagcttcactaggtccaaggtagctgacaattt

SEQ ID NO: 84728 - DNA, 1009 bp, Oryza sativa
gatctttactcccggtagttctcaacaaccgggaccaaagatatctttagtcccggttgttgtcatcaaccgggagtaaagaccttttcccgctatttccaaattctttttaaacccagttagggttaagaaccgggactaaagattatagcactgcatattattttcgcttacatatgtgtttctaaaatagaagttaatgcattaacattatttaaagtacaaagattaatgaaaattactttgaaaaattatttttgtctgtaataaattaagtggataaatcataataagcaaatatatgacttaaaattaataaaaattccaataatcatatatacttagcatatgaatgatattattaaattggtaaaaactctaattaagataggtaatgtacatactgcatgatttagaattaataaaaattgtaatcatcatatatacttagcgtaggaattatattaaattaaatgttaaaaactctaattaacatatgtaaatgccacatgcatgatttaaaccttttaaaaattcaaatagtcatatataagtagcatatgaaagatagtaaattaaattgtgaaaaactctaattaacatctgtaaatgccacatgaatgatttaatacttttaaaaattctctagtcatttataattagcatatgaatgatagtaaattatgccatacatcaatagatttatatggataatcaatacatccaaaatagtttacattgtgtacacaataattacggcattacatcggcggtgacggttgaccgcatgtactttctcctcactattgttccctccttgtgatcgctgcgtgagtaaggggtgtcttcatttgataggaggatgctagggtcaatcgtcaccgtgaaagggggttgcccatccaactgattgtaatcctcgtcagtcttgtcctcaactccgacgatttttcttttgcctgggagaaccacttgacgattaggctcgtcaggccctctgcccttcttt

SEQ ID NO: 84729 - DNA, 840 bp, Oryza sativa
gaaagccaaccggttggttaagacgtagacgcccaccacggcggcataaagaccagccgtgcaggcggaaaacaccagtcggcggcggcgaaggcaagccggtcggtgaagacatagacgcctaacaacggcggcataaaggccagccgtgcaggcggtgacaccagtcggcggcggcgaaggcaagccggtcggtgaagacgtagacgcctaacaacggcggcataaaggccagccgtgcaggcggtgacaccagtcggcggcggacgagacggccggtcggtgaagacgtagacgcccaacaacggtggcataataggccagccgtgcaggcggagacaccagtcggcggcggcgaaggcaagccggttggtgaagacgtagacgcctaacaacggcggcataaaggccagccgtgcaggcggaaacaccagtcggcggcggcgaaggcaagccggtgaagacgtagacgcccaacaacggcggcataaaggccagccgtgcaggcggaagcaccagtcggcgacggacgaaggcaagccggtcggtgaagacgtagacgcccaacaacggcggcataataggccagccgtgcaggcgaaaacaccagtcggcggctgcgaaggcaagccggtggtgatgttctgactgatccattcctggagcgtaagagataagcttaaagccatgaatcccttttgtgcatatctggatctggatcctgcagaacaaacatataggatgagtagtatctgatataaatacaatactcgagaaaaaatcaagtattttaaaatatttataaatatatatttctcctcttgtcaattttgatttccc

SEQ ID NO: 84730 - DNA, 718 bp, Oryza sativa
tcagctggcctacgccgccgccgactgatgtttccgcctgcacggctggcctattatgccgccgctgttgggcgtctatgacttcaccgccggcctacctccgtcgccgccgattggtgcctccgcctaaacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggccggcctattatgccgccgctgttgggcgtctacgacttcaccggccgcctgccttcgtcgccggcgagtggggccctccgttacacggctgggctattaatgcggccgtggtggaaggctacaatcttaacggtggcttaacttcggtggcggcgactggtggtttcggttacaccggtgaactattatggcggccttagtgggcatttttggtttcaacggcgaacggcttcgtcggcggcgactggtggcttcaatggtatagatggaccaatttggtcccacaatggccacttctggcattaccaagggggatattacaaagcttaggcatcaattattttaatctttatatgagaattttccctttcctctgcctcactacactaattgggctttcattga

SEQ ID NO: 84731 - DNA, 697 bp, Oryza sativa
cgaaggtgaagatggacacgtggattccggcatgggatcacgagttcaggtttccgttgagcgtgccggagctggccctgctccgggtggaggtgcacgagtccgacaaccaccagaaggacgacttcggcgggcagacctgcctgccggtgtgggagctccggcgaggcatccgctccgtcaggctctgcgaccaccgcggcgagcccctccgctccgtcaagctcctcatgcgcttcgacttcacctgactactccatcttcttcttcatcatcgtcatcgtcttagtagtagtagttccatgtatgatatcatgagggatgaagcattgatcgtactttctccgtcccgaaatatagcaatgtaggattagatggaaacatcttaatactacgaatctggatatgtcctatctggttctggtttgctatgttttaggacgaatatagtacataaaattttagaagttttgttttaaaaaaaaataaattttgtgcgaaacggaaggtgtgattgtacattttgtacgtacattgtttggtgttgataataaacggttaataaaagagggaaggattcttttaatttcaaggtgttgccattgattacatgttggtgttgagccacaaatcattgttaggaatcactcacaaaggccaactaggtaggtgtttaattattttcatgtttatgtac

SEQ ID NO: 84732 - DNA, 559 bp, Oryza sativa
actgccctcgaggtgctcgaccttggtactcagcgacggcagggaggcgcccagatcttctaccctcttctccaccgccggaatacgagattccaccgacttcttcagatccaggtactccgccctggttcggacctccgcttcctctctcttcctttcattctctgcaatagttttgaacaagagatcgaacttggcgtctaaatccattggtgtgtgactctggatcctaacccgcgctagcgctccgaattcagccaaccagattgagggagccgaagcttttgtggatcacacgccaccaaggtagcaggatcccacctctctcccggaaattttacggctaaaccaagaggattttgcagcgcgaatggctctgataccagattgttagggactctcaagaacaactcagatatatgcgaaattgtggcaactatgtggtatttcctctcagatccgacaggatcgagccgccgccgcctacgcctccagttgccaattcatcgttcatacaagtgttcatcgtttgatttaatacatccctctccctcacgtg

SEQ ID NO: 84733 - DNA, 4461 bp, Oryza sativa
taaaacattctcacaaacattacatttatctagttctgctaatacatttcatgcagaatggacagggaaaaatcggtaagtcaacagttgtgtaaactgtaaaactaatagggcatgataaaaggatagtaagtttatatgtactagaagttgaatttacaatgcaaatataaatccagtaaatgaacttcactaagaaaaatgttctgctatgcaatattctccgtggctgtaccgctgctgttatttattactctgtttttaggtgttctcctttcagagttggataacttcttttagctactcacatattgtttttttaattatgaagtattcctctgtaaattattcgggaatgctttgcagtttgcatgatgaataaccacaccactatattatcacgaagaggaagtatataatagttctgaaacagatgaacatggctgcagtaaccaactgtgaattattgcagcagaaagaaaactgcttgctttgtctaaaagaagaaccgctaaagaaatgataatgcagctaacaataaataagagacagaagaaacctctgtagcatctcggtgaaatgccagcatgctagcctcaaagcatacagcctttagctgtgcaccattaaaatcatctgtacagcaagccaactcttcaaagtttacatcagggtttttgtccatttttcgggagtggatctacaaataatcatacagagcaagacatttaggttatgtgtgcaaagctagatatcttttcaacaactaagcaagtaaaggagggaaaaaaaaggtgttcaaggtagcttgcctccagaattctaactctagcctgttcagatggatgagggaattcaatcttttgatctaaacggccagatcgcagaaaagcaggatcaagaacttctggccgattagttgcagctattacctgttagtcagccaaagagttcatcatgtcattacttttttaaaaaataccagcaagaaacagaagtaaagtattaacagaaatcatattttagtgaatgtcataaagcatgtaggaaacatgtgttcgttagatagacaagcgataaggaacaaagcttatgtttgaagttataagaagctgaagacaatcaacaaaaatgcaagaacaggtccttaggaatatccattaggataactaaaaggctaatatgaatgaggatgtcttgatattatctttttcatggtatttattgtagctttcatccagtgatcaatattgcacagaacaaatgggcttcgctcccttccaaaaaaaaaaaaaaagagagggattcactgcttatggtcacctaaagttattcacaagttctaagaaatttcgagtccatgctggtaccatttgctgtttgcgaataaaagaagagattactgcatcttaacactacaggcctgtttgggtagtcggaaaaggaaaaaaaatcactcacaaaaagccagcttttcgtcctagtcattcattctcctcttctcatttcaacctaatccttcctatcccaacaccactaatatcccacagcccaaatgccctgtatcagtacatacgtgaatataaaaaaaataaagtggaacaggaagacatctgaagggctctgtactctgtaccaggatatgcacacacaccaaatgatttaatacaatagttccatacacagaagaataaagagatatgaaaaaaaaaacacacttctaaacatatttcaagccgcagtttgcatattgctaaatctccatctgtggttatcgaaagtcacatgagcttgtggttattaaaacatttacctttatactctcatagctcccgacgccatccaactgattaagaagctccacaattgtttgttgcacttccctatcaccactgcatggcgtgcaactagtcagaagtgcaagtactcaaacctagcagaaacagaacatacattgtatattgttgagagcaccataactgccaaatgtactaaaggtcctattataaactcgagttacttctactacaagtctcaacaggagccttcatgactttgtgccagaaatgaagttcaaacttccttcctgacatttctgaggatctaaaaattcaaatgtcttaagcagacataaaaacttgtattggaaaagaacctagaatcatttgcataaagtaaacttgcagtatacatgctaaattaagtgatatatcaactaagggtgcaggtaaaggcaatatacgattagaaagaggacatgatttaacaagtatttaacatgtcagcaagtaggaaacaaacaattgctggaaagaaattaacagaaaagacctagtgtatttgttcacatattcaaaagtgggaaatgatgaaggaacgaccatgtttgtcatacctatcaaagtgcttgcttccaattgcatcaatttcatcaatgaaaataatgcatggggctttctctttagcaagctgaaaggcatcacgaacaagtcttgctccctcaccaataagcttctgcacgagtccacaaagaaaccagtattaatctcaatcgtacataaaaaaaaaggcaaatcatgtagcactaagaaacttttcagaggagctcaaagatatcgaaggatcatgaaaaactctgctgttcaatgcctttacgcatttcatgtatctatcaaatactttgattggttttcccaaattcactgaccaatgcataaagatggaacatgagaaagatacagaatatacgcacacctgatttcatgaatagcacaacaatattttactgacagttaggtgatggattttctgttgcaagataattaccacggcaagttgtggaccagttagcttaagaaatgttgcatttgtctgggaagcaaatgcatgggcaacgagtgtcttcccagttccaggtggtccatacagaagtacaccttttggagggtgaattcccaacctctggaagcagttcttgtggattattggcaacacaactgcttccacaagctcctcaatctgaatatgaaatttacaaaacagtttattacttataggagatggggtggtataaattaacaagtaaacaaaacgctattcagtacaataataaattaacaagtaaacaaaacgctattcagtacaataataaatgaaggagtgcaaacaatgttgctattcagtacaataataaactatgtccactgttattattaccattcttaagcagggaaaagtagaaagagttgtaacttacttgtttttcgagaccaccaatgccacagtagtgttcatttgatgtactgtcaacaccaattaaatctccaggcttaagtttgctagggtacactaccccagcaataggacggaatataatctgtcattgcaagaaaaggaaacaaaagaaaaaatatatatatcagaataagtttagaacatagatgattgactacagaaaatgaaatcgagtgagctcattgcctcaagaatgtcccctgtgcataagttcatatttatctatgggtggtatagttattgcagcaaatttaggctcctgttgatgcatgtgcatattgcaaaggaaagaactccactgttgattcgacatgccagtcaggattgaacatatccgagcaatattcataaccgagctcacaggcaataggaacgtaggattggtttaattcttcgcttgcaaacataattacattgcgaatgagtcacgaccacaaatattagcaaaacacattgagtatgttccgtacacatgcacagttcaaaatgtggaataccagaagcgtacttttaacttttgaaaacttaatcaagcttgttttagtctagcagtagagacatgctgaattagtgaaaggcagagagtttgctattgtctgaaaagagaggttatcatctgtggaacagaagatatcactgcaaccctgttgatgttacaaatgacacagttctgatatattatgtatatactgcctccgtttggaaaaggatgaagttctggcctcaacgcctgaagacaaagacatctctttacagctaagaaattgacagctttgccccttactagagtaattaatgttccaatcattgaaatgccaagagaccaagcaggcccagggtagcacaaatttcaatctacctcaatcaatgcaagtagtgctgccacgtggaaacattcatatgcaattagggatagctaggaacagcagagttgagtttgagtaatggattgctctctctctctctctctcaaacgggcaggagagccgcgcatcattatataaaggaaaagagtctaagaagactcaaagaagcccattagggcaaggtttagtacacaagggctggctaaaggaataaaaaaggactatgactagcaatccaagcaaacaccacatctatggccaaaaggtactaatgaattgcttttaataggggtaatttgat

SEQ ID NO: 84734 - DNA, 630 bp, Oryza sativa
acgagtttaacttcactggtgagtggtcccctgaggacgcctaagcggcgaacccagaaaatttatgttgggcgtaatatgaagggctaatgaattaatttggcaacggactagctgacattgtaatatccaaaaacaccgccgctgcttagcgcctcaaacatcaaataatggggtgtttcgtttgtgcagggcacggactgcagtctgcagctagcttaatgctgataaatatgactacactgatgagtcgctgatcccaggaaatttcacatttcttggggtatgccggtgccctcccggcaccacccctgggtccggccttggaggacgggcacaaagaggatgccagcaagccactgactttacaggattttttctcacgcatcacaaaccaacgaacgatgcgatcgacgaagaaccatccacccaaacgatcactactggctcaggagcagcatcgcctccggccgctgctgcccgaagccgtagaacgggtggtggtagtggtgcggctcctccgccgccgcctcggccttcgcctcggccatcgacaccaccagcaggttctccttgtcgccgtcgtccacgcaggcctcccttcttcacctgccctcgtaccgcgagttg

SEQ ID NO: 84735 - DNA, 1065 bp, Oryza sativa
aactcctattgcattcagcagaccagataaacttttcttccttcttcaatagttgtgtcattggcttggcaattttagagaagttctcaatgaaccgacggtaatagcccgcaagtcctaagaaactccgaaccagagtgactgtccttggtggggtccacttggtaaccgactccacatttgctggatccaccgctactccttgagcattcacgatgtgaccgagaaactgaacttccttaagccagaagtcgcacttgctgaacttggcatatagctggtgctcttttaacttttcaagtaccagccggagatgctgctcatgttcttcctcggacttagagtagataagtatgtcatcgatgaaaaccacgacaaacttgtccagaaattccataaacaccttgttcatcaaattcatgaagaaggcaggtgcattagtgagtccgaaagacataactgtgcattcgaacaacccgtaccgagtgatgaatgctgtctttggaatatcctcttcgcggatcctcaactggtgatagcctgatcgcaggtcgatcttagagaacactgtagctcctttcaactgatcaaacagatcatcaatccttggcaacggatacttgttcttaatagtgacctcattgagtgcgcggtagtcgacgcacatccttttggttttatctttcttttccacaaaaataactggagcaccccaaggcgacgtgctcgggcggatgtatcccttctgtaactgttcatcaacttgcttcttgacttccgccaactcgttggctcccattctgtaaggcctcttgtggatcggtgcagttccaggtaccaagtcaatccggaactcgatatccctttttggtggcattgttgtcagatcatccggaaaaacctctggatactctctgactatgggaatatcctccaacttcttagtggttttctccactactacctcttgttcttcacccgcagcctggtttaaactgatcactggcttctgcggcactggagactggaaggttaccacttctcctttcacattggtcaacttga

SEQ ID NO: 84736 - DNA, 576 bp, Oryza sativa
cttcggacgatttatttagccaatttttaaagcaaggagagggggaaacttcagggcgtgacaaacctaccccccttaaacggaatctcgacctcgagattcggaagagctggcgaagaggtgcgggtgggtggccttcaactcatcttctctttcccaagtggcttcttcctctgagtggtggctccactgaaccttgcagaatcttattactttgtttctggtccttctctcgctggtttcgaggatacgagttggcttctccgcatacgtcaagtcttcctggatttcgatttgatccggacttgcctgttcctcaggaactctcaaacatttcttcaactgggagacgtggaacacattatggatgccaagcatgttggagggaagctcaagctggtaagcaacttcacccctgcgttccaaaatccgatatggtcccacaaagcgtggtgccaactttcctttggtttggaagcagtgtactcccctgagcggagtgacacggagatacacataatcccctgcttggaaaacgagctcccttcggcggttgtctgcatagcttttctgccg

SEQ ID NO: 84737 - DNA, 630 bp, Oryza sativa
  unsure (1)..(630): unsure at all n locations
cagagtatcatcatctcagatacaagctgcattgctgggttggattggtcttcaacatatagattaatgtttggttcaggatcatcaggatttgccaccttgatacgtgggtctatcatagcagtatcaatcgaaccctgtgaacttcagagtgtcaattttgtcaaataacaaatgcatcgtagtactgatgtaatacttcaaaaagattttgaaaatacaggcttgagctaattggtaagtggcaccagtagtccagtactaatggtgaaatgaacagccgtggcattcattttgtagaccttggtctaggaaaggaatctggaagggagttcccttgtccatagaaaaccatgtgtatctcgctttataagaaaattacaggtgcatttcattctgctttcatttgctaatcacagatgactcataaaaagacaatgtattgataacttttgaaattgttttaatacaaccttttcccccaggncttattggggggggcgagggaatactaggctctttgaatggttcacatggctcctataaataaagtccaatgatatttgaactacacttgagaacatgcttgatggtgacattgacaagaagccaactttcgtttatgacttg

SEQ ID NO: 84738 - DNA, 1613 bp, Oryza sativa
tacagttcagcccagatattagttcatttttgtttcagcttttgcacgattatgtcaccatgttttaactgcacgtttcctcatcgcaggacctcgtctgccttcgagcgcgttcgcaggcacgaccggcgcttccacgagctccgcaggggcgttcgccacctcttcgggcgcgttcgccagctcttcctctcacggagcgtcgatccctcgcccacacggtactttactttttattaatactgttaaatacctgtacgaaactgatggtccttgtccagcaggatttgcagccgggatcttcggtactggggcctcttcgtctcaagccggtaggactggtcctactagccagttctacgacgacgacttgcacggtgcagaccaccacgacgtactaggctcctctcagcttggaggagctccagaggcgcacactcaggagcagccagaggtcacacctgtacaggcaggacgggttggccgtgccgtacccccggaccgactcacgtactcccacgggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgctgcacggtagtgtcagatccagtagcgcgcacagtccacaacagcacacatgaaaagcggcagctcgagttatcactatcaactttcggcgctgcctgtttacataaagtgaatcacgcccacgcgtgatcgtcttgtcacatctaatgaataatgtatctcattgagttcacatatattgcagtgaaaacgacgctatataattgacaatctgaaggcaacctcttcatattttctttcccactagcacacaacacacgaaaatggaagcctattcattggtaatacgtaatctagatttgagattatgtagaacattttcactacaattttacattttggcagcaaaccaaatatgatcaaatgcaattttaccttaccaaatatttggtcgtgaagaaaaatttggcactaacaatccaaatatgccctaaaaattaataaaatatttgtacggtaacaaaatatttgtacggtaacaatccaaatatgccctaaaaaataataaaattgtattttaccagtcttggagattttaatcttgtatagttttcaatataaaaagatttgataactattgatatttatacaaaaatatagagcacagtacaaaatcgccctagcggagggcggcaagggggccgcctgcaaaattccatgccccctcgccgcccatttgcaggcggccccccgcacagtacaaaatcgccctcgcggagggcggcaagggggccgcctgcaaatttcgttgacggccgtcgcccgagagcgaacggccgtctgccacgtcattttcgccgccctctgggagggcgatttttaaaaatcgccctccagagggcggtaggcgactacttccgtcaat

SEQ ID NO: 84739 - DNA, 4950 bp, Oryza sativa
tattgttttcatcaggcacaatgtcaagtaaggtcacatttcagatagttcacgatgaaggaaatattagatttggtccagatggtgttgatctgtcagattttgtaatgacatctaagggcatcgataggcctgcggagagaacatttcagtcaatttatagttggttgttgagaggatttagaatagaccaagaagtatacacaatgtcagtgtcagttgtagtgagtcgtgcaacagaaggttatttttgggaactaatgccgatggacagcactgatgcttggagacggtatgtggaaatggcttttgaacggtcatggcccctcgttatatttgtgtcggtagaagagaaagatataaatgtttcaatgcaaaccgaagatgtagagggtcctatcaatgcaggggatgttgttggaccatcgatgcaaaatgaggaaaatcaaccaagggaggagcaggctatgggcatggcggatgagggggagagagtcggtataattgttgatgaaatggagagggaagattcggataatgaggaagtggacgacgacgcatcatccgatgaggaaggtgatgtaatggccactgattgggcaaatgaggacttctctggacttgttatatcagagggtgatcatgtaccttgggagtataaggagaacgaggtaattgagggtgcaaggtatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaagatcattgagatgaggtatggcacatttgaagcttcttatgataatttgcctcgtttgttagccaccattgcccagaggaataataatacgtactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagaccactagttgaaggtgacgagcctcccatacctcttggtgcattacatgatgacccaccaacaatgagaaggaggtcagggtcgtccatcagaaatttcactcagtggattgagaatgagcctaaggagaagtggtctctattgttcgacaccgatggatctcggtatggcataatgacaaccaatttggcagaggtgtacaactgggtaatgcgaggagttcgggtacttccattggttgctattgttgaattcatccttcacggcacgcaagcgtactttagggatcgatacaagaaaattggtccgtccatggccgataacaacatagtgtttggcaacgtagtgacaaagtacatggaagataaaatcaaaaaggcacggagacatcgagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttatattccagatccatctaagttaagggtgaaaaagggtcgacgccaaactagacgcatcagaaatgatatggatgagtcagaagcaggtgggaggactttacgctgcagcagtgtgatctgctcggccatacttacaagaaatgcccgaagaatgcagaagttccaagcggcgcagatgctagtccatctggacaggcaagtgatggtaggcgaccacctggtgaaggaacaacaagcaggcgcgcaagaccaaggcgtcgtcgcgcagcaggcgattccatggtgtaacaatgctttcgatttaggaaataaaatgctgttgtgatgtaatgagtgttcggactaaatacttctatcgtgtaatttcaattcaatgttgttgtaatgagtacctccgactattgttgtactagtagtattgcgaattattcggtgttgtatcataatgttatcgtgatgagtgttcggactaaacacttttgtttgtttgtactcttgtttaatatgtgttagtaattcgcttatgaacatttattacttatgttgaactaattatttatatgtttctgatcaacctatttgatgcaggtatggcgtacgacacaccggcgctgttgaaccgtgggattgacaagaaccaccgctcgttcctgtcagcagtcgagggtgcacagctcggcaccttccgtccacgcacgtcgcgcgagtggttgcgtgtcgacccccgtcacgttccttggtacgcgtatgttcacatttcaactcaactttgctttgtgttgtacttatgtttgaagtttgctctatacaggttgcgtgcggcaggccttctaccactttgtaggcttgttgaggcggcggcggacgaccgtgacccagcgaagcggtgggatgcagaccggtcactccttgccgctcttatagaccgctggagacctgagacgcacacgttccaccttccctgtggggagatggctccgacactgcaggacgtgtcgtacctgctcgggctaccgctggcgggagcagcagttggtcccgtggacggtgtttttgggtggaaggaggatatcactgcgcgcttcgagcaggtgatgcgccttccacacctaggaccgaccaccacccttcctccgtactctacagtcgggcctagcaaggcttggttgctccagttcactgtaagtaaataagttgttattatcatacgtgcttatttgcgaccgaatgagtgttttgtactaacatttcattcttaattgtaggcggaccttctgcaccctgacgctgatgattactcggtccgacgctcccttgaggcgtacctgttgtggttgttcgggtgggtgatgttcactagcacccacgggcacgctgtggacttccggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccataggtcgaccagtggtggacagcgcaccctacggggttggtcgcagcgcgcagtggccagaggacggtcccacgatggggacttactggtgtcgacgtggggttagtgcaacttcgctgcgttataagtttatcagtcgtctttttttttcttcacataacatgtctaattccgatcatgtttattgcagcgtcgttacgctcacgtccaggtgagacgtggttacccggacttcgtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcctccctgccgaccactcgtgagttcggattgttcatttctaaatttttatgataattacttcatcgagccatataatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttcttacaattatttcatttatcttgcataatataggacaactactgaatttgttatttccatcttgcataggctgatgccgcacggg

SEQ ID NO: 84740 - DNA, 743 bp, Oryza sativa
ggatgtgtttgagatccgttgattatacggctaattcgagctcggtaccaggcctcaatctactatcgtacccaactttgcaattggaaatattgctagctaatcgaatttgtgttgctcaaactacttccatgtttgaatgaacaacgaaatgttttgaatgaggaagtaggagcattatccatgtcaggtcagaagatttatactaaaagctagaaggaatgcatcttaaaaaacataagggaatttacctgcatatctccttttcttgttagctcttcttcttttgcgctcagcttgtgtaagttctgcttcttctttaacatcaccttttccttcaaaaatttcttcaagagcaagcattgcagcatctgaaacagctacaggtgcaatctgcaaaaagagagagaaatcatgacatgaaatgctcaaccgtataaacatcatggagaaatgaaggattttatttacctcctccattgctagagctggtacatttgtttgtatagacatatcttcaatgacctgaaaagtgaatatttaccttgttagttaacttcgctgaaagaaattacaaatttaagtaaaatatctggtcactattccataccggctttggagcaaagtgtaaatgagatagtgcatccaacctcaagcatattctcttaaataaggtctttgccctagtggaaacagaagtttgtcaatgcagcaagcctctatatcatcacaggggaaaaaaa

SEQ ID NO: 84741 - DNA, 739 bp, Oryza sativa
  unsure (1)..(739): unsure at all n locations
tggacctgagaatccgttgactatagggcgaattcgagctcggtacccatagcagcagatcgtattgggaggaaaccagttgttgtgtttggcattttcgcggtgttagtgatatttttcctcctctatatgaaataatagttgatatctggcacaacctagtttactccggtatagcagttccttttctttttattggtgtttgtctaactaagttcttggtataatggaaccagggtcatatttaatacgctatttgggcttagtttcacctattggatggcaatagctacaagattccttcttggtgctttaaatggtttacttgggccaataaaggtacaataaagttgaaactttcctttgttgtacttgtacctggtcatgtttttttttcctccaatgcttgtacctggtcatgttgatcttgatcaatttatatttgtcctttcaagcctatgctattgaagtttgccgacctgaacatgaagctcttgcattgtcacttgtaaatacatgccatactgntctgntattaatttttttctggttaaattgagttgattttgaatttttttaatattaggttagtacggcatggggaataggtcttataattgggccagctattggaggctacctttcacaggtatgtcacagagaattgaacagtgttagggatttttttttaacaatggggctacatttaatacgatttcttttatggcagcctgcagaa

SEQ ID NO: 84742 - DNA, 763 bp, Oryza sativa
  unsure (1)..(763): unsure at all n locations
tgaaaaatctggctgaaaancngctgaagtaaacctactcactacaaggctatattagagctcggccccctacatcctctgtcaagcctaataaaattttcctatagtgtatgtgtaatgttttcgggcttgtgtgaggaggcggcttccactcctcactctctcttactataactcttcttcctttattcaatgcatgaggcagtgcccctgccctttcgcaaataagaaaattttgggtactagagatggaaatcagcaattggagaagctgctttcaattgtccaactctgatcacaaagagttagtcttcttagtaaatctattatctttcttctgtctctctctctgaaacattttttctctcatttcaatatttattatcttctttcgtgtgtaactaattatatatgtatatgtagtgccaatgcacaattgtgatacttttttttaccacaagcggcgccagtgggtccgagaggaagatttggctaaagcattaaagatttcctctaagcaactgcgccgcattctccagttttttgaagaagagaagctggtgagaagatgtcatcgggaagaggttagaaatctctgagagaaagttgntctcatttttgcatagcccttttttttttattctagcatggnaatcgccatctactncacttaaaacagaaagtgntaatttattagtagtttctgaaagcaagacctgatagaagagtgagacaacgattgcggcctctcagtttgcactgt

SEQ ID NO: 84743 - DNA, 596 bp, Oryza sativa
ccctttttttttttcctgaaatgtaccagaaagttatcttgcattttcgttctttggggaactgcaacgaaatagtctgcaaaactagaacaagacaaaggaagtacttccccaacttaaaatgagaaactgccatcaaggccgaaactcaatcatacctgcagaaggtttgagcttgagcaacccccacttgccttacgtatcaagtctgccttgcaaagcactgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaagcctagtccgtaggcaggacttttcaagtctcggaaggtttcttcaatctgcattcgcttcgaatagat

SEQ ID NO: 84744 - DNA, 1791 bp, Oryza sativa
caaagtcagggtcaatatcactaccattacccataattggatgctcatgattttgtatctgacatgaccatgaactcttgttctgcagcgtgatattcgggatgctgattgctctccccatcacattggtctactacatactgctggggctctgaagagctctccaagtctcaactcaactgtgcaagaacttgatgttactgacagtttgattaggatttatggttctgttttagttgctcagattttgtttggatgataggtcagcttagtgatgctagttagacaattatccgaggacttttgggttcaagtgacggccagccacggtttctgattgaagattaggaacatagacatcacattagtgacaacaggcatctaatttgtaagacattgagaaggtctgtttcaaattactgacaatgtagtaagacattgaacagtgcttataagcttatttagcattccaataactgatggtaatgcacttaaaggagctactctgaaggacttttttaatctcttgagagattagctccggattttttccttttggaatgtttctttagtttgagggctctgaaaacacgaaaatagaaaaatcgtaggaacatgatgtcatgctatacaaatattataggaaataaatttattaatttataggattttgcaaaaaagtattgtttattagtagcaccatcggaaaatcaaaggaactttaaggctgcgttcttttagtttttagaaacggctaattagccgcactaaaacttttgaaacggctaattaactacacgtaaaacgataagtgtgattagtatatgattaattaagtactaatatgtaaaagaattgatgaatatatttattagattttttaaacaactttatataaaaaatttttacgtaaaatgcaccgtttaacagtttgaaaaacgtgctaatgaaaatcgaggagtagcatgaggtctagtctcatgttttctttcaaaattcctacacaatgagcaataggaattttaaaggattttggggaagtcatttctatgttccaaaagatcatgttgggaaattttccaatggattttaagggttgtttggttccggttacacttttcatcacttgccaacaaaagttgtatcactttgtttaaggtgaggtgaataaattcttagtcataacttactaagcctaagcctaaggaaactttaccatatttttttaagttattgacacgtgagacccaatttgttagaagagaattttattaactatgggtaaacactgaccaaattgattaactaatcttaaatatgggaaactggggtaaagtgtatgttccaaccaaacatcctctaatcttttaaattcccctttttttttctttttatacacttttactttgtttaaaaagaagcggaaagagggaatcttttttgccacttttttcaaagtttcaatggaagaaaaacatggcgtagcattgttgagcatctttttcatactcccaagtataacaaaaagtttggccccaaaattaaaatgctaatggctggcctgtttgctcgaaacaacaggacagaaaatgataggtgttgggagtcagacaaaagtgtttggctttaagcatgcgcacttgaaggttggagcaacatccgacaattatactccactcttctcgtctgtatgacaaaacttaacgggtggatggattctgaaagcgattaaccaacgggaatttttataatacgttgccgaaacatattgttattaataaaaatggggac

SEQ ID NO: 84745 - DNA, 694 bp, Oryza sativa
aacacccatatacggaggacactgagaaaaaagctaagtgcctttatttttcctctttatgtgatattttccattgagcaatttttttatatctactcatgctaactactcgtccagcgccggacgcctagttttatcattatttatcatattgatttttaatctcagattaatctcttgttattttttgttgttgttcgcatataattacgcggcactattgaggcgattaatgctggtcatggagtcgaggcgtctcagctttccggtcgatcggccgcgagtccactttgccggcttgtcttcgccaccgccattgctgataacaacaacgacttcaccgccggcctgcttccgtcgccgccgagtggtgcctccgcctacacggctggcctattatgccgccgctgttaggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgctgctgttgggcgtcaacgacttcaccgccggcctgcctccgttgccgccgagtggtgcctccgcctacacggttggcctattatgccgtcgctgataggcgtctacgactt

SEQ ID NO: 84746 - DNA, 649 bp, Oryza sativa
tcggaaaacgatttttttggttcacaggcaatcaaacctaggtagccaagggaagtatcaaaaagagctatgagtttgagactcaccttgaccactctcctgtttctctcgcctgcgattcaacagctttgtatagtctatcaagggtgtacagtgttaacccgaacttacagcatgcctcttcctcctgtaaaattaggaaattcagccagacatttattagtacgtattgtaatcctaatatttttcaagtttgtaattcgaaagtcgaaagaaaatgactttctcatcaatacgaaagcacttcaatcttggattttcaagacgaaggtggggatgtccaatcttgaaaatggcagtttcttgttttctcatactaggtgaaggaataaggtttttgcagacaaaatacaataggaaagcgttatatactccctctgttttttcaagttgttgacttatgacatgacatttaaccattcatcctattaaaaaaatttatacaaatgtcatttgttttgctgtgacatgttttatcattaaagaaactttaaatatgacttgtactttagtatatttacactagtttttttaattaataagacaaatgatcaaacgtaattctgaaagtcaacggtgttatttatta

SEQ ID NO: 84747 - DNA, 541 bp, Oryza sativa
tcctgcagccaaaaaggccttaatgaatgaattgctccaggccagtgagcagtacgcagttgattcgcagtcaaaattaaatggctttctgtacccaaaaaagaaacacgcagatccacacgctaattcgagcgtagtaaaccatctcgtgagatcttaattgcacaatcaaacaacccgatcgcccagcgtgaaacaagcgaccgcaattgaagcatcgcataacccgatctacgattcggcaagcggactccgacgcgtgcgcgttgtagagcagaggacgaaggcagggttagagagagggggcaccttctcgtcgcaggaccggcagagcgcggcctcgtcggccacgcagaagagcaccgccggcgcgctctcgcacacgtcgcagatcgtccgcatcccgcccgcgccgagccgcgcccgctgtcatcgccccccctcccccatctccccgcccccccactccctcctcctcctccttcggcggatcggtcctccccgcctggctcttcgccctcgtaatcgtacacacagcggc

SEQ ID NO: 84748 - DNA, 1186 bp, Oryza sativa
catgcggttgcttatctctcacaaatttggtggtttgaggtcagaggggaggttgaattctgcttcccagaaggtacatatagcctatttttccgtcttcatctaggcaggccactcaagcgactaggacgacgggtttatagctccgagcacatccatggctgggatataaaaccagtgcgcttccagctatcaacttctgatggacagcaagctcagtccaagtgctacttaactgatcctggggtctggatcaatcaccacgtcggcgatttcgtcgtgaagagctctaatgaactagtgaagatccaatttgcaatggttcaaatagattgcacacacacaaaaggtggactctgtgtcgattccgtggctgtaaaaccacaatacctcgcgaagaagaaagcatctcggatatatgtgtaggttcttcgatcaagttcagctgattctcatcgataccgcatagctttgtttttatgcaccacttgtgtgcttgcttttgagttttttacagatcctgtaatatgtagttcatggggtaagtgatttttatttcctcttgtccctctagaagcatgttacacttgtaaattgttaatttagcatacagatagcttttgtggctcatgatccttgacaccctgtgcaccaatgttgttcttctggtagtgtatcaaaagctttcatggagcaatttcatcctcaatttctgagttctcgacttaatgagaagtgctagtgcgttttgctcatcagtaacttctgaagccattttacacagttgtctgatatgttgctgcagttcatcagcctgtaactgttgaggttcatgcgcaaagcaacatgcttcttcagctctgctcaattaagaaatactaaatttgtgatctggttttcactttgattccagaaaatgataaattaaagcagcaaacaaaacaatattttatccatgatttaagtttacaacagcttgtggttatcagtaatcaaatttcagctacaaatcaaacgtccatggatagctttcgctctaggttgtacaggacgctggaccagtggatcatgaaagaatcaagctaaaggcagcttgagagacatcattatgcaccatctccattccttcgatatggcatgtagcgatgatctttggaggcgttcttcctccgccgcttctccatga

SEQ ID NO: 84749 - DNA, 3643 bp, Oryza sativa
  unsure (1)..(3643): unsure at all n locations
cccctgtacctactctcctcctagtacttcgtcagaaatgaacacctcacggtgctctgcctctaacctgccccacaagtccagtaaatcacacgcaaacagacagcaatctacggcgagaggaggaaacgtcagtgtcgcactgtcgcaacaaccaacaaaagcttgactctcacaccaattctaacgtacccaccagattccagaaaccacactcgggttaacttccaagactacaccgccacaccgggaggaagcatcagatgaaacatcagcattcacacaatacaatggttccgtgcgtcagcagcaacatttacaacatcgatcataatgtgcacttgtcagtatgtcaacgccattttaaaccgcgccggcgaccggcgtcggcgtcagtgccacgcgtggtgcctccgatcaccgtgctccacgccgccgcagccgccaccgtcccggacgatgatctcccccggcggcagtagcgcaaccgccttgccaccgtggcgccggtgcttgttgagcttgagcccgtccctgtgctgcacgccgagcgccgcctcgtgcctgccgtgccggcggaggatgacgtgctccgccgccgccgccgccgccaccgggtcgtcgtcgtcatgtatgtggaggacgtggtggcggcggtggccggcaagctcggtcttgtgcctcttgtgcgcgtcgtggtggtgggagtgcctgtggctgtgagctctcttgtgcctccggcgcgcgcgctcctgcgcctccgacccgaccacgccgtcccaccaatagtacagtggatcgaagagccctttccggtgcagaagccacaggactgaaagccaaaatgaggaacatatgttatcacgtttggtaagcaaagcacgcatggaaatgcaatcaacctgatgaagaagacacagcacctgcgacaagtagcaggccgtggatgacgaacttgaggaagctccagcatctcgtgctgccacatgagaatgatctacgaggtcagaaatgtgacacaaatagatgaagcacaagaatggcttcctactatatcaatacaaaacgccgcactgtctttgcatatggcatatagcttttgtcgatgggcatcaatcggagggagaaaagagaaagtgcgggctggaaggagtttattgacgcacctgcatgttgtaccagtgaagaaattaatcagcatgtgccacattttggcgcaccaggctttgatggcttcaaagaaaccccagatgccaccctttgtgtggttttcggacgaaccaatctagaaagttgtgttcaagaaccatgagtgtctgtgtgtttgattgctcaaggtactagattggacaaacacgctccaagataagttggcaaatgcttattaataggtaaccggacaatgctaaggttgtatgcagatctaaactacctcgttgcacttcaacaaaagcaaaaggacaataaattctagatcggctattataaggcatgaatatttctcaacctgtgttccattgttaagaactgtagctgtggttgagaattgggattcttttctgtcaagttcactgaaatctgacgccttcaaaatagctgcaatagcgcagaaagaaatcagatgtcgagtctcaagtctccaacacaggattatgaacagtagaatacatgctatgctctagtttatgtataactgaccttgacatgtatagttcgatgcttggtctgttgacgaacgcaaatcaaatgtccgaataagcttttcatcaggcttcatgataaagtactgctcctgtaaattgaaaaaaacagactaacttcactacttgaggagaagaaacttaatgactagtacataactagagcactaagtacaatgatgacttgatgatcaaatgtacacatcatgtacaacaacctcatacgaagaattcagaaaaaaaaaagatctagaaaactcaagcagtacactcaatcttgtatgaattcaatatactttgaaaggttcagaataaagtgaacaagcttggaaaaaaacagtgtgcgcaaaatcacagaatgtgattactatagtaccattacctcaacgggattgatgccgcttaagcagtcaaactgcaaaggaaaagagaaaccactgttaacatttcaggaaaataaagggcaagttacacatctagtatatggctagataaaaataaaagagtaaaataaaattttatgataaaatgtatcgctagtattcatatgatgcatcagcacatgtaagtattccagattgaaaataattgcatgacagttagaaaatcaatttctccttttgaactcgttaaaaaatagaataaaaataacaaagtaacctgtcaaacagcaatttcttgacaagatgcataccgtcaagctatatgaagcttcaagtcttccaatattcttggttttgactctagcactgccaacttgacttaaggcttcaaacgaagagatgttaatgctaattatcttccctgagcttctgaaattaacaaggaaatttaacatattacacatactgctaagcaaagaacataaattagtgatttataacatgaattgaaatgtaacaccagagtagaaaattgtgtgtaaaattgtccaccatgtcttacgtttagtgcaataatgtctgaaattgtatacatttaaaagtaaggttgtgcctactggtaataaatattcagtcgtataatgcaaaagtattattagtacctctgatagacatattctatgtcatcagcactcagctctatcatcaaattggtattgagaacttgtgggattcccacagaaaaggntatgaactcctgcattctgtaaatgtatctatcaaaaaactttatccaatgttggcatataagaagagaagagaaagaacttaaccggatattggttgatcctttcaaactttcccagaacaacgtattggggtggttggctattgtttaccctgtttttgtcaatctgaaaaaaaatggtgaatgatctttcaagaccaaaacagttttacaatttaataacaagatacttggtactcagttatgctatgatgaacaaaattaacatggaaacttaaagcacaagtgttgtagcaataagaaataaaagaaatagttacagatctactttttagtgttacctcccaaaatttggaaagctgatcgcccaagcagctgtcaagtggcgatgaacaaaagttaggctggctcctgaaagcttcatagccaactccaatcttattacattcaagaccatctaatgtaaacaggactctctccaacagcatccacctggaaaagtcatcaccaagcacttctagttgaccaccgccaacacccttcaacattttagatttagaagcacaatgaaacttcatgtgagggaaatattcttatctaaaattttcgattacctttcgtggagtcacaaggtagaagttctccaaagatggaagacttgtataaccagcaaagtcgccaactaaatttactctcagggagctgtcttcagaaacaactgttctattttctggaccaacaataacctcctggtgtgtaatgctaatttagcaaagataaccaaattttgggaagtgctttgcataatcaag

SEQ ID NO: 84750 - DNA, 663 bp, Oryza sativa
acgcgtccggcgcgcatgacttcagcgcgatggaccgaccctcgattgcggagccgcgaagcggttacgaccgacccgaggacgcactcatcgatgccgcccgcgaccagggcatgatctccgcgagccgcgagcccgacagacgatcgagctgttcctaaaaccaagggtcaagctacttcgcaagatcgccatctacgtcgtccgcgagtgcatgcaccgtgaagtagacagtggcggtgacgctcaccgatttgtggcggcggcacgtcgcctcctgagcgagcccgagtctgatgatgagtacttgcgggtcgagtacgcacacctcgcgcgcgttgcgacgcagatcgactactcagtgagttcggtcttcacgccgtttcttgaacaggcttaccgtgccgacctggcatggatgcgcgagcggcttgtgcccgaaggcgcggatcctggacaggcagaagcggagatccaggacaaggccgatcgctaccggcacggttggctcgctgccatcggccacgacgcgctccctcctgagctgcaacaagagctagccaagttggacgcgactcacggcgaaatcgagaagccactggagccacttgggcaggtgacgacctggaccggccctaacccccacacaagccaagaggaaat

SEQ ID NO: 84751 - DNA, 565 bp, Oryza sativa
tgatatcgatagcttcttggatcatttgggaccgcggtataaagattggtctggtcttggccctattcctgtggatgctgacttgcttcctggtgttgttcctggttacaagacaccatttagactacttccttacatggttaaaagtacccttcggaataaggaaatgacggctctgcgtagacttgcaaggcaaactgctcctcattttgctctaggtatttcagtgaacttatctgagtagcttttcatctaccgcatagtattcaatttgtcaattaatttccttcttttcacacttcatgcgtaccgtgtggtttagggagaaacagggaacaccaaggattagctactgctatcgttaaattgtgggagaaaagttctattgcaaagattgccatcaagagggggttccaaatacatgcaatgacagaatggcagaagaaatcagggtaaaagatcatgataactattatcagtagtttgcctgtttgcattcctgtctccacaatgttatgtatgtgttgaatcaaataaacatggcattgcttgataagtagctatt

SEQ ID NO: 84752 - DNA, 709 bp, Oryza sativa
tggagcatctttggtggctgttcaaaccacaggcaatgctatgtatgatccaattggctccatcattgttggcaacttactgggaatggtatgttaacatagtcggttcatattattctattatctttcttggcttatattctgttgctatgtgtgactaattgatgtaacggaatatttgttcaattgttttctgccttattgaatggtcatttggtattggatacatgtataccccttagtctgacacaaatatcatgtcctcgtttctttataattaaataaactatgacaatctaaatcttttatcccacttatcttgttaaacttcttatttcttgcatttctattgttgctgtctacacttcatcgaatgcccatcaactatgctaggaagggccaaatggtgctttgttcattttttatttctatgcaagataaaacagtattttggctatcataacagatgagcactatgttcagatatcagcagtttgtgaaaccccaagacaaaagattcatagctaccagtaaagatttgtttattgatgtgtatttcttgtatgttgactacatctattctgaagtatattttattcagatattctgtattctgctcatactaaaattgtggatgctatccatgtttttgtgtgtttctaaaatctaaaaaagcctaattcatttgtatattgttacataattggaa

SEQ ID NO: 84753 - DNA, 501 bp, Oryza sativa
ggagagcgtcgcgcacccgcagatgtactacgagaacaacgtcgccggcaccatgaacctctactccgccatgaccaagtacggctgcaagaaggtcagtactatacatctacacgatcacctgattgattccattccgatgcatgcttcgatcactgaaatcaacaaacctacgcgcagatagtgttctcgtcgtcggcgacggtgtacggccagccggagaagaccccctgcgtcgaggattccaagctgagcgctctcaacccatacggcaccaccaaggtataagacatgatcgcatccattgctcgtgataagcatgcacccgtcacgcgccattcggattcgcttcgccgattcggtgattacgatgccgaattgcgatggcgatgatcacaccattgcttttttgctatgcaagcattgtttctaacggcatcgaattcgattctctcgttggggcagctcgtcctggagaactacttccggcaggtgcaggcc

SEQ ID NO: 84754 - DNA, 556 bp, Oryza sativa
  unsure (1)..(556): unsure at all n locations
acgtgtgcgagagcgcgccggcggtgctcttctgcgtggccgacgaggccgcgctctgccggtcctgcgacgagaaggtgccccctctctctaacctgccttcgtcctctgctctacaacgcgcacgcgtcggagtccgcttgccgannnnnnnnnnnnnnnnnnnnnnnnttcaattgcggcgcttgtttcacgctgggcgatcgggttgtttgattgtgcaattaagatctcacgagatggtttactacgctcgaattagcgtgtggatctgcgtgtttcttttttgggtacagaaagccatttaattttgactgcgaatcaactgcgtactgctcactggcctggagcaattcattcattaaggccttttttttttcattcgttgagtattgtggacttatgaccaaacgaagttatggtataataggatgccagcgtgcattgatagtgactaactgtagtgcttgtttgggtagtaaccgagaaattgccttatggggtatccacttatttcttgtctgacttcacaatgaggcctattgcttagagaatt

SEQ ID NO: 84755 - DNA, 1299 bp, Oryza sativa
cctgcagccccacagctgtacgtcactcgtaatcgtcttgccttgcctccaatgatcgtgtgaacaggaagcagatgggcgtgtaccggccaccgggtaggcgtattaaccgtagggacgttttccctcccaatgtgaatcaccaacgacttgatgttgatctcgctcgtcctctcctccttcgacatgctccgtgtttgtagtgacagggagtgcactatcaagttccgactcggcaattgtgagtccgtcactatggtgtgctagctgtagttgcctccgtcgtctagcttctcagcctgttcgctcaccctgacaccctcgcctccatcaacgatgatgaggatggttactggtgtgcatccttcgtcgccactgccgagctcatgccaatgcatggcaaggacgaggtggtgccgtcgttgtggtggtgtccggtgtggtgccgtcgcactaaccgaagtagcagttcatcgttgtggggattgttgccgcacaacaacgcggaggtaagaggtcctccctctgtcctataatatagtaatctatgattggatgggatattttatagtgcaacgaatctgagtaggggtgtgatctatgattggatgggatattttatagtgcaacgaatctgagtaggggtgtgtccagatttgttgtactatgaaatatcaaatacagtcctagattgctatgttatgagacagagggagtaccgcagtggtgcataaaggcgggaagacaatgttaatagtggtggataaaggcgggaagacaatgttgatagagggagtaccgcagtggtggatgaatgcgggaagacaatgttgccaacgagagggatagtttggcatgtgtgctgttggagatggggagtgatgggaggtaatcctccgtccataaaaaaaatcagaataaatctagataagtgtttatacggaattatttgtacaagttgattttttaaaaaaaaatgtaaaaaaaattataggcatccatgttctctcatggtacgaatggtataaaggttcagttcttttgtttttacttgttagaaaggggaaaatattctgtcagaatcggggagcaccagcagatggtcgacacggtttatgctactattaacagcatttgctggaatcctcgaagttgaaaagtcaaagcaaagggaaccgtataaagctacaacaagcctacaatgccttgtttatagaaaactaaatcatcaatatccaaaacgagttcagtacttacatatcttcggtctgaacttacttaatttgatacgaaatctta

SEQ ID NO: 84756 - DNA, 714 bp, Oryza sativa
ttgcattataggagactgcatctttaacaatcagttgattaaagagatgtcttgatatcgtgatttttttgcatttggagtacaccttaacaagagcagtcgccaaaacaacatccagaggtatatatcttcttattaagtaggtatgaatactagcagcatagccgaaatagcatacctcaacacaagcagaaatcacgtttgcgaaggtgacagaatctggagttattttatgctcatgcagcatcacagacaaatagtggattgcatcaaaactctgtccagctctagtaagaccagaaagcatagcattccatgaagctgcagttccctttgaattctgtaaagtagcaactgctgattgataagctccacatcgagtatacaagttcacaatgcaggtctctagaatataatctgagacaacaagtgctctccttatggaatagcaatggagtgatttgccctctttaagtgctcccaaattcccagctatttgcagtaagcttatcatagtcacacggtttacttccaagttgccctgcagcatatcaatggcaatatcaaatgcattccatgcaactgaatccacaatttctgaataaccagtgatcatcgaagtgtaagcaacaacgtccttgtcaatgatctctttaaacactccctgtgaatcgtccatcctatgaagcttgagtattctatagtgtcacctaa

SEQ ID NO: 84757 - DNA, 663 bp, Oryza sativa
tggctacaacttggcagaccagctaggtgcgtacgatcccagatgaatatatggtgccctctatttagatgactaaccagcatgtgccgcgtggcacgcttcgatgatgaacagctcagcagctcggcttcccaatgagcccaccggcgtacctgtcgctgacagcgaagaccatcgtttcgcagatgtacaagggcatcaacttcgcatcaggcggatcaggcctcggtgacaaaaccggccaaggggtttgtttaacttgaacaaatcagtaacacacgttattattctgaaaattctgaaccatatgacacgtgacacgtatgaccgtgccgcccgggctgaaacgaacttgtttttctgaaggccggggatgtaatcccgatgttccagcaagtgcagtacttctcgaaggtggtggcgatgatgcagaagctgtcaggctcgagaacaaccaacactctcctctccaagtccatcttcctcatcagcaccggcagcaacgacatgttcgagtactccttgtccggcggcaacggcgacgaccgcgagtttctgctgggtttcgccgcggcgtacaggtcttacgtgaaggcgttgtaccggctaggcgcgaggaagttcagcgtcgtcagcatcacgccgttgggctgaaccccgtcg

SEQ ID NO: 84758 - DNA, 1514 bp, Oryza sativa
tttgaggacagtattttgatatcttgatgctgttaaattacatatatataatgcgttgacgatgctttgatcttcagatagcatgtgagaaaatattttcatttggctgttcccttccccagaatctattggaagaggacaaggacctagcaaagcagcaacaggagttacttgatggaatttacaagaagtactgcatactagacagtgacgtgatgaatgatatcaagaacctctctcgccgttatggagtcaacctggccggtgactgatcagttttgaccatccaagagacggactgcttcaaaaggtccagatcagtccccagggcgagcaacatgcattggtgtgacccaataactgcatcttctatgtaaatattttttttgagaactttctatgcaaagattctgtagtgttactgttgttcccgcatcctgacccacccagcaacagtatgctcgttttgtgatgtgtataggagtaacttcttgcgctgcgcggagatgattcgctgctgtcggatgctgtctattatgcatgtctgaaattaacttgctgttgattaatcggaggttacattcataatgcctagtcttgccttgtttacattcattgtttcggttcagttgagagttcagagatgtcctgatggggttgcggatattgttgtatcaatctctcactgagcaagtttaataataggatataaccaaccacaaacttttgtgaaagaaagggagaaacaatgttagttctcgtactagcagtaaatgcactacttatataataagtaagagtaagacaaagagatagggaaaaaaaatagagacaaccttatagtaactaatactccctctatctacttttgatagtcgtattttatcttggcacacagaccaaggataagtaattctacttatcatccatttaaacatgttaccagtcattcctcgtaaacaagcgattcattaatatttacatttctcgatgcccatatagccaatcttgtgtggaagaatgaagagtcatgcattacaaccaagaaagtcattaagatgatagattgttgaattgaaatatgcctatcaaaaatatttttttcagatttagaaatatgactatcaaaagtagatggagggagtatgctatacatgttagctttagttttttgccgggatggccaacctaattttattaaggctgaaaggaattgttacaaattttacaaaattgacattaaactgtaggggggtggggggttgggggtagagaaaataaaacgaaaaacaaatagggccggctgacagggaggttctcagccaacttctctaaaaataccggcctccctccacaccaaatctcatctctaatttctctataaatctctgagcgtgacttttgctcaaagatcctagcattcctctctttccacacaaactaacataccatcatattagttttagtttgagcttgctaagggcaaccgcaatggttatctataggctatctac

SEQ ID NO: 84759 - DNA, 727 bp, Oryza sativa
ccgtgcgcgtcggcaaggaggaggaaattgtcgagcaggcgctccgcgaacggcgaccgcccgagccgccggagcggctcctgcgcctgcgggtggtggagcagctcggagagcgacaccagcacccgcccgagctgctccgcggcccccgcgacggagcccgccgacgcggccgacgccaggcggcccaccagctccctcatcgtcgccacatcctcgtcaagctggaccaccagaggatggaaccggcacggcaggctcgccgaccggacgcggtaggcctcacccttcgcggccgtcgccgccttgggcgcggggaacgagatcgtgcggcggaagccgaccaccatactccaccacctccgtcactctttgatgggatcgatcaagcgaagggtaacctgtgcaacctgtgcgcggatggcgaaggggaggggggcgcgttttaaatgggaggggggaagtgggattcggggtggaagcgtggaacgctcgaggaaggcgtgggcggcggaagcggtcatggcctcatgggtcgtcacggcgcacggccgcgcgagagtacgtagtagacggtagtagaccgcgaccacaagttgtggggagagaacccaagaatggtgtgggtttctggaccggttctattcgattccaccgtgacgcaaggtcgtgcttggcacgcatagcttttgtctgattttaatccttgtgcttttgggggtgcttt

SEQ ID NO: 84760 - DNA, 566 bp, Oryza sativa
aactacagtcagtgtgaagaatccttgcctccaaagcggtggtgtatcatagctcatcatgttttgcgcctttatcatctgactttggtgtatcagatggcggggaagtagttcctggtgactccggattatctcccaagattcgtgctgtgaactgccttgcttcactgtcaagatcaacccactctggaacaattcttttggcaccctagaaagtcgatttataaccttaaaattagttctagacaagaaacaggaaacaaaatatggactattactgcaaaataattttacctgaagctttggctcctttgtcattgggttgttgcaaagatcaatggtttttgctcttgcctttgtggcatttccacaccaagattcacaccatagccattcttgagggagagagaatatgggcacagtatgctgagcataatttgggagatcctgaatataaaggtgttgcaagtaagcattcacacatgttcacatctgtaaactgcatttgtgtagtttcttccattaatctctgcacaccacagcatgtttctgcaaactagtttttt

SEQ ID NO: 84761 - DNA, 3148 bp, Oryza sativa
ggaggataaccatgtgtgctcttattgtaaaattttaattttaacgaatttaatgtacaattaatcatagattgtataaatagtttaaaagaaaaaaatcgatgagtttgttacctacaaacatatgaagagtactacttagcataaaacaaaaacaagaggaagcagcgagagggcgccgaggatgacaactatgtggcgacgctccggtgaggcacggcatgatcgaggatcggtagcgttctctggggttcagaatcttaaacaccgactctctggatcttttatagccgtccgattaggcatgtacgaaccggatgagcggaaaaaataatccacaatcaaagaccgcgtagtccgttagccgcacgaacaacaccttaaccacgccgatgcgcctgcgctactctgcacacaggacacagcgcacctctgattccgtcatggagaccagaactactctcgacctcaagccagggtgcttcttcctgtacgcggtacgccaacgtggcggtgtcactgtggatgttaagtgcgtatgccggagcctagagacgagggcgtcgaggggccgaagcaggggtcagccacgatgtatgggcgctccggccctgtggcgaagcatgcggcgggggttcggtgaataaaaatccgactcccattgggatatctgccggccgttcgatccggcatgtgcggcacagatgagccgaaaattatcacggtctcgcacaccccgtttgggctgccgtctcccgtgccgttttctatcactcatcagcgcttgacatttcatgaacctttcctcccacaaattagatgctggagaaatacgcatgtacacaccgaagaaaaaatattaaaaaaatgaataatacaagtgaagaaatgtcacaaaccagtatttaacaaccgaatcaatccaaacacaaacaaatcctcaaagcagagagaaaacacgcaagatgtgtacaatttgccatgcattcagtcgtgaacgcgccgccggcgcgcactcagatatggacgtggcagttcacccgatcgaacgagctcggcgacgagaagtcgacgaccaccggcgagcagctcgcgcgcaacttgtagcgccgtgtcctcaccaagccgtaccggaaccgcaccttgcccttgatgtgcacgtccaccggcagcttcccgtcggacctgtccttcttcacggtcgcctccacgccccgcggcagcgccgccctcacggcgggcgcggccacgtcgatcctcttcacgttcagcggcggcaggtcgaacccgggcgccacggcgccggcgaggtacgtgccgccgtaccacaccccgacctcgaccgacttgtaccacacggcggcgcgcttgttctggttgtatgcgcgcagggtgatgtcgaaggtgccgttgaggctgccgccggacgtgaagttgaacccggtcaccgcggcgtggtcgacgtagacgagcagcggcttcgccgggcggaccgtcagccacaggatgacgatgatcaccagcaagacgacaatcgccagcagcgccgccgcgatgcacttcgacgtcgttggccgcggccgccgcgtcgtgctcccctgacgcgccattcttccacacacacacagagtaaactatcgctagcttggtcactacagggaaccagatcgatcgagcttaacccaggagtttgtgattaagtttacatcgtagcgtctctatatatatagcaacaactggacgatactttgagtagcgagaggaggttccacgggctgtcacacaggctgtggttggagtaggcggcggttttggtacgtgttgttgccgacgagagctagctcgatcggtgagacagtgagacgatcgctttgcctctttcctttgcacggctaagcgttcgtcgtgtcccatctcgtgtggtcttttggtttgtaggaacctctcgagcgagcggcagagcgctttggatggagctttggttttggaatccttctggcacactcctgttgcttaggaatcattgtcaaggggagggaaagcacatcgcaaagacagcctgcaaaacgggtgcatatgtatctaggatgaactcacatattcacatatgcgaattttactttgggatgaaaagcgggatgtagaagagccaggaatgtggaaaggcgccgaccggtgaaaaggtcgtgtggcgtcctagtgaattgtacatttgatgacagcccaccatgtgaaacaaggccgccacttcagcactgtgggcctggctcatgctcggcccagcaaaggccatttcaccaggtttttttttttggaataagttcacttggtggcccttaaaagtgatcgaaatctaatcagtgacctaaaccacagtaccggatatctcgacccccaaactcttaaaaccggtgtaatttgactccctcggcggttttgaagggcggtttcgctaacatggcgcctacgtgtcagtgttgaccttgtcatcgtccaacgtggtgtttgacgtggcatttatatgacattaaaatataaaaaatataatttaactcacttgtcaatcacacaaacaaaaaggtgggacccacttacacatggggctcacaaccatccgctccttcccttctctctttctctctctccccttcctcttcccctttgttgcgctggagtggcgggcagggccggagcagcggcggcgacagcggacgagggccgagacgcgagcggcggcagcggcgggcgagggctggaagagagggaggagaggcggcgctgccgagatcatgcccgctcgccgccgtcgagctactcctctactccgtcgctgcctgccgaagcaccgtcgccgtctgacgctatcgccgagatctcgcccgcccgccacccctcattggctacctctgccatccccgtctgaggccattgtgacattccggcttagggcttaatagaattaatagaatactcataccaacaagttgcaacttcttttccagaagccgataactctgaggttaagcgtgctcggtttgtagcaatttagggatgggtgaccgatcgggaagaattgtgttggtctgatgacctataaaaactgccagatgtaagtgggccccgcctgggagaggaggtgggatctttt

SEQ ID NO: 84762 - DNA, 702 bp, Oryza sativa
tccatttccttttgtcgttagttcagcacttcagttccttagatgtaagctaccaagttgtagattattttattatttgtcatgttccataatttgcagggacattaaaggtgcaaacatactggtagatcctaatggtcgtgtaaagcttgctgacttcggaatggcaaaacatgtaaattctctgtttcaaattgtaaaaaaaaaaatctttctcatttgtcaggaataactaaaatttaaagcaaaagcattattagatgtaattccttgtatcatcttcataggaagaaatggtgtattgtgctttaccctttccctcgtgttctcttgcacttgaggactaccacttgtgctagatcaatccattcaataagagataaccattttgttttggtccttaccgtatctgtcagcacatttgctggcttacttggaccaaatggttatgcatgtttctatgctagttactaggcagtagtttgtttaccatagatgtagtgccattttattagtaatataagcttgtataccttcatgggccgactcttatgggccatttggataagtgattagttgtttctagcaagttatatgtttatgggaaggtccttttgtctatagatgtttcttctttggatatttatccgcgcatatgaacttcttttctgccaatccatttttcagatcaatgggcagcag

SEQ ID NO: 84763 - DNA, 671 bp, Oryza sativa
ttaccatctggcaagcaaatcatagcactaactctgacgtgagttaagtttaggttctgagatactgtacatacctgttagtacttgatttgttttcatatttctctctctgacaccctgcagttacaaattcaaactagaggatggtgctgaaataaagccccgtgtgcccctacttaacaacagaatatatgataacaagttcgagtctcagtattatagaatatcagattcaaacaaggtacatttttttttcatttttatacatttgttcctttaatttctgtaccacttctatgatagggagatttaaattatgatttccagttactgatgattctttgcctgtagcttctgttgaagcaaaggctggattttatccattatctaaaaaaagatttttacccttctttttccttctgcatctagattggtatatggcatatcttagtccagtactccagtatccgcattatacatagcgttcccaattattacattcttttcccaagagtagatataatggatgtggtaccaaatgaagaaatacagcaccatcaccatgcacactttgttgcatacattttaaaaactttatgtactagaactatctactccctctgtctcaaaataaactaacttttgtacacgaatctggacataggctacgt

SEQ ID NO: 84764 - DNA, 879 bp, Oryza sativa
atggagcaattggttccatttgaggagtgcctgcagctgcattccactgatagctctgtcatcaaaattcctgagtacataatggtgacaaacaatgggcgcactttcaagttagtaccttgtctgtttaagctatatgattttttgccactcttcatttcagtaaaataatactagtaaaatgaacttattggtgttgaccatatttgctgagatctcaagttcataagaacacacacatgtcatatacacttcgttatataactcatctacttcatagtccatgattgtgtatattcaattcacgtcctttgaagttgatcaatgatgcttaacttccatgcaagtagcaacctgactttgctgaaaatatattttgttgaaagagaacttcactgaaaaaatacatcaccactagagcatactccctccttcccaaaataaatcaacatttgtacatgaatctggacataggctatctccagattcatgtacaaatggttttattttggtacggagggagtatataacttacgatgtctcttcagttataaacaggatgtatgtcatgtcaaacgacacaactaacaggtgatacaaggactaatccaattggactagcaatattattagtaaattgtctgatcaataatgtatgctgcttattctgtcaagcgccataattttcatgtgtttttcctttgccttttgcagcattgttgtaaatcctgttaatatcagcagcggccttcactattatgaagtttatggtatagattgcaaagcaccatggcgtggacctattttccgcgtaccaatcactgtaataaagcctattgctctatcaggagagccacctgcattgacactttcaaatct

SEQ ID NO: 84765 - DNA, 881 bp, Oryza sativa
tcaatatcttcccaaccgtaaatccgtttgactccgttcaaattccaaaatttctcaaatctcgagatctatctaatggcacgcttagaggtcattaatagagctttattttcgccgtttgttgagttgtcccgttttgcgtatagtttcggagcccgaagacccgcagtgcgaggatttcgaggatcaagctccagatctcgagcaaggcaagccacctttgaacatcttgagcctatatttgaaatctaattatattgcttgcaaaatattatgcattgataggattgcacttaatctgttgttctgtctgcaaggcagattggcagacctacctaacttgttgcatttgatccttccattgttaattgctatacaatgtccccttgtaaccatccagttgcgcctcgatattcgtgcaccctgtgccagtatcgacggtcgccttcaaacttaaaatctgagtaacaacttgggtaaaactggagttttacaaaagacttggaaaacccgacacctgggtcggtgcttgcgaactaaatgaatttccaaaaccgcggaccgggaaacgtaccgggtgtacggtttcccgctctcgcacttaaggaccgattccttggaatttcatccaaacataagtcaagtacgaccacatgggtggaatgggacacccctggctgagtaactagcttatcaggggagccttgatgccgagagacatgtggattcgccggggtagtgtcggggaggacccctgggcttcctggcgcagtatggtctgggacctaacctgttgttggtctgggacccctctcgtcggcatatggtaaacctgtgtcggctttggaaatgccttgtcatgaaagcttggaggtctcccg

SEQ ID NO: 84766 - DNA, 1027 bp, Oryza sativa
ggtgtttttccttttttttatgttgtctagatgcggttttttctacatctaaatgtagttgcgcttagcgcgtctgtagcataatcgttttcgcgatgcgtactatattttcttctcatggtattgttttcctcaccaaacctgcggtggctagcctaggtgctaaaaggactttctcaaagcgtatgtcgttcattatatattttgacatgaggggtttggtcactggtggggagggtagggcaagaagcatggcggacctaggctcattggccatggaagagaccaagaagggccttggccatgcattaaatagaaggatggtgttgtggcctagagggagaaggaaggtgttttcgtcatgtactcttcttgcctgatatgtaatgtttctcagctgagaaccattgcttacatgtcgctaacttttccgatcaggaatggttaaatatcgaattccaatctataatgcttctccaacagttagagattgatcagtaaaggtttgacatatggatgaataatggtttcatgttagttaggctttatcgggatcattgcttctatagtagtaagagcgagtacaatagcagggtacaagtcagttgtaagcacatatggagaagagaagagaagagagataaagaagacgggctataaacttgtagccagttgcagcatggactataatacattgtgcatatgagaggtgggaccatatattaatggtgtagtatatacttataagtaactattgtatgaatgagctattagattggctataaataaattgaagctagtagttggctatactattaaacttgctctaatagttagtattattatggggaatgtgtaagccacgagcacggagtagcgcttgcatttttgttgtatatctcgaggatcacaatattcttcaacctctgtcagctcttaacatgggattcaggcgcagccccccaccgttcctcgccgtggctaacaaaaccagcaacccattgttcagggggctccagggaacaaa

SEQ ID NO: 84767 - DNA, 1248 bp, Oryza sativa
cagcgatccgcgcggcgtacgaggcgctgcctgccgcggccagggagcggctgcgcgcggtgtacttcgtgcacccgggattccaggcccgcctcttcttcgccaccttggggcgattcctcttcagctccgggtatgtacatacaacgaatcactccgtgtgtgctgcactacgattcgtgggtgaggcgctggtgtttaccgtggtttccttggaattttggatcttgcaggctgtacgagaagctgaggtacatgagcaggctcgagtacctgtgggagcacgtgagcaagggggagatggagtcccggaatgcgcgcgccggcatgacgaggagctcgagcgccgcccgctcatggactacggcatcgaggctactgaccgccggtgcatgttcgacgccgcgtccatggacacctcggcgtccctgcactcgctccggtgcatctcgtaatcgtggtggccgctcgactgtagcatccgtagctggcctcgccccggtcctatattcgtagctagcgaaggcactgccgcactgtcgtagtttgcaggccctgttgttcttcgttccatctgtacaaaatagtagtatttgtggaagtaaaagagataataaagagaaacagtttgaaatgcttccctcgttgcagcttccacacagatcttatcagcatagggtagagaaatcaaaatccaacttaacaaatcaaccagtgcagtaattcgcaggtcctcatttgccatttttaactatcgtggagtggtaaattctcaattatcctcgctgtcaaccttttaacaaatgaaactgtaagcaaaggactacttggagagataacgtgttaaaaaaaactcttatagttttatgtttggaaaaaaaatgcaattgccttattacagaagtgtaaaaacctcatctaagtatttcttcatggtcaaattccacggggagaaatgcaaccaagcataactatgtatactgatatagataagaaagcaaataaaaacatcctaacaatgaaatgagtcaaccatttcccaatgtccaatattgaccagaagcacaatgggatagcatagaacaagttctagctagaatgaaatggatggaagcaacaagaaacatatagaaagttataaagcatagtaaccatttaggatagtttcagcaaacaaacattgcagaagcatttctcaggcgtcataacttgccatgacactgcctccaaataagtaacatatatcaa

SEQ ID NO: 84768 - DNA, 2842 bp, Oryza sativa
attcctgcagccttaccacaagggctccggcgaggaagacaagaccgccgccgccgccaccggcgagcacaagagcagcgcttaattggggcgtgtgtgagaccaggccatggttggaatttggaagtgtttggcgtgtgttagtttggtgctttttctgcactgcagctttgttaagttcgtgtcaagattggtcaaggcctggtcagcgaagcccgatcagtgatcgaagtttgtgtttcgtgtggggtacgggcttcagtttgctatagtcaagtactagatgttgagtttgtttaattattattggcactcttgtattggttttgggctgggcattctgccttggtattaatgatttctgcccagaatatattgttgccttgtacagttgtactgtactactctactggggtacactgcattgtgatcacattttctactagatcttctcaatcatgtgcctcatgtattggtccgctcttggttcattggtagtgtgcattgcgggccagtgtgaaacgagagtaacagacaccgcgagccaactggtacgtggattgactggcggaccttgttctcatgggcttcttttgaaactcttatgggcttttcagttggcaaggcgtaatattttcttgggccatccatctttggatgggccttgtaatcgagaagtgagagagaagacaatatctgggcctcctctccgagagacggatattgcagcgtacgcgaacagaacaagcgtgtacactttggcgcttgcgctcaagcagcaatgcgggtttgagaacatgccaaccaaacacacgccccagcgtgtcatgtaccaaacctcttggcgacggaatccgcacggtacacgagcctgcacgcgctcccgcacgcgcgcgcaaaggaacagaggagagaaaacgacgtggtggctggtaacttcgtccgtgccagcgctcttgggcctcatggtcacgttgatgccaaagcagcccatgttctacgcgatcctacgacggcctagagctctactcctagatgcgagaagatacagagagagacatactggaaatcgtacgaccgtgtgccggtgcacttgtcgactgtcgaggcttgtcgcgcgtgcgtgatcaacgaatcgagtgctctggcctgcacgtagaattgaaaatagtactactagtaggaaggatgaaaaagacgagagttctagtaccaagttggtggatacgattatgtgcctttggggagtggagaaaaaaaggcgcaataaactagagtttgcaaagatcccgcttaagtactctctgcactcgtggtgccaactcgatcaaaggattaaactacgagtactaaccaccatatcgctagcgtacgtcttggagaatagctacttgcacacagtaaaaaaaagaagtgatgcaatcattcaacctctgcagtggcacggtaaacgggtgaaaaggtgttcgtgcagctgtcagaaaaatctgaaagtgagcggagactgattagggcatccacaatagttatctataggctctaagagatccatatcaacatattttcctacttgaaagagattaaatgaagagagatagttatctacaggctctaagagatccatatcaacatattttcctacttgaaagagattaaatgaagagagagaacaaagctatctactaacctggagatagtatacagagaaaaacgagacaatgtattagagagctatagatacccatgtagacatactattgagatggtttactattaatctagtctattgctgagagatacatgttttatagatagcaccttactttaacattgcgggtgctcttagagcaagtttaatagtatagccaactactaactctaattcatctatagtcaatctaataactcatttatacaatagttatatactataatattaatacctggtcccacctgtcatacacacactatgtcttggagtccgtgctacagctggctacaaatctgtagcccactgctcttctctctttatttatcttctttaaatatgtttgcagctggcttatagcatgctattgtacctgctcttactgcccgagtctcaaaaggaaaaggttgcgctgcccactgctgtcgttttattttcgttgctttcaacaggagaaagattgaaaaaaagccatgctgtgcatgggatcttctttttctgcctgggcaaaaaaaggtgcatctggcaggctagcttcagttgtaagtgatggtaagaacaatacagtatgaaaagaactaaacgtaaagatataattattgggtgcttatttaagcgtagaagaatcggccagcgcaaacttgtgtgcccagccataaggctgcctattcatcccactggagcattatcaaatgcaaacatcgaaagtaattaccgtatcattggattccggctgcctttctctatgcttcaaggcttgtagacgtgttaaggttcctgcctgtacaaatgcatcgagtggttggtagaatatgttcctatggacaacggggttgatccaagtaatcggttctgatcaagctaagttacccccactcagtcccggcctcccggggatcgattttctgtgaaaagtagcagtaattactcttgagagacagagtatccaaaggcacttagaacatcatgccgatataattcgcctgtaggaccaccagggagcatgagatcgtggcgagtaaatttgacggggtttgctggacaagtagactgagggatcttcttggttttgtcacaagtacatgtaggagccaggatagtaggataccttgatcgatcgactttcttcgctgt

SEQ ID NO: 84769 - DNA, 676 bp, Oryza sativa
cccatgtgggtgctgcatattcggccatcaaaggcaggaagagcgcaggattgaccctcatgacagctggtaacacttccttgaagtccaataaacttataaggactcaacatcatatagtctccttaaccataaggcggagcatttcaattgaatgggcttggtatcatatacatataacccaatgctgccaccatatgaatcaaattcccaacccaaatagtttactatctgcaaggaaaatgtctaaataatgtaaatctaccaacagcacgaaatttcatatgagaattgggaaattgagtgactaatagaccaccctatttagagataacggtgaataattgagtatgtaaataaaatctccttgcctactccaacaggcctataggaataggagtgagcagaaatgtagaattacacagtgtgctgactaaacgaattcaccgttttaatagattcagttatgcaagaaaaacttctttcccccataaacacaatccaactaggcaactagtataggcaacgatagttgcacaaagtctagctaataaacccgctcacatattttttttctctgtccataaatccacgagcaactgaagataattctcacggctaatgcccttcataccataggcgcgaccaaaatccaccgctaaggcaaagttacaga

SEQ ID NO: 84770 - DNA, 1626 bp, Oryza sativa
agaaagttactcttccaattccctgcgagctttggatgagaccctgaggcatgccgaagaggaaaggttgtctagagaaagagccaaagtttcataggcattggcatagaggttccatctgacactacagtgaacacagcttgtaaaatacaagggtctcctctccaggtggttataatttatcagatcaatgcagaatgttctgggcaaatgctgcttgcagatcaaatttttgtggggaagttctgactttggagttttgctaactgaccgttgtttgtcgatgcagttcaggcaaatgtcctgtgttgatccatcataatagatatagttgtgttgaagtagcaggtacattaggtacatataggtgaagtgctcgtttcggtgctagtatgcaatgtactgatcttctgtgttgcctttttcttggcctccatacaattgaatgaatgagcaagagtgcacttggaatgaatgtgcaactgtgcaagagttgaaagagttgaatgcagttcgtggcgttgtattgagtatttttccggtgcacttgaatgaatgtacaactgtgcaagagtggaaagagttgaatgcagttcgtggcgtagtattgagtatttttccggtttaatagggaggtatatactccctagtatattctagggagtacctcatggttacttctcatggagtacttcccaagagctataaaaattccagagagcaaaataaattctgctaacaaaattcaaaaatcagaaggaaaattgtccactgaaatcttgcctccctctctccttgcacaggcaaatgagtcatgcattcatctgatattttgacgaccgtgatgaaaccattatttctgttaagagattttttttctccaactttctgagggtttttgtattttgtaagtttggtgctgccgagtgcacatgaagtgtcctaccttggcgtacatccagttcgtgtcagcgactttcacgaaattacagagggagttgtgtacttgtgttctggtacaataccttgcacttctgtaaaggaactcaattacacttggccccttgaagcatggcacaatttgtggaattctgcacttacaatactctgaccgcacctatagatagaaaacgagaaaccatgtacagtatcaaacaatcaatcacacaagtagctaagcaatctacgggagctgtacgctagcaccaaaatttaccagcgagtcagcaacccagcttgtattccgtagctcctgtacaaaagaatatcatgatttcttgatttcccagcggcgtccccgtatgacatacccatctgatgtctggtcgctgccttcccaactgtccacaacaccagctgagcttacgtccctgcggtgccgttttcctctaccgatcccactgtcactagagctcccgcatatgagaggatcatcgatcccatggattgctctctgtggcgtggaggtactcacccaattgtcatcacggctttgcccgaacttgcccttcttcttcattaatttctcaaagcgcttcccgactggtcgcactgcttgcttcatcgtgaatttgagatcttttatcacctaaagataaagaaaaacacaaaacataataagaatat

SEQ ID NO: 84771 - DNA, 3549 bp, Oryza sativa
gtgcggcaccggtacgcgctggcggaggcgcacgccgcgctggccgactcgctcgcgtcgatgtccgcgtcactgcacctcgtcctcgcgcccgcggtcgccgcggggacggccgtcgcgctgccctccgcgcgcaaggacgtggacgccgcggccgaggccgctgcctcgccgccgcactcgtcgtcgcacatcaacttcgcgccgtcctccggatccgagtcggggtccgtgtcctcctcgccgagccgccgcgtcgccgccggccacgagcaactctaccaaccgagcgcgctgccgttcccgcattatgcgtacggatacgggtacgcgcccgagccgccgttcgggtacccgccggggtcgctgcagctctactacgcgcggagccgcccgcccccgccgtccgtcgccgtcgagcagcgcgcccccgcgtcggagcgcgtctacttcggctcgttcgaaccggcgcagtatcacccctacggaggcgagaccaggagggcagacagggcggccgcgccaccgccgtcgccaccgagggcgagctcgtgggacttctttaatgtgttcgacaactatgaggtgtacgacaactactgctacgatgctcccggcaccggcgccacgacgccagcgccgtacacgccaagccggagctcccgggaggtgcgcgaggaggagggcatccctgagctggaggaggacgacgcggtcgtcaaggaggtttccagcgagtactccgcgcacgggagcggcggcgctcgcagccgacgcagctctatcggcggcgtgagcagcagcattgccgaagtcgacgaagaggagaatccagtcgtcgacaagggagtggtcggcggcggcgtggcgcggcaacagacgcctgcgcatggcaacgtcgccgcgtccgttccgactccccggagagccgccgatggtgcagacgttgccggcgagatcaaggcgcagtttgtccgagcggcggacgcggtcagggcgctcgcgccgattcttgaagtcgggaggcggagctaccatccccggagctcagtgtaccatggtgagctatctctgttctttgtataacctacgcatgcatctcccgattacctcgtgcctgatcattggagccattgtttgattgctgttcggaaacagtttcatctcggatggtgtcagtgattgcgctgccgcattcaggatacggaggcagcgacctgttggatgtcggaggaggggagaaggtggtgggagcaaggaacttgtctttgactctgcaaaagctctatatctgggagaagaagctgtacgacgaggtgaaggtatgtatttacagattgaaggtgcccaccttgttaagtaggagtagtaccctattttgctgtatgatgcagtatattttttcgacagtatgatgtagagatatgttgaaatatgctagtagcatgtataatattagacgccatgatattgctcttcaaagtgttgtaggtcaggatgcaaaattgctgctcgctgagtggtcccatactcccatttgaaacaaccgagtacaggtcctgactagagagcaataccattcatttcactgtggcaagtttgcacagtgacaacgtccttaaccagtcaccaatagtcacgcctatgtagaaagatggatttgagatcttagcatggcattaggtgttttaaggctgaatcttgttgagatgttcatgcattatgtattgcccactcctcccaattccaacctactcatccccaaacaaaagcatacacccctaacagtgttggttattttagtactgttgcattgggtctatcttgaattaggtgtgctgcttgattaagaaaatggctcattgaatagcagagttgaaagtgcctttatggggacctaacagccagatttggaactgttcttttacttgctgtattctaagttatgcattttcttcataagcctattagtgagatttatttagtaagaacacttacgggttggtgccttttcctctaatggcaattttatcaagatgttgctgccatgcctttttaggttcccttgtagcataacaggacaatattatattttgttttcatatcattatcaccctacgtgtaaactaataatcctatgaggaacccatcaatgaagaattactgctcttacattggggaaatcatgttgtttgcttgagctcacccttggtagtctctattccgtattgaatgttttggtgctgttttcctcttccaggctgaagagaaaatgcggctcctgcttgccaagaactctaagaggctgaaattcttggatcaaaaaggcgctgaagctcccaagattgatgcaactcgtaatttggttaggaagctatcaacaaaaatacggatagctgtgcgagttattgctaaggtgtcgaaaaagataaacagagtaagggacgaggagttatggccacaagttaataccttaatccaagggtacactctattctttccctctgacatttattcaaatagtctgatttagctttgtctttacccattattttttttattttgtaatgtcagtccacatgtgtagtatgtctatcagaaagtaactgccttaattctgaaggtaattatgtaccagtgcactaaattgatctctgtagaaattgacacattttcataacaaaaatgatttatgcacatttaagttaatcaagttaaagcatcacaaacagtcatgtgtacgtctagaattgcttttttttttgggtactctatggcaaaagtgtatttgacgatacctatgttgtagaacaatcaagtggaatactgaacactccaaatttattttctagatattcttgcatttcatattatcttcaaatctagtttgtgtcaaaagaaaagtcttatagccatcttttacaggtttgtgaaaatgtggcaagataagctgaactgctaccacatccagtgtcaagcaatatcagaggcaaaaaacttggattcaataatttctggtggaaccagtcgagatctggcaatggagcttgaactagagttgattaaatggatcgtcaatttttcctcctgggtgaatgagcagaggagcttcatcaaggcactgaatggatggctggcactctgtcttaactatcagcaggaggagacggctgatggagttcctccgtattctcctggaagagtgggcgcaccccttgtgtttgtcatctgtaatagctggtcccaagctatggatcggatttctgagaaggaggtgattaccagcatgcaagctcttgtgtctagtgtacggagcctatgggagaaacaaaatgttgagcaaactgaacagctgattgcaatccgggaaagagaaaaatggaacaagatattggaaaggaagaccctggagattaacaagtaggccgacacactcaacagaaagctagctctagtaccgggccggcaaagccttcttccaacagcacaaacgtaccaggtccattttcttgaggcaaacagtgtgcaggttagttgggctgcaggaat

SEQ ID NO: 84772 - DNA, 674 bp, Oryza sativa
actaaacatgcacactgcctactgacgaaccattgcatgaacattttaataccaacaagatcaacaccatttcttcatcaatcacaaggtggcatcccattttgtcagcgaagaaagatttgactcatgcatctcagattatgacgggaacgcgtccatgcgtcggggaactaaggaccaatcgtaatttatgcttcgcatgagaatgtgatgagatcaagagggctaaatcatttagtcgcggattctacaaagttattgttcttttgatcatggtttatttgacgaaaagaaatatcacgcacctgccattcttgcacgccctgtaagctctccggatcgagcttcttgacggcgacggccatgccggagccgctccgcgcggggctcatggtcctctcgtccacccaccccttgtgcacccgcccgaacccgccctcgccgaggacggtgtccgccttgaagttcctcgtggcggccctgagctcggcgaacgtgaagatccggaggttgggcgcctccaggatcctcccctccgcgctggcgtcgccgccggcgttcgtccggcctccaccaccagccaccgatcgcccgccgccggtgcttgtggctgtggcctggctcggcaacttaccagttggtggccgccctgggctcatcgcgacgcgtgcatt

SEQ ID NO: 84773 - DNA, 688 bp, Oryza sativa
ccccccccccccccttttggctgtagaatcaaggcggagacgaaagctgtgcagcgtagccccaaaaatctgtagccatgttgtagtttaatctgtaggtgcagagagactagagaggaaattaaagaagatcagattcatcaccactggtactcctagcgatgcttgcggctactcccaataccaaatccccctcagatctccacacacacacagagaccaagaagcacaatcccatctaaacctgatattctgatctgcccatcccccaaccccaagaatccctcacccaaggccggctacaaccctagcttggagcttcaccttaggctctataaatagagcactctgtaaagggtcactaccttattacagtgagactgtgggaatagtagtagctgcggctgtggatgcacagcttgggagaaaagcagtacaggtcatgtgggcttatcaaaggggcgcttactgagagttctttggcattctgtccacctccttgtcgaatcctcagagacagaaatctcatatctgttgatcttggaggtgggcatactgccaatggagctgtgtaggcctccctttgtaaaacccatatgactcaaaatcaagagagagagggtcttgttaattagatctgattagttctttggaaaccctaaccaagcctggttggggctgcaggaat

SEQ ID NO: 84774 - DNA, 657 bp, Oryza sativa
cgcgggccgcgccgatggcgatgcgcagccggaggctccacgacagcggctgctgaggcgacgcgcttccgccctctggttgacacaaaaagattgtcatttttcagctctcgttctaccgttcagttacagtgtgttcagaaaaattctggtttgattttccgatgccagctttgcaatccaataatgaagtaaattccattgtcattccaattccaacctggcaacccaattatatctatatatctatactcttcatatcaagctagcttttgatactctattcacctgtataaattatgcactatcagttgactctgttctcagaacatccactaatcccctctccatgtgaagcagaacaatgatctcaatttgtccccttgtgaccaccatcaggcatcgttaattagcagcccaagtcaagttgtcagctcttaataatcatggccataccgtcatggatctgaaagcaccatgaaaccttttgtcttaaagtttacttactgcgtggctcacttctgaagaggtggttctccaagctgccttgggccatgtactcgtacacaagcagtagctccttgtcctcccagcagtagcccagtagcctcaccaggttgggatgtgaaagtctccccagaaaattcacctcggact

SEQ ID NO: 84775 - DNA, 991 bp, Oryza sativa
attcctgcagccaaatgtccaaaaatactacgtagccaagatgctttattctgtttccactaagtatatatagtgtataaacatatcaatatatatttacatcattatcaacggcatccgcaagatgttaatttttccccctcatctagaaattacgctctatgtccatatggcacaccaaagatttctgtgtttctttcccgagaaatcggtcacatgaaaggattcaagtgttccgttcggacatcagggaagaacgatcgaggatcagaaaagaccaaagcatatggtgcagcaaaagcattgcgtatgcccacgatctgcagcagctgcaagcgccggtcgctcttacgctatctcactctcggagacgggtggccagcggccgggccagcccagtccgaccccggccgcggcgactggccgtaaccgtgcgcgccgccgccgccgccgccccgtgccgcgggacgcggggacgccgagccgggggcgccaccgccgctgccgcccctggacatggactcgatctcctcgaggacggcgacgacctccctcatggagggccggttcttgtggtcggcggcgaggcaccggagcgtgagctgcgccgcacgctgcgcgcccctggacgagtactgcccctcgaggcgcgggtccatgagccgagccagcttccggcggtcggacaggaatggcttggcccagtccaccaggtggtgctgcccgctgggccgcccggcgtcgagcgcgcggagccccgtcaggagctccagcagcacgacgccgaagccgtacacgtcgctcttcacgtacaggtggcccgtcgccacgtactccggcgccgcgtagccgtaggtgcccatcacgcgggtcgtcacgtggctgctgccgccggccggcccgtccttggcgagcccgaagtcggagagcttcgcgtggaattgctgcacgtacgcatgatcaatccgcgaggaaaaggggctgcaggaat

SEQ ID NO: 84776 - DNA, 920 bp, Oryza sativa
ataagattactgcaaattcattgataagtgcatatgccaaatgtggaagactggatttgtcagtaggtttgttctttagtttggaatacagaaacttggatacttggaatgcaattatcagtgcttatgcgatgcatggattctatattaatatgcttgaaatgtttaagcaaatggaagaagaaaacattcagcctgatgagttaacattctctactgtgcttactgcttgcagccatgctggtcttgtcaaggatggttggcgtatgttcaattccatgacctcagtatattcagttcttccacaggaagagcattatggttgcatggttgatttattgggtcgtgctgggcatctggaagatggatacaaatttataaagctatctaccttgaaggataaatccactatattttgtgttttgatctctgcttgcagaacgcatagaaatacacaactggcacttgctattagcaaagagctccttgagcatggaccacagaaaccaggtatttatgctctgatttcagaagtgtatgctcaggaagggcagtggaatgaatttaccaatacaagggccagagctaatttaagtgggttaaagaaacatcctggttctagtttcattgaattaatggagcaaggcatgtgttagcgaagagcctgcggacggcatgctactctttatagtgtgtaaactatacattatgaccctttttaacttcttactttacaaatgggcccatgagataactaatagcaaactaattgcaggaatggactcctccctttgcatgaagaacagaagcgcacaactgcccatctcgcatctctctcctctcaaatccttctcaaattggcctgaaatcaaaggtttttccgtgggacgtgtggacatcgtctaggaaggtactctccc

SEQ ID NO: 84777 - DNA, 1370 bp, Oryza sativa
ggaggggaaggaactggggtttaaagggggcggcaatgtcggtttgggaaccgacttagggcggtcaaggcgcgagctggcgctcggcggtcgcggccaaagcggcgacagggaggatgacgccggcgggggaaaaaggggaaaaaggagggggagaaaggggcttgcccttttgccgattcgggaaaaaggaggaggggagcgggggcgacgcggcagagggaggaggggcgctgcctccgtcccttggcggcttgcgcgcggagtggcgggggccgggcggtgacgacggcgatgacggcgggcgatttggagcggcgcgacgacacgggcgacagacgcgtgcagaggctgacggcggcggcgaccgggcggtcggccactcagcacgcgcgcgtggcttgcaacgggcggcgtccgcgcgggcgcgcgcacgcgaacacggcgtgcgggaagcggcagcgagggagcggagagggaggacttggctcggcgcgggcggcttacgcaggcgcggcagagcgaggagaagggaagggggcgctcggcgcggcggctcacgcgcacgcgcgcgggcggagcggaggaggaggagcactcggcgcggctctcgcgcacgcgcgcgcggcgcgcgggcgaggcggagcggagctgagcgtgggggaaagcggagcgcgctggggaggggagagggcgagagagagagagagggagcgcccgggagagggagagagggagatgggccgagcgagattcggcccttcgacccgggggaggcaaaatagacttttgcggaggaatttgatttggaaggatttggattcggatttgaactcgacgatagatcggggattgagatcttgagatggcacggacactagacaacaagcaaagaaacaaatttcgcaattagggtttttaagagataattttcccgctaggcgccacgacggaacgggcgctacatattgcttacggaaagccttcattatagtctaagtgttgctttggtcgagattaaggatgaagaacacttgtgcctgtagtttgccacggcttgttgttatatcatttttttagtttttaaaaataattataggctatagaataactatgtgaagaatgtgagtggttttagagtaattgaattatcgtgatataattatctaagtaggcagctaaatagctatattctagaacagagaagatcaattaaagcttaatttatgttgaaaaaaaaaatatcaactctatgagcatacagatgtactgtatgtggtacctgttgattctatccagccaatccgatatcctaaacattggtagctccacatgttagtgttctctgtcggatcagggctgcaggaatt

SEQ ID NO: 84778 - DNA, 2148 bp, Oryza sativa
acagaaatgagcttgcaggttatgaaaaataaacgatattctttggaagcccgtctaactcggaaaggtgaggtacctctatacaaatgatgaaatcttgaatgcttgactttaactccaagctctgtgccaacggacttctaaccaagcccaaagaatacatgatagcaatcataataccctgccaccaagttaaaaatactatagatttgaacgaaagaaattttgccaatggctttatatgtgccaattcgtccttagtagccgtgtaccactccaccaaacagtatagggcccaatattgactgaagttaaggacagcggcaaagtatgggtatctgcagtttgaacaaaagcaatgaagttgaaaaaatggataagcatgcataaaataattcattgaagtggactgctagatgttcacatatattctggggataaagacaaggtgataacagcttatgcagtgacacaggtagagtcatcaagaagattgcattactcttctatgcagttatctgtctctgcattattcctattataaaatttttccaagcattatgaaattcaaattataaaggtgaatgccttttgctttgctgaactcaagacacaagaggtgaaaatggaaaattgtcttacccgcatctcaaattgaattctccatcacaatatgcaccaaaaggttgaagaatcagggataggctagctgtgagggtctttataatcacctgcacaggtacaaagtacttaaccaatatgctctcaaaatcataaattccatttcaactagctggacaagtggtcatacatattgaaatataccaaatttgataatctggtaaaacctcacacccattctccatggtttcaatatgtaattcacagggaagtgatggtgtatgatccctttttcagaagcaccatgcaaaagaggttccccagaatctccgccaccctccctcttcaaaaatgcaattgtcctttcttcaccacctatatacaaaatatatacattttttttcaaattaaataagagcgatagatggagagcttccaaattattaatgaaccggttccatatagtatttttatcatgttaatcctactttccttgtataaaaaagcaattaatgggaaaatatacatagggatgcattgtttgtttgtccaaggtgacatttttagtagttatacacaggttcattttattaagcctcttctctcgggtaaattccctcgaatagaatccttgataacaacgatactgttatctcaggaatttaggcagatagaatggtggatgcctttgcataaccttatcgaacaatagttccagttgttctggggtgaatatagactagctgtatacatggaaaacctgtatccagttatggaggtacatattatatataaaggaccataaatgaaatcatgcctcattccaatgccaaaggtctgtttctgttacttggtgtgttgaaaaatttatgaatgcccataaattggtcatcctgccaaagttttgcccaaattgaaagcacaataatatgtagctagtcattgacaaagtccatggggttagacaggccacaaaccaaacataacccaactacctgcattgttttaacatatccatccccacgttccctcaaaatgggaaaaaaagattggtgcatcatagcaacatcataaatgtgacagatctattgcaaaaagagtagaccgtagatcaatctttaactaaatgtataagtgcaagtagcaccctgagagtggcaatgaaagttagaatgtctaagaaaacagctcacctaaacaagcagtaatatatcttccaaagcaatacatagcaaatgcttcataggcgtcacgcaggatgccacagtacacgctagtgtcaggatttaccaatgaaacatactgttgcagaggagaagcaaagatcatcaaatacgcaactaaaatatctgaagagccctaatccaacaaaaaaaaacagaagttgctttggagatattaccgactcaactgcatagcaagggaccatcaagataacaccgagaacaaatttctgttcctggaaaaacacaaaaacgaaatggatattgtttgcagacatgacaaaccttagtattgataacatgg

SEQ ID NO: 84779 - DNA, 714 bp, Oryza sativa
gtggcgtgctatcttggcatgaggtgggtcgggtaaagatcaagcggtccacgaccgagaaagcgtgcgtggttgtgacatgttcctgtacaggccaccttgcctacggcccaacgagaacttgatggagctcctcatcatgatcgacggacggcccccgcgcatcttgcggtttggcggcaagcagcagcactagtatggctatcgatctcgccagccatggcggagctcgccattgaagagggacttcaaaatccacacggaattaagccgatttgagtgggatttgtggggggaattgatgaggaggatgagaggaaccgatttttacattcaatttggggcgagagcaaccgaggagggagatcaagagagggcattgttgcatgagttcaccggaagagagaaggatggtggcgggcggaggtggaagacgctcctggcgagcgggccccacggtggaaggatcttggtcggtgcgtggagtggctgaagcaagggcatttgggtcaaaccaaataagcaaaacaatggaaaatatttgcaaataactgaaattggctaaaatgccagtgtggcaagatggggacgtttgaagatggcattataacgaaaccacattcgaagatggcattctggcgaaaccccaacccgaggatggctaaatgtcaattttctcctctagcatagtgccatgccactgttccagaaatg

SEQ ID NO: 84780 - DNA, 631 bp, Oryza sativa
ctttgtataagctaatgtccttctttttttttactaacgtggcaattccatctggtcaggtgaatacaatcttgtttctagtcatggcgaagcaggcctacgcgacgagcagcctcgtgataggatatgcactctgctcgagcttgctcgcgatcatcaacaagtatgccatcaccaagttcagctaccctggcctcctcactgccctgcagtacttgacatcagtggctggtgtctggaccctcggaaagctcggactcctctaccatgatcccttcaacctccagaccgcaaagaagtttgcgccggctgcacttgtgttctaccttgccatcttcaccaacacccatctcctgaagcatgccaatgtggataccttcatagtgttcagatcgttgaccccgcttttggtcgccatcgctgatactgccttcaggaagcagccatgtccttccaagctcacatttgtgtcccttgtcactattttgggaggcgctgttggttacgtgatgacagattcggggttcagcctcacagcctactcatgggcagtcgcttatctggtgactataacaactgagatggtgtacatcaagcacatggttacaaagttgggcctgaatacatgggg

SEQ ID NO: 84781 - DNA, 669 bp, Oryza sativa
ttacttgcaaagcattaggacattatgtccggaaaagttagagagaggtgaaattttttcaggaagaggaaagaatcaaagaacaaatttggttcgtcctggagatacaagatggggttctcattttacaacattagctcaattagagacaatgtgggattctgtggtcaaggtgttagcaatggttcatgcagatgagcgtaatcctagtcgagccggtggtttggtgcacaaaatggagagcttttcctttgtgttaaatatgaagttgatgttgaaagtatttcgtattacaaatgagttgtctcttttgctacaaagaaaggatcaaaatatagttcaggccatgcagttgcttgttgatgtgaaagcgcgcttggtcgccttgagaaaccaaggttgggagccgttatttgaagaagtcaaatcattttgtggcaagatggggtcgatcaaggcttgatggcaacttaatcacacttgagcatctctaccgtgttgacacttactttgcagctcttgattctattatcacggaaatggatcatcgtttcaatgaggtatcatctgagttgcttgtttgcttctcttgtcttgatccaagagagtccttctctaagtttgatgtttgataagatcgcacggttgacggatatgtatgaccaagac

SEQ ID NO: 84782 - DNA, 505 bp, Oryza sativa
cctattttgtaccctttattaacatatttgtttgtccaacttggcatctgcatagggtgatctgaaagaaaagaacttcgatgtaaggaaaacagctggcggaaaatcttttattgcagttaacaaaagatacaacgcaactgtgtcaaaaaacttccttgagatacatctgttctgggctggcaaaggcacttgttgcattcctactcaaggttactatggacccatgatctctgcactaagtatcactccaagtaagctcagtacccgaattagttaacttgaagaatgtatgatagttttttttttctgattactgaaacacgttgtccagattttactcctactgtgagaaatggagttccaaaaaagaaaagtaaagctggtgtaattgctgggatagtgattggtgcgtcagttataggatcagcagccttacttgggatctttgttttggtaaagaagagaagaaaagcggcaaggcagcaagaaggtatcatttaag

SEQ ID NO: 84783 - DNA, 1203 bp, Oryza sativa
tccttgcatatcattacatattccttctttggcatgaaggaggcattcggatttgctccttcctggctcttatggctgaggttagtaaagaagatatatcattatttaggacaaatttagagggaatgattttctttttctttcataactttttttcttaaacctggtgctgattttgtacaggtatagcacctttatggtattgtatcctactggtatcagcagtgaggtcggtttaatctacattgccttgccttacatgaaggtaacaagaatgaacttcagaaatgaagatctccacgttgttcattgcataatgcataatgcgtaatttaactgctcctttcttgtgactactatgcaggcatcagagaaatactgccttaggatgcccaacaaatggaacttctcctttgatttcttctatgcatccatcctttctctcgccatctacgtgcccggtatcccctcttgccttgcagtcatcctttattcagtggttgaaattaaaactagaattgcaatgttgttttttagtagctgggattaagataggatctgacaagaacactgcgttgcaggatcgcctcacatgttcacctacatgcttgcccaacggaagaaggcattggcaaaggctaaggctgcataatggtgatgctcaagagctttcttgaatttttcatgtgtggcttaaggatctgcctaaatagctcatatttgctactcttttagtacaagtctgtagatgaggaaatgttggaaagaactactatcttaatcccagcatttgttgtaactgtagtaactgcccatcatttgttgtaactgtagtcttctaccaagaattgtatgatattttacctggttaaattattgaatgattgatccaaaatttgccggcttgtttcaagttgcactctttctgcgtttgctgttagcctgttatgctgtatgttgcacactttgcactgcgggctatagagaattggcacatttgcatatttattactggtatgcaattatgagtcccattgtttcacttatgcttataagcagttttaaattttataacttaattttgaagttgattttgtggttttctcatcgtagcaacatttgcttttgaatcactaagaacacatataaaattttttatccatattatgtttatattgctaataactgattcaaataagcata

SEQ ID NO: 84784 - DNA, 616 bp, Oryza sativa
actatagggcgaattcgagctcggtaccctggtgtagacttctttaggaatcttattctgggtcctaggattccggcacgatgtagtcccagaagtggtcgttgacatcggttcgccttgctgcgacatgtcctatgtcactgttgtacggggagaaagaacttgggtctgcccctgcggatttgtccggagatcaagtacacaacatggtgaaggacattaataatgagtttgggaagaaaagaaaacgtagcaaggaggacaagaagaggatgtggaataaaaaaaatccatattttggcggctaccttattgggaagatcttgaggtccgtcattgcattgatctgatgcacgtagagaagaatgtgtgcgatagcttgctggggctattgttgaatatgcctggcaagacaaaggacgggttgaatgcgcgtctcgatctacaggagatgaacattcgcagtgaacttcagcctgttacagatgagaagatgggaagagtgtaccttccaccagcttgccacacattgtcgaaggatgagaagatcgcatgctatcatgtctggcagatataaaagtcccttcgggctattgctcgagaattaagtacgtac

SEQ ID NO: 84785 - DNA, 3136 bp, Oryza sativa
  unsure (1)..(3136): unsure at all n locations
actgtatacttatgtttccattcaaaaattgtatccacaaaacatggtccatttaaatcgaagtggttaacggcttcccttttcagttctggaagctggtagcgttcttcgcaactccaactatcactcctgcgctatttggtggtggcctgttgggatatgtgatgtatgactgcactcactattacttgcaccatggacaaccatccaaagagccagcgaaaaatctcaaggtgacaacttagtgccacttataaagctatagattatctagctgttccaaccaaagtccatgaggcttgtattccttacaacgtttgctcgttatgcagcggtatcacctcaaccaccacttcagaatccaaaacaaaggctttggcatcacctcatcactctgggattacgtttttgggacattgcctccgtcgaagaccaccggaaagaacaactgagccactgacagaaatgtattgttttgcatgagaaattttagaggatatgtaatatatatattaagtctaggcacaactgcttgttttgtctttctgggacaacaggttcacatgcccattcagttcgaattcctgtggtttactgatgactgccttgatgtgggtgaagaagacatttcattgccttgacatccaatgttctgaattcagataataggcagttcttgatgtgatccatatgccatgttaagcttagcaattctattggcatgtccaattacaaaatgtttgtcttttcttaggattttttcccctcaatcatcaaagagtatcagatactcacagatgcgagatgccgttttctgggtccccgtcatgcctgtcatgatttttttttgatacgcctgtcatgagttgtctggcaactacatttcggtctaaaggcaaaatgatgtttatgtaatcatataagtaataaagaaatatgaagtattattttggaggaataagcatactggatagccctacagatttatacaggcgagaaagctactcagaagtcaaacagctatgacaaaatagattactagttcctgaatttctgtcatggatatgccttttctagttttcttcctttttctttgcgaggacatgcctttgtcatggatatgccttttcttcctttttctttgtgaggacatgcctttttcttattaagcgagccaagagtctaaatgcaaattctgacttttgtttcatgaaaaatatcagacatttttttttacgtaagaaggtagagcaggctctaccttatggccatttcattgatagaaatgaaggattacaagattttaacgaagcttatagaggaagaagaagaaagaggaaccagaaaaaaaaaagaganaccagccaaacaggaataagagaaagagccgggggttaggacttaggattgtagaatttacagaggtatatacaagagcctcttcctaaatctcgagcaccaagagataattttctgcttgattaactcgtttgctctttttcatgaaacgttagaacgtggcaaatacgaaagcagttcttgaagtcgcagcagatcgcacatgaaatgcagacataaatttaacacccagttcagctatcaatgagtctttgcttatcaccagatccccggttgagatgaacaataattccattcattataattccagatctacagacagttggggcgttggaagcacatgggaaccatctagttccagttcagatcttcagatgcccctcatgaaacatatttcctcagatgataaacacactacctccttttcaaatgtttggcatcattgacttccgtacaacgtttgatctttcgtcttattaaaaaaattagtacaaatatgtaaaaatataaattaagattatactttatttgatgataaaacaagtcacaacaagataaatgatatttcactccttttgttttgaataagacgaatggttaaacgttatgcgaaaaatcaacaacatcaaacattttgaaatattgaaatggagggagtagtatgttacaacagtatccaataatccagcagcaagtgaaaaaaaaatcaatttagccacagtaaaactgtgcctattcaaattgagatgtacaccaaacaaaaatgaatctgccaaattcgagacagaattgcgcttaaaggaaaagcaaacagaaactagagttttgtaaatcgacacaatgagttggcgaaacttcccaattttcattaatatataaacacaagtgtcccgcatttggctacattgcaaaagggcgaagcccacactacgaaagctgccctagatacaaggaggctaaaaggcgaagggcctcacacctctgggtgatctgggccagctgcgtcagcttcaccgtcgccagctttgggctcctccgcggcttcttccgcttcgcgttgagccttcgcgctcttctccagttggtcgcggagatagcccttagcgatggttcacccctccttctgccagtactcttttcgccaagcgcgaagagtagtagagatggggtacgacttctccggccaatctcccttgacgaactccgggaattgggcgacatgttcgcacccattttcctggagcaccccaagcacgaaagccgccgaaacccgagcacaacaatcaccataattgctgccggtctcagccacggcacctccggcttgttgtgtccattccgagaagtccagcgcggaagcatttttgcctggaacgcctttggcctgggcgcccaactcatgaagggcaagccggagagtatagctggccgacttggccgaatctgtaatctcagcaacggagcgggcagactctttcgccgtggtttcggctgcggcctttgcctagtccagctcctggcgaaggctgttcatcttcccctcggacgaattgtagtagtccaagagggtagcgttctggtgcttcgccttctccagttcctcctttagttttttgttttcggccttagcctgccttagggattcggccaccacctctcgctcctggttttttcgaccaaggtctccctcgagccgacgtagacggtccttgtacccgtcgaggcgggcccgaacggactgtccatgttgcagtgggctaaaagtgcctagcgaaga

SEQ ID NO: 84786 - DNA, 3260 bp, Oryza sativa
  unsure (1)..(3260): unsure at all n locations
ggagatgggttacacaaaatcagtatagcatttcaagagaaacacacatggtatcaatgctatgaacataaataatatggggaattttagatcagttcatgtactttatggactatacatcatccacgagcaaggcgtctagtgcattttcagttttattcgacctcaatgttcagttagctactagtatgccgttttggtttttactaaaaaggagacttcatttggtggtatgaacaaacgaccgattatacttggcagggacagtttggtcgcgagatgaggtaaatcgtcccttaatcttgaaaacaaaggtcaagcataacaacaatagaacattcctcgagcattgcaatctgaatttcacttgggggtgaaaatcatatgccttgaagccttatcacaacattaaaatttatcgatctctaatcccttggaatttttactatgttttagctggcagagaataagctcaaaagcagccagtactgcacgggaaataagattcatactctataaaatagggagtggaacagcttattcaccatatcttagctgtttacttctgatactaaaccttttttntnnttttcaaaattttttaaaagnaaaggggggggcggaaggagcgttaactgagcctgcagcatgtgtagtcctagaaacagggaatgtgttcattatcttctaaaaattntcctgttnaaaancatttgagccnnnaagccaaacgagcgttntnttccatttataatttaggaatatgngcaccatggagatacctctaatttgatagtctccgaacgcagcagctcatgagctgactgcaaagatgacgcaccaagatcttggaacccttgcttaacagcttgcattgtataaggaatgaacctcagcacagaacctttatcagcaactgctccaacaactccctgggcgactttaagctgagggtatcgcctaggtacctggcgtcactcccctttgtcattgcttcgagagagcccatgcctcggtattttttaacacggtggccatcctaaaagcattccaagaaccataatttcagacaggagggagtgaaacaacaggtacgtgtgataagagtaacataaatatattcgaccaaccaacacaataagcaattaaaaacccacttctacgacacagtgctagaaatgacacaggaaaatgctgaagacatcttaattataataattcaaaatattttaaggattaatgttgcccattaaattacatgatcctatcaactacatgcatcacattggcaatctaagataggacaataatagctactaatatattggcagcttatcaccccatttttactagtatattgtagtaataatcctaaagcaggtcaaatttactgaaacatctgcaaatggaaaatgctaaggtgtggtttcacccaaagcatcattgaagaataagagtggttatccaaaacaatggtttctaattaccagatatgaccttaaaacaactagctagaacaatctagccatgccactggttgcacttgcagaaataattaagaactaacatgaatacttcaggcacacagattgtgatcaccaagagtgatgtgaaagaccaatagaacacacatatatctagtatttacacttaacagaatatgtgctggcaattggttcagacagagcaatctcatacaaagcacaggaggcaaattgtctcagtgtctctcgctactaggtttgttgtgttttaaaaaactgtgattttcagcagccatgttactaatattgtcatccatgaagcaaatattcagaagcaacatatctaaacacacaatcatcttatataggaacttttatgacggcctgattagcacttttatggcatcaattagaccaaaatattgcctaaacattgatagcatgttttcattgcagtggtcacatgggatgtacatttgcatgtgcatggcatgtgggtcgtccttcaaagtatcaattcaatacgtacggttgtacagactcagacagacattgctaaagaactacaaaatagtttatgcatggtaaaagcatatcagaaataaaatcacatgctgaacctaaaaattcctgcagaagctttaaaaaattgaataccttgtactcgtaagtaccatgagcttcatggctgccagccaagaagctacccatcataacagtggatgcccccagagacaaagccttcacaatatgtccagagtttgaaattccaccatccgcaatgactggcacattgtgatctttggcataagatgcaaccttatacacgtcgctgtagcctggtcgcacgacaaatgcaagaaacaagtgtcaaacacatgcagcacacagcagtgccaaaattctttggtatacgatatataccatatatataccatatttgttgtatccctataacatttgtatccgccacatgtcccatgatccacttattatacaaacctcatttcaagtttaggtctaaaaacagcagaaaaggaatgagctggacaaggtctcaatacatcacagaacaaaatctcgtaaacaacataatgcccaggttccacgggtatgaatgggaggttgtagcaactaacacaaagttcacacttaaaatgtaacgtctggacaacccagcctaattaaacaagaagaacctaacacctactcattctcactttgtgccatctaaaaatatgaaacaggatatccatatcctcctgagtgttggtggaaatggaagacgctatagatcatccaactagtttagaactttagatgcttgtgataacaatgcagagacgaagcatccaactagtttagatgcttggatagatgcttgggataacaaggcagagaggaaggattataaattagagcaaggcatcagaatctagtttagatgcttgggatagcaaggcagagatgaaggattagaaattttagtaaggcatcagattctgggcctatttggatggctgccaagtattgtcgcacatcagttattaggtggatatgaccaaatatggctggtgcttttggtttgttactatcactacggtgtgccacactttctaaccctttagccccacttgtcatcaactctctccatagccaaaataggccacaagtgtggtgaccaattttgagacacaaaatctgcagtttgtcacactttcggcacgggattgtggaaaagtggggatacaagtaaccaaacaatgtttctgtctc

SEQ ID NO: 84787 - DNA, 1651 bp, Oryza sativa
gaacatctcttggatggaggtggagttcccgacgaaggtcgccgccatcttcagccccctgggcggaatgtcacagacactggatttgacgttgttgggaatccactcgacaaagtatgaggagttcttgttctgaacattgagcatctgctcgtccacctccttggtgctcatcttcccacggaacatggcagaagctgtgaggtagcggccatggcggggatcagcagcgcacatcatgttcttcgcatcccacatttgctgtgtcagctcaggaacggtgagagcacggtactgctgtgatccgcgtgaagtcaatggcgcaaagccaaccatgaagaagtggagacgggggaaagggatgagattcacagcaagtttgcgcagatcagagttgagctgaccagggaacctcaagcagcatgtaacaccactcatggttgcagagataagatgattgaggtcaccaactgcattgttagaaccaagcaagctatgagtgcctacttctagttgaacagtaatttagtgatatcatggagaagtaaacaagaggagactaacttacaggtaggggtagcaagctttagtgtgcggaagcatatgtcgtagagagcttcattgtcaagcaccatacattcatcagcattctcaacaagttggtgaacagaaagggtagcattgtaaggctccacaacagtatccgagacctttggtgatgggaagacggaaaatgtcaacatcattctatccgggtactcctccctaatcttagaaataagaagggttcccatgccagatccagtgcctcctcccaatgaatggcaaacttggaatcctgcaagtaaagaatataagaccatgatgttagtcatcaatgcaaacagacttcaaacatgcatctacaaaaggcagccttgggttcaacgaatgtagcaacattcaaaaggccaagggcagctagaagtttagggtatcactgtgtcttccacgaaaccagagtttgggagcaattgatcatgttccaatagagaaggtattatatggattaaggcaaaggcaatttttcacatcttcttctaccaagctttattagtcgatgaacttgtcatggcattcaactaaggcatattacttgggtctatcatgttgaatattatacctgtacagctgtaccaaaaataaataatcataaggatgaccaaagcaataaagttttgatttcattgtaaaccatgaaagacaaggttacaattttgctatgttttgagtttttaaagaattaaatccagctatgacacaggtggacactacaggtaaagagaaaagttctgtgtaaacatctagaacagctacagtaggagctagataagatattggtgttgatgttgatgcccattccaccaacaaggcaacaacaattgatgttgatcaagctacataagacaataggagctcatatacaaaacataggttgatgattgatagagcgtcttatggagcttaaaattctcacaggcacatccctaccaagatatgaaaaattggtcacacaatggcattataagctaaatgcaaattgggccattagaatttagaacacaagtagcacagatgacagattatcatgctatacaacaaataacacgaa

SEQ ID NO: 84788 - DNA, 705 bp, Oryza sativa
cctgcagcccgagaagaaagaaaaaataacaatagaataaccagctcaaggttgataaattcttaccaataggttttggtctcaatgtggaataggaagcggtgcaaagtatactcgatcaatgtccaaatgaatattccaaatagggccattagacctacttcctgaatagtatgacccatccgaatagatttcacaagcaaccagcagacgacaggcagccatatggttggcacagcaaaccactttgtgcgcgtcaagaactggacacaaaaagttatgttatgacagctcagtttacaaaatcctaaataataattggaatgtataatacctccaggacatcatttccgaaaaagcgtggaccttccttgctcacgataggttgatgaacccattcctgataacgttcctcaagatggccaaccttcatcaaattcacaccacaaacaaatgttactccaaatgcaaagcaactgaactagttttacttagaatccagaattttacagcgcattgctagaaaatcagaatttgacatttgagcaactgaccttatggtcagaaactaagaattgtatgcaagaagctaaaaaacaataagaaggtgagcatggcaacggtatgattttcaaggacaagtgacgcaaaaaaactattcgcaaaagaccactgatagagagcaaatcaaaacctggaaaacga

SEQ ID NO: 84789 - DNA, 661 bp, Oryza sativa
atgacatgcataccttaatgctatggctatataagccacattttttaaatagctccgtgcagtgcgcatcagatctagtgatactgttatcctccctgtccatatcaaatcatagaagtccagtacctcatattaattcccaaataagtacgatgttaaatctctcaaaaagtatacgcagtgatcagacaaaccatttgatacagtgactcaccgtttcttgcaatattctccttcagtacaaaaaatccattgggtttgagcccaatctggaagcaatattaccaatccaaacttaattagaatgcgtagagatggaatatcttaattcggattttatcactactaataataagtgcagaaacatgaatattgatatttttcattcgataaaattagaaataggctgaaaataaagactcgaagaccagaaatactacttggcatggatttagaacaaagtatcggcatccaactagcagtaaactccctcaaaataaatatagcagtgcaacagacataattatcaaggtagaagtggtagcatcattgatcaactggacaggtatttgcagatagtatatagtaacaaacaactttgtattcatgcacaagaagaagtttatctgtatcgaagggaaaaaaaagaccagtttccttc

SEQ ID NO: 84790 - DNA, 586 bp, Oryza sativa
actgattggtagcagttatgcaagcataattatgtatcatcacagttcagtcagttctccataggtattattgttcaaatcatcgtacattttgtgatcgtactcactaatcccgtttggaactgtaggtggattatggattattatcgcgggaatacttcctaattaaaaagctaaatggtatggtttattcgagaactttcttcattggcatttcatataaaacgttagttttaaaacaaaattttcaacttcctgatattcaatttgttcatttaatttgtgccctcaaataaggaaaaagtacaaattaccccccaaactatcgcggtcgtctgaattaccccctgaaccataaaaccggacattcttcacccccaactttacaaaccggacgaattacccccctcgatccaatccgcggtggttttggtctacgtggcgcacacgtggcagttcagtcagcattctatttattaaaaaaatgtgggaccaacctgtcatactcctcccactcttcccctctctctcttctctctctcactactcttcctctctctctcttctctcacgcgcacggtgagca

SEQ ID NO: 84791 - DNA, 545 bp, Oryza sativa
cacttttatccatttacaaaagctgttgctgctacggttatcccatccgggcaaatgtgtgcacacgcgttgggagaataggccttcggatccacgctgttgctgcgacgttcgcacaatcgggcgagcgatcaggtttttggggagcgcaaggcgcgactacttactgatcgccaacatttacttcatcttgaccaacatgtcgaacactggagacaaggagaaggagactcccgtgaacaccaacgtacgcaatactgcctcaaactccaggggaggaccattcttggggtataaccctattacattatttcaattagaagctttactgttaatgttcatcgcaatgtcaacattgggtcattatgtgattgttgacgcttattcaacgttaagcatgctcatgttgattacattcaccactatgactggatcaaatgctatcgaaaatatcatgattattatcttggtattttggattaaaatatgccgaattatgaccaagatttcaacattaataccatgatcaacggcgtatacattgt

SEQ ID NO: 84792 - DNA, 550 bp, Oryza sativa
tggtaatccagaatcgacttaacatctgcccagaatacatttgtcaactggtcatcttcatccacttggatggcataaaagaaagaaggatgttcacctttcttcctctgcaaatattcataaattgcctgggtatcacctaattgcatatcttttgtgtgccttgtccttacataatttttataatcatttggtatcaaaacaactcttggtggatctggaggctgctgtaactttgctaataacttatgtgatctcagaacctggatgtccaccaaaggagtttcaagatcatgattatgatcagccacatactcagtcactacatatttgccactcacagtgattttaatagtcatgtgtgccagacaaccagttcttgtttctggccgtggcttcttgggatcagtactgacacttttagagcggaatccctctttagaacagacatatgcccgagattttgtagtatttgttgctgttttttccaaccatccttttcggacgctgaaccccacagttccagcataggtgacatagcagtcatagg

SEQ ID NO: 84793 - DNA, 540 bp, Oryza sativa
gtccttgccttcgaagggcggatccaatggctggattccaatgtcgtattcgtatctcatccactcatcgtcgccaatgcgacaataccaaatcacagtggcgatgggctcgatgaggaggacgcacaaccggggagagatggcttgctggagagacggcatgagcatatggtcgacaagcctccttctagcagatgaggtagacggatcttatcttggggatcctgtgggttctgcaagaacatggtggtgctctggcgaagtaggatccatccctgtggcgtgaaccatgcgttggtgttggtcagccctgggatgccgccgtcgatggccttcttgtccgagatgctgaacaacgccggcttatccgcggagtcgtcgcgttgctccaaggagaggcaaggcacggagacgcggctcgtgttgtccatgattgggtgatgttcttcttcctcttcttcttctttcgtttgttgtgatgttgtcaacctctattcctctcttcttcgttggatttgcaaactgtacccagcatgcact

SEQ ID NO: 84794 - DNA, 1263 bp, Oryza sativa
aggctcacataaagagaaagcttacgaaagaggagagattagaaatggtgaaggctggaagagaggatagaggaaaataccaagcaagaacagctgtgaaacagaaaaaggtattcgtttatatgatcctcctttttggtgcttattttgacctatgttggctatatggcacaaccttgtgaaatctgatcatgaattgttctttcgtagttgcttttattccttctctacttatatgcttctcattgcgttttagaccggtggcttgagcaataggcagaaacaacacaagaagaaaatgcccctcgctgcaagcagagcgaaggcagcgcgttctcgacaggagaagaaaaaactgcaaaagcgctcgggaaagcaattcagaggacggaaggcgtggaaatgagggattttttgtacttgcgtttgccaattcttgtggtctactggccaaaattttgactccttcagttaatgattttcgtatacaaatatgggtttcacaaaccgtgtatcatcgatttttcaagtgctggtgtattcttttgtgagtggagagaatgaagccggtatatcatcgctcacagtggttgctctatgaatttggacagtactcgtatccaggaagttcagcatcacgtgtcctcctggccagtgtctatacgttgcagtgactccagcgagagccacaattacgatatgataaatgctgtctctgtttctgctttgatgagactgtttcgattaggccagcaacctcacctctcctatataggctgtgtttatttcagcgtaaattttggattttggttaaaattagagatgatgtggctgaaaagttatgtgtatgacaggttgacgtgatgaaaaagaattgaagtttagatccaaactttggatctatacacacagacggattcagatcatgcgcagttatagctattactgcaacttatattctgtgctacagtatttatgctacagtacgatgaatagtgcacctcgctgatctggaccgttccatctacatcgttgatgaaaactggtaccgcctaaattgcagtcccagtagcgactgcagctgatccggattcaacacggacatagtacaccctcttgttgcttcgatgagactggtccttagcacaatcatcaaaccactaccattatatcagtgcttggtgttctattgggttaaggaattctcgatcgttctctgctagtaggaaatcgagccgactgaccagcgatgtcggcggttga

SEQ ID NO: 84795 - DNA, 608 bp, Oryza sativa
aagggactttaaatgaacttattctaaatttgctatgggccaccttgtttacgggttagagagcccataacaataatggttaattggatccagccatgcatcgagcctttttatagatcgcaagtggtctcaaaggtgtggtttttaaaatgggattggtgctggagcactcattggtgccgcatccctagtgtcggttgagaaaaccgataccttaagaggtttttcacatgttctgtggtagtgaaagggtccgtatcataaagagattaccataccgtaacacacaacaatgacttatttcacaagacaagaggactaacaatttcacaagagaatttttatgtccaaaactccaaattgacggagcaaccatcaattcagtgcggtagaatccccagggccttgccgtactcgacgaggtcgccgaatatctcgtccagatccgtccacttgaactcgaacccttccctcgtcagcttctccgacgaatagcacactctcggcttcttagggaacccttcgaaactacgagcaaacaaagatatcgctggctcatcaggttctctcaagaaatgcatgtgtcgatcgatcagtcacttgaaagt

SEQ ID NO: 84796 - DNA, 630 bp, Oryza sativa
tatgtaattataatttattttgttatgagttgttttatcactcatagtactttaagtgtgatttatatcttatacattttcataaaatttttgaataagacgaatggtcaaacatgtgagaaaaagttaacggcgtcatctattaaaaaacggagggagtactatttaagttcactagctgatttctccacgccgttttcctagagcaacaatttttgaaagcaaatttaaatataattattttttatgtaactatattgagaaaatctatatcgttattataatttagactcaccctgatcggatagtgtaaatctttctctctttttctaagagtaaatttcacataactacatatatttgagctaaattatcacgaaactacatatttaaggtaatgtatcacaaactacagattaacataaacttatcacaaaactaccggtttaaggctaagtatcgcaaaactatggatttagtaatatatttatcacaaaactatagattttgaagtttaaattcttagcactaatgttatatttgagttataaatgttcaagttttatgattaaattggcaatcggtagttttgtgataactttgttactataaatttgtagctttatgata

SEQ ID NO: 84797 - DNA, 2742 bp, Oryza sativa
tttttccctcgaggttcaacattataggttacacttgttcatttttggaaccatgtttgaacgacaactcctgcaatttaggtaggacttgagctagttaccaaagattatgacatggatatgccacatccattcagaaggtcagatataatcagcattgttcctatctacaaggtaaagtttaaccctttggattctgtaattgaatgagatgcaaatacttcctgtttattaacatgtttaaccatgatgtctttactccagcatgttgcatgctcatcagcagacggtcgaaccctgttggagtcatccaagactttcctggacaagggaaagcttgaggatgctgttaactatggcacaaaggtacagtcctgatcttgtgtcttgacacatcatgatgatttcttgaccactacatcctgttgattatacatggtgatgcaggctcttgcaaaacttgttgctgtttgtggtccttatcacagaatgacagcaggagcatacagccttttggcagtagtgctttatcatactggtgacttcaaccaggtattttctttttgggatttaagccagtagttattttatacattgctctgtagaatgtaatattgcaaatattgtcttctgtgcaaatattgttaaagttgaattctgattctagacaaatcttgggtacgatgaatgggaatcatgcagaattattttgaacaacagttaatatgatgatcatgtggaaattgtgactgtaagctgcttaagtgtaatataatgcaaaatgtttctcattcatgttacatgaagtactgaaatatacacttgtcaaggggttaactcgtagttttttgagtgaaggtttaacttgtatatgcatatatatacatatacatacatacatacatacatacatactatccagtgctgtgaagactggctttataaatgttcactctctattttaccaggcaacaatctatcaacagaaggctttagatataaatgagagagaacttggactagatcatccagatacaatgaaaagctatggagatcttgcagttttctattaccgcctgcagcatacagaattggcattaaagtatgtgcttgttgtcgtttacaaaagctatatgcctagggtaccatctagtttgtttttatgagtaagctatgaagtctgttctatttactctctttggaaatctcaactatgttatgctctgttttgtgtatcaggtatgtgaatcgtgccctatatcttttgcacctgacatgtggaccctctcatcctaatactgctgcaacttatattaatgtggcaatgatggaagaagggctgggtaatgttcatgttgcacttcgttaccttcatgaggctctaaaatgcaacaagaggttgcttggtgctgatcacatacaggtttgcaaccctatctgttttagttctcaattgagttccgacacatacagtagtctaattcatggccacatcagttttgatgttcacactcgttttgctgggaactatgagaaccattccctttcatgatccaaagaaaacttgagactgaaaactcatcttatatatcttgatgtttttattgacagactgctgctagttaccatgctattgctattgctctgtctttaatggaagcatactctttaagtgtccaacatgaaaaaaccactttacgaatacttcaagcaaagcttgggtcggaagatcttcgtacacaggtaagccgacaaaaattgcttcctggtgatgtgttcttccacttaccaatcaatttcattctttagttattttccattctactgcagcaaggaaatctaataactatgttttccacaggatgctgctgcttggcttgaatattttgagtccaaggcactagagcagcaggaagcagcacgtaatggtactccaaagcctgatgcttcaatagcaagcagaggccacctgaggtagatgacatgattgctcgtctttaccatgttgtttcataaaagtggttgcaaaagttaggattgagttttgtttatttgtgaatcaatgatctctattgcactattgccatttctagtactggaaatggcaggggctctccctctatctaaaaataaaagggaaaaaaaactcatctctaagtgtctacatggactaataaatgccatagcgtgctgactaagcttgtcactgttatccttatgatgattacatttcgggggtagaggcttacaaaaggaaaagagtatacttatttaaatttacatatcgatctattttggatgattgtctttgcttgtgcttaggtttgatttttctttcagtgtatcagatcttctggattatatcaatccagatgatgaactcaaggctaaggaaatgcaaaagaaacaagcccgcgctaaggtatgtttattgttaaggccttccactggtactatatggcattcttttatttcgccaatggtcactcatatgtgcacattatgaataatagatcaaaggtcgtgccgggcaaaatccatctgaagtagtcgatgatgaagatcaaaggagcccaccacctaaaagtgaccattcattaattgagaaggaaagttctgaagtcaaagagaatggaacgtttattcagaaagagaaactgaaagaagaaataccaggtaacaccttaagccgtatacctcaagatgattttactgaagagtacacgtcggatgaagggtggc

SEQ ID NO: 84798 - DNA, 2713 bp, Oryza sativa
gtacaacaagcatgccgccgccgccgccaccgctcgcccgccgcacccggcgaccacgacgtcgtcgtgctcggtggcgtacagcatgtcgccggccatgacgcccacgtcgtcctcgtcgacgacgacgacgacgacgcacgagctctcgccggcgccggcgttcctgcccatcctcgacagcctcgtcaccgagctcgccgcccgcggcggcgccagctgcaggccactggtcatcccctcctccgccgccgccatcgccggcatcgtcggcgtccccgacgtgagggtggagttcgccgggccgaacctggtgctgaagacggtgtcgcaccgcgcgccgggtcaggcgctcaagatcatcgccgctctggagagcctctcgctcgagatcctgcacgtcagcatctgcaccgtcgacgacgccaccgtcctctccttcaccatcaaggtaaaatactaatctactgtatattttattactcatcagattcatggagatcaatctctgcatcgtccataacatgctacactaaatcgatctcgaaaaacactcaaaacacatgcgatattatattacacgagacatgcacgcacacgagtttaatatataatcaatgtacacattaagcaagtgcactgatcagtgatatgatatcgatcgatttatttgaacagtaattggtaggatgtgttcatttcatgtgaccaagagtactacagtgctacagagccacacactgaaactgaaactaagcatgcgtatacgcaggattgcattaattaagccccaaatcaaccttcaactgttcatgtcctgcatggattctccttctttggcccataattccctctcatagatatatataaatctctacggttgtctctgcatgtttaaaacttcttccattattcgatgggtttcataaatgcaggcatacgtatctgcatgctgtataggctaagtttgtgttcagacatttctaatgtagagctcagatacacagtgagtgtgtacgtacatacagggatttataacacaggcctgatgcatgagtatttattggaaatggcacttctgtgtatatatacattatctttgaaagagctcgagaaactgccagagccagagcgggtataagtaattaatatgaacacataaatatatattcggggataaatgtcactactggtgcgaaactatgcatgagcagtcgagcaaagcacgagctgggaagaatatgcgtgtacacaatagtaaaagctacagctttggtagctgtagaacgttgagtgattaaggtcctctttgtttaggattataagccaacttataagccaaaaagtctaagcctaaacaaataagcagctttttcgtttggcttttttgaagccatcagccactcttacactattaagtcaaaagctaggttggagaagattttttggtttatatgagatagatgtatgactccaccactaaacttaggacattaaataagcagacttaaaaatctaagccaataagccaaagcctaaataaagagggcctaaacctgcttgcaagttgcatgcacacacacacacacacacacacacacacacacacacacacacacacacacacacacacacatatatatatatatatatatatatatatatatatatatatatcgacgatataatgcttgtttagctagctagctgttaattctgttttactatatgatatgtgtatgcatggtaatcaagcacacagatcgacacagtagaatttaatttgcttgtatattaatatacatatatttggatgcagtgttaattaagctggctagtgaactgacaatggattcgttgatttggtttgtgtttgttcatacagattgggatcgagtgcgagctgagtgcagaggagctggtgcaagaaattcagcaaactttcttgtgacgtgtaacatacagtgtcagtgcagtgactggctagctagctaagctagctggagtacgtagccgcgtgcataactatacgtgcatgtacacgcgtgcgtaacgtacgtgctagcttagctagctagtagctaattgcgtttggcttaattagtttgcactttaatttcatgggccaatctagctagctatctctatccagcgatcgattgagagagtacgtactgtgtgtgagagagagagagagagagagagagaagggctagctagtagattagatagcttggagttgcagagttgcagcaatgcattggagctatatatatgcaatgcaagctgcatccatgcatgctgatcgagaggttaacgacctacctactagctagagatcgagagatagctatctactagcgggaccatgcatatgcatggatgatctgtttctgtctctgtagctagacacgaacgatttgttatatatatatcttgatctgcttaatttcttgcattaagtgtttatgtgcatgatgtataatttaataactccattcgcgtgtgcgagatcaatcagttttagtagtatttttgtgtagggattttgccgatcccagcaactatctgcgaaagtgggatcgaaatattaatcacgcaatggattagacatggattcgactgatcatcacgagttttacgtatatacaggtcccgaccacaccatatccttactgcagtactccctctatttttttaatatatacgatat

SEQ ID NO: 84799 - DNA, 1670 bp, Oryza sativa
atgaaagctaaagcatggctacatggctttccacttatttgccaagccctacaactacaagttctctcattcaagtttactgcatgtgtaatggtggatacagttacctcggcggtgccatctccacatctaagaacttcatggtccttgatagccttgctctgagcattaagatctttggtaatggctgggattatcttgccctccatatttctagcaatattggctctcaagtcaaactttgcaacaatcatatgtcttattttctcatgcatatccacaatatgcaagtccttagtttttgacacccaactgttgaatgattcagaaagattattattgatgtagtctaccttacatagttcaaaaaaattgctcctactccaaacatatggatgattctcatccaaccattgtattgcatcaggacacttctcctttatcttgtccatgtggtattcatacctctgaaatgtgcagctcttggcagctccccacatgttctaagaaaacaatgtgccatgatacttcttcttcatgttcttccacaagtgtctcatgcactctcggtgttccactcctggatagacatcatctacagctccctctatccctttgcctgttacaacaaaatgacaaggcatgagatacaagtgtacatcacagtcatgaacaaaagaatgcaaaacagaaattacttgttaatatacctgcatcggtgttgatgaccaatcctgtaggagtacctatggcttgcttcaagttctgaataaaccatgtccaactctccttagactcgatttcaatcaccccataggccactagaaatagccaatcgtggccatcgactgcaacagcagctgccaactgacctcttgaccttcctgtcaagtgagttgaatccattgcaatgtaaggacgacatccttgcaggaaaccatcaatgcatggtttaagagctacaaagaatctcttgaaacaaacatccccattatgctcttcagtgtccaactcaacaacactaccagggattgccttcagaagtgcctctttgtaagtcggcaatagatcatagctctcatcccacttcccatatatcatgtccatagccttctccttggccctaaaaaccctgaaatttgggacatccatcttatacttcttattgaccttctcttgcaactcctttggtcccaatgtgggtttctcctttaaccagtccaccaccctatcagctatccatcccttagaagccattgtatcaccacacttattaactgaaaaacaagtgtggtctggcccattaagcttaacctgcatcaaacaatgtcgggtcccaaaactaaagattcggaaatcgacatgtttaactgtatcaagccctggatcagtagattgacacagcttcaacaatctggatcttcattgcgtacatttaaacaaggctccaaagaagatgttattacataaaataataggggaatttacaagactgtggctaactattacagcagaagttatatagtgactcaactctaaggttttgctatagacttaaaccatctaactaatctagatttgaaaactaggttaaaataagactaacttatatgattgaactcctggcttcggcaagaacttcaatttaattctggaaaagggggttgaag

SEQ ID NO: 84800 - DNA, 615 bp, Oryza sativa
tagaggatcccctgggtacgcacttgaagataacctgcctgagatctgggacatctgtattatcatccagcaacaatgcacatgcccgcgccagtaacaatgcggcctgatcaagatctttcagtgtcctgagtctttttttttgcccggttttctttgcttcgcggataatgtccagaattagcatatcaagcacatcaacggcatcgtctaatgccgttatttcctgtgctttaacgaatgcagtaagtacagcaagctttctctgctgtggcattcgagcgatatattttaccgacgccatgccagcataacgagccagattacgcagttgaatggcaggcagaccggaaaagttcagtcgggaaaactcaagacttcgtaatcggatatatcgttccagcgcttcattaaacgcaggtccactgactgtaacagggccttttttcaactgttccagtgctgatacacgctgaccttccggaatgaccagaagctccatcacttgagctgcctgccatttgttcggcagtgcggccagctttttccacagccgctgatttgccctttcacgaatttcactgatgagacgtactagtgtggttgctccgggca

SEQ ID NO: 84801 - DNA, 559 bp, Oryza sativa
caatgtttgcttttcatgcgctggagagagttccgtggatgaggcagttgatgctgacggaatgcgtccaataatggagctcaccttgtgactttgcgagtaatgtgtatggatatctccaaaattcactgaagagaaatagaggatgctattgctcctgtcctaaggaccagttcggataaatggatgtcggatatatattatctaattttgtgataatactcgagagttaacaataaattaattattgtaaattggaaaaagtacaaattaccccctgaactatcgcggtcgatcgaattacccccctgaatctgaaaccagacattgttcaccctgaacttttaatatcggacgaattatccccccttagacccaatccagagcgattttttcctacatagcgtacgcgtgtcaatccaatcaacattttcttttaaaaaattggtgggacccacctgtcatttctccccttcacctctctctgcgcaaaggggccggcggcggacgaccgcaacgtaagaccaggaggggcatggatgaggatggacgccgccac

SEQ ID NO: 84802 - DNA, 5906 bp, Oryza sativa
gcccgcggttatgggcggtcgaccagattcaccgtgattagtttcaccctagttagcttttggaactggttagttcaggtggtggtttgggcctgtggcaacgtggtgtaacgttggacagtgattggttaatatggattaattactacaactgttttactgctttcaactactgctttgaaatgccggctttatgcaaaagaacctttagcctccccttggatatatcttgcatcatacctcctcttccggtgtgacttgctgagtacagtgggtagtactcagtcttgctctcttttcccccacaccagagttgaagtccttctcagttgaagatgtctcggagaggttggtttcgtcgctgccgtcaaggtttgcctgtggaatggagtcgcccgctgcaggagtcaagtcttcaggcttagctcgcttgtatcttttccgctgcatttgtaatcttttatatttttgtaaggcgtgggtctgtatgtcaacaattgtcgtttgtgtaccctggctggtcctggacaggggtttaatacacattcagcttagaaattctggttcgtgaatttctgggcgtgacaggagataacttgtgccgatctcgtgtagtttgaattttcctcaaaactaggtcaccgactaaaaaggcacgagatcgaacattgcgattatgatagcgccgcaacccttgtaaatatcgagccgaccgaatcaaagctgcttcgcgggcttcttccaatcggtgcaagtcatccactcggtcttcttcgtagcgttcttcacggaaattacgaaagcgcaaagactcaaattcgacttcactcggcaacattgcctctgccccatagacaaggaaaaaaggtgactggcctgtggcccgactgggtgtagttcgcaaagaccaaagtaccgatggcagttgttgcacccatttgccggcatagggttttagccggtcaaagacacgcgctttaatcccttgaagtatcatgccattagctcgctccacctgtccattgctcatggggtgtgccactgaggcgtagcaaatcttaattccaaagtcctcacaaaagtctttaaaaactccgccagtgaattgtgtgccattatcagtgattatccgattgggcactccaaatctatgcacaatgttgatgaagaagtctcgagcattatctgctgtgattgtgacaaccggtttagcttcaatccacttggaaaatttatcaatggccacaaagagatgcgtgtaaccgccgactgcctttttaaacgggccaaccatgtcgagcccccaaaccgcaaacggccaagacagcgggatagtttgcaactcttgagctggtaagtgaatttgtctggcgaaaaattggcaaccttcacatgtgcgcacaattttgtcggcgtcggacactgcagtaggccagaaaaaaccctgccggtaagctttgccgacaatggtgcgtgcagcagcatggtttccgcatatcccagaatgtatgtctttcagcaattgtctcccttcctctaaagatacgcagcgttgcagaattcctgaagggcttttcttgtataactcagattcatgcataacataaagtttgctctgccttgaaatccgctcggcttcatctttgtcttgagggagttcttgagaagtcaaaaatcgtatgaggggttctcgccagtcggtttcaaccatagcgacgtcatgagtgcccgcaacttgagtggtatctttgtgaggtactgtcggcgtataaaggtgttcaacgaaaacatcagagggcgccacctcgcgcttggatccaaagttggcaagtctatcggcggcttcattattatgtcgaagaacatgactgagctcgagtccatcgaacttatcttccaatttgcgtacctcttgtcgatacgccatcatgttgtcgtcaaggcaggaccactctttcataacttggtggacaaccagctgtgaatcgcctcgaactattagacgctttatccctagggaaattgcaatccgcagtccatgaaggagggcctcatactcggcgacgttgtgggacgccgaaaaatgtatccaaagcacgtagctcaatctttctccagttggggaaatcaaaaccactcctgctccagtgcccgaaagtcgtttggatccgtcaaaatgcatggtccagtgctccatgttctccgcgggggtatcctcctggcactcggtccattcggcgacaaaatcagctaacgcttgggacttgattgaaatccggggcttgaatgatatgtccaaagacatcaactccaaagcccacttagcaatacgtccgtttgcttcgcggttgtgcagtatatcaccgagtggaaatgatgtgaccaccgttaccgagtgaccttgaaagtagtgagatagcttcctggtagtaattagaataccatataacagcttctgaacctgagggtacctcgttttggagtcggctaggacctcgctgacaaaataaatcggccgctggactttttggacatggccttcttcctcgcgctcaacgaccaagactgtgctcacaacctgggaggtggctgatacgtatagcaacaacggctcctgcgggtgtgatgaggctaagactggtggctcggtgagaagtttcttgaaatcttcgaaggccttttgtgcttcgggtccccactggaagttatctgttttcttcagcagcttaaagaagggcatcccccgctcgccaagtcttgaaacaaatcggctgagcgccgccatgcatccagtcagcttctgaacatctttctgggtacttggcggtttcatgttgaggatagcagtaactttctccgggttggcttggatgcccctatgagacaccataaaaccaagcagcttccctgacggtactccgaaggtgcatttttcagggttcaatttcatcctgaaagcacggatgctcacgaaggtttcttctagatccgagatcaaatcatccttttgcttggtcttgacgactacatcatccacataggcttcaacgttgcggccgatctgcgttgagaagcatctttggatcatacgttgataagttgctcctgcgttttttagtccgaacggcatggtgacatagcaataagctccaaagggcgtgatgaatgaagtcttcaagcagtcagattccttcagtcggatctgatgataccccgagtagcaatccagaaaactgagaagctcacagccggcggttgagtcaactacctggtcaatgcgaggcaacccaaaaggatctttgggacaagacttgttgaggtcggtataatcaacacacatgcgccattgccctgttttcttccgaactagaaccgggtttgccagccagtcgggatgaaggacttctttgatgaagcctgctgctaacagcttggttaattcctccttgatcgcgtccttcctgtcttgtgcgaatcggcggagtcgttgtttgataggcttggcatcttctttgacatgtaaggagtgctcaatcacctctctaggaataccgggcatatcagatggtttccacgcaaagatatctttattgttctgaagaaaggtgatgagcgcgctttcctatttacaatctaactcggcgcctattacagcagttttagtaggatcagagggatctaggggaatcttcttagtcttggcttcgctttctccactttttgaagtcttggtagcaggtatttctccttcgctcgccgtggctgcagccagtcggatatcctctcgggcagacgccatctcgcgggtttgagccatgtcgcaactctccttgtcgcatgtgacggcttgcttgatgtcactccgtagggatagcactcctcggggaccaggcatcttcatcatcatgtaagtgtagtgcgggacggccatgaacttggctaacgccgggcgtccgagtatggcatggtatgctgtctcgaaatcggcgacttcaaagctgatattctctgtgcgaaagttttcccgagtgccgaaagtgaccgggagggtgatctggccgagtggagttgcggataatcctggaattactccgtgaaaaggcgcattgcttggttttaactcggagcgaggaatctgcatatcatccaaggttttggcgaagaggatattgagtgcactgccaccgtcgatgagggttctgcgaagcttgacattacggaccactgggtctagtaccagggggtaccgccccgggtggaccactcggtcaggatgatccgagcggtcaaacttaattgcgatttctgaccatcgaagatactggggcgtgtcgggttgaacagcattgatctctcgttcagtcaacttctgcttccgtttagactcataagctaaggggccgccgaagatatggttgagctccttgcggtggtcttgaaatcctgccggggcgtcgccgtcgtctttcttcctcgacgtgctttgttcttcgtcagagttcttccgtgcagtcttggtgtattgatccgcgaattgcttgtagacgaaacaatctttggccacgtggttggagttaggatggtgcgggcattgggagttcatgatcttgtcgaacgtgttgacgcgcgaacgctgtcgagaagagtgactggcggttgcaacaagttccgcaggcttacgcttgcggtccttatgattgttacttccaccacctcccgtagccggcgtacccttgttttgcttccaactggggcccgactgctttgatgcggtgacggcgtcttcagctttggcgtactcgttggctttttcaaacataagcttgactgtcctgggaggcttacgcccaaacttgccgactagttcttcgtggcgaattcctttggtgaacgcggcgatgatgacgtcgtcggtgatgtcggagatcttgttacgttgttcagaaaatcgccggatgtaatctcgaagggattctccggacttctgaatgacgttgtagagatcatattgtgtgccgggacgctcgaaggtgccttggaagttggcgatgaagtggtcgcgtagttcggcccaagatccaattgtaccacggggcaatccatggagccaagatcgggcggaatccgctaaagccactggtaaatagttcgccatggccttgctgtctcctcctgctgcgcggatcgcgagaccgtagacggtaagccacgattcggggttagtggtgccgtcgtacttctctattccagtcggcttgaagccggctggccaatccactcgacgcaggtcgtcggtgaaggctgctactccgtcaaggtcgtcgtcgtggcggtccggcgagtgatggtagcctcgagctgctcggcgctgtatgattgtgtcgcgaagatcgatggggcggcgacgaggtggtgagcgaggccgttccactcggcgctccctatgaaggtcgggaggtgagtgaacagaccgctcgtcgtgacccctgctcctgcggttggatcctgcgccggtgatgctgaggcttggatgacggtagtcatgagatcggaagtggggaactcggctgccagtcggcgtgtggacgctttcggagttaactgggaccgaagccgcaatcatggtcttcgtctggttcaagatgttgacgacgtggtcggattgattgagctcgttttggttgaggagggtgtcgagaagggtgatcgcggcaaccgcattctgttgaggggtgcggaaaaccggtgtcccttcgacatcttgctggccgatgagatcacgcgctcggcgccctgcttccaaagctcgctgacgtcgatcctgtcacaccccgaagttttcctccctagccaaaatcgtaattttcaaatgaccccaagaaaatgcaggtgaaatcaggagaaaa

SEQ ID NO: 84803 - DNA, 661 bp, Oryza sativa
tcagaacaaggaagctccggggggcctttgctgaatggtcaggttcaagttacgggcctcttgcatggtggcaatggcagttttcattttcatttctcttccgaatggggtaaggcacaagaacgacctaccttctaatgttcacatatgtttcctaatttaaattaatgcctattatataagtttctaatttcgattgtttgtatttgtaggattccttgtatgatttgctggccctgattcaacattgctccgccccctttacctctttctggatgctgtgtgtatgggtgaacatgctgcgacttttttgagatagttgcaacttgctctacgtttgcgatgatctatgaatttttggtagaacctactttacctgtctgttcctggtaaagatgagaattttgtacctaagatattttccttaagctcaaagattcctggtcctgtttgaaaatgatcggatacggttatatcttaaagatgagaattttgtatctaagatattttccttaagctcaaagattccttttcctgtttgaaaatgaagatacggttatatttgccaagtccaataatggacttcgttatgaagttgtgcacgtgtagtgacgctggatgtcagcatgtgtggttagttgatggatttcccctgccactt

SEQ ID NO: 84804 - DNA, 620 bp, Oryza sativa
ttttcttgatgtaagttcttttttatgtatgtataaaagtaacaatatggcgcaggaagtgaagcatagaaactgttcatcatctattgaattgctctgacctctgagtttatatctagtagttaaccacttatcattggtataatgcaggcaagggcaaacaaggtgaaactctttgatgcaatgggaacattctttgcaaggtttgattggatccatttggctttcttctttcattgctacaaatttctagcttcactttgacttttgatctaggtcaagtagaccggtcaatgagacacagaactccatagaaactgtgagaccatgtgctgcatgcaatgaatctgaaatgtttctgaagcaaaggccggtaaaattatcttcccatacatcttttctttcttgaaatggttctgaagcttaggcatattggaagtgtcgcactatgtccatgcttgagctttgcttttctttcctcagactggcgaatttatggttgggtgtcggggcttccctcaagtgagtaacatgtgtgctttgcttagttaccagacctcttgttagtaaaaaaggaaataagaaccattcattaatcttgccagaaaagagcatatgga

SEQ ID NO: 84805 - DNA, 1330 bp, Oryza sativa
cagatatcgcaatcttggacctcgatagaaaaaagggtcaagaaaaacgcctcttgtttttgtcataggacgtactactaattaaccaacagcatcagatccctagagcagacttacacagaagcaatgacaaaacagcaatggtccctgtcatcccaacatcagattaattgcttttcggactaacacacatcagatcagtttatttattatcaaataattaaacaagattaggaaatctcaacactttgacaagaaaaatatccccaccgcaaacagcacatcaacacattactctcaaggagacgagacgaaaatgcgttgagacttgaaacagtacagaacatcactgtcattttcccttgtaagactcaatgtcactaaaaaacaatcgactccacccgaataaatcacttgctagaattttgtaacccggataatcaagaactagttgctcaaaggtagcatgtgctacggtgcatcttttattacgctactgtaagtttataccaacaggttcatgctttttaatcaataacagtgattaaacagtggcattgcgaatccgaattgcgaaacagtattagcactggtatgaaaaagaatggctgagggagaagaattgagccctaacctcctcctccgctcccgcgttcctggcagctcatcgacctcccgaccttgccggcggcgcgttcttggtggcggctatcgttggccaccttcgccgagtgaaccctgaatccggcgccagccctgccggcgtcggggaccacatcgtcgggcgccgtctcgacatacttggcggcgcccatctccatctgcgcgatgcgcacggcgccgaagagcctctcggggagctcctcctcggactgggactcgacgaggaaccccatgtcgatggtgacggaggtgaccgcgccgagcgcgaggtggaggatggcgctggcgatggcggagctgccgatgtcgacgtcgatctcgaggtagccgtccccgccgtggtagcggcaggtgagcgcgcggccgaggaggcaggcggcgtagttgccgacggtggcgcgcaccagccacgggcccttcacgatccggttcacgatcttgaaccgcgcgttccggtacgcgtcgtcgccgtggacgaaccgccccagcagcgactccgccgggatcgccgcctccgccgcgaagtagaacaccgcgctgtacgcgtccggccgccccggcacctgcacacgaaccgaaccaagagattgattgtcacaaacaattcgatcggcgtcgacgcgcagatgcgatcgatcgggggggggggggggggggaacggacctg

SEQ ID NO: 84806 - DNA, 6704 bp, Oryza sativa
ggtttgttgtttggagcactgtgaaattgaagttgttgttcttctccttcttgagcaggaaaatggttgagcacctatcgaggatatcttcactgtgaccaggttcgatcttgatgggaagaagttcgacagaggtataattttacctggctgtacaatgaattgagctctgcgtctactatatggtttgctatgatgcctgacaatatgtctcccggagtatttgttacttgttagagctttgctggtttcgaacttaggccattttctagttcctttacattgtttagatctttgagttgtatgccgttttttgtgcttaatgttggtgcagatctttgttgaagtaatgttatccttttccatgtctatgtacagttagtcgcatcgaagctcgtagcgagcagttcgacatgtacatgcagttagatgttgctactgaggtctatccgatgcgtgctggtgacagattcaccatggttttagctcctactctgaatctggatggaactccggacactggcttctacacgcaggtgatgggccttattcaccttacaagttgattttgaaaaataatgtgccgattgaattatggaaatgccactagaatgtgttttagttcacttgaatcatgttcttgtttcctttgggtttatattcacttaggcgcatatatttaattgccagaactctgtgcatgatgctaacattaaataatgtgctaattgaattatggaaatgccactcagaatgtgtgttagttgcctagaatcatgttgttgtttcgcttgggcttatattcatttaggcacatatttgatagccagaactctgtgcatggtgctaacattatatatcatttctatctttcaggctggcagaaaaacacttgctgacaagtttgactatgtcatgcatggaaagctctacaagatctcagaagacagttccagtggtcaagccaccaaagtgtatggcttctatgaatttcaaatttaatcaatttgcattgtctagcaggagcatggtttatcataatctagtaaggcttaagtggggtttctttgctcatttttcaacatatcccagatgaacttatcctatagggttaattaaccatgctgatgaagtgcgtagttttgattattaaatgctttctttaagcttcaggatcctttaagagaactttcagtatttggttttaggaataaatggctgttttttgtttagtttgagtgcatcaagatggtcttattgatcaatctaatttttctattgtccagggtaaaaacatatcagtgcactcagttttttagcttttccaaagaaaagatgcaaaattagttgaagtgactagcttataatgattttgcatggggtttttctttgtgcactaaaggctattcttactttgatatcatgtaatgtcaacaagattaataatcactagctaaagaactcaggtgttcagtttgttcgaacagttcatatgcatcccattgctgtctgtactgtttcagctacttggttaattcaattcaagtgcatttacttaattaattgtatcattgttatgtgaatcatgttatacgaagataagtaccttcaaagaacaatttttcgccttgccaatatgtaaatctggcctacagctacacagcttgtactagactactgttagtcctgtatcaagtttatttttaacgtaatcctgtatcatgtgatgatgtcaactccctttgtgctatgaattttaatgaattgcattcttttccattctagggagatctatgcatcgtttggtggccttctgatgatgctcaagggtgacccctccagtgccgctagctttgagctggaccagaggctgttcctcctcattcgaaaggtgtagatgcactatctacctaataacctgtgatgatggttaactttcaggctatagccagcctctgatctccatttgatggtttcttgtcatgctaattgcgcaccacccctatccactcccttgggtggcaatgcaactttgtatcaaacatcgacaaatacttgttgaaacataactcatttaagcatgttatgtgaaattgtcccgttgtttcgcatttggtacactgcattgtgcaggttgtccttgtgggtatttatcagggggtatgacattgcgtgcctgaaacttcaatactcgtatcctcagctcttatgagtacaatggaccacccaatctgcagcagcagatcaatgaacaccggatgtatagctgtggctgcctggctggctggtactccactactccctacatacttttggatggttacaaagttcacatgccatttccttccaggtcctcctgaggacaggaaccagttgcagcccaggagcagaagcctttactactaccatatatagagagcaggatatgaattggggacagcttatgatttaataacctactagctcctgcaaggcacagaaaggctcaagaaccattgccaagaaacacaaagagagattgaagatggctggaccactgtctcttgaacaaaatttttttgagagctggaaagggctctgtaccaagaacaatccatggagagcagctcctactcattacacctaggaacagtactcactcaccatatatactgccacagcttttcttttcctgggatcatatcttcagagatttcatgcttcaaattttggtggccatctttattatgtgctgctaggattgtgtacatctgctatcagtactgattttgagcctacatttaatcctgtcatcaattcaagaatcaaatggctgtgctaataaacaacaaggacagaaacaaagagagtacaagagcatttatgcatgctggttcgaagagactgttgatgagtaggaacagtgtattctgagcaactagtaattaaaagaatcatacacatattgtgctcagtatggctattaactaaagcccattctgtcatggggatacaggccctacacagccacaagaaattcatgagttcatgaggaagtactatttttctctaactttctacgcagaagaatacaatcaaaatcttttacttcagagttcaggagatcacatcttgtgaagcttttggggtggaaagaagcgatcctcagacatgatgaactgcagaatcttccacttgtggaatcgaaacaaacaccccatggaggaatagctgatgagggcaattcttgtttctgatagaaatcaaaaccaacacagctagacagaatatacacccaagtgctggcagacaaaagctcagagaagaaaggagcaaatagaattcatcagcaaaaaagatattaaaaaaaatgctaatactctactttactaacttagcttatctagtccatgatgaacagaggtgatgagagcagttgagcaccagcagagaactcactatgcaactgcaacaccaatggctacaatgctgcttgctgcttaactaattgcagctcactgaccctgtatctgtctacaatgcttgccttgattgcttgttagtttgctcttcgattcgcattcgctgttgctcgtcttctagcttgggcatcgcgatggagttcttgccgcgcgatcatcacctgttgtgcaaggggttcgggcccgtcggcacgacgcgcttgtcgtcgtcgtcggagcacggtgacggagcgccgccgtgtccgccgctcttctccttacacggcacgccgccgccggcgtcgaaggcggtcgagcgtccaccacctttcgccttcgccacggcgcgatgcacgggctgctgcagggacgacgccaccgccgccgccgacgccggcagcgccaccctgtggccgtggtcgtgcgcgcggcgcctagacgacgacagtgacctggcagcggcggcggcggcgagctgcagcacgacgacggcgatgcacagtgcggcggcgcagcgtgccggccaccgccgcctcctcatggagctccacgcagaggtggcgccgtggcgcgcgcgcgcgcgctctcgagtacgcacgttcttgttgttgttgatgatggttgggaggaagaagaagaggaggaggagggagacacacgcaggtgaaacgaacactcgccgtttttaacagcgcgcagttgtggtgaccaccacagtaccacactgacaaactacggctaccaatattattaaccacactttctgaggacaattatttacttaattaaccaaaactgcgcttgccagaggacagaacacacgatggaactaaacgtgtttattattggagaatttatgtcgattaatgggatttttttcaacgcttaactattcgtcttatttaaaaaattaatgtaaatataaaaaatgataagtcatacttaaaatacttttgataataaagtaaatcacaaacaaaataaataataatttcataattttttttaataaaacgaacgatcagacattacaaacaaaaactcaaagcgacaagtattttgggacggaggtagtaattaatagctgtacatgtgtgtaagtgtcctaggatttttacagttttgcaaaaagaaaggctgcactgcaccccatgctcctggatgcagctatagctagtaccacacccaaccacattgatgagccttcaatccccttcctcctctcactttgtgcgtgtatttatgcctgtacttattccgtcctaaaataaataactttattatgatatataacatatatagtattgtgaatttgtattatcgacacctctcgtattagttttgttgagaataaatataatatttcaactatttgtctagatttatctatacaatttgatctttttttctagaacgaaaggagtatatatatctttatatctagagagagaacatggcaatggcattgcagaggtcactctcttgtgtatgcatgggccgagacgacgacggaaatgcatgccgggtttgactgccttttgcatgctacctcaccggtgagatccatcgatcgatcgatagatcaacacagtgtgcacatactccatgtgttactcgaattcttctccgtttccggcggccgtgtgaccgtgtccgtgcccataattcttcagtactcttcagttcgtattactccttgggtatctctctctctcgagagagagagggtacagtctacagatagactgtagtgtgtgcatgtgtgatgataataatggagtgctcatcggtggttggttcattacatgtcgatgtctctagggagtggactatgtacctgtccaacgataggtagcactgaaaacgtgcattagagtagcactagcaggacttactagctagcagtagcactgaagaaaatgttgctgctgctagctgcttcttgtactgtatttttcatcttcgttttcttttcttgggccgagtttagttccaaaatttttctttgaacttctaactttttcatcacatcaaattttttctacacacataaactttcaatttttccatcacatcgttccaattttaactaaatttataattttagctgaactaaacacaccccatggtgttgaaactgcactgcacagttttcatctgaagagctacaaactcaaaatacctcacgcaagctgtatatatgcactactgtacgtatactctagctagtctatactactctgtattctgtgtgtacatgtgtacgtgagcttatactgacagaccagacgagttgttaaatgatttcatgagttttgacgcagtttgctgctgcttcttggatttcagctcctgcatcgatctgcatgcttgttttagtatgggggcacttgattcagaaagagacacacaaaccgtctcgggagttacgattcgatcagatacaacaaaaattcagcatgaatttcatccgatgcttccagtttctctgaatccgtgagaaaaaccctctctgtttcatgtacatgcatggctgtcaaaatcatatcaaacctctgcttaacattgatcactcttctcttgtgggatcgagctgtactgattgaccgatgttgtaagcaaaagctgtttccttggtccatttcctgtgctgtttcttactacacgttctatagcgtttgtctgattacaattactgccatatagagataggtagcgagggatgggccggtacatgagttgcaaagcctgggcacaactgatgcatgcatagctcaaagctaaacttatttatgtttctgcctttacccagttcctttttttccctttacctttacaagaatgatcatggctatgcatgaatgcatggtgaccgagtattcgagtgagtgagacaagcatcagcaacaaagaggcctcccaaatgagctataggagatacatagtattatatgcatggttcactgcaatatgataaacaagcatatcgtatcgagatactccttcctatcataaatctttgacattctgaaacaagattttgatcaaaccttttcaaattctaacaatcaacttatatcagaataaatttattttgtttgaacgaaatcggcaagacgccaattttcattgaatagagaagtaataaactgtacaaaaagtaagtatttacaagttataaggccgcgaccctagcaaccgaaaacaattacactatcagccaggcggcaagatgccctacgcccgccagactgggctgcagga

SEQ ID NO: 84807 - DNA, 539 bp, Oryza sativa
gattaccatcaaagacaccaaacagtccaacggtctctccatcgacaccatcaattctggtgtcatagaagtcctccatggaggatctttttccaggagagctcgcataaccatagctaaatttaccatttgcactgtcatgataacacaagaagaacaacaatatcaggtaataataacagaaacgaattctctgtcaatggctatatacagatattcgaaactaacactcccaatccaaaatgaaaaatcacccatctaataaataaaaacccccatcgtttggcttttttcataataagccaaaacggcttattaggaaataaaaataaatttgtaggtaaaacttttatatatgcgttctgggtgatttaaaaaccaatgttgttaaagaaactacgttgaaaatatctcaaaatcaatcttaaaattaagtttaaaaattttaaatttggcttattcgttggctgttcggcccccaacttgcttaaaacggatcaaacgaaaacgaaatcagaaagagagatgaagcgaaacgg

SEQ ID NO: 84808 - DNA, 581 bp, Oryza sativa
ttattatttgcattactttcttagggttttcttctgatttcacctgcattttcttgggggcatttgaaaattaccattttggcttgggaggaaaacttctgggtgtgacaggatcgacctcagcgagctttggaagcagggcgcccagcgcgtgatctcatcggccatcaagatgtctaagggacaccggtttttcccaccccttaacagaatgccgttgccgctatcaccctttttgacacccttcttaaccaaaacgagctcaatcaatccgaccacgttgtcaacattttgaaccaaacgaagaccattattgcggcttcggtcccagttaacttcgaaagcgttcacacgccgactggcagtcgagttccccactttcgatctcatgactaccgtcattcaagccttaacattaccggcgcaggatccaaccgcatgagcatgggtcacgacgagcggtctgttcacttacctcccgaccttcatagggagcgcccagtggaacggactagctcaccaccttgttggcggcccatcgatcttcgcgacacaatcattcagcgccgagcaggttgagg

SEQ ID NO: 84809 - DNA, 607 bp, Oryza sativa
acaccgaaatgcactactcgcaaagaagtgcatttgtgtgtcatcttttcagtactgtacagtgtacacattgcatgtctagtgaccagtgacacgggtgtgacagggaaggggggcctgattgtctggatcttggtgtcctctctctgacactccgatattcatcttcaattaaatttaggtctctcaccaaaattttagtctctgagaggactaaagtttagtccctcccacccaaacatcaccttaaatcgtgtaactaaagattaagggactatttagtttacgaacaaaaacttttggcgtgtcatattggatatacgaacacacatttaaagtattaaacatggattaataacaaaacaaattgcagattccgtcttaaaattgcgagacgaatttattaagcctaattaatccgtcattagtaaatatttactgtagtaccacattgtcaaatcatggcgtaattaggcttaaaagattcgtctcgcaatttacacgcaatttgtgtaattggatatttttaatctatatttaatatcctatatatatgtccaaatatttaacgtgacggagtgaaaaactttttgtttcgaaactaagg

SEQ ID NO: 84810 - DNA, 580 bp, Oryza sativa
cttgggcatgtattagaagactttacaggcatgcgactgaaagtgctattttggcattctcagcttccctctccgagtttgaactagaccagacaactatccgtaagatggtcatggaattaagagaacatgcaagaagtatagtagaagagaaagctagagaagaagctgggaacgttctgatgcgtatgaaagaaaggtagaatctgctactattatttttggaggaaaacttagcaaacatatcttgacttttcagggatcacacttaccatttttggaacatttatcttatctctacctgtttaattggactctaggttttccactgtgttgagccgtgataaggattccatgcctaggacatggaaaggaaatgaagatatacgtgcaatcactagagaagcacgcttagcggtatattctttcctgttgatcaatattgcactcatttatcctgatctatgctgtagaaacatgatctatgtatcgccttcccactgcagacaaaagacttatgtcggtaatggcagctgtacgtttggacgataaaccagataaaatagatcgggctctaacg

SEQ ID NO: 84811 - DNA, 697 bp, Oryza sativa
cctgcagcccctcaagctgtaacacttatttctcatctccctaatctctggattttcctcttgtcctggctcatcaggcttgggcttgatggacgtcagatcggacagtttcatctcatgaatcccactatagaaatagctatgaaactgcttttctaaatcagcccaactgttaattgatccatatggtaaagaagaaaaccaagtaaaggttgacccagctaaagacaaccgaataacctaactttcaaagcatccacagccgatgcttcaccacattgagctaaaaatcggctaatgtgctcataagttgatgtactatcttgccatgagaactttgaaaaatctggaactttgaaccggttgggcaaaggaactctctcaaaccacttaggatatggctgccgatatagatttccagcatctttcggcctaagcctgaactgctccttcatgacatctgcaatcaaatcggcccatggccactattgaggtgtcccttaggttgttgtggcatcggctcgaattggttgtattgaagaacaaattggggtgagccgatcctgcttgctggtattgaacatgaggtgatggtggctgatattgataattcaaattgccccctggtaattttgaagatccggctgaatattacgcaccaaatgttcaggaataactagcggaattaccgtgccat

SEQ ID NO: 84812 - DNA, 678 bp, Oryza sativa
  unsure (1)..(678): unsure at all n locations
tagccgatgttctacaatcgatcggctgagtccaggcatctcataatactcccaagcgaagcagtctcggaattctttcaacagctctatcaacttggctctaaattctgtagataaattcttacaaataaatgtcggccttggtcgatcacctggacctatatcaattcttccaaatcatcggccgatataaaaccctgtccttgtttgtcatcgagatcactaccgtgtccttgatgtagacatttgaaccctccacaacgccctcgaaataacagcttgggttctccatcttcaattggctgtatattagaatcggacacttttagaaaatctctatcccaaacttttccagataaacaatcgagaccatccatctcccaaagagctaaatcagcactagcaacattgactgacctgtcggctggcacaatctcaatcttgtcgtcttgccactgaatcaagcattgatgcatggttgaaggaatgcaacaattagcatgaatccaatcccttccaagcaacaagctataagaaccattcccatcgatgacaaagaatgttgtagggatagttttgttaccaactgtcagttccacattcgaaactcctttggtttctgatagattgccgccaaagtctatgagcaccatgnttgtcttgatgagatcttcaacg

SEQ ID NO: 84813 - DNA, 709 bp, Oryza sativa
aaataatcagtcgccaccaatataaacttatgtccttgactcgatggtcgacttatcataccgatcatatcaattccccaacctctgaatggccatggcttaataataggattcatagccgacgccggcgctcgctgaattgctccaaacttctgacaatcttgacaccctttataatatttgaaacaatcttccagcattgtcggccaaaaataccttgcacgccgaagtaaccacttcatcttatgagccgattgatgagtaccacaaattccttcatgaacttcgccgattgcaactttagcctgatcggcactcaaacacttaagtaacactccatcaatcgtccgatagtaaagctcatcatccaatagagtatacttcaacgccttatatctcaatttcctagaagctgattgagatggattatgtaaatattgatgcacatcatacctccaatcaccggctgttattgctgcaatttcagccttaacatctttgatcatcggcttataccccgatgccccctgggccaaatcattagcttcaatattttgttctcgagacacatgctttaaagtaaccagccgaaattcctgcatcagttcttggcacttctcattataaaccattaatgtatcactcttgcattcatatcccctgccaattgactgattaccagcaaagaatcccccatgatttcaatagc

SEQ ID NO: 84814 - DNA, 514 bp, Oryza sativa
ggttccaaaccgactttgccgccctttaaaccaggcgccctcccttcctctttccccccccccccaatgggccccgtttctcgtccgcgccattgccgccgccttccgagctctgtctcgcctccgccgtcatcgccaagcgccgggagagccggtgcgttcgtggacgcggaaggggactccgggcgcgccctctccttcctcttccccggcccgaggccggagagatcactcccgcgccgtcggcctctcgtcacagcgccccacctcatctcggtagtgcctccctccgttctctctcctcgctccatctcctccccttagactcgggtagtagcacgtgtagcctccccgtagctagccggcgccgccccgaccgttgccgccgctcgccgtgtgctcgccgccgtcgccgcccgtgctccgtagcacccgctcgtcgtcggcctcgctcggcgtagcttcgcccaatccgacgctagcaacagattcccgtagccgcgtagatgctctc

SEQ ID NO: 84815 - DNA, 1300 bp, Oryza sativa
cgcgaagcatatcttctaggatctgatttagacgctcggtctgtccatctgtctgcgggtgatacgcggtgctgaaatttaatcgggtatccatctcttcttggagcttcttccaaaagtgagaggtgaattggcttcccctatcggatacaattttcttaggaacgccatggagactcacgatcctagcgaagtagagctcggctagtttgttccctccataggtggtcttcacaggaataaaccgagctaccttggttaatcgatccacaactacccatatagaatcatatccaccttgggtttttggaagtccggtgatgaaatccatcccaatttcatcccatttccattcaggtacttggagaggttggagaagtccggctggtcgttggtgctctgccttgacacgctggcaaacatcacaaagggccacgaactctgcaatttcccgcttcatactaacccaccagtatttctccttcaagtctaagtacatcttcgtgctgccagggtggatggaataaggactttcgtgagcttcctgaagtatcaactgtttaagttctctgttatctggaacgcatacccgatttccgttccatagggttccgtgttcatcctctgtgaaaccagcggctttaccctgtttcatattcttgaggagcccatgcatgtctggatcattcttctgagcctcgcggatttgatcgagcaaggtgggcttggcttccagcgcagccaaaaatccgcgactaactatgcttaggttcagggcttccatctgttgattaagttcgggtggaatgccacggacgttaagagtgttgcaatggcctttttgacttagagcgtcggcgaccacgttggccttaccaggatgatagtgaattcccacatcataatccttgatgagttctaaccatctcctttgccgaagattcagatccgactgggtgaagatgtatttcaaactcttatgatcagtatatatttcatagcgattcccaatgagataatgccgccagatttttagagcatgaaccaccgcggctaactccaaatcatgggtagggtagttgccttcatgaggccgtagctggcgtaaggcataggccaccacatgaccttcctgcatgagcacgcaccccaatccttggcgcgaagcgtcacaatacaccatgaagtccttgcgagtatccggcaagattaacactggcgaggaaaccagcttttcttgaacgccttctcgcattgcgggctccacacaaatttctcttctttcttcaacaactgtgtc

SEQ ID NO: 84816 - DNA, 675 bp, Oryza sativa
ggaaaggccagtgaaaatcctggacaccatggagcgcgggaccaggaaccgagtaattcgtttttgcaaggtccaatggagcaaccacgccgaggaagaagctacctgggagcgtgaagacgagctgaaggcagcccatcccgatctcttcgccagttcttccgaatctcggggtcgaaattccgtttaaggggggtaggtttgtcgcatcccaaaacgactctaaaatacatcctcgaaattatgcctagaaaaaataaaatccgtgtgaaagcctccaacaattaaaatgtgcaaagttaaaagtcaaataaggcttggaggatttttgtatatttcctaaaagcctaaaatgcgtaaataaattttagtggaattttcagagcacaaacaataattattaagaaataaacaaagttaaaatgattttataaaaagaaaagctctaaaaagtcctttttccccctccccctcttgggccggttcggcccatctctctccctctctctccgcttccccgcggcccattcggtctcctccccgcacgcgcgccgttgacgagcgggcccgcccgcctccctcgctgacgggtggggcccacccgtcatccccttcctcccgccgttcccgcgcttgcccgcgccctaacgccaccgccggcgggaatccggccgt

SEQ ID NO: 84817 - DNA, 1269 bp, Oryza sativa
taattgaccctttcaattggtatcagagcctaatctactaattaggcttaaccgcttggagagatcatgtcgggccaaacgggggatggcaaagatggtgataagggatctacgtttccttatgactatccatccacatctacctcttatgtgagtacctatagcggcaaagcttcgtacttcaacggcacggactatgccgcttggaaacataagatgaagatgcatttgaagtttattaacccatctatttggagaatagtcgaaaagggctatgttttgcaaaaacctgaggatcccaccaaggaggatgacgagaacgagcacaagaacgctcaagccgctaatgcaatacttagcgccttgagtggaagtgagttcaaccgcgtggacggtattgagagtgccaaggtgatttgggacacgcttcgaatttgcatgaaggcacggatagtgttcgcgagtccaaggtggagatcctcaaagggcaatttgagaggtttgtgatgttggatggagagagcccaagcgacatgtatgaccgtttgagcaagatcgtcaatgagatcaagggacttggctccaaggacatgaccgatgaggttgtggtcaagaagatggttcgagcaatcactccaaggaactctaccttagtaactatcattcgtgagcgtctggacaacaagactctcacacctcatgatttgctcgggcgcatcctagcccatgacatgcttgtgcaagagtccaaggaggtcatccaatacatcaaccaaagctcaacgacaagcatcaagaaggaagatttggcattgaaggcaaaggaagaagaagaatagagccgcaagagcaagagcaaggaggagatcgatgatgaagaaatggctctcttcgtcaagaagttcggcaagttgatgaggtgaagctgcttcttcaagggaagttcttccaagcaccactccaacaagtcaagtggaagacattctgcagggtgtgctacgtgtgcaaagagcccgggcaattcattgcggattgccttacctcaaggatggttcccacatcaaggaagataagaagggcgaaaagaaggatgagaagaaggagaagcacaagcatagcaagcgggaacgttatggccaagctcaccttgggatgattttcggttccgactccgagtcaagctcaagtgatgaaggagttgccacgtttgccgtcaagccttcatcaccaccaagactcttcaactactcaagtgatgaggatgctccc

SEQ ID NO: 84818 - DNA, 783 bp, Oryza sativa
  unsure (1)..(783): unsure at all n locations
cggactgggannnagtgagcttgcgatcgtattcctgcagcccttcccttgattgctttgacagacatgcaaattggtgcccatttgtagtttatgccaaccgggtgtagggtaatgcctaccaaaaaaaaaccatggcttctctttttttcaggatgttaaatttcaaaaattgtggcctattaagaaagggcctgctattcatattgcgttcttggctgtgttttcatatatgatatatggaaatggttttgcttactcaacaatccatatacatttctaaactgtgacacctattgtttggtacactcaagttctacaaaacaattttgtgcaaaagtatgttactactattgcatataagtacttcaatttatatacttttcgtgatacactgaataatatatttgtcttgtaatttgatctgggcgttgtttatatatgacctccaaccattcctttttggcactgtatatgtattctttagaactcattctcaacctgttttaggtgaggaaaacgcttaagaactttttcctaggaaggaatgatctatacctactacaagttgacacttccaaggtaacgtgtgtcagtgtatttaaactccattggatgtagtcacataatagatcattntaaattaaactagttgcgcggctagcacccatataaaattatatantttttaatatgatttacttanaacttatagataactatcttgtggcttagacttagactttgaaagacaaactttatatcccttgttttaatttatag

SEQ ID NO: 84819 - DNA, 788 bp, Oryza sativa
  unsure (1)..(788): unsure at all n locations
cctgggaannagtgactgcgatcatttctgcaccctatgagtgtatgaacagagactaaattctttgattgcttggggaccatgaattatatttttaagaggtaagggactactaggggtaggaacaatggtatgaccaatatgttaaatattcataccttcgccactagcagtgtggatctgatctgttcccttgtacttctccatgtagtcacgtttatctagctgccctgtgatgtgatctgttgccccggtgtccacataccaattggtgtcaacaccatacgcatatgtggccgcgtcgcctagcttctcgtcggagacgtacttctcatcatagcggtgccagcagtcacttgcaatgtgacctcctttatggcacgctcgacacaccgggtgggtgtccttaccgcgccctcgcccagtgttggccccgactgcgccaccacggccggcactgcgaccggcgggaggagcaccgaccgcgatttccaccgcgaccaccacgaccgccacgatttgcagcgtttgccgaaatacggaggtaagtttggcgaatactgatcctgttttcatagctcaaaagttgggaatacacatgagagattaagagaggagcaattcttgtcgctggcatcaatcctataaccgatgagtcaaagtctgagtcgaagccgttgatgatgtacgctatcagctcttcatcgtaaggagctttccttgccccgtcatctcatagtcaaaggatcgcatcttggcaatgaactcacttatggacatgggtccct

SEQ ID NO: 84820 - DNA, 764 bp, Oryza sativa
tgagtgatgtatcttgtcatatgcatatgcatgaggttatattgtgatttctaatcttttgcatagattaagggggagctctcatattcttttctagcttatctttagggggagctccacctaaatcctaatcttttattatttctaattgtgttgtcatcaatcaccaaaaagggggagattgaaagtgcatctaggacccctcatttattttggtgtttatgacaacacaattagaggttcactaatgctctttgttgagatggatgcaaggataaaaaggagtggaacttgaatttacaagctttgcggcatattttctggtaattgtcttctattccatgtatatcttgtgttttgtattaggatgccgtactattaagagggataccacatgcatataattggtagaacactagttctcaaaatcctttatttggactgttcctattttattcctgtcagactatccgatcctgatcagactatccgatgctcagactatccgaaatttcttagaactttgccctctatctttggtctgagtgttggctaaaaaatatcggactatccgatataaggtcggattgtccgatacatcggactgtctgaactttctcagaacttcactctctgtcttgaattgctttttattcctcttgagtgatttttcaaatcagacaatccaatgtgatcggagtatcggatgacccagagactccgaaattcaatggaacttgagtccctgtgagaggggctgcagg

SEQ ID NO: 84821 - DNA, 789 bp, Oryza sativa
  unsure (1)..(789): unsure at all n locations
cggatggtannttacgatctgccatcttagtactgcaccncctaccccttcctacctctctcctcccgttctctctcctctccatcatcttccccatccttcttcgagagccgcaactgggtgtgggcggcggcggcggcgtttactttggcagcatgcgggggtggcgagcgcgggccacggcgtgttggcgtcggctcgcgggcggcggccgcgttctcaggcggcagcgtcgacaggtggcggcctaggtggcggcgtgcgcgagcagccggggaggcggcggcgtctacagtcggtggccagaggcggtggcggagatgcgtgggccaaccggcggcggtggctcgcgggctgaccggtgccagcggcttgcgggctgcccggcggcggcaacgccagggtaacgcctacaaggtgttggacgaaatggcgatgagggatgtggtaacgtggagctgagtaatctagccaaacacttttttacctacctcaactcctaaaggagccagctctcacttggagttgaagtttacagttgtgagtttgaattaggagctctactaaatggcgcctaaatatgaaccaagaatttgattttaaatttcttaattggctttgcactataaaaggccttgaaaaagccaaacttttggacataattacaacctattatctcgcttacacttacccttgaagccaaaattggtgacttttaaatttaattttgggaatggtcttcggggcttttccacatagtgtatcttatagcccatactgtaaataaag

SEQ ID NO: 84822 - DNA, 760 bp, Oryza sativa
  unsure (1)..(760): unsure at all n locations
tgttggannagtgactgcgtcatgtctgcagcccgtctcctcagctcctcgggagccgctcgaggcccccggcattttttaaaaggccttggccaaggcccccttggttggcggcttacttcgcgttttgcccgccccaaaggcccgcctgccgcccggcgcggtctaaacgggagacggcgtcccgaagcatgccgggccctacctcgttcgccaagcggagggcctcgacctccccggcggacaagtccagcgcgccctgcagctcggcaatggtgtgttcggcggctgcaaggcgggcggttaggtcgccgtggcccgtggccgccccgccgttgtgcgctttcgcgtccagctccttcgcccgcgcttcgagctcacgggcccgttgatccagtggcgccctttcggggcgggcgctttcagaattgcggggcgcctgctcttccgcgctggctcgcggaggaacaggctgttcggccagccctgggccggggcctcggcttcttaaagctcgccccgctcgggagcgcctcctccggaggcgagtgcgacttcttttcggcgcaagcggcttgtgcgccgccaatgttggcttccgggtgcgaacggggacttccggtcccccagtttttttcttttcgttcaagggcgggggcccttcttcaaacccaggggggagcctaaaggcttttttggcttccggaccccaattttttttccgcccccctttcccggcagggaggttgaaggatttcac

SEQ ID NO: 84823 - DNA, 581 bp, Oryza sativa
cttttccaaccaagccattgtacaacaatcgttttgcaacatatacttatacagaagaaattctccaagaaaatctgttcgagaaaaaagaaaccggaaagagttaaaagcacaaatgttagccctgccccccagcgcatgcagcacgcccaccctgatcaggtgtcctgcacgtctcagccatcacacatatttggtacacacacgaacgtacgcatgcatgaatgtcacctcggatcctctcgtgcaaatctcccatgcacacgtccatgcatcgatcccacccttcacgccatgtagggggctagggtctttagaccttgaagccgaggaagtgcggcgtgccggtgaacttgagccaggtcccgccgtcgacgaacggcccggcggtgaactgctcggcctccttctggccgatgacgcggaaccccttccagttgacgcgcttgctggtgccggcgccggggccgcggttgttgaactcggcgtagtaaagcgtgttgagcgcgaattcgccgttccatggcatgtaaccctccggcttgatgaagtcggcgatggtgctctccatgatgacgagg

SEQ ID NO: 84824 - DNA, 890 bp, Oryza sativa
aggaggaggaggaggggggcagtgaggaggagtcccgcgcggttgttgtcagggagccctcctccacggcgcgcagcggccgggcgaggagaggcggccctcctctgtatcgtacttatctacttattatctacgtgtaccgtgtttatcccatctgttttcccctttatttcttaccgctgaactaatttcccaatctcaaaaggcaggcaaaattacttgaaacagtggcggcggcaacccactgatgagctccggccctccgtggatggtggacgagcgcgcttggctggatggtggtggagcgagctggagaggacggcggccagccaccgcgagcttgtgtggaaaggaggctcgttttgcttcttcttcatccaacccccgttcttgtctttctctttgttgcttgattgtcttcccctggaatcgacatcaaaaaggaatttttctcacagttttcccgtgaccacttactgtgatcaataggaaaggaaaatggcgccttcaacacgcggaagcggcgagccttctcggcggcgtccttgtacgtgcgcccgtgctccggcatgcttcggccgccgttgtcgtcggagctcggaggcggcgggagtgaggaagaagagggagagccgagaggggagagggaatgacatgtggggcccacgtgggacccaccattttttaagctgacatgtgggcccgtggtttttattatttttcgagatataattgccacgtaagcgccacgtcaatgccatgtcagatcgagacggagtcaaattagccacgtaggcgccacatcagctaaaaccgccatcaaaaccaccgagtgacctaatctgcaccggttttaatagttgagggaccgttgtatctggttttggtgt

SEQ ID NO: 84825 - DNA, 538 bp, Oryza sativa
tgcaagccggaagaatcccgggcttttctcttgccgcaacttctctatgagactgaactggctagtgaaaaattctcgtcttttcttcccccatgcgtcttattgcaaatcaacgcatatcatattattgcaccgaccgacaccgacaatgtcacaacttacagcagatgaagcgatcgaccaatgaccacatatgatccatgtatagtcacctaaactagaacgagaacttgtacaccatctcgtgcttgtacacctgtccgggcctcacgatcaccgacgggaagttggggtggttcacggcgtcggggaacccctgcgtctccaggcacagcgcgccgtactgcccgtacgccttcccgcccttccccttcacgtcggccgtgaggaagttgccggtgtagaactgcaccccgggctggttcgcccacagctccagcgaccgcccggacttgccgtcccggacgacggccacccgccgcagcgcgtgcgcgtgcgcgtcgacgtcgtcaccgccgtccacggcgtagttgttgtc

SEQ ID NO: 84826 - DNA, 601 bp, Oryza sativa
agcatcacttgctacaagcacatcatactcattatcctgctcattaaacagctttgcttgctgccgccgtgtctctggtggaagagctccatatataacgcaacacttgtgcttcgtaaacttctcgattgccagtttcacctcaaatatctctctgcgtgaaaacgcgacaatgcagtcaccagagcgcacattcttgaggtctccaagcagtgtctttgcttcaacaacaagcggtttgaagcgctcatattgatgcacctccaaatcatctccagtatctgcgcaaatcttccgaacaatcttcagaacactagggtcaccacagagatgtatctcgtctgccttgagcccaagaacggctcgtgtccacgcatagcccctgacagggtcagccatcatctgtatctcatcaaccactgcaacctcgtagggctcctccgtggagagcatttcgatcgtgcacgcgacgtggttggagaatggcacctccttgatcctcttgtccgtgccgaggctgcagtagacgccccaggcattgaccctgtcgaagacctccatggcgaggagcccgagcgggctgcagtacacccccgacttg

SEQ ID NO: 84827 - DNA, 651 bp, Oryza sativa
ggagatcatacaactccagaatatccatgaaaaaaatagagaatggccggaccagccccgccattgcgaaagagaggaagaagacggaccgccccgggtagtgtggcccgggcgtccctcgcccagcgcgaccacctcccggccggtggcagattccggatgaatcggcgcggcagcccggcctgcctctcgctcacgatgcgggaaggcggcagcacgctaccatcgagcggtgcggagccccgtgccatgacgccggtggaggaggagcttgagagcgagcgagtgcggcaagggtagggcacaggaaacgaagagttagagcacaagtggcgaaggcaaggggaagagtggcgagaggaaagaaacgaatccctttctcggcgtctttacacccttgccaatgctatgcccggctcctcgcttcccgcgcccgctacctcgccccctcgtttctcgcgcccacgcctccactaaccccactcgcccgtttgcggcgcacgcggcagatgtgcggccgtagcggttgagatggggcagatcgtgcgcgcattaactacgcccgccaaccgtgaaaagcgccatcatcatgtctccaggcgaaacgaaccggctcgtcccgattcgcgcgctgctcgagtaatgtagcag

SEQ ID NO: 84828 - DNA, 2806 bp, Oryza sativa
tcggtcgaccggggtctcgtgcactacgccaggagcatcgccgacgccgcggtcggtgaggtgcctcagtggagttggggctccgcgttgctggcggctcagtaccgtggcctctgcgaggcttgtaccaggacggaccctggcgcgatcttcggtgggtgccctctcttcatttctctttgggcggctgagaggattgcgatcggccgcccccttgtggagcaccacccttacgacgcgtcgctgtacgagaacagaccggcggtcgactacccaacgatgggtactctgtggtgccggcgtcaggtacgtcgctagtatttggtaatgttgtcctactattgttaacttcatcctacgtcacactgaccttattgtattgcagcgccgatgggctcacgtgcaggttaggcggtcgtacgcggagtttgtgatggagttcgaccgccttctgccgacggacgtagtgtgggagccctacagtgccttgcttacccacagtcgggcgccgctaggcctgtccacactctgcacgagggaccaggcgtactggatgactacggttccgatggtgttcgacatctgtgtcgagccgcacgcaccttaccgcgtgatgcggcagttcggcttccgtcagtcctttccagtcccgtttccggcgggcgtcacggctgccgttcaccggtaagccgttttactacgatttaatatgttgcattaacatcgggctgtccataataatttgctttgtttgtcgtttgccctaatacaatacattaatttgcaggtactcgcgcaagggtcagcactcagctggtcactggcctgccaagttggggccttttctcgacgactggttgcttgctaccgaggaggtcgtggaccacgcgggagagtcacacacggaggaggggtatgaggcgtacctacgttggtatcagccacgcacccgtactagagtcacctacgctccgacggagcaacaggcccacgccgcgagcgccagagacctctacgccaggcaccgcgaccaggacttcgctcgtgcggtgagtaccttgcatcgcacatcgtctcatcatcctttctgttggacaaaggctacgaatatttacgttgtaattaaccgtgcaggccgttgagtgcaacagggtcgtcgttgatgctacaacggcgatccaacggttaggcgcggggattgaggtgggggcagacgagcacctgtcgacgtacacgcggatacgggactcgatgcgctcggttctccgtgcgctgacctgtcgtgctgccgacgttgctcaggcagacgcagcaccacaggtgcgtccccgaccgactgctcctcgtccagctgcgcacgttcctaggccgacaccccctcccttcggaggtacgtatattcaaggtctatttgtacatcatcaatcaattgatactcaatttatgtgtaagcttacaagtgtcgcgtcgtcgatgtgtaggcttcgctcagcctgggacgacgccgggcgcccactcctggcaggctgcggggtcatcgtcacaggcaggtgtgtcggcctcgctgtctacacagttttggcaggacgccgggagttcgtcacagccgggcggcacgtctgttgcgtcggcctcgctggctgcgcagttctggcaggacgccgggacttcgtcacagccgcccggcacgtcttggcagggtcctaccgggacttcgtccgagcacgggtgggcttccgccacgcacttcgaccttagtgacttcgacttcccggacattatcggtccctcacagcttggaggcgcaccgccggtgcacacgcaggagcagtcgccctccaccccactcccagaccctcgcgctacccgtgctgtcccaccggatcgcttcacgtactcccaggaccacgtgcgagcacaggcccggaggaccaagcggggtcgcggcgcgagtcacggccagtagagcagacatctctttatttttctttacattcttgtactatatggttgtaaactgaatatgttgttgtttatattcgggactcgcattcctatacttcgctgttacgttttccaaaaacaggagtcccttccagccgttgtgcagaggggagcagtgaaggaagctgccgcccttgcagagggcggcaagccctcggcacaccgcggcccgtgcgcgccgtcaagacgcacacggcgccgtgtgccacgtcggcttgccgccctttcaaagggcggcagggtctagttttgcaaattttttcggcgctataatatttctgtaaatattaaaaaaaaaaaatctaaaaacaaaaaaaactcgatagatagatagtgtgaagctagtgttgctagtgttgagtgtaggcatgtgtgtatttcagcccaacagggcccattacaccaatgtatatgtatagtagaagagagaggaaatagtgtgaagcttctggagaaaaacaatcacctagcaacatggtatcagagggcgaccgcgtcgaggctaaaccctagctagcggcgcgccggtgtgtggtgctgcagcttggagcaacggagtggtggcgttgacagcggagacggcgacagctgctgcagaggatctcgccgcagccggcgtgaaggagggagcagggtgtgcgctcgctggctgagccgcgcaaggggaggacgcacggcgggtgagaggcgcactgtacgagctgtcgtcggcggagaaggggaggtcagcgacgcagcggtagagcttcgcggctgagaagacagagaagagcgaggtgtgcttgtgctgcttggatttggg

SEQ ID NO: 84829 - DNA, 1515 bp, Oryza sativa
tataatgacaacaaatttggcggaagtttacaactgggtgatgcgcggtgtccgtggactcccactagttggtatagtggagttcattttacatgggacatgcaagtatttcagggagcggttccaagcagtttttccctctatgccgaacaacaacattttatttggaactttcatggagaaaaaactagcggagtggcgtgcaaaggccatgaaacatcgagctctagtgcaaggtacccaacaacacaggtttgaggtactctgccaagacaaggcaggcaggggtatctaccgcaagagagtaaagcaggagtgcgttctcaaagacgacggcacatgtcactgctcctgtagaaagccgacgctgctccacaggccatgcacccatgtcatttccgcggcatctgagtgtggcatccaagatgcagtatatgtgtcacaatacttctccaagcaagcaatatatcacacatggagtggcgagatttttggcttcggtgtagctggggagttcacaaagattaacgatccgataatctatattcctgacccaacgaaactccgagacaaggcgggacggaggaagactcggcgcatccgcaacgatatggatgagtcggaggcaggcagggtgaagcggtgcagcaaatgcgatgaacgtggccacacctacaagtattgtcctaaagacaaggaaaaaccaagtgcggcggaggcaggtctatcaggatcagcagcagatggagctcgccctacgggtgaaggcactacttcaaggcgaccccgtcctagacgttctcgtggaacgaccggttacgtggtgtagttcgtgtgttgtatgttggcaaaaggctttgcttgtaatttcgttcgaacttatcgatatgttcgcattgtgttgtgttgcgaaccacttgttagacttccgcatgtaatgtcttcatgttttacggcttgtaattttgttttatgttatttcattctcgttacgtgcctttgtgtaacgaaagttatgttctcaataatctgcactcttgcatgtctctataagtattcttccgtttcagataacttgtttttacaattatattattaccttcttatttaccctaacatgtaacacgttacttgcagagatggcacatcctgagttgttggatccggcgatagatcagcgccaccggtcgtaccttactgcggtggagggggctcagcttgggacgttccgtccacggtcgtcacgtgagcgacttttggttcacgactccttcgtcgagaggtatggttttactgtattcacgacaccgggcttaccttactacggtggagggggcttagcaatgtgttcattttaacgtctggtattatttcgctttcgcaggttgcgtgaggccggtctcttaccgttggctcggctagttgaggccgcgaccggcgacgatgacgtgacgagacgttgggacccggacaggtccctcctagcagcgttggtcgaccggtggaggccggaga

SEQ ID NO: 84830 - DNA, 804 bp, Oryza sativa
ccttgttctcaatcacctccctgaagactccggacatgtcggacggctgctaggtaaatacatctgcattgtcatagaggaaggtgatgagcttgagttccaatttgcagtcgagctcggcgccaatcttggccgtgtttgtcaagtgtgctactagacagcgggattatctttatggcgtcgtctggtttgggtgccaagttgggtttgctcactttcccaggaggctcgattgtggcgggactgcggtagtttgctcgactatatcaaggctcatcttgtcacattgcacggccatcttcgcgttccctggcaccgtgattatccttttaggtcccggaatcttaatcaactggtaggcgtaatgcgaagccgccatgaatttggtgagtgttgttattctgaatatagtgttgtaggcaatatcgaactctgctacatcaaaatgatatgctatgtctgcaagttgtcaactctgccaaaggtcacgggcaatgtaatcttcccccaacaaccttgatgatgactctggggtaatgccatggaagggctgttctgaggggatgagctcgcttctaggaatccccattgcgtcaagcgcgctgaggaagaggagattgattgactgccaccgtcaatgagaaatcgcgcgactagaacgttctgaatagtaggcttgactactatcgggtatcgtccaggggttgtcgtcagagaagggtagtcgatgtcagagaactctatcttctgatttgaccaattcatcttagacgtcgatacccgagatgtagagcatacttcgtg

SEQ ID NO: 84831 - DNA, 777 bp, Oryza sativa
  unsure (1)..(777): unsure at all n locations
agtgactgacttctttcctgcgncccctcatcgtagcgatgccagcagtcacttgcacatgaccttttttgtgacagacttggcacaccgggcgagtgtcattgccacgccctcgcccaggattggcaccgcctgtgttcccacggccaccaccacggccgccgtgaggtgcgctgctgcgcccgccacgatttccaccacggccaccacgaccaccgcgatttgcagcgttcgccgacgtggtgaggtaggcttgacgaatccgaatcctgttttcataactcaagagttgagaatacacatgagaaattgaaaggggtgcgattcttgctgttgccatcaatccttcaactgttgcgtcgaagtcggagttgaggccgttgatgatgtacgctatcagctcttcatcgtcaagaggcttccctgcacccgccatctcgtcgccaagagatcgcatcttggcgatgtactcggagatggaaatgggtcccttctgagttgtcgttagtgcaaggagaacgttgatggcaccagctttggacttgcaggtgaacatgtcgttgatcatgctccatgcttgggccgccgtctttgcgccagccacctgctgcagggacctccgtgacagggagggagagaggaaccccagcacctgttggtcctgggtgaaccacttgatgtattctggaatggagatggtggtcttgactttcttgtcgccatcttctttctcacactcgggccgcggaacttaactgggcccgtgatgtacccttt

SEQ ID NO: 84832 - DNA, 931 bp, Oryza sativa
gtgcggacaacgccaagctgcaggaggagattgccagcgcggaggaatcaccaagtccaaggacaactctgcttcactctggcaagctctgcactagaactacgggcgcctcgatgtggccgcaaaagggcctggggatgagcgttcctcatcccgagtttcctgacgaaaccacggtcctggtgtcccttgggtcgctgataaccaagctggagaccgccgcgagctcccatgcagaccaagtagacaagggaatgaggtctaggatccagaccgacgcatgccacgttcttatgtgcctcaaactcacacgcccggaggtcaacattgaacaaatgatgaccaagggaggagccaacaagcgtcgcgaggacatgatatcagaattggaggatgtcgaggagtctgtgatccccttttttgaagagtaatatgctaattttagtttcattgcaaccttaaggacaagtatttcgtctgttgcccgagaacacttcccttctgttatccttttaaggtttccatcttgtcttttgtattctgtagatgctttgaagtcgagaatgagaacgtccagcaaggcggacgctcgtcaggcttaattgcacatcctagtacgccctaggcctcgtcaaccccgagtgatggcgaccgtgctctggtcgtcgtcacttctgatggcacgttggcctctcaagatgatcaactcacgctccttcgtgagaaatatcaaggtgcgaaaacccgaaattatagtgtattgctcctgtactcagaacaaaggatgctaatggtgtcgctgtctattctagatcttaaacattctctcgaggagatgaaacgctgggccgagtactggagaactaagttcgaaaagaaagagccggagcgagcaaccgacaatatcaagaaaggctagaactcgaagctt

SEQ ID NO: 84833 - DNA, 788 bp, Oryza sativa
  unsure (1)..(788): unsure at all n locations
agggcatggcgccctagttgggttaaatggaggcttggagaggaggggctaccccttatttaagttcctcaaacgctccgggcccgtttactaagacggagaaggttgagcgggctttcactcagttgaaggcgtacctcagttctcccccagtcctggtcgcccgggagccagatgagccgttgctactctacctggcggcaaccccgcaggtggtcagcgcggcgttggtcgtggagcgcgacgaggacaaccctcactccgcgcatccccaccntgtgtcgactcgacccgggagagagcagggaggagaggcccccgagccgaacggcggcccgaggcccccgacggccggagctggccctccgcctgcttgtccgacggtgccaggtgcccccgacccccaggatggccccggggccattgcgggaaggccgcgcctgtcgccctctaaccccgaggtcgtcggcacagaagccgagtgcgccccgcgtggcctctcggacgaagagcgccctggagatgcggcccctggcgaagaggatcggccccgccgaaaggtgcagcggcccgtctacttgttagcgaggccctccgggacgccaagacccgataccctcaggcccagaagatgctttacgctattctgatgacttcgaggaagttgcgccattatttccaagcgcatcgggtcacggtggttacgttttaccccctcggccaaatcttgcataaccgagagggtactggacgggctgcaggaaagacgtcagtcactnntcaccacc

SEQ ID NO: 84834 - DNA, 751 bp, Oryza sativa
tcctgcagcccctttattgctattgcgattttaaaatcaaacatgattattcttttaccttttagaagtcctgaacctttaaaaattggacctcgtagtttttaaagtttattgtctcgttgggtttcattttttataacttttagaagtcctgtcaaacactgccactatactactctacgactcgtctgccgcttactctttgttgtcattgggattgtaaaatttgaacataactatcattggaattcattttttactttctagaagtcccaccaaccgtcgacggctctgccattgtactcttgtacaacccgcccgccgcctcttctttttattgccattgagattttaaaaattgaatattattatatcattatgcttttttactctctaagaagtcccgccgaccgccttgacctgttacttcacggcctacgcgttatccctcctattaatcgtcattaggattacatttggtgttttattaatagttttttagatgtcacatcaaccgccaccactctaattttgattttttttattttttttattctgaatttttataatctcgtattgggattttatatggtctcttcttttaatattgcttaattctaattccgaattttagttatttttaaattgtatttctactcgaactcttcttttcctttttttttttgctaattgtggattttattttgtatttttaattgtgaataatctcgtattgcgttcttatagggcc

SEQ ID NO: 84835 - DNA, 763 bp, Oryza sativa
aatactgtcaagtgcaacgcacgggtgagcaactagtgttatataacgaggctagcaagtcctgcacaaaatattgaatgatctttgattctgttgttcgatttatgttaggaatctgttatgtcactcagaagttggggcaaagtagtgtttgactgaagaagaatttctgaattaccaaaatctacaccaaacataacaagtagttgctaaaaaaagcacagtcatgccaaacgttcaagttacaatatttcatccaaaattacagacatgaaaggaaggtgaaattccatacctcagaaaccgaaggaagaaaccatccatatcgtctgccattgtacaagcatttacctccagctgctgggccagaaggtatgaatgctatatccagtcttccagttatccaaaagaatcaccttcttcactgcccaccacccaattatcatgaccgccagcatcgtaaaacgctggatctgcaggctctccaccctcaccagcaagtgtgtcaccatggcgatcatgagccccacgagagtgtacaagaacccaaccgcaaaaccctcggcgccgagctgcatccagacccctggtagaagaacacgagcttgtttggatcggaccggtcggtgatgaacatcggcgtgtgcctgatgatcccgtacatccccccggacacgctgaagaagtaaatgaacagcgccccagccatccacacccgtcggtcatggaacaaggtctccccgtccatgatcgggctgcagga

SEQ ID NO: 84836 - DNA, 630 bp, Oryza sativa
cgatgagggcagtctcccgctcctcctccacctccctggcgatctccgccaggtccttacgacgggcctcgagctgtgaggcgtgccgccggtgtgccttgtggcccgcctccaccatggcctccaccgagcgccgcccctctcaacgcacgcccacgccgcgttgagctccgcccgctccgcctgtagggcctccatctgggcacttaacccgtccagcaccgtgctgttcgcggcggccaaggcctgcaggaggggctccgcgctcagtggggcagcggaaggcagaggggagagccccctcggtgtgggtgccgcgcggctcggcccgccgatcgacgtgccggactcgggggcgtcccccgaagctggctcgtcccaagcgtcgcccgaggggtcgggcccgagcggcgtgcccgcggcctcgtcgtgggtggcctcggaagtcgtcatcgcctcgggcggagtcgggtcgggggtttggcaggccgcctggcgtgcgcgcgccgcctctgcctcctgacggactccccggcccagcggagtctgacctcctcccgggcggcctcctccggctggcgaacccggacggcctctgggcagcctcctcggcttcccggaggcggtccg

SEQ ID NO: 84837 - DNA, 680 bp, Oryza sativa
tgtcattttgtttgttggaatggttgttggattgaattcttgatgtaccatgtgtgtattctgagctgtgacacatttatttacggttaagagggggtgctgtgtgtgaagaattgctcgggatctgaccaatttggaaatgaaattatgattaagatgcatctgcacttctgcagcatgttcttctgcctgattaacgttgcataagtgaagaagatacttgtgctacactttgcataggtgaagaagatacttattctcccattcagattcaggcaccgagcatgttgcacaagcagatagctaggcgagacgtatttaatgtatttgacatctttaattggttgtcacaacttggtgaagtggcaagaatcgcaacggagtcggatcatcaccaagttcaagctgaaccatcgttctgaactttatagttggcagctgcaaagtgttctttcaccaaagcaagagcttttcccctgtgagatatttgattcttcactgacttgggcatctcagcgtagctgtaatacacgtgtgtcagtatttgaatcaagaggggtgcacagaaggtagtacaagctatcatgaaactcacgtttgatcaaaaccatctggttggaatactgggtcccatccaaaatcagcaggtcctctagcaggcacaatctttccctgtacaa

SEQ ID NO: 84838 - DNA, 730 bp, Oryza sativa
acccacattaggctccagaggagactggattccagccggcgcttcagctagaacctcatcggcaggaatatctgtcatgattgcaggttgtgcttccttgctttcttttgatgaatccagatcttgagcatcaactgtttgctcaatagcatcatcagttttacaaatttcttcctgcaccatggtgtcattcgttacatgaccttcaacatcttgttggccatgatccttggcctctgcattctcacatttgagaatggtggtatcttctgatgcactctctccatggctaagagaatcagtcatctcttcttcattgcttttattgctcgggtaagtacttgttccatcagatgaagtttctacctgctcttgactttcctgattaatttcatggggctgctcatttgaaatattctcttctttattcacatgaccattcaaagaagacgccgtgccatttaaactatgttctgaaggaattttggtttcagagggtgcttctactaaaacttcgtcctctggaatcttcaatattccttcagttgaacccatggtttgtgcctcgcccttgatctctttaatagaagaaagcttgctgtcaagttgtgcttgcaaatcagtcgcagcttccacttgaacttcctgggaaatgtataggttaatcgaacatataaaactgatacacttcatgtgacagtgggttgtcattatgacatgtacattgttt

SEQ ID NO: 84839 - DNA, 1147 bp, Oryza sativa
cattttaatgtctaaagtgaatcatggaaaccatcattagtgatcatttacttcagaagtcagtccttataaaatttagcagttagcactgcctaaaatatgcattactattttatgtattgtaaacattttagatggatgagaaaaagcattggttgatacttaatttgaacataccttcagttctgctgactcatgtatattatcttctatcttttcatgcactgaaattacatcgccgattccattacccaaattttcttcatttgattctacatgataatcttgtagtgattttccattatctgttggagatggatcctctgaagtagctgtctgttcatagcagatttcttcatcacaagtgccttcagtgcccttcatttcttccatagtctccaagtaatgcacttgctgaataccatgagtcaactcaacagctgatagattgctttctgaaaatttctccgctgaagaaactgcttggcctgcatgggaggtttcttcagcttcaatggcatcagtatccttgacttcttccactaattctagttcatgcccttgatcaatatcaacagatgggtcaatttcatatgcaactctatcttctgcagttggatcttcaggggtgacaatgttgctttggctggatgtttcttctgcctctacgagttgattgtccttgctatctgtggttaattcaagctgctgtacgggttggacataaaaaggttggtcggcttcttgttcactgctttcttgagctccattctcagaagtggtaaaattaatttgcttggatatttcttcagtttctgtatcttcattttcttttacttctaccgctgatttattctcctgcacatgctgatcatcaacgtttggctcaacctcagtcactgactcctcacaggtagaaactccattttgctggtaatcttcagtgcctttggtttcttctgtggagtccagttcttgctcttgctgaacatcagtttcctgctcacttttgactaagtcactttcttgcactgcctcttcaggattggaggaactactgagatcggtttcttgatctgtgaaactctgcgcttgctgagtgtcaaaagtcgcctcctttactgttgtgatctctgggctgcaggaa

SEQ ID NO: 84840 - DNA, 2018 bp, Oryza sativa
cctgcacccccatcctgtttggatgtttctacaacaaattctggaaagtcattgaatcctttcttttcctttgtatcttcaacttctctgggctctgtacttgtattttcatgtgtcatttctgcataagaaattgcggtatcatccattttagtgtctgcactgtattgttcatcagtatgcacttgggatgcctcttccttttgagttgtgaccagagattcatcatggtgaacaacattgtcttcattttgcattccttgtttttcttctgcatcttcaatcactttatctgattcttgaatggcatgcatgtcaacgttgactttgtttgtgtatccttcctccgctctgtacatgtattcatcattctgtggaacagctataggattctgtacaacagataggacagctcattactctgataattatgtgatagcattaaagtaaatgaatgataacagctactatgcttttgggatgccatattcagaaatgagttaatcttgagaggcatgcaattgttgatagaaactgggaaatgttcacttagagaagagctggcactcaaaaggcttgcaggtcttttgtgttaagaactaagaagggtccatggccaagctcatagataaatctgccacttaaatgcacatgcatatactgcgaaggaaataatattataaagtagcaaaactcaagttcatctctcttcactttttgttattttgtataactttatatcctttccattttccatttcttttcactcaagatcactgtttttcgttcattcttcgaaagaaaaaaaatggtggctaacattattttcaatgtttatgaaattatgtatattgggtaatattcactacaacaaatcttacattctctagcatctggtcatttgaaaggtctgaatcaacttgaagatctctctccagagatgatgccaaacaaggttcaacctgcaagttgagcaaaagataacaatgttgttcagtataggcaatgaaacactttcaccaaaccatgttgttcagcatagatttagtcatatgaaatctaatcgcagcataagtcattctgtatttacatatttcttaaaggtacttctacttcaaaagttagtccataacaatcctctatgctaagagaagtaatcagtaatgcttcaaagtttgtattgccaaaagaaatcaaaagaatgagatgatagtgctaaaaagaattcttagttgcttgctaatcaatgttactcacccatcatactcacagtgacataagttacctgtataatgaaaaacttttttaccattttatttacatttctaatttggaaaattaacaattttcagttagttgaactagaatatgtctaaatttgtcacattgcatcaatggaaattctgtactgacctcttcatttctaatttcaccagctatttcatcatgttcactacttgaagttttttctaccactgcatccttttctgtattctcatgcacatcttcattatagtttttggcagaaacctctaaggtgccaccactatttggtccattctcttcttcagtctcttcttttatttccgtaatgttttcaaccatcgcatctgtagttcttgggatggaatcctcgggttcatgttgagttacttcatcattgagcatttcagtaaccacggaatctgtttgttcagcctgcaaaatttcattggatggtaacttactttcaccgtgcttctggttacaagagattttgatgaaaatagaacatgaaattagttagtatcagagatattcacctgaaatgcatcaatggactccacttgtgtgtctatgatgaaatcaaccctcttgtcatcatgtttctgttcatctgtctggagttcttccttttgcttctcaatttcttcatcttccttctgcttctcaatttcttcatcttccttctgctgttgatccaagttaacgttcttcatgtcctcatcttgttgcccaatatccactgatctttcacg

SEQ ID NO: 84841 - DNA, 7293 bp, Oryza sativa
atgtcccatgaagtttgacctcggtttgtgtattgttctgcttgctagtactactagcttcaaaatcttggagaaatttcactgtttgggattcagcgcctagtctgaattctcctcaaacatacttgagtatcttggagatcaatctggcctacttagcataatagcattctcattttgaagtcgaaccatctctctgaaaattctgaagatgtaactggctaactgcaagtctgcaatctagtcatatctgaacatgaagcagcagcaattaacaaactgctcatagaaaatgacctgcataacaattaacacaaactagttagtacaaacactagcacacaaagagctagctgatgatctgatcatgttattttaatccgggcccaaggaccagctttgctgaaaattcttggacagcacgcagtgcaggagtaattaaactgcatgcaatgcaatgtaatggcgatgcttttcccttgtcctgaagaaaaaggcaacgtagaaatgaaatcgcaagtgttgtagagtgctccccacatcgatcgatctgctctgattacgagagattgctagatgggctcaaacctcaaattgccacatctgtgtcctacttcactttgcctactactcctgcaacactgcaactagcactccactccactacactacactacactaggagtggtactgtagtacaacattccaagcaaatcgaaatgcagagattgtaggagaaaggattcttgccctgatcgatgcaagttcagaaaatgtagtgctccatgcagaattattttgtcagatcagtcaaaagatgtgcaaattcggctatgcatgagtagttcagaagaatgccaatctcacgagataagtaagcagcatactaatcactgatcagccaagataagtgaggagaatgactgaaacagcttttcccttttttttgggcccccacaaaaacgaccgcaatctgcatgaatagtgcaaattcaagacttgatgccttcctttgctgatcagacaaggagaacggccaagaaacgttgtttggactacgcccatggcagattggcagatggaaaatttatgcatctgcaaatcctgcaatttctgcatacactgtaaatgtaattcacgagcttctgatgaattgatgcctgcattccatttcatccagcttggcatatgcaggactgcgtggttcagagatcttgcattgcacagaacccgggaaggctgcatcatcgcgtctatagctaatactagaaatcaaggaacggagtgcagatagaagcaagcagaaacggacagagaaaacgcatgcacagccaaagcgtattcctcttggtctgctgctacgaccactgcttggtctgctgctagtgcaaagctcttctgcaccgtctcccacgcgaattccttcctctctcaccctccctttggtcctctccatgcatctccatgccctgcaaccatttgtctctacctcgtcgaatctctcggacccagcagccactcaccactcactgcagtgaaacgcactgctatctgcttctcttcctctcctgcatgcgtgcttgcagctacacttgagaaactggtgagtgagctcgaaattctgacaagtatatagtgagaagatagttggggagaatcttaaaaaataggtttgttcgttcctaacttctatttcattttatgtattctataactacatgttctcaagatctggggaagaatttactccctctgttccaaaataactcctagtatatataatgaatctgagtggagagttatctagattcattgtattaggataatcacacctaggttgaactttttttggacggagggagtatatcatttagggtctgtttagttcccaaacaaaatttttcacgttctcacatcgaatgtttggacacatacatggagtattagatgtagacaaaaaaaatcaaatgcacagttcgccaggaaattgcgagacgaatcttttaaacctaatcgcgccatgatttgaccatgtggtgctacagtaaacatttgctaatgatagattaattaggcttaataaatttgtctcgcagtttcttgacggaatatgtaatttgttttattattagactatgtttaatactttaaatgcgtgtccgtatatccgatgtgatatacaggggcaaaaaattttaccaattaaataaacccttagttcagctaaagattttgagaagttgtagctatcataaacaccccgaaaccgggttttcattattgcatatgctgcttgtttgcttccattgggagaagagaaggcttcccatttcgcaagtgaagtggagcactcatgctagagtacaatgtgctacagtgccagtcagcttcctcctttcttgggcttcgccatcgccatgcttgaatagcgaggctgatgcttcaagaaaaatttgcatcctgggagtttgcgtcgcaatctttcatgcgtgccggcaaatcgcgaggccaaatcatgcccctttttaccgcacaaatgtagagttgcttgtgatcttgtctttaccaagggatagatatgacttgtactaaggtaggttttggcccatgataatgccagttttgtgtgtgcaaaccacagtgtcaaaactcaaaaaggttgctacctgcttgatgtgatgagtgcttgggatcaagttacagtatagtgtgatcagctacaggatcgatctagaaagatgagatgtgggaatagtaatttatactgtttctttcactgtcatttcatatgtttaaactgcatccaaattgttctctccttgtcagctgattcgattcctcatcagtgaaatgaccacaatatcctcccccgacatctcgtatgctgataattcccagaattaacaccactaattgatccaggaactgcatggcatgccaggtaattattaaattaaacaagctgatcagctattcagcatctgcatgaaaaagtgtttcttgcaaagatatatgcagtacaaaagagagggcatagatacttttaaggatggaataagctaaagcaaacgacccaagtaagattattcgatcgatcaactagctaacgctcttacagtttctttcaactgatgtgtcactcttgctgcacatggtaaagtagctgatcagttgcacactctgtctcactaactttagggattcttccagatcacctctcttcattctactgatcatcagttcatcacctctgcatgcaaggaaggaccagcagaagcatatgtacacttttgatcttgctagcttaattgctacttaccttattaattactagttccttaatcatcatctcttttcctaccaaacctgtactgctccatccagctagttcaagtgcagcttcatccattattactactgttacttacctgatgatcccctgttgatgcatgtgctagctctgaagaactctgaaacacattaacaacacaataatatgacaagcatcatcttttcattgcccacacacatacacaatcacacatgcatgaatgcttgaatccatagaccatggggccccaaagaagaggtttgccttcttcttctaccagatcttgaggtcgaccattggcatcacaattattcaatggttcacgggggtgacaaccctggtgtcccggggacccatgtctggctgactgcaactacagtctttacactgtatttttcttggagacattctttggagtgcagaaatttcaaaaaggaaaaaaactttacagtaatttggcagctaaattctctatggtcataaatatgtgacgttttggacaagattcagtcacattaattaataagtttataaaatctaataaggttatgataatacttttcgaggcgaatctgcacacatcattttttaagctagcatttgaaaatttactgataatcagaattttaaaagtttgattgatggagtatttcagagaacactaaaatctggtttttcaaaaggccgttagtagtaaaaagctaatagggtaattaagccaccatacaaaacatccctttgaaaagggtaacagtacgagatctattatattcagactgatattcagacatggtccaagcagccatttggtgccacctaggcgtcgcccacatgtgttctcttgggatggcacaataggacatccatccacacatcaaatccattatttggcctggccagcatcatcaactcagctatctaccaagtgtacgcactatagcctatacaaacatacatactccaacataatggtgaggctgagccatccatcaataaaatcgagatgcagatcgatctatctatgtgtatatggatcaacatttgcatggatttgtagtagcaatcacagtatcacactcattcagtctgtctgtcagtcacactcactcacatgcgttgtactggtggtttgtgatttgtgaatagtaatgtaacagtgctagctaactattggtggctatatgtaagcatgcagagcagtgcattgcagcagccatgcatgcagcaggcagggtgtctagatcagagatgaggccatttttctctctgaatttgttggatgattggtgagattgatagctgatgcctgatggggctctctctgcattgcatcctagctgcctgatgggagcttgctagctatgcatcgcgcgcatgcagatttaacaaaacgagcaattttacgattcttaacgaggtaccacttttttactgtaaattcggtaccttatagtatctaggtacctcatagtaattttacactaaattcttgatacctcatgctacctccttaaagataatagaatttctcttaacaaaatcaattggttttcgtgaaaatcattttcgataatcgttggtggtctgtttatgaaaatcagtcgatttcagctggttttcgtgattgaaagtcatcggtttctatcggtttttgatcgatttaggtaaaccggtgaggagcggtttttaatttcaaaaaagaaaaaaaaaagaaaaacagtgcgtgtgcttaccgctggatctgatttttgattgatcagacggttcagatttgttacgtggactcgctagcagtgacgcggtccatgctacattgactgtcggttggttatcggtcggtcgatcgatgtgtttgtggatagtgtttacatgcttgctgtcattactcgctatgtttctatgttatttagtttttatcctaagtcaaactcctttagcatccactgagtttataaaaaaatacactaacattaacaaataaatgaaatatttgaagaatttcatgtaattgttatttattttgctgtgactttatttattgtcgattaaatattcttttaagtacgacttctatattttatgttttaaaaaaattaataaaacgaatggtcaaatgtttataaaaattaatgacactacatattagaaaatagagataatattaaggaaattattgtattttttccactccatgatcctacgactaaatgctttgaaagaggtaaaacagttatctagttatactagcttattacatgaatatactacgtggcttgttttagtactccttgcacttgggagggcagatcgtatctcttatattaaagggagaaattaaatatactcatacgtaacaaagtacacaggttaatctgatacggttaatttgtacaggaatctaaatatacggggtacggtgtaatatcgatgtactgctagtgataaatacaacacataattaaccaaatcaccctgcatatattttcgacattgttggacctagctaatatgatgtgcttatgatgctatcatggcatcattagagttagcacggaagcttccatagtatgtcacggttatcagttttgtcggctatctgatttctatatttaaattgtccatttgtccttgtatatcattagttcatcgtatcagtcataatcatacatacatacatatatatatacatatatatatatatacatatatatatatatacatatatatatatatatatataaatataaaaactattctatacccccctccctcccatggctcaaacccacctcccaccttagtcaaaggtaagtcaaagcaccctcacgtcagtcaaaactcggtcaaactgcctaccaactcccccaccacccacctcttctcagctctcgtcttgcggaacagtgcagtaacgcgacagccatcgtgcagtaacgctgtgtcttacgtgcagtaacaacattcaaatttagttgaaatatagtcatgacggatctacttttgataagcacttttttctaacatcatggtgcaaatggttttaaaaaatcatatatcacatgagagatattgtaatttgaagcttgggtttttttgaatcttaactctccacaagtagtaacactataacattactacttgttactattatctgttatgcgttactacaatcctatcgcgacgttactgtaagtgtgtagtaaagaccataagttttgtagtaacaatgcgtcttactgcaatttatgaatagtgttactgcataaacatatggtaacatttccactttgtgcggtaacaagtatatttagcaggtgagacttttaacccatatttttcttttaatttctggtttactacagtttcaccatgatgttactgccaaaggtgcagtaacgttctatatgttctacagtaacaaagtgttttactgcagttcttggatagtgttactgcataaacatgcggtgatgtgtaactgtcaggtggtaacgtgtaccttccgtacagtaatacttttacttttgtgcagtaacaagtatatggttagcatctgagacttttaacatatatatttttgtttcaattcctggtttattgtaattcaccacaatattactgtcaaaagtgcagtaacgtcatatacatgcaataacactatattggagggaggagaccgattttcttaagaagagggatgaataatggtttctttaggagaggagtacgtagatgcattttgaagtttaaaccttcacatgcagtaacactatagtatcattgtaaaaacagttttaaaaaataatacatatcttgtgatatattgcttttcaaaaattggcattttgaactttaatcctccacatgcagtaacagaatgtgtaccttgcagtaacaagggcatatacatgcagtaacatggttttaccaaatgtataaaattattcaaaatgctcctacat

SEQ ID NO: 84842 - DNA, 7992 bp, Oryza sativa
cgacggcgtgtaccactctcctgtaggttctgacgatgagcagaggccgtggtatggttcaccggcaatcctcaagcagtgggtacatcatctcctcagttgaacggttgatggctttgatgcagagaagctgacgatctgaaagtttgtagacagaaatgtattgcatgccgccaggtgagggttaggccaggggaaaactacacatttttcagtgaattagagggtagccaatgccattctatacacaacagtacaacacacatgcgatttttcttctcccaaagaatttgtaacagtataaatattgctcaatgtgcagaggtaattcatcacatacatgattgcaggttgtaatagctacacatacagtatgatctataacaaacttcattccaaagaggaataccaactcagatcattgagaatgaatattcacgtctcaacctagctggctctttgttccaaaacctgtacatgcaaataaccatccagttttccttttgaggatcaaatggccattgaattctgaagaaagcaataccacgaatgtgacaattaacatgcctgatcaatgaacacaagagcgcctcaaccaaaccagcatgcatacatacatatatgtagtatatgcctggtacaagatgccaatggcagattaaaaattgaaccacataaaacgcctgggatcacagtagtaggacgcaataaaatattgggagtgccttttttttttacatgcatcactgggaaccccggcctagatgttcaacgaagtcttttaagtcttaacacagccacatgacctaaaacctagtggaaccttggggcctaacatggatcacaaaagaagcatcccaacacaagtccgagcagtaagcactaatacttgctccatatgactggtttagttagctttaatgaaatgaggggacagcagcttggcaatctccatcatcccgaccttgtccttcccggcgaataagcttttaagcttatcgtcacagttaatctcccttttgtttgctgggttctgcaaaacatcaagcacataatctcatttcaggaacaaactgcttgcagtgaaatctacggcacatgaagagttcagtttagtacagcaaatgattgtgacacaagtgtaatcaaattaatttatataccatggtaaactagaaaggcagctaaagtagcatatctaaaacacggctaacactgctgcaggtgcagagcagacattcaagaacatgagttcaatcatgcctataacaatgtacagtaagttaataacagatgatcaaagaataactataatgcacgtcacactatatataaccacacaacagtgatcagcatacattctggacgccgtgctccacatcgctctaacagtcaagttacaacttcagtacaataaaactaatccaaatctgccaaataaaatgcaccgctgtcaaagtagattactgctcagcaaccttagcacatgtaaaatgctagaaaagaactttattgggtgcaattttgtttttattcccttattgacacccccccaaatagggcagcctttccaatgtccaaccacattaactagattatggcaacacatcaaatatttatttctgaaatagaacccagtagcttacatacagtgctgccgaaaatacatcaaagccttgcgaaaaaacagagaaactgactagaaactttactgaagtttcatataccacttaatagatccaatagatggcacgtgcaaatccttttacagtagcacaaatttcacaaatgaaattataaccaatcccaccaaaatggggcaaaacagtatctaaccaccacgaagctgtaaccaaatccgcggaaatgggattcccctctcctaaatcaatactacttgaaccaaaccccacgaaatcgatacttgaaccaaatccgccgagatgggattccccctcccaaaacaatactcgaaccaaaatgggggcaacagtatgcaatagatattccttcgctagcgcaagcgagacttgaaccccatggctcccaaaccctaatccaacaaaatacaaatcgcaacgcacagctagtagatcccacaacgagcgctgagaacaacgagagccgcggctgctgcaaaatgaacatgtgaacagtgacggggaagaggcagtagggctgtcgggggcgctcacctggaggccgttggccttgatgtggttccagatgagcttgacggcgccagcacgggacatctcgggggcgccgccggcgaacctgctgagggcgtcggagaccggcacgggctgcatgatccctcgcttctccttcgcctgcgccgcctccgtcttggtcaccttcgcccccgccgccgacgccgacgcggaagccgacgcgggcctcttgccccccgccgccgccatgaggaacctgcacccgcggaaaaccctagccgccgccgccatgggaggggaggagccgccgcttcaaattcgcgcttcgaggaggaggcgaggcgaggcgagggttttggggtttgggggttgtttgggttgcaactccactgagggagcattttgtatttggaaaattttgggggccaaccgattttttcatctaggtcctttgtgtttatttttcgttacaaatatgtccttcattgtcccgctgcgcagtggggccagtggcttttgttgtgcatccagatattccaggggtatatttataatttcgccaactactaatgcgaaaccaaccaagcagggtgagacatattacccataaaaaaaagagcatctgttttttttatggcctctttgtggcaacttaaaatgtggatcccatgctggaaatttaactatttgtcactcttgtgatatagcaattaacgatctgccactcactatctataacatgcggaccctcatgtgtctattaacgatctgccactcactatctataacacgtggaccctcatgtgtctatgacatgttggcctagtggcaaatcgttaagcaccactcgtaagagtggcaaatagttaaaagccccttacaaggacacagggattttataggattttttttgtaggaactagtttaattctcgcgaaaattctctaatccaaaggagggctctggtttgtcattccatgtgtaaactacgttttatctaagaaagaactaaaagtcttgtaacaaaatactgagagactagtaattatcaggaagagtgtgatgtcatatccatatggagaggaagaaaaaaaattgtgacatatattcaactgaatcagattctttgtcgtagcaaaatcacaatgtttgggacggcattatcattattttgattggtacagtttgacaacaataacacatttggactgagcatcacacgtactcaactttctctattgtcaccaactgaatgctcaaaattttgttagcttcttcatcttctgttcttcaatgtttaacagtctttcttttctttcatgagctactcgaagatgggtagatcaagaggcttattctttgacccatcttgagtgtctcttgaagatgatgagagagagagagcagagaaggcttttgtatcagattctttatccatgtccaggaagaaccgatgcctatcaagcaggagcagacagatccatgagcatcagagcctaaacaagatgcatgaaaacatgatatggtatgtaggaaaaggcactaaccatctagagtctgatgtcaattctgggtgaaaagcagtagcgaggatgttcccttgccttacagcaacaattacccgatctttcgagtacacttcttcctgccaaagtattgtattgaacatcagtgcacagaagataaacagaactttcaattagactagattcttcgcacaacacatcaatcggcagaactttcaattcgactagattcctcccacaacacattaatcatcaatatacatttgaactagacacggcagggaaatcagtaaaaacgtaaaacagtcaaactgacagggtatggtcagaaaaacacatctagtgcagcatccagaaaaggagaaatatcacagtacaaatcagaaaggaagtgagcatgtatatgcacttgcaatctaaggaaatgtccttaataaccaggagatgaatttagtttgagaatttgtccaaatacaatatgttcagtaattctcttctcatgtgtcattcaattgaaatgatcaagaattatcatgttcgagaatgatgatactagaagagccgatgggggagggcatatgaggacagtaggtgtaaatgtccacatcaattgacagagtttatcttggaattgttttccctaatagttatgatcagacaccataattactacagattcaaggagaacagatagtgaaagggccacacaaacatgatactagctaatgctgcctgaacaacaatgaacatggcatgaacagaaataactgttcatcacgcccatccataaatcctgtctagtttcaacaacaaaattccacttttactgaaagatagcatatgccatgatcatttgcagaagagtgttggaattttcaacaggggtaaaaggcaaacctcaacaccctctccagacgctattgtaatactgggtctatccgatggaacaggacaatccgccagtacttcaacatttgaacctacatccaagatagcaggtgctcgtataaatacgccacggcatgtatcgctccctccttccttctctgcaagcattggcactgaaagttccgtttcaaagctttgaagctgcaagagagtgtattcatctcaaaaataaaataaaattgaagagacaatagaaatgatagtgaaaactgctccggccatcaaacagagaacacgatcctcaaagttacctggctcccaaaaaagttccggtggacagtacaatctagtcctccaataagctcctgacctccggatttttggcctgcaaataactttcatcaattgattccaaagaaagaaagattaaaccaattgctgtggctcacatacctactgccttgttagctaggaagatgagtccagcacaagttccccagacaggccttcctgtaccaacaaattctcgaagtgcaggaaactgcatggtagatgaaataaatcgttgcaacattgtgcaacattaaaataaggtaataaaaaactatgagttataaaaaaggttaatatataattgtattcatgcagtacatgaagactcaatctccacgaagtagaaaataatcaagtacgacgggtgtgaatctggttcttatgaaaaggggaatgtactcgtcatctcatctacatgtgaaactaattgtacacttatatggatgtatactaaataatagtatgtgactagtcacagtttcacaatactcagggatggcggatacggacgaaggaatttaccttaccagcagcaggtagcaagcactggtctacttccaccagcaaagctgtcaagtctacagctcatcattccttatatataaaatgttggacaaagacattcgcagtttctagttatggccttgtaagcgaggctaaaaaacaacgggaatctatatctgcaacaagttgctctgatggagccatgggctactaatatcccataacctcatctgtttttctctagattagttattctgttctgaaagcttaaaagggatggatatgaaccataaattcgtataataggattaacaatagttctcgaacgtgcagccctttcagaattgtatactcactagtagtcagtaatcaacacaaacacataggaagaagagaagtctaatttgccttccatatattactttggttgatctaccaccaaccctcctccgtagtagacagtaacaaaagaaatgcacatatttggactagttttgaccaatgcaagggagcaaatcaatatttcatttacatggattattgtagtgtttcttcagtctgatcaaaactgggctagttgttcggaatgcaaaacaccgggtcacttttgagaactttcaacaattgcgacagtttattagtacacatatccctttcctctgttttgaggagaatctaaccaagaaggaaattatcactagtgcccaatttataatcctctcactgaacatcgatcgtggagattcatgcatcgcatcaattccaataataaacagatacaaatgatttgctaaaacgaaagaacagcaaccaaaagaagaatggggggagttaccaggttgtggtagttggcgagtttggccatggtggtgctctcgccgccggggatgatgagcgagtcgagcccctgcagctgctccggcttccgcacctccacccccctcaccccgatcctcctcagcgctgcacccccccgcatccgcatcaatcaacaaccaacaaaccaaaccaaaccaaaattcccaaaaaagaagaaaaaaaacagaagcagtgggcgcatacataccggccaagtgctcgttgaaggagccctgcagcgcgaggacgccgacgaccgccattgctgctgctgctgctgctgctcccctcctcttctctcgctcgcgttgggatgtgtggctttggctttgaattggggggtgggaagaagtggacgggagaagcacgttgccgtggcggcggccgccacacgcacgcgcctccacctccacctccacggagataggctaccgctgctgccacgagggaaaaaaaaaacagttactggcggtcggtgctgcgcgatcctgaccgtccgatcgtagcagcaggagcaatctcgagcgttggttgttactgccgtgtgtgaagagtggtgatacggaccaaccgaaggctttaccacttctttgggccgccaggtcgtacttgagaattatgggccatggaaatggaggcccacataccacattatcggatatactaaattattacagtatactccgtcaaaaaaacccatctaaaattaaaatgggacataatttattgtattcagattcgttgtactagattatgtttcgtcctacttttagataaggtctttttggaacggagggagtagataatctacctatcatttttctttgataatctactacgagaatgttgtaaaaaatgcacgaatatgcacgtcaagcataatgagatacttccttcgtttcacattgtaagtcattctaacattttccacattcatattgatgttaatgaatttagatagatatgtatgtctagattcattaacatcaatatattagaaatactagaataccttacattgtgaaacggagtgagtatataatactgtgacatttaatttacaaagcacactgtaacaaaaaggaaagcaccagtaggattaattaattataattaattaattactactactgtaattaatagcagggtcaaaagggcttcattgagcttaagccgatcgatcttagcattcacgcatgagagttcagttcagttcacagctcggtatgccggacctcgtcgtcgtcgtctttgtcgtcggggtggtagtcgtccggcgacatgccgccgcaggggctggtcctgaggcagtcggcggcggggctgacgcggccgtcgtcgaagcccatggcgcagttgcagacggtctgcacctcgccgccgccgtcctcgcggcgcaggtcgatgtcgctgagcacgatgccgacgcaaggcacggcgtcgctgcacgccagcctgatcgcctccgcgcgcctcgccgtcccggtgatgttccggaacaccacgccgctcacccgcacgttcgacgtccggttccggcacggccgcgtcgcgtcgcagtagaactggtcgatgacgatggggtggtcgacgccgtcgacgcgcacgccggcgaaccgcacgttccggacgtagccggcgccgccctgccacgtcttgatgcggacgccgttctgggcgcgcgcgacgcgggcgccgtcgagggacac

SEQ ID NO: 84843 - DNA, 2931 bp, Oryza sativa
cgccgacctccgcctggacgactcgctcctcctcctctccttttcgctcgccggggaaccagtcgccctcagggtccccgtcccgagggtgctcgtcgacccctccgcccctcccgagtgccgcgacgcgggggaccatgtcgaggtccgcctcgcgctcgtcctccccgtcgaccaccccgtcgtcgccgccgccttcctaccgccccccggcgaggagccgcccgcgcctctctccctccgcgatggtgagctactcgtgtgttttactgtcctgtgaagttattaggtagtagggtttatgagctttctcgttgattcctggccaataattcgatccccgctagtcactccaaatcgtcgtatgcctctgggattttagtactaatgaaaacctaagtcgatttgcaatttaaaatgctagtaaaatgttactgtattatcttaatgtaatctcccctgtttatattataattatgaatttgtgattcattttcttggatgaacagatataaagaatctgtcttctggagatgttcacttgtactgcaaagcatgctcagcaagattgacaaaacagccactaaggtagagcataacagactttgagttgtgacttatagttgttttgcactttaccatgtctaatggtctgtttatgcaccgcgcatatatttctttaccaatgaaaagatacatgcaaatttcaacttgcttacttcttaaatcatatgtttgatgctctggggttcacatttagtagcaatgaaaccaccgcatgacatcttctttatcaagttaaacaatttgtcattgttcatgtcctcctatgcaacctattctgttcacatgttttgtgcaaataacttcaaacatgtcttggactttcatatcatcgcccttggttttaagttgggggaatcttccttggggggatggcctgtctgcttgatcatagaggtttacgaaagtatgataaaatgttctgacctctacagaagcagtaattttagggtattcaacttgtgtcctgactgagggatagtattgaaaagtgggaataggaaagaatttgtcccttggttgtttattggttctcttctggttctcagttcgaagagatataattcagtcgttagatgctggttttctgaattcctatagtggcatttattctataatcagtttgctgttatctgattatctccaagaaacccactaaagcagtatgtccctcagtggtatggaattcttattgcaagcaagcatgttatgctaaggttttggtcacttgcaagctagagtttaagcttttgatcgtgtttcgcaattagatcatagactatacttaaagaactagggaaaacctatgtgccaaagttcatatggtggagttctttttttatattatctttggtgattagtaaaatatacatgcatatgttcaggaacatcgaggaaatgccatcgttaaactgggaagatgtggctgacaattggtttggtggatgttgcacctcatttggaggtgcaagcgaaaagctagtatcacagtatatcaatgcatatgggcgtctagagggaacaagtctactaaatgctacctccattagcatagaaaaggattatcttgagaaggatttagcatctgggttagttagttcagtgcccagtaacgattgtgatgctctgcaggaagatatatgtgatgttcacataggagaagatcataccacggggaacatggaatttaatagttcagaagagaaagcatatcatgaaaagcagattggttgtaatcatgtgcaatgttctgttgttcctgaagagggtccttgtgtcagtaatagtgaaaaagatggagacactctttggactgatcaatctggcatcattaaagtgaaccccgaggagtctaaaaatgactcttgtgttgatgacatagagaaacctaccaaagagaccgatttgttgtctgtagatccatgcaattgctgttgtgacggtggaaacagcagaaaatctgaagacaatccttcgaacgtgccctctgggaacctggaaatgcaggctaaattggacacccaaagagattacaaattaacaaaaagtatatctcttggttgtagcttcattgtgaaagcatctaaccttgtaaatgatgttgaatggcttgaacttctatgtgctcattgctcatcacctattgggtcatacccttcacaacattcacatgctccagcagatggccgtgtacgactatttaaatgctatgcatcgtcagaccttcatgttgggggacctcatgatgtgttcaggtcagtatcttcacttctcattgaatattttgtacgcctctcaaaggtaaaaagggaagggaaaccagttcagtatagctaggcagctaaagtctatggtccttgctagtaaactgatttcatcactgatcataaacatccattatctttatgcagggggcatacattagaaagactttttgttaatttgttgcttgaagttgcagaagatgaaatatcttttcgtacattagtcagagatctgaaaaccaaaaggcccatccttcaaatagtcctccttagttcaaaagcgtggctgttttctggctactgctatgaaaatgatatggatggttcacatggggcagcacatctgcagccctctgttaagatcttgtattctaattgcagtaatgctttggaagaagacttaaggtacgtgatctgcttacacagctaatctagacttgttatgcttttcttctgccttttatccatattaaaagtgttttgggtgtttgtctttcttgtgctaaatttgtaaagatatattgaagtttgcattcttacatacaaagtggaacaaaaaaaactctgaaaaataattgaagggatacacaacccctggccatat

SEQ ID NO: 84844 - DNA, 1442 bp, Oryza sativa
ttcttgctcaaccagagagtttatcctatcgagaacctagaatcaaagttaatagaatagaattgttagcaaaagaaaaataaggtgacaaaaggtaaaattcataagggtttgtaaacgtacagtagggttacaaaaatttgcgttgtccaaaacaatccattcaccacattcaatagccctgatcaagtctccagcaacccattcaaatttaactggttggtgtacagcttcactctgctgcaagtaatagatagacctcagtgttttactcaaatcatctttattgaaggatacaggcaagtcaaacatttccatatcacacttcatatcctcaactatgtccctgaccaagctcaatgatggcaacgatgaattcttgctcatttcaacaagggttgaaatgcaaattgaagagaacttctttgcaattacaaattcaaaccattttacaaacaatgtcttcctgtctgcaaccaaactcttccactgtatatattgactcaggctgaagtattcatcaatataacgctcaacttgagatatgaccactttatagtgcctaaaaaagttatactgctcaaagcatcccaacaattctgacacatcagttgccgaagatagattaacttcgttcaatgtattgccagataactgagcaagcaagcggattaatgaggttttcccagatgaatgttgtccaacaagaatgcacaaccaaccttgattgatacagtgcatggcagcttcaaggctatggagggtaccagggagaatgttgagttggctattctgaactttgcaagagtggacgcgatttcttctaatagatgcacttccaaccaccaaacactgtggattaacataaagcatttttatttcatgaatgctatactttgtctgaaagacttcttcaaaaagcttgacaacttcttcgcgatcagctacagttcgcattcgttgaaggtagactgtatttagaaagcagtcaaccattgaggtttctggatatcctcttgctgtctcacaagcaccaactatcatctcacaagacctaataatatcacgtagattaaattcccaaggagatccttcttggccgcacttcttatgtatcatggtatccatgtagagtctattgttaaaggaaatcaacttttttagaatgtcatccttgattgatggatattgtgatttacagatgaatgagtagtcgctttctgataactcatcaacataaacctttgtgaagcggttcaagaaggacttcggaaggcctttccgcccaccaccttgcgacgaaggattctgacatgcaaagacacgaaaggacggtggacatttgtacgtctgaccaagctcaggaataaagacctcagcacggtggtccaaaatggcattcaaaccctctaagacagattggggagcgagattgagctcat

SEQ ID NO: 84845 - DNA, 14127 bp, Oryza sativa
cagatgtggcacttcaagattatgatcatctccaggtgccctgtcagtattgtgttcctctttttgcacacggttttcatcctccatggaagactgtttgacttgcaggtcatcgttgatttgatcagctgttgcattacccagtgcctgagaggtgctctgctcactgtccggcacataacgaaattcggtagcactttcatcatcaatatggtgttcagcttctggttgatgatcctgcgtatcagctgagactttggcccgttctttccagtccgccattgcatctccaatgctcctaaaaggatttgtctgtttgatctgcgatggtggagtatcagtctgcaactctggcttagagttagacaataacctagagccatccccagagttgggcatagatatttccagactagggacttcattgcttgaaaaattaacagaaggagcagcagcactgttcatatcagtgctgttagccaagtttgattcagattctctgttatagtccatttcggcattatttggttgtatgccttgtgaaggatgctcaagtgactcaatattatgaagttctttctccatgttatttgtctccatctgtccatcttcagcatgctcctgctcaccatcaatctcattgtcaccatgttgagctgcatctacatcctccacatcgtctgaagcatctaaacacccatctgctgctagcttttcctcttctggactgagttcttcaccatcagcatccatttcatcaatatgttctgtcccatccatatccacatcctcagaatcatcctttggttcagggagttcaggtgctgttcgatcatcataggcatcagctttgtccattaagtcattcgtatcctgatcaacatcctcacaagtactaggatcatcctccaaattattattcttgccttgctcatcacaatctgtctccatgggatcttcttcaagagcaccttcgtcctttgctctcagttccctatcattcttctgtgtctccttggctgatgaacccgactcatacttctcagtggatctgttaggatcatcatcttcatccttatcccaagatttcttgccgaccatttcacttgcatcaccagtatcacccatctgattctccaagttcgtgtcatcatcctcatcgcctgaatcattgccttcagggtcctcagaaacatcagacagttctgcattaaaatcgtcttgcatttcaactgcatcatcatcattcttaggagcttggtctggcttacgtagagcatcctgttcaacatcacaaaaaatggttaggctctgtttttatttctattcaaactcaaaaggaagaaaaaattgaaatagagagacaaccgaggaagcattgtttgatcacactaaccatttcattagctgtcccctcaagttgggatatatcatctattttagaacttgcactctctttgccttcaccctcacccatgccagttccagttgcatcctgctgtggtccatctgaagcatcttcagttgtatcatctgtggaaccaaagccttccgcaaatagatgaatcaaaagatccccaagtgcatgagtcatttcagatgtctgaaaccatcagaaaacaggattaggaatttttctgaaactgttttcccaaaacagggaaaaagaaatgagaacaaaattgtctaagcatgaaatacttacagttctatgagcttctaaaagttcagaaagaatgccttcagctgctgataggaccagaccaagcaaagcatgaagatgcattaactgcatccctatactagaaggcaactcaggtttaatgtcgaccagcctcctctgttggtgatagatggagtcaagtaatgtagcaaatatatctaattctgtagagatgaaaagatgatgcgcaaaaagtgaaggggcataccactgaaacagtaagttttttactagcatcaaacaaatggcccatttgaaggttcatgacatatgtctgcaaaatatctttccacaaagtaatatttccttccaatgaatcatgagttccatcggtggatattccctgatcagtgagctttccaacaacaccaacagccagtgaaaagatttccttaaaagcttctgcatatgaagcttcaagattgtgtaggacatcggaggatagcatatgcttgtcttcatcaacttttctggataaaatcgccattggtgaattcccctgcaacaggaatgcatgtttaagcaccaaaatatccagaaaacagacaagaaataaaaggtaaataaaagcattttgcaaaaaaaaagtatgtgtaaagtgcatagaattgccataaaatatagggtataattgcgaccagccactcctaaaagaatacagtagattaaagaagctatgaagttttctgtgacattattttgtgggatctatagcttccatgtccagtaataaagtgaacattagtgtgtgttacagtcttagcatcagaatacaagaattctacatatgttaagatctctatacatataagaacataccttctccagcaactcttcaaaccgagagagcagaactttcttaacagatctcatcgaaacatcctggtggcatagaacttggatatcctccctaaacatgctgataagctggcaatttgcagcaacaagttgctccatctctcttgtagcaagaggcatattcttgtgtgagccagcgatcatataattggatccgagtaagtatttgtctaacaagtcctgcaaaatagaatagagttactagtcacatattgcttaagtttgcatagcaatggtattcagggccttgcttgataaaggtgtagcttctccaataagcaacttgaagtgtcttaacgccaacttatttgaagcttctactggaaatagagcttattattcttggaccagaccacaaatacaagccccatgtctcagagatcataggagtggtcaaacaggaccaataagaaggcagaaatgaacaggtttaccttagattcagaaaatcttgcgatgaacttttcaaaaagcgttgacattgcagaaacttctacttggatgttgtcacaaggatcatgatgacaatcgatgaagcttctgagcagcaagttggtatccatggtcgtagccagtatgttgtcaaaaaattgctacataaaaatgcaaaaaggatacatcaaactataaaccccaattacccaaataactgtaagactttcatactgcaaaccttaccttttgctgccacatggaattcagcagtacactttggcatgacgaaaggtagtcactatcacctacaaaggatttgtaaaagttactacatggatttcaaaacaagaaaaggaatgtacagatcacaaaataagtacctccagaacctaacaacaaaattgcatgccgaaactcattcaattgctcaaacatattgtaagcaaaatgtctttgttcagacatgatggataaaagatgatccataaaagatgtagccctattaacctgcaaattttcaaacaataaatgccaatttgatactataatcactaagtacattaatactagaaggaagactaacctcttctaaaccaagatctttgttaaatttcaaggaaatttgtcgaagttgttgcatcattgccaaacatttgaagtactgctgatttgcatttttccagttatttgtgctcaagagggtagcatgagcaacgctagcatcttcaggcattttcttcgagatcacttgctggagcaaatgtgtcgtgatatacgactgctctaaaaatgggcttggtgcagccaactcgtttccctgtattattttcaatttcttacgtaaatgtgcacttgacaacaagtggggaatgaagacaagctttttgacaagtaatatacctcacgacccattggtctgtgcttcgataatccacattcctcaagtgtcttgaacaaattggatagagcagttttcttctggttcttcttaccacttttcagtatagaaccaaaatcagctgcattgcaaatccgctcaattgcagcccaaaagaaatacaatctgtcctcaagttcactttcagcttgttggcagtttgtattgtggaaaactacacgcgcaaactctgtcaaaaaaaattcagaatctcattatggaagataaaaaggagaaaatgattaacaaaattacaattttgacacgcgagaaagagagagagagagagagagagagagagagagagagagagagagagagagagagagagagagggtgcagcctagaccttcattatgaactccaatatcagtagcatttgtatgttgtaaagcttgaaatgacaatttggcctgatttgcccacttagtgtaccacaaaaacctggcacaatgaacatagtagattaagtagatgatataggtggttaaaaaatttccatactcttaaagccttaatgggacaaccttccgctaagtttcccaaggtcaacaggaaactctgattcaggcatctgttgatcaagccaacatggaacttttcttgccacagattcttgatttagcaggaccatcacaggtttttgcaaaatatcctataaaagcagaatatccaattaaatgcatttttctaaacagttaatgaatgcccacatcaataataaacactaaacacttcaggtaactttctggtaacttacatgattgctattagtaacaaactataccataaagagagatttaaaatttgggccagtcaactagagattttatggcaacaattacaacatgtgatggcaattatctagaaaaactgatagcaattatgaatcatgtatcagttagtgcttcctttcacataaaaaaaaaagactaaacaatcaccacatacattgaaacactgcagaagcttaaaaactttttgcctcgtcctcttgaaattctcaatagaagcactgtgtggatcttgctcccaacggtaaagcttgacctgatctttcaagtccttttctattgatcctttaccaccttcaatttccccaagaacactgatgtcatgaaaacgttagttataacccaccatgaagaaatgaacaaggaaaaacttcacataaatcacgaaaagcaactcacagtggcaagaactgcatgtagtacccaaacatgttgtacagaatattctggattttcttcaacgagttactgtcaagaaacataaagtcagaaaatgatgcccattttcaaaacaaagcacacccagttttcagaacagtgaaaaattataatgggcaattcaaaatgaaattaacaatcatgctgtactaaacaaagtggaacaagactcttgatctcaccttgaataagcaccaacaccagcaccatcagaaagttcaccatggaaggccagtaggagatgcaaccttctcttgaattcaccaatgcttgatgtttgaacaaactcctcaacactaaatttaggttcaacaatacattagaaaatatacagagagccaaatagagagagcaaacacggatggacaccttttgattatagatatttcctcgttctttgaaatatcacaggattgtgtgagtaatgctcgcaatggaaaccatagctgcacacacccaagaatattctgtcagccaaaaatcaagcaaaaataaattattaacaaatgtatattcatagtagaactcacttttagagcattgctctcgtacttctccagcacctcctgaagtagtataggccaacattctaactcaagcctttgccatgaagacacaatgatgaataattgtggaagatggtctgtggagaaaaagaaaattaataatcttatttgtaatttgtcaaatttgataatcaactatgtttgatgagttatctattttgtaacagtagggttctttgtaatttctgtcccttttgtgtttcatgagggctcggtcaactgtacttctggaatttattaatagcaccaaatcttttttattacaaccctatttactgaatacctccatccggtcataaatatttgacatataggacaagatacagtcaacttttgaaattttatatttgaataattttataaaatttagtgagtctatgatattatgatagtgctttcaaggcaaatatacgcataccatttttttgttttgtttttaaactaagcgtttgaaaatttattgatggtcaaagtttcaaaagtttgaccaaatcttatcatctacatcaaatattgtatgtttagtccttgactactggtcttgttaaaaaaagatgatattttaagacttccaaggggtctaaatctgaactagaggtctagagcagctgttgtaaatagaaagtaaagtgggaagtgtgtgtgttattctcggggacatgagatcaataaaactttcaaattcagcacagtaatcactaatcagcattctatgttttatactcctgccacctgagcaacagagattagaaaaaagatgctaaatatactgcaaggctccaagtcctgctaaaataggttactcaagattcagcactaccttttaagaagaacttggagtcattttcttgcaatgtttgtgcttttccaaccaaaagttgcaatccaagtaataccttcaagaataagaaatttgtgtgataattagttgcaatccaaataagttatatacaaacaaaaacattttatggataccagacctttgaaagtggagtgctcaggggaattgccaaaagggaagtaattatgtctaatattttcagaagacctggatgaccaggccactcgtccaaaaagtatctaactttttcttgaagtgcagtcaatggctcaaccattttgaacaatatagaagggtttggatcctgcaaaaggttatcagatatgctagtaacaattgggcatcaaacgtacagcttggaatatcctgtaccttgtaagcgttataggtgttgcattctaaagatggtgcacaagtttgtcgatattccagacaaacacgaagtagatgctcaggcatgagtttctcatcaaatgttgaagatgtcaattctggcaagtctgaaaaaataatcataaaatactgcaaatcaaaatacagaactattttcttgcaagtcaaaatactgcactgcttgaaatgacatggtacgttacccttcagaattcttgctcccagttgatatgagtccataaaagattgaattttcaggtcatcactaatttggcatttactaggctgaaataaattcaaaagaaaaactaccaattagctatgtacagaacaacactaaagcaattattgaacaacagctccttaaacaatactaaagcaattattgaacaacagttccttttttatccttcttttttctaatagatctgagagaaatatgctgtgccagaatgtatagcgttatttttgtttctcgatcctcatggacatccaaaaattacaaattatagtgccatacatatgattatgagttcaagaagttcacagaagatcatctctttctcctgtcactatttaccttctcaacaaggtctggcgaaccaaataactggttatgtattgttacaatacatttcagaatagattctggtatgagatcccacgagtcttcaacagcactatttttctcatcagttctctcctgaaataaacaggaatacggggttgatacataaaagtgaaaagaaataaaggcattggaagagaatcctcaaacatatgataccataattttaagaaaatcctgctctaacttttcttcagtatctgctacagcattgccttctgcatccatatctgaaagtgatggcacgtctcctttaaagatatcatgtatatcaatgatacgggacctgaacttgtaatactgtgaatcatcattttccctggccttcaaactagatttcatgtcaacccacatgcttgtaaactggtcaaatgtttcctttagcgactgcaaagacaaacaggtaaaagatcacacatttcctttcaagtaattgtgaaaatgagaatgagtacataccagataagatgttttatccaggataagggaatagcagacacggtatgttgtccgtactaaagaaatatgatggattgatactagcatctgagagtgagacctctgtaatgagtgcaaaaaggcattatgaaaagcttgaatctctacatttgaataactaacgagacagcatgaattgaaataagaagggaaacacttccatttcactaaccaatttgtcagccacttcaccaacatgcaattgactcgacacagcagctagcttcttcaacatagcaaggtcactgacctcattgtagcgaatttccagttgatcatcatttacatatttcgttaaatcgggcatgtccactgaaacattgccagtagcagatccacttggaaattgcataatagcaaaaattgcaccctgcagcaaagaaaaagattaaagtagcaccgtcagcatcattgaggactgtgcacattctctgtcactaatcaaggaaagtacaatctgtttttacagtgtatatgtattacacatatggaaacaaaatagcatgaagtttatttattactatcagctactgtttgatgacacagatacaaatctggtcaaaagaagtgcaccactaagtatgattcaaacatagctgcaacacataccagagctcgttcaatatcatcttctttaatcttcttcaaatattccctctcaagataaccagacagagcaattgccaacccaagtttcatttcatatacagcaacttgaattggttgaatcaaatcaacatattccacatactcctctgtcagtctcttgatgaaatttctggatgttatctgccacagcacgattatagggccaatcaatataattgagcgataactgccactagaacaaaataatccagctagaagacaaataaaccagtcccaacaaacctaacctgccaattgcagactctatcaatctctaattgcccaactccatcaccatttaaactagtcaacagagacttgcattcagacaatcgttcctcaaactcacagcatgccacaatcaggctcttatgcctagattgtggaggtcgaaatacaacctgcaaaaagtgagtaaggatatatagttatcaaaacaataacagattacgtaaggaaaataataaccaggtctgtagtttatattaatacatattgagtactaacacctgttgaacggctgtcttgcccaataggcaagctcaatgatctaaaggtaggatcaccaacagaacaaaatatgtctataactaacattgaacatacccacctagaacagaacagagccacagatactgataactacagattgctatgacatttttaggagtcctgagaagattcatcaagggtgtgtttagttcacaccaaaattggaagtttggttgaaattgaaacgatgtgacggaaaagttggaagtttatgtgtgtaggaaagttttgatgtgatggaaaagttggaagtttgaagaaaaagtttggaactaaacaagggccaagttgctgcattcatattcaaaacattaatatagcatattaaattattatgtcccattctttgcttgtgtctcgacattaacatatgcctgttctcaacaattgttggaataaccagtgaaagaaatactagcagcttggaagaaccatcatgaactttagaaatagtatcataggatggggaatatttaaaacttcaaattatgtattaagcaatggattagcatatatacctttgcccggatgctcttctcttttgttttgagttcttgcaataacttctgatcatacccatcttcctcagagctagacccagccaattcctcacactgatgacgaacctattacacaacaactcacagaataattagccaggctttatcttacaaatcttactagttgtgatttttttcgtccaagataacagactaagatacagtaccacagttaacattgtactactaccattctcaaatagatgtcatttttaagaatgtgtccacccaaatcttaaaattagatttgtcatgtgaaaatgacaatagtatatctcatgaaaaacacttgtttatgccaccaaaatattttgttaatataagataaaggcaaagtgaaggtcagatattgttaatatcctaattaacacaagtaaaaaagaaaggagaaaacagtttacatgccacagcattctatgtagcatgttaattcattcattatgcacccaagaaataagagaccgttcacctttccctcaagctccagtagtgaaatcttttccagaatatgagagtgcatgaaagcggattcgaatgcaggatctggattatatgagctcaacaataaccggaagcgcaactctccaatgtacacccaagcagccccaagatgcatcaaataacctgcatgccacaaaaggttaaaataagcatgcaccgttcagttgaaataaacaaaaactcagggaaaaatcaaagcaaaagtcaaaaccacagtgcctattggaacaaacaaagactaaaaaacaaagaagaaaagcataagaagaaataccacgcaatagaccattcatagtacaacagcagggtaaggaaaaacaagtgcataggatttgtcatagccatgctacatctaaatgctgtcagcaatgtctccagatatcacaatgtcaaaaagttaactagaatacattagcttcaatttcgaaagtcaaacaaaatatgatattagtatctacacaattttagattctgttcagggagaccataatggctaacaagctatgaaatggagattcaatcattcattgagaagagataaaaaagaacacaccctgtgagaacggtgagtgcaattccagaagtaaggaccctattagctcatgcgagccagcgagtgaagccaatactccatgacttgaacgtgataacagcgcacaggcagtgtcaagatcttctttctgcaacagaacaagacagaccatgaaaatacgaaccaccagcaaagaaagcttaaaagcgaaacagataacttgttaaacaatactgctgtccacaaagatgctgcaatggtcagagtggaaattgttcacagaaaagaagaaataacaagacaaaaatgtcactatggaatacatttatgggctgtctggtttgaggtttgagatgattcattgaccatttgatcctaaatagtttgtttggtctgaggaatggaatagactgatccatcatcacctcatccctcaaacgtacatactaggtgaagcaatgagtggagccatcccaccgtatttgaggaatgatcccacaatgggtcatcatcctagatgctttggtacctcaaacataactgcctcttaaaaaatagcttgttgatcacttgattaagttcatatatgactacaaaacacagttacaaagatatctgattataagttgactaagaactgaagcaaccaccatacaaatgtattaagctatccttgtttcctagtttgggaactgcactcatctgtagcattgtgagggttatattttgtcatatgtggcactgtgtctgttcaaagtgactatgttatttgtcattttagcttcacatacacacaaatatctactaacagatgcacaggaaatcaaggttacagttgtcaatccttacaaactaatacgtccagaactttccaaaacagaacttaacatgttccaacaaagcttcagtccccttaaaatgaacaagaatatattgatttctacatgacttagagctaaagaggtgggacagattaaaaacaagaatataatagcatgcaatttgcaaaaacatgtggtacatgagatctaaaatcacgtcagaagaatgacgcacaaacctttacacgatgttcagactgttggaagaggatggactctaacttgctatactcttcttgcttgaaatgcttcttatggacaactatgatctgcaaataggacatcagaatatatattccaaagggtgcatcaacacaaacacagattaatggactgatacctgtttaaagagggaatcagcagcagaatgtagactaagaacaaagtttcccgcaaacgagacaccttcccagaggtttcttgatgaaattcgaagcactaaacggttcttctgataatccatcacacgtaaatcctcttgactgcagaaacggagggtattaagagaattctttgcaattggtatcccttaaggcagaaacatctcagcagcccagaaggaaggagcagagaaatacaatagcaatcaaaaggaaagatcccttcactgtttctagcacaaagggaaaaaatggacgaaaataaaactcatcatacaggatggtatcgattgcatccatttttgtcaggtgtgcaaggtcgcaggtttcatcatgggtaactgagaactgaacctgaaaatggggctaatcagataacaaaggaatcatgaaatctccatataactctggaactgtatgaagagtcttgcgaggaaaaaccttggtctcccagagcaatatgtccacaaaaaagtatggtagttgtaccacatttcaagaatagaactagcaacttttacatgcactgcagaacattcgagtgccaacttgtaagctaaaacaaaaacaaattgatatgttctaatcaaaatgcagagatcatcttttaccgttatcaactgtggcccaagcatgatgaatccaccaaatgatctgatgttgagtaaactcaaagggagatcttgaagatgatcccaattggaagtccatagcatacttgagcatatattcaatgtttgcaataatctgtgtcataagagaaaattactaggcaaatatgcatgccacaaaatctgaagggcagttgttgcagatgaagtaccaacaacatgatacatgagatgattgcagatcaacaaattctataagctaaaatccgaatacagtttaacaacacagagacacacatactaacatagggaaagggggaggacctgatgagattcagaggagtccaattgtgcacacttggatagccgttgcagtaacacagtatccaggttcaggctcttcaagttgagcaaaggaagacttgctacccaaccatggaaaccgtgcatgttacataaaacatctgatgagacagagcaacagaattttacttcagtagttgaagccttggacaaaaattcaagatttttcttctcccagtcaaccttctcaacaagcctctgcataaagaaaatgcagtaagtcaataaattttaggggggtaacatatcatataacattacaccgagtacaaaagaaccttgtgaacttcatccaactgggccaatactgttgaatcttcttcctcggtgatagttgcagcaagagaagccatagaaagaccttggcataaagttaaaaacagtaataagaaaccaaagttaagtaatgaaatgcagctcttctgcgttttcgagggaaaaaagaaaccaaagctaacactgcaaaattaaataaaaatgcacttcgagcatttaagtgtgcttccactgctttgaagcattcgagcaatacagattaaaaatagaccacaaaaaagaactctacaaacacagaagctgcctctgaatacaggcttatagaagcaattccaatgtacagcctcaaaaagatctgttggacaaatataagagtaccttccatcgcaaggtttctaagatcctgattggctgacaacatagcatcaacgaagtgttggttgtctgcaatcaacaagatgattagatctggaagatttataaatgttctgatccataatatataatttaccatcaaaatgtcccttcagaagattcttccttggccaaacagctgcagaaaatgctaagatgtcttggattttgtagaagattctaccagatgatggtacaatagggtggccaccataaacccacaaagttggtttgtcataatgtaaattgaaatcttggaggctgttgagattgacactttccatctgtataaccatgg

SEQ ID NO: 84846 - DNA, 1627 bp, Oryza sativa
gagttggagaagagaagagatgagatgggatgaggaggggtcgggtagaaggaggaggaggaagaaaggacaaagtcctgggcccaccaaccctggccggtcagaccggctatacgcgtccggtcagaccgccagggtgcagccggtcagactggtccctagaggccggtcagaccgccgccaccaggccggtcagaccgcgcatatagcgccggtcagaccgcctggcccccagccgactgtgcacagcccttgcacagttcggctacccccacacaataaaattcaacaaaaatttgatttttggagcaattttgaaatatgtgagttgaaatattgccaaccattcataatatttgaaatttatgaagatttgcaacaaaactcacttgagtgctaggaggtgaccatttatggtctataggggtttttgggcgaatttgattttcaaacaacttttggaatatttggtttttgaatatgatttgaataccaaaaacatttcaaatcctcctctctaccaactttgttttgaaacttttctcagattccttctcaaactcattttggggtttaatctcattttggccaaaaacaaaaatctagattcttcaaaagagagccaaaatagcatttttcattcaaaaatcatttttctagcaaagtgaggcttggaaaacatatagggacccttttgaaacattttccaagagatagttttcaaatttcattgattttgcaaaagttttgacttatattgacttgggcattttgaaaacactactagcacttttagttgatttgctcacatataaaaggaagtagagcacatgcaagagtccaaaactgccccttaatgtgacatgctccattttcgcaatgaagaaccaaatgtcaataagtccaaagcataagagcaaataggagcaaatatacaatatgcaaaagaagcaaccatggtgcaccatctcaagccacattagagaagtctatgacatttaactcattcctcaacttgcaaaagcgggtttcattaagaggcttggtaaaaatgtcggctagttgatcctcggttcttatgtggctaatgactatgtcacacttggtaacatggtctcttaggaagtgatggcgaatgtcaatatgcttggttctagaatgttggaccgggttattggctatttttatggcacgatcattgtcacataggagtggggttttggtgaaggatataccatagtccaacaaggtttgtttcatccaaagcaattgggcacaacaactacccgccgaaacatattccgcctcggcggtagagagggctacggagttttgtttcttggatgaccatgacacaagggatctaccaagcatttggcaactaccggatgtgctctttctatccactttgcaactggcataatccgaatcggaatagccaacaagcttaaatttagcaccttttgggtaccacaggccaatagtagaggaatgctttaaatatcttaaaatccttttcacggccactaagtgacactccttaggagcggcttgaaaccgtgcacacatgcaaacactaaacatgatatccggcctagatgcggtaaggtaaagcaggctaccaatc

SEQ ID NO: 84847 - DNA, 728 bp, Oryza sativa
ttaccgaaagggtgttagactaaccaaagttgaaagtcggtgtgatgaagggtttcttctaggttatgcctcaaatagcaaggcataccgggtctacaacaagaacaaaggtattgtggaagaaaccgccgatgttcaatttgatgagactaatggctcccaagaggggcacgagaatttggatgatgtaggtgatgaaggcttgatgagagctatgaagaacatgtctattggagatgtcaagcctattgaagtggaagacaagccatccacctccactcaagatgagccatctacttccgcctcgtcaagtcaagctcaagttgaagtggaggaggagaaggcacaagatccacctatgcctccaagaatacacaccgctctttccaaggatcacccaattgaccaagtgttgggtgacattaataagggtgttcaaactcgatctcgtgtcgcttcgatttgtgaacattactcgtttgtttcttgtcttaagccaaaacatgtagatgaagttctttgtgatccggattggatgaatgctatgcatgaagagctcaacaactttgcaagaaacaaggtgtggattttggttgaaagacctagagaccacaatgtcatagggacaaagtggatctttaggaacaaacaagatgagaacggattggtggtgagaaacaaggcaaggttggtggcgcaaggtttcacacaagttgaaggtttggact

SEQ ID NO: 84848 - DNA, 588 bp, Oryza sativa
catgagttctgtgtggagccagtgtcatggttgtcgatgaaggtgacggccttctctggcagccagccaatcatccccggcgccttgccgttgccgtccttcatccgccacagctcaccttgcaccgccgcctgcagctcgcccttggtcgtgaagtcgaacgctgacgcagggccaccgacggctgcgcccagttcaccagctcctgccggtcaccgtcctggttccacgacggctcaccgttgccgtcgtaacgcatgttgctccatatctcggcgacgacgaaggacgggtcggtgttgtcgacgtacgtcttggcgacggccgccgagtatcccttggcgaagtcgaggcgccagccgtcgaagccgacgtcggacttgagccaattgagccagtcggacagctctgtctgcacacgcgtgttgaggtggtcgatgtcgggcgccgcgccgaagtctgcgccggtgtcgcggtgaccgcggccgctggagtactgcgtgtcgtcgctgcagatcatgtcggggccccagtcgaggcggctgtccggcgtgccaccctcgaaaatgcagtagatgccacggctat

SEQ ID NO: 84849 - DNA, 683 bp, Oryza sativa
gatttcgagcccatcatctcctccctagtgtccaaatctgagcatgtaagcctaggagaggcttactcacagctgctcagctttgagcagcgcatgaagatgcgccaggaacactcggccaatctcgccaacagagggcgtggccgcggcaatccaggaaggggccgcaacaataagcagccgcagcagcagcaacgcggccatggaggaaacagccgcggcagaggacgcggcaacaactccaaccagcgacaaggaggcaatggcgttgattatcgccccaagtgccaactttgttacaaaagggggcacaccgtgattgattgctggtacaggtatgatgaggattttgttcctgatgagaaatatgcaggcacaacagcatcctatggagtagattcaaattggtatgtagacaccggcactacggaccatgtcaccggggaacttgagaagttgaccatccgggacaaatacaagggccaggaccaagtgcaaactgcaaacggcgcaggtatggtaatcactcacataggtcattcagttgttaacaccccaacacgttcccttcacttgaaaaacattctatatgttcccaatgctagtaaaaacttgatttcagcctattgtcttatggttgacaatgcagcctactttgaactgtaccctaaacatttttctct

SEQ ID NO: 84850 - DNA, 4336 bp, Oryza sativa
tgcagtcactgacatggggggacacgaacgtgggtcccacttgtcagtggcgtggttctggacgacggagacgtcgggattgtttctgccgcgatggggatagccgaggtgagatgtgtggcgggaaggggaaggggcgcagccatggcgcgtggtacaatgaatctggtgtgggcccggttgtcagcgtggggttgtggtgaccgggctctgggccgacgtggcccgtcctgcgcctcccatgagaaaaatcgggttgggcagtgggccaaatctcgttccaccatctgtttgagcttattttcaacttgtaaaaaaaattgcagagttcggagtttgcacagtgtaatttgagggtctgtttggcacagctccagctccaactccacccctcctagagttagagctcagccaaacagtttcagctctatcaaaactgggagtggagttgggtagagctctctcacaaaatatactagagttgtgaagctgggtttaggcagctccacaactccactccagactcaactcctggagttatatttaggagttaaagctgtaccaaacagaccttgaatctttatttttaattaaaatataaataagatagatagtccaaaatgacagtctacacctagatgcatcacatttcacatgagatttatcacatgtgaagaaaaggggaaattatgtttttttggaaagtccctcctatatccaaagttccacattaccggtgatatatgatcattgtattgccattatgtacttcagatgatgaacatgttgattttgtttatcttccttgcgagttgacatcaagtgattttgcaactgacatttgccgatgaccacgaatgcctagaagctactaggctttatttgaggcaaattccgacctttgaagtataaactttgtccttttggagaaagctctgtgagtgccgattttttacacacgcatcagtgtcaccatcgctatccaagtaggttgttccaacataacccaacgagaagtggtctgaaacgaccgtggtgtacttggttagaccaaatgctagatttttcttgtaaaatcccgatttggagaaaaaaaacagatagtatattgttctaacaaatttataattaaatcaagtttcaatattcaataatttctcaaatgcttatttcaaaataaaaatgtcatacatataaatttgttctaaaaaaatacaatcattatctagactttataaacttatgctaacataaagttgattatttgaaattttaactgaatattatctaaacttcaaatatgactggaatgagtagatcagtgcagtattttaggcctacatcaacatgctgggtcggtaccagagtactggacgaggcccaagcccatgtgtccgtacgtgacagctggaattcaaaacccgcgagcccaaaacggcctcgtctcaccttctctctcgcacccgcaaaagctcaaacccctacactcgcacaccgcaccagcgatgtcggcggcggcgaaggcgaaggcgagcggcggcgggaggcggggaggagccaaggacccaaccgacgcgctccgctccgacaagaagcgccgcgacatggacgactccgacgacgccgagctcgacaggtgcctagctagcagcgccccccccccccctcgcctccccttccccctcctccccggggtccccgcgctatgttcggatcgaactcgaagcgagggtttcctggttgctctcccgcttgccgcgattttgtcttaattttgcgccggatttttgtgcgattaaccgattttctgcgtatgcatttcgtgattcgtgacgtgcttcggtggggatcgggggaggcagtgacatgaaggagatcgtgttgctgctgcgccagatcaaggacaaggctcacaaggatggccagaagaagaccgagcaaaccctctccaggtgattccgagtcccaccctttttacggcggctttattaccatgccaattggtattgtagattacacgcgtgaaattgtttctaagttttctattagtgctaattgagagataatttaacgtgcttactgttagatatcaacagatggtgctcactagtcactatgcaccacacttgcttaatttctgcagaattgtgctcaagtctctatacaccaatgatctgttatgagttccgttgtgttgaccagcagtagttggtccacgtcactttaatttctgtggaattgtgaacagatcaccgtttaggtctcctatcttttatgaaccaatgatatagtaggatgtaccagtgtgccaactgcttattgttcaacttatctcctgaatccgatttttttttactgtataagtctgtgtgagccttggagctcctgtaggctatactcaatgtagcagatgtgaggcgtagagtgcgttaattgaatcgctcccaaagcatggaaaatgagttgagactagtgatgtggaagaatagcttcatctaacatggttttcatatccacatgacaaaattaatatggtgtctcaatgtggtctgtttctgaagttatctaccacgtgcataatattagattacatgactaactgttctgctcaattttcagtgttgctacagaaattcagactatcgtacaggatgccaagggcaagtttgagaaggaaaggtaaaggaccaattcattttacttgcctgtgaacttctacttgtatgaatgcagttcttttttgttgtacatctgtggtgagatttaaagtggtttttgattcattcctataacatgattatcatatgaagctttcttggaaatgattacggtgcatcattcaaatatactatgaattctgacaactgttttttatttgcattagcaggcaaaattatctgaaagttctatcaaagacttcaaaagaggttaccgacctgtatccaatgcagtgatgctcatctggtaacaatcccctcatagtttgtgctaatgtcagcttcatttgtatttgatgtagtgtgaaggtttactgaagaacgagtacaccaagtttcaagcaacacatgataaattctgcaaagaaaaagctgcacacatgcaaactctcaaaggtatgtcaaatgagctacctgcaaacacatttacttagaagtgagttttgctgtttgtttcctgtgctattaggtgaattatataggtgaactttgtgcaaggaaaaactgtcatattttatcttgagatttggtaccaggattattgtactagttaaccttgacctttgttttcttttgtacaaaaatggagcgatatcattaaataatactcataatgagcaatgtgcatgcaccttggcagtttcctgacttcattagttcctgccacatagatatcatcagttgtcacctgttatcaacctatttacacatgcatatactgtgttctgcagaccttttctcaaagttcgaagatgcaaaggagaaattacttatccagtatgaactgcaaagtaaggatatatcattttctatctcattgtaaatgttctttattcttaaccagtgtctcttaaacagttaccatgtgtgaaagacatttgttctgatcttgtctaacagggaagaaggagaaggctactctgtctgaactcgagaaaacattttcagagaagataactaatgcagaagaatctctgaagaagatgaagcaggttccgtcatttaatggcttacatgatctactataatttcttgtttctgttgatacttgataccatgtctcatagtccaagttagaattgatgtgtcctgattttcttactcgcaagtacttctctttgtgtgtttgcaggatgacaaatccattgtcaaccttcgcaagtccattggctcattcctggacccggatgatgagtttggagcagacgatgactgaaactgctgttgccaaaatggtccttttagaacgccgtggatagtatttgagaatatcgatagtatatatatgaacagaagttacaaagttctgtagagatttggtagcatcatacagttaggtaccacatcatccgttattttgttttaagttcattgggttaggcggttccatcatctgttttaaatgcatcttggtcgattcaacagcaagaggctcaagattgtttaacctctttggcctgattttccttcttatataggagtaagtcataaccagtagctcgctaaacttacttgtcaatatatttgtatatttgcaacaaattattcatatacagtatcagatttgtatatcaacagcatagaattgcaatgaatcttccttctaatttacaaatctg

SEQ ID NO: 84851 - DNA, 604 bp, Oryza sativa
ttgccaaagtatctctagtttaataagggatggtactacaatatgtacacatatatccttgaatcctactcttcctacataactggtttgcatagagaaaatatttatgcataataatactaaactaaaattttgtgccatacctatgattagaggacgatggtcctgatggaatttctttgccctatagagcaaaaagcaaattggatatcaacagcacaaaaatgttcaataaacagaactaataaatgtggcacgacaaaactcgccttaatacgttctttcgcctcctgtaacagtctaagatgtgtcacacttagcttcatgcgatctatctcgtgatcaggtgtttctagtaaagtcttgacttctaaaaaaagtggacaaaaataaatgagttaagacctcatgttgtatgaaattgatgttttactatttgagccagctaccttccattctctttcgacgaattcggtgtgtaagcttcttctcaggttgttccaccgatgaatcttttgatgttttcttctgaccccctgaagatgctttacttttatttttctgaagcttctgcttctgtgattcctctatagtggaatccccc

SEQ ID NO: 84852 - DNA, 588 bp, Oryza sativa
aagcaccgaaatctgaaaccttagtagtgaaggtaccatccaagagtatattagttgatttcacatctctatggaagattggcattgcagcagaggaatggagataagcaagtgcccctgcagcctctagagcaatcctcattcgatcatcccatgtcaacaaacaattggtgctcagatcaccatgaagaagaccatgaagtgtgccattagaaatgaattcatacactagaagaggcacctcagattcaaggcaacaaccaaaaagtttcaccacattacgatgaataatctgggaaaggatggcaacctcattaacaaattggtcaatctcactctgctccacaattttggacctctttatggcaaccactcgttgatcggataaaatccccttgtaaacagtaccatggcctccatatccaaggatacgtgttgggtcaaagttgttggctgctttctctaaatcttccaaagaaaatattcttgtgttaggagtaacattgttactggatgagatcagctgctccaagagaagccctctgttttttcggaagtatgcccttcgaatttcttccgagtgcttct

SEQ ID NO: 84853 - DNA, 510 bp, Oryza sativa
ccccatatatgcctagctggcttgctctgagcagtaacatgccctgagccaacaacaaaatggtagttgcaccttcacgcactgttggaattttttgctgcattttttgctctgttgaccacacaagcactcttgcacgagcaaggtattaattattttttctttttgctaattctatgttgacggtttcaggcaaagccattactatcaagtggggaaattaaacaattggttgatccattcttgggaaatgattatgactgtgacgaaatggaaaggatgatgttggattaggcctccattctttagctgatgactgactcttgcagccttgctatgcacaaggacatcttctcattcccgaccggaaatgtcacaggtaagaacctgaacaaattacatgtgcaaaatacttaaaaaatgtcttgatgattgacctcaacttgctatgttctggcaacacagattttgaaactgcttgaaggagatgacgaaacgatccactgacca

SEQ ID NO: 84854 - DNA, 2509 bp, Oryza sativa
tcaaaggcaacaacatagttctccgagctaatgctatttggaacagtcgtcagaccctgacccttaccgtgtaaagccttgaaattattttaatattttgtcctacatatcagaaatatcatgcaaaacagaagaatatcatcatgccattactcaagcctgttgcacgctgaatttaatttagagaaagtatagcagaaccaaactcagttaccactcatgctcagcgagctaacaacaagaattgaggaagaaggaacagttagggggtttcaagtttcaaccatgaagcaacggacaagaatcaaatgcacaagggacaagctggcctttatcaactaaccttaataaaagagcctccaatcaaaccaactccaattaataaaactaactgaatcaaatcacttggcaagcattagctctacaggctgagtggttactgtgtcacatccgccatgcgcttgccgcacgcgcactactcagaaaccacttatcttcaagctgaatgtagggaatcaattcttcaactcctcaattagttcttaggagttgtcagcatcatgcagtacaatcaactatgagaggttagtccaacacggcaacatggaataaacccataaagatattaacctcaatgcattgcgcaacctaatattagtctaccgagagatgcacgataacatctgaaacacaatgtttgataatgaagttcatcaatatccttttcttcatccaactcttgttgaagaaaagaacggggcctatgaggttatcatctgggccatttaggattatttttaattcaagtgttgcaagatctcatgtcttatctagcaacatccaacagttagggtaaactgaattgaggtgtgggtgctattcttctttgtaataatttttatgttagcaattataaatgtatgtcactggctaaccttttataatctataatacaagagccattaagaaaaaaaaataaccaagcagtcacctatgttttagcgcttatgaggcatatgtgactgcttgtgccacttaagcagtcgaaggttgcaccagttccttgtatacagccacatagaccttgtgtttacaacagtgtacagaagaacataattcatgagatgtccgtatcatattatagatgaatcaggaatcatatgccccaaacttgtctcttaagtttgagtaatgaagatatattgttcagaagcttctgtgcatgttcctcagtatcctcactctcaatacattactgtctttcgacatagattaacagtcaagactagcaaaactcacaagtaaatcatattacagatacagaggacaaccaacttgcctgtaaacgctgcgtacagcaaactatatctgccaggatccccttctcttgtaattgagcttcaaaattatcctattatacaaaccactacaaatgtcagctatgaactattcatacaagaatactgctgtgtttaggtgtgaactcgctcagatgaactcagcaatgagagactgaaaggtttccttttgctctgccacgtctcacaagcatcattgacaatagatgcaggtgtagaaagtgtgtgctcattaacatgacagactagacaatctaaccatcgagcccccgtactgggctttcaatataagtcggacctctggcctttttctaaaaaaaaaaaaaatctaaccatcgagaggattaagctagtgtgaattatcctaccaatccctatgtaccgaccaatttgaacatcatcccacttgcctgtatcaactcaaccatcacaatagagattgcaaacctttttcgtgttccaatcaacaaagagaagtatcggatttctgcttctgagtatcatgctgatttggaacaaactgacaatcaggaacaaaggagcagataacagactgtggcataagaaaatgccaaaaaaaaactaatgctaacttatgcttcacaaaacagttgcaaaatcaaacaatgttggcttaactcagataatagcatacacactaatgctaacttatgcttcctttacaaggtatatcaagtcaccaaacggtttagggtttaacgggcgaatacgctgtgaattaggattatggcgcgcgatctaatcttctctaatgccaatccaccgtgctctcatttagagtcactaacaaagcagcagagttcctagagctggtgcagtccaccacgagtccacgatgcaaggtacctgatgatgcggcgatgagggggagaaccagcagcgctccagcctccaggtgatggaagaacccagctgcgtgcggtggaagagggcggcctacaggaggcgggcacccgccaccacccggagtaagcgcaaagccggccgtgagtcgggtaacaccgtccgcgcggctgcctgggggagggggctgctcggcggcggcggatggggaacgggcgcgcagcagcggtttggacctggaagtctcgggcctgtttggcaagacaaggaaagaggaatggcggcct

SEQ ID NO: 84855 - DNA, 3313 bp, Oryza sativa
cttgcttgcttgcgcgcgtgcgtcgccgctttgattgctaaccaccgttgctgctccaccgaatattcattcccccgcgattttatccgttcccccgttggttttctccgttgttgcgggagggaattgtgttgttctgttgtagtagtagtagtaatagcccatgagatattttggatcctggtgcggcgctggttctggttctggttcagcgtggtggtttaaaccgagaagaagtcaaattggcgcatagtttttattatatgggcggatcggaagaagtggcccaaggctccgacggcgcgcgagttgctgtggtggttgtgggagcccccgtcggcgacgactccgccgctcctccgcccgcggctgcagctggagcagccccggcggtgacccccggcgaggaggcggctaagcgggagtccttgttggcggcggcggcggcggcggcggctgctgagtgcaagcaggaggcagcggcggcggcgacggggttgcaggccatggcggtcaccgtggcgcgggacgtcgaggcgggcggcctggacgccagcaccagcggggccgcggacgagaagccctcgtggttcacccctaagaggtaaggtgcttagcgcgattgggctcgggatcattgattttgcgggtggaggtgggtttgaattgcttggttgcacggggtttgcgcacctcgtggactgtttgatccgaatttgggcgatttgattgttttgcttggggagttcgagttatcgtgagctcgattgctcaaacctgccgcactggtgcagatgattgcgggatatcgagtagctgatatgcgtctatatgaattggagcttttggcgatgccaatttgtagtgtgaatgtaaataggagcaggccagcggaggttgccatttagttgcttgatagcaaatcatctctgatgcgtattggctgttccattcgtgacctggagttttagaatttgtatgtttctcctcgttagttttcttttgtgtaaaatggatctgcgttaggtacaagtttggtgttggcttgatgcaattcgaggtgcatttttttggttttcagacggcatttttgtgggataagctaagttaattttcatggcattggaattggaaaggagattggtctggcctcgcgtgttgtattttggtgccgactgagctgtgcacttcaatgttggagagataagcttgagagttcatgaaatctgctacatggccccagctgatcctgtttgtacatcttctgctttcctgtgcttattatccctctggattttagctctagatctctctcatctgcgtttggacaagatggagtaggaatgatagtgtttcactgcaataattccgaactctgaagtcgaacctcgtgtaggtatcgagttcagatgaagattgtggtttcaatgcagattgctcagtacatcctgtgctcgttatgcctctgaattttactttctatttgaatttagccaatattttcatgttatgtggtattgtcttcagaacagctgtttgtgtagtcagtggacatctggtgtttgtgtatttgatagttatgttttctttattgtaattgagaactctatctatttatcccttctttgggttgattagtttatattgctgcagattacttgtgatgttctgcctcatcaacatgctaaactatgttgaccggggtgcaatagcaagtaatggtgtgaatggtagccgccaaagttgtactggtggcacatgcacatcaggttctggaattcagtaagtcccagtggaaattccatacagttttttttttagattgctgtatgtcagactcattgtatctcatggaatgagagaacagatcaggacaaacactctcattctttttaacctttttatgttgttatatatattcacactgaatttcttttttgcaataaattcattataagtcatcactgatttatcaatttttgagtttactcctgaatgcccttaccatgctgatacaggggtgatttcaatctgaacaattttgaagatggtgtgctatcatcagcatttatggttgggttgttgattgcttcgcccatatttgcatcattggcaaaaatgttagtttcctattaattccaattttcgatatgtggtacattatcctgttattggtgctcaatccacaagaagaaaatattaaagatgggcaactgcttttcaaagaacaatatatgctaatgctacagattgtcagattaaggaatatagaaacattcatacttcacgttctgctggaggctaacataggtttctgaaacatcaaaccttttatagtgtaatgttctgacgcatgatagtttgttccccttctttcagacacaatcctttcaggcttattggtgttggattattagtctggactattgcaacagctggttgtgggtgctcatttgatttctggtcaattactatatgccgcatgtaagtaccttgtcattgtgaataatcaattcatgtttcagatctgttacttaaaataaatcttactctgataatgacacgaacaattctccaattattgttacttaggttagttggtgttgtgaagcatcatttataagtcttgcagctccattcattgatgataatgctccagcagcacaggttctgtcattcttagaatgcctttacaatctttctctgcactgagctgatatattatgttcaaacaaatcttatttttacacagtattgtttctgtgctcaatatacgcttatattcttctgggaaacaatctacatcttcaggcatacaagtacaatatctatcagttaagatatatatgtttactatgtagtcaaggatacacatgattttactccagatcattgtatatttataccagatgaaccaattatcacacctgtgtaatctaggcttaatttcgaagggtcccttccagatatcctttgttaaaatgacctgtacggcacataggtatcatcagactgtgagctacaacggagcactgtaatatagcatttgtctggctagcagttctgagaactctttactggttgctaatagatgttgaatcagcattaaattgctcttgaatacatccagctagctatgcatattacttggaggttctgtttttaattgtacttgttttcatgtctagtctctagtgtcaaccaggaacttacttgctactcctatgttaccagaaaacagcatggcttgctatgttctacatgtgtatacccactggaatagcggttggctatgtttatggtggtttggtaa

SEQ ID NO: 84856 - DNA, 697 bp, Oryza sativa
ttcctgcacccctaatcttggcatgcctccattacagtgtcgtatgattttgcaggaagctcaagcccttggttgcaagccctcatgtacatctcataggcaagcctgggtttaccatcttgtacaagagcttcaatcaacatctgatatgtaatttcatttggctcaatgttctgcactttcatcctatggaaccattcaaaagcagagccacccttattgtttctcacgcatgcgctgattatcgcattgaacgtaacaacagttggttctatctttgctgacagcataccacgaagaacagaatctaccatagcatggttccccttgccaatgtaaattgatactaagattgtatatgcatgtaggttcggcttaacgcctaccttgcacatgtgttcccaaactcggagtgcctcatcatacagctttcccttctcaagcgcactcagcagcgctccgtaagaaactacatccggtgtcaacccttgatctatcattctcttaaatatatccactgcagcagatgtttcagctgctctagaacacgcaagaaggacggcattccactctctgcttccaggcttcaagcccttctgttgcatcttatcaagcagccttacaccccacctccaaatgccccttctctttgcagcattgagtagaatattgaaatgtgacatgatgagctcatacg

SEQ ID NO: 84857 - DNA, 666 bp, Oryza sativa
attcctgcagcccatatcgatttcagagataggcatggctagtcccctacggtgcctacggatactgtcaggagagatagagcggtgtctctgatctcgccggatgcggattcgaggaggaaggctaccctgttgtcgactacgagtcagtactacagaccgccaagtcgacaacagttagataggctggtgtgttctccgtctcttttacctaagtctcacatatatcctagtaccaacgatccccatactatacaaataccggaatcgcgacatcaaacgtcgatagtttctccagtagtagattacgaatctgattctatgggagtcaaaatggtcgattcacctacacgttcggctgattgcaatagtgaaagtggccactacttcgccatttgatcaatttttcgtcctttatttttattaatatatccgttcttttaattttttaatttagaaacagtacaaataaggtttacgtataagttttacgtgtacacataagaacattccaataatttacatatcatacacactagctgctcgttttcatagaaaatgtaataactagtgagctagcactagcagtatcaactaatttactcctcgtcgtcgtcgatctcgacggtcttgttcatcttcttcctgctcccgccgccgccgccg

SEQ ID NO: 84858 - DNA, 1687 bp, Oryza sativa
atcctatgcaaaatggtgcaggtttcctttcgacggaaaaaagtaccaactcaaattcgcaaattaatcaatgtttgagaatctgcctggtccacttccccagccttatgaggtagcactttcttgtttgtcttccacaattgttgtacagccttgttgtcataaaactcccttacataaagcctcttaaagtacagcaacttgtggtagagtatcacaatgttatattatgttgaaacagattagcaagcgaggcagcattaacatgtagaaatccagaatttaactgagttttactatgacaagaggtgccaatatcttatgccaagttatatattgttttcttcaaatcatttttgctgtttatttagggtaatcattgttaagtttttttattcaaatgcttattttacagttttacttcatttatagctgatagttaccttttgtttttgtctgactgactccagaactcaatttgctccgttgcttggtagttctggtgttgtcgaaacaagatttcggcaatataaagggggtagcgcacgagacgtaagagtggatggatgcggagacaatgatttagacaggttcaggcactctcgatgagaggtaataccctactcctgtttggggatttgaatccgccgggtgtagtattgatctgacgatccagtcgtgaatcctctaccctagaggacctcctacccaccttatataggatggggggggggcaggattacaagatagaaatcttaaccaaaacggtatcggtttcctaaatctactttacaatattatcaaatcaggactttagaccgttccgtaatatacaaggaaacataatactcaagtcatgatctgtacaaattccatagatataagttatcccctataactagtcggataaccatgtcgtgtgggtatggggtacccataatcttcacaggtgtggtgccagtttggtggatcctcgtggagaactttgctcgttcatatgatatttaggtgatgtgcccattccccttcaggacttttttttaatgaactagcacggacggaggtgtgtcaatttcattgaatatagtgaatttccttcaggattcgctctgcaggtcccaattttctcattgccggattttctttttgacagagttgccagatatattctcttcaggtttgtattcaacttttgttttccagaagcctgacccagatgcgatgccaacaattctgacgcccaatttgcctgaccctgagaatgctcaggaagtggtctgttctgcatttagcactgtcgattttttactttatgtgatgtgtgttaactgtagcgaaatagcagggatgcctccggaggcagcaggcatcagtggacgatggaaagggctcagagcctcagatgctgatcgatatgattcccatggaatggtcagaagggtatctctggtcgtccccgggcctgctgatatcagtggacatagaaggggctcagatgctgattgtaattcccatggatcgtgcgaagagcatccttggtcctcggcctgcagatgtgaggctttagagtttactgatgaatacttaggcataggcgcatggctgaacttggagttggctatgtgcatcctttgcatatatgccgggtatttagggtatataatcatcttccttatctctactacta

SEQ ID NO: 84859 - DNA, 680 bp, Oryza sativa
atttttttaacgactcggacgagatggtgcgaagttctattaatatagcatgaaaaaattataagattacaaccctgtaaggtcataaccagtaaaaaggaaaaaaaatacaaccacccacacattgacagcgccaacacacaggtccggaagaaggctagcaccggaccgaccgctgctagaccaaccaagctccaccaccgctcaacctctgtcgacatgtgggaccactgtgtaccggcgccccccgccggcaagccttcgtgcgccgtagaccgtgccacaccaatcggcagctcctcctcgcaccgtggtcgcctcctccaccgccggccgcgcctctcgcgccacgccggcctcctccaccgggtgcgcctctcgcgccagtccggcctcccgccatcggctgtgcctctcgcgcgaagccagcctccatcttcgccggccacgcctctagcgtcgtaccggcctccactaccatcggccacgcctctcagcgccaagccggtctccgacctctcctcaaaacactgctgcgcgggccagatgcagccgtttgccacgccctcggctagccgtccgagaccgccatgcctcctccacccgcagccacggtcgcccacggtagctatagcagctgccatcgtctagctacctgctgtccaccgggggctgcagga

SEQ ID NO: 84860 - DNA, 586 bp, Oryza sativa
aaatgagcaacactgccatatgaaaagtaatgggaggagtaagaaaccatcaaaacacaacaggacaaaatgcactgctaggaaattttttatgattttgttatttggcacttccattaatcagtactcctttacacgactacaatgaagatagagtagaaacaatatatgtatttttgtttcaaaaaactagatgccaatactcctaacagttgaatctattttaggtgtgatgtgctacataacagtcattcaataaggcacatcatgatagctattgaaatgtaattgtaatttagcatataaatgtattttcacgcttccatctatcattgttttgttacttttaaaaaaggaacaaaattattaagaaaccaaatcaacaggttcaaagagaaacaggtaccaaaataaaagaaactcattgttttggatcaaaagtcagcaactaacttattatattgcgcctttggtatggatggtaaaatatcatttgcacgttcaatatccccacgcatcacaagtgtcttgtactcaatcaaactaagaagtaatgtgtaccccatgacactgcaacaagaaaaat

SEQ ID NO: 84861 - DNA, 534 bp, Oryza sativa
aagagtaaagagagttttatcaactgcccccatttcaaaaccattttgaagcaaaaaggttttcaatctttcataccaggctctgggagcttgttttaaaccataaagagctttatcaagtttgaacacatgatttggaaattttggattttcaaaaccaggaggttgtttgacatagacctcttcctcaataactccattcagaaaagcacttttcacatccatttgaaaaagcttgaaaccttttgaagcagcaaaagccaaaagaattcgaatagcttctaatctagcaactggtgcaaaggtttcttcaaaatccaagccctcaacttgggtgaaaccctgtgcaaccagtctggctttgtttcgaacaattgaaccatcttcacctagtttgtttttgaaaacccattttgttccaatcacattaaaacccaagggtggttctaccaaagaccaaactttgtttctttcaaaattttctaactcttcatgcatggcattaacccaattctcatcagataaagcatgaca

SEQ ID NO: 84862 - DNA, 946 bp, Oryza sativa
cccgctcagtctcctctccctctccgggaaaacctagcgccattgctcccccaaatccgccccgaatccaaccgttctttccaaattaattggggggttttaatccccattgaatcctcttcaattccccccaatttcccccttgaatggcgcccccaatcgtcgggaacggccgcgcttttcccggccaccaaccatggccgccggccgccattcccgtcgccgttccgccctctcccgtgcttggctcgcttccctccgctataaaatgcaaccccctcgttccgttctatcgttttagccccctcccgagcctccccgtggtccctagccatcttcccgccgtcctcctctctctcctgtgccgccggccgcctccagccgcctctacctcctcgccggagcgccgtccggtcgcgccgtcgcctcctacagcatcgcagccgcctcctcttccacggtctaccctccgtttcccgcggagacccccggagctacgttcccgccgtcgcccttctctttccttcgcgccggccggctacagccgcctctccctcctcgcccgagcgccgcccggccgcgccgtcttctccctcggcctcgcagccgcctcctctccctcggtcagccctccgtttcgcggggaaaccaccggaggcgcgtccccgccggcaaccggtggcattgccgccacccactccctccagccggctgctgttcctcgtcggaacgccgatcgacgtcgccgtctacttcgtcgacgccgtggcatcgtctccttcctcgtccacccctcggtttcgcccggaagccccgcacatcgccgcgaacctctccatccgcctcgccggagttgttcggccgcccgtccctcctcacccgtgcaccggtcgaccgcacctccaccaccttcggcatcgcagccgcgacgtcgtcctcggcatcg

SEQ ID NO: 84863 - DNA, 1128 bp, Oryza sativa
ccagcacaagggagtgcggcactttcttccgaacattgcctcattcggcgacatctgaatgctggcctgataactgttgttgtatgagaactccgcgtacggtaaacaacgatcccaagtgccttcgaaatccaaggcacacgctcgtagcatgtcttctaggatttggtttaccctttctgtctgaccatcggtctgcggatggtaggccgtactaaaattcagatcagttccgagggcttcatgcaactgcttccagaaccttgaggtgaactgagtgcctcggtctgacacaattttcttgggacagccaaatctacatacgacatgggtcatgtagagttctgctagtttctttccatcaaaggtggtttttactggcacgaaatgagctgatttcatgagtcggtccacgattacccaaatggagtcgtacccgctgggggttcttggcaaaccggtgatgaaatccattccgatctcttcccatttccactcgggaatcggtaggggttgcagcagaccagctggcctctgatgctctgccttgactctttggcaaatgtcacacaaggctacgtattctgcgacatctcgcttcattccagcccaccagaagtatgccttgatatcttggtacatcttcgtacttctggatgaatggagtaagcggactcatgagcttcctttaggatgagatctcttaactcctttttggccggtacacagatgcgtggaccgcaccaaactgtgccttgatcgtctatggagaaattggtgtctttcttatcctgattcttttattaactcttttatcccttcgtcatctttttgagcctcccggatttgcgattctagggtaggcttgtactgtcaagctggcagggactcctgactgtaccacggtcagtcttaacttctccaattctctgcacagatgatcttggtcaggccgtatttgagctacattgcaataggccttgcgacttagcgcatcagcgaccacgttggctttaccaggatgatagtggattccaagatcgtaatccttgattagttccaaccatcttctctgtctcatatttaactcggtctgtgtgaaaatatacttaagacttttgtgatcgg

SEQ ID NO: 84864 - DNA, 559 bp, Oryza sativa
gtgttcatgcaagcaacttgagtggcctgatcatggcattgtcttcgtgatccaagatctgcacatcaaatcacattagaacatataaattcgattagaaaaaaaattaacccagtaagatagacacgtggcatttaacgtggcgcttacgtggcaatggtagacgtatcccggctcggcggtggtgtcgaaggggtaggtctggttggtgtcgacgagcttgaaggcgatgaccaccgaggtgacgaagcccgggggcaccttgatgacgttcttccacgtcttctcgtggtccggcaccggcacgacggggccgacggcgtgctggtcgacgttgcacttgaccgcgtcgttgaccgacgtcatgcagtcggtgaaggcctgcaggttgacgagctgctgcatcttcaccgcctggaacattcccaagtggatgtgcagcgggtggttgtcgccggtgaggttgatcacctgccacagcttccgtcgtgccggacttgggcgtattcgtcaccgggtcctacaggcggagcccgttgatgtagaggtgcgtcgactg

SEQ ID NO: 84865 - DNA, 936 bp, Oryza sativa
actgggcggttgtccactcggcgcgcgcgcgggatactacgaacggcgtccgcgcgggcgcgcgcacgcgaacacggcgcgcgggaagcggctttgcgagcgggcagctcgcgcgaggggaggggcgctcggcgcgggcgactcccgcgcacgcgcgcgcggcgcacgggcggaacggaggggaagcggggatagaggcgctcgggccggctctcgcacgcgcgaacagcgcgcgggcgagtctgagcgggggggtaggtaaggagcgcgccggaggggagaagggagagagagagagagaaagggagagagagcgcgcccgggagagagggagagatgggccggggaaaagagggatgggccgagcgatattcggcccatcgacctcgggggaggcaaaatagacttttgcggaggaatttgatttggaaggaattggattcggaattgaactcgacgatagatcggggattgagatcttgagaaggcacagacactagacaacaatcaaagaaacaaatttcgcaattaggttttttcggagataattttcccgctaggcgccacgacggaatgggcgctacacaacatgactgtactcctactctataataaagaggcctctgttgctgtgatattctatcttcctgtgataccagcactgtttcctgggactggtatcgattaacaggttaatttggagcgtcacgggctaattccagtcgggactagctcggggcgtgacaaatatccacaagaaacagaggacaatctcgtccatctcctgaaggcgcagcattacaagacgttcatactgttgccgtacaacacagagttagtttaattttactgtcttcctacataccaaatttcattcccatacgaacttgctaagtgtttcatatgtaatgcatcccacgcacattgcagattcca

SEQ ID NO: 84866 - DNA, 9941 bp, Oryza sativa
tgtagggcttggtatcggttccgtcatttggtccgcggcaactggagagaaagacttaggcggaggttcaaatttcctgtcagtacacatgctctacatttatatttctccgattcaaattaatacatacaagtgtatattaattagatctcacgccgttaatttgtcatttatttgtagtgcgcaaagcaaaagcagggaactaatttgtgcggctactacgtgtgcgagtattgccactgccttgcagaccaaatcatcaccacaagagagctcgatgtacgtacaaataaattcaaaatttcattacgtaacaatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtaaattctactacgacggaaacacaattcaccggtccttaatcgtagctagctaggacatataatggattgtaattaatacatgactacatatgtttctatatgcatgtgtacacattttctataatgtaaatatattttggtcatatatatatacacacacacacacatatgcatttgcataacatatatatgtatatatacatatatattatgcatatacatatctactgaaccatatatacatataatataatatatatatatatatatatatatatatatatatatatgcatatatatgtattgaaacatatatatgcatggtttatatatatatataaaccacgcagcaacagggccatgaaaaaaaaaggtcagctcgatctttagggactaaagatggctcagccacgtggctgagccatctgttaccaaccgggattaaagatcgatctttagtcccggttattttacccgggactaaagatagcgatctttaatcccggattggtactcccggcttggaaatcgggactaaaggagggttactaaccgggactataaagggtttctccaccagtggtatagacatagttgagcggctgtatatgatcttacgacttgtttagcctctgaaatgtcgatggtttgcagcatgaatacacacatgaggttgttgcctttgttatgtttgcatatggacatatggttgtttcggcactaatcaaaactccgcgtgtatataataatattgtaccgttgattactgattactctgactaacgagtccgtgaccactgatttgcttgcacggcccactttgcttacttctctcgatctattattttgacattctcctcgtcagatcgaatcaacatgctcgccgggtagctggggtcgttcactttgaacctacgaaattaaattaacggtgtgtgtgtatgcctgtattcctacatgtagagagttcggtttgcttacctaacaatctactacaggcctctctctctgtggccaaagaataggcaggcatccatcgatcactggttaatttctacgtgcgaaactagggacgctgcacacagattcactgacaaatatcaactaattccaacatttcgaaccatccttctgaatttcacaaaatcaaattaaattagtaggataatgctggccataatggttacaggctcacagctgctccctgagaccatgaaggcaggaggtctttgcaatcctgccaaagcttgcttgctttgctaattatttaccctagcaaagggcccaaagtcgcaattgaggtgtacgtttcaatatgcaactattcctgtcacgagaggacaatggatcagctacagtagatagcttggtttggctgctatggttgcctactgatctactgctactcgcgccgccgtattcgcgtatggttgctttcagtatttcgcttgttcacgcgcatgcatatagcaggtataaccaaagacaaaaactgccatgcgttgtgttccgtcagaaaagaaaacaatgtctccaattcagatacagagatccatccacagataagaaaagagaagtcattttaatttgctgatgaactaatgttcttttgttctctaattcctcactatgaaatatatattatgcagttgatcagtttatcactgctaattctttatatatcccacttccatctgatgcttgtgtgcatctatgatgcagaggccagatgtgttatactcttccatttttctaaaaagtttgttaagcaaccgattgatctgctccctctttctgccttcctatggggtgtagccaacttattctaattaagctagtattctcaatggacaaattctattctatgtatgtgtatattgcactgtgagttgagtgctgattagtacctctgacctgagtccaatgatttgcaaagcgggtccttgttattgttttgtccctaattctgtacgattttactatttgttagtcaccatcaacagggtctatcgtgttccttgattttggtttttgcacttatttaattgcaccgcaaatggtgtgtacgtaaaccatctagtcctctgtctttctgaacttctctgaagataagagatttgtctttctctgaagacacgaaccacacgctatataggcaaaacataactgaaaaagtagtcgtccataggcatattcagttagtgaaagtgaaactaggaacattgcccacagattcaccaacaaccattgccaacttttggaagagctagcattcttacctgacgtgcaactcagattctttgacgacggataaccttattgttctaatttatttgaaattaacggtagctaactgatcaaatcatggatagatatgtacttgtttgtacaaatagtacatgcgtatatctgtgtatcttcgatcgctgcaaccaattccacgtttgtcgaacatttttgtggcaacttgcatgttacttgtatccaatgatatatatgccaaacagctaagaataattgaataatgtgaattggaacgccggatctgctacagattcgatccaattggcaacaaagtcgatggaaaaatgcagtagaatgtcaacgaatcctgcgttttcattggatcttaacagctttgatcaggctatacattgtacatgcctagattaagtttttttgcttttcaacaaaagaatcttcatcagaacacaccatgtcacaccatctatcacaccaagttgctagtggctagctagctagtagcacgctgtgcaagaacaattataattagtgcatgcctgttgtaaaatagtgagagtagttaggaggtaattgatcgatccttgacttcttaatgcatattattggtatgatagtggaaatgtgcagtcctttagtctcatgggttgatcagggggaggtgtaacgtgattgatgttaattagagcttactattggtagtaggtaccaatctggccagcttaataattgttatcaacattatgtttgatcatgtaccatgtagtatataatgtagtattatactatcaacgtgctcatagctgccacatgtgtagtgcacaaatgcagtacgatgtgtgactactgtaaatatgtaatgtttgctgaaacaacgccaagatcactggctcacgcatgttaattctccaagtagctactactagtagtactttaaagtttgaacaattcaacggttgttcttcggttgatgagacaggcatggttgattgatgtgtggacaaagctgacaaggaataggacaaagtaatcagtatcagtaactaagaaactgttcaaatggagatggaccagctggtgtacatatgtgttcaagtgttgaccatacatctcagagagcttaattagttgggtttgcatccggcatccctagctctgaatttaaaatggcctgtgtgtagaagctctcatgcagcttgctagaatgcacagcttatttttttcagtttgtttaattagtttaggttgggttggccgtctccaactaactattcagcttgttgcgtcgtcggtcgatcgatccatccatccatccatctcgctgtcctgcacgtttagacgtttacttactcagtctcatcctataaatacatgcccatctcagattgccaagatcatcatcagtcgtgtgtctctcgtgtgttagccacacgccactgtctaattgtctattatcctttgcatgcccctctccagctgcttcatctgttcgtccacaagcaactaaggtgagatatatacgtagtgattaaccagtaattaatcagctagcagtagtgcagtacattgattacatcagtttgctgcatgattacaaatgatttgattttgggtgcagatgatgggtgagaatcgagcgagggtcgtggcgttggtggtggctgtagtggtggtcgtcgttggtgtcgccggcaatgtcgcggcggcgcaggcggcggtgacggtggcggacctgcagagggtggccgggtcgctgcagatgtacgtggacgcgctgccgcagatggccaagatccgtggctatggattccagcgcggccaagccgtgcccatcaacctcaccatcggcatgtaccagaagacctgggtacgttaattagctgcacttaggagcactaattgcgtactcatatatgcaactcaacacttaatttgacctctggggattagcttcaaatcttcaaggagtactaattttgtagcagaaatgattggtagtacatttttggtcggcacaaatttggggcgaatgccttttttttctttttcgaaacagaagaaaacaaattagtactttgatcatgtcgtcggtggtgcctactagctcaaataattggttttagcccaaacagccaatccaggtcacatcaattcatgattagttagttagacttgagtgatgcaagtacagtattcccaaaatgcatgtgttaggctagcttcacacagtaggattattctaatcagggtcgatatgacaatacaattaatgcattgaatcaattaattgaacagtaaaataaataaaaaataataaaaaatgggatggttgcatgatgcatgcagaaattccaccgcgacctgccggcgacgccggtgttcgtgtacgggcagtgcccggactcggcgacgttcccggggccgacgatcatggcgcggcacgacgtgccgctgttcgtgaggtgggagaaccacctcccggcgtcgcacatccttccgtgggaccccaccgtccccaccgccatccccaagaacggcggcgtccccaccgtcgtccacctccacggcagcgcccacccgccgcagtccgacggcagcgccttcgcctggttcaccgccggcttcgccgagaagggacccgcctggacccaggccacctaccgctaccccaacgtccagcctccgggcaacctctggtaccacgaccacgccctcggcctcacccgcgccaacctcctcgccggcctcctcggcgcctacgtcatcgagaagcccgaggtggacacccccatggacctcccctgcgacgacgacgaccttcacctcgtcatcgccgaccggagcttcaacgtcgacggctcgctctacatgaactccaccggcgtcgcgcccaacatccacccgcaatgggcgccggagtacttcggcgaggccatcaccgtcaacggcaaggcgtggccgttcctcgtcgtccaccgccgccgctaccgcctccgcatcctcaacgccagcaacgcccgctacttcaacgtctccctctccaacggcctccccatccacgtcgtcggctccgacgcgtcctacctctccgcgccggtcaccgtctccaacctcctcctctccccggccgagatcttcgacgtcgtcgtcgacttctcccagtcgccgacggccgagatcgagctgctcaactcggcgccctacccgttccccaccggcgccgcccccggcccgctcaacggcaaggtgatgaagttcatcgtccagccgaacgggccgctcgacccgccggacaactcgacggtgccggaccacgaggtgccgtacgcgagcgtgacggcgctgccgccgacgacgatgacgaggtacatcgtgatgtacgagtacctgacgccgacggggcagtcgacgcacctctacatcaacgggctccgcctggaggacccggtgacggagacgcccaagtccggcacgacggagctgtggcaggtgatcaacctcaccggcgacaaccacccgctgcacatccacctggggatgttccaggcggtgaagatgcagcagctcgtcaacctgcaggccttcaccgactgcatgacggcggtcaacgacgcggtcaagtgcaacgtcgaccagcacgccgtcggccccgtcgtgccggtgccggaccacgagaagacgtggaagaacgtcatcaaggtgcccccgggcttcgtcacctcggtggtcatcgccttcaagctcgtcgacaccaaccagacctaccccttcgacaccaccgccgagccgggatacgtctaccattgccacgtaagcgccacgttaaatgccacgtgtctatcttactgggttaattttttttctaatcgaatttatatgttctaatgtgatttgatgtgcagatcttggatcacgaagacaatgccatgatcaggccactcaagttgcttgcatgaacacgataaaacacggtgctgacattgacgagatgatcaagatgcctcaccaggatcaataattcgaggatttccatttgcgtgggaaaagagatatatatatatatatatatatatatatatatatatatatatatatatatatattatgttatttaaatttatatttattcaattcattctgtgtgtgtcttatatggttcttatggcgtcgatgattgatcgaggggtacatgtttgtaatccgcttgattcttcgaagtgaaaagtataatatatacgtcattcatttttatctcactcggctgttcctgaattgaattctctctgttttccattatcgtatatatgcagtcaatgctgcctccttatgctcaatatgagatggattataagaaaatctagataggaagtagtagttcgaactccaaacttcaagtttctcgttttcttttagtaaatatttcaaactgttaaatagtatatttattgtaaattttttctatatagaaactgttttaaaatttcaaataaatctatttttaagtttataatagttaatatttaattaagcatatgctaataagtattttcgattcgcaatgcagtgtgattaaaaatcggttcatacgatcgtataatctccattgaactgttgcgtcgggatgtgtaaatgctcgatatcaacatgtaacgaacaaaataagctgatcggtcactgaattgttcagtcattacttcacaggcttgagtcgtcgcattgctcattactttcgtgtttcaccaaaatcttttaatgttctttctatatttcccatgttcttaagaaataactaattaatgaaggcatccgccgacattttataatcttgaaagcaacaactcattgaaatgatgagctaatacatatatgcctttttcagttttctctatgtatatgagctaaacggggttcagttaatcacatggctccaaaggcccatgtgattgtgtcagggcccaagtgctggaccgatatattgattgactgttgggcttggcccatacccgcaagagggaggcccacaagatttgctatagcacgcacgcgggccgccgcgcgtccattgctggcagagttcattacatgggctccagtggcccatttgattgtttcaaggcccaactgctgggaacgtactgttcagagtgcggcagcaagggtgcgagcgctaaatagggcccaatagccatctcgatcccgtgaagcctgtggacctgtgggccgttatggaagggcttggctgttccggatgacttcaagggcccatcagcccagacgcggcacaggagaaggcccaccaagtgtgctcgtcttggtcctccgttactgattgcattctaagtttgaatagacttcaaatgttgtaaacttttataacttgtacctttttgaaattttaggactataaacaagttaaattattttgtattgtgtactatagaaacaaggtttacctgtaactttcaaaagattcatctgcaaagaccgtgtcacaattgccacatgacagaatcggcaggtcggccggcggaggaaacctccggccaaattttattatagggaaagggatcacaaaggcaaacgtacaacaaaagcacaaagcataggctatcctatccgaatggagacacccatgcatggccaccaacatgtaacaaatacccccatacaaatgcacgggttgacaactatagtaaaataacttggataacgcgataattaactttcacccaaacagaaatgctcataatttttaatcctggtgaggcatcttgatctcctcatgcatcaaccaccacgtacagtgtgcagtcttgttcatggaagcagcgtgagtggcctgatcatggcgttgtcttcgtgatccaggatctgcaaattacattagaaaataatttcgattagactatagagccactggataacctagtacttactctcctccaaaataagttaatatcacatctcatagaaggttaacttattttgaaatggagtaagcagtagaatggcatgcacgaaagtagcatgatgtggcgcttacgtggcagtgatagacgtatcccggcgccgccgtggcgtcgaaggggtagggcatgttgttgtggacgagcctgaacgccaccaccaccgacgtgacgtacgccggcgggatcttcacgacgttcttccacgtcttctcctcctccggcaccggctgcagggccccgacggcgtgctggtcgaggttgcaggcgaaggtgtcgttgtgcttcagcatgcagctcttgaaggtgtccgggtcgacgagctgcagcatctggacggcctggaactcggcgaggtggaggtgcagcgggtggttgtcgggggtgaggttgatcacgtgccacagctccgtcgtccccgatatcggcgtctccgtcggcggatcctccagccggagcccgttgatgtagaggttcatcgtcttggcggtgttcgggtcgttgctcgtcatgttctcgtacaggacgatgtacctcgtcttcatcgtcggcggcagcgccgtcaccttcgcgaacggcacaccgatctccggcaccaccgtcgagttttccggctcctgcatcggcatgtcgtcgccgacctgccacttggcggagacattgaacgccatcaccttcccgtcgagtgtcgcgttcgccggagtgccggtggggaacgggtagggcgccgagttgagcaactcgatgtcggtggcgttggggttcaccacgagggagaagtcgacgatgacgtcgaagatctcggccggggaaaggaggaggttggagacggtgaccgggcggaagaggtacgtcgcgtcggaggcgatgacggtgaaggggagaccattggagaacctgatgttgaggtacctcgcgttgctggcgttgaggatgcgaaggcggtagcggcggcgctggacggcttggaacggccacgccttgccgttgacggtgatgacctcgccgaagtactccggctgccactgcgggtggacggatggcacggcgccgacggtgtccatgaagatggtgccgtcgacgttgaacttgcggtcggcgatgacgaggtggaggtcgaactcgccggagggaaggttgaagggcatctcgagctcggcccactcgacgatgtagacgacgagaaggccggcgaggaggctggcgcgggtgaggccaagggcgtggtcgtggtaccagatgttgccgg

SEQ ID NO: 84867 - DNA, 632 bp, Oryza sativa
cccaatggccggccctactcctcctccgccggaggaggagccctcctccccttccctgcgcctgcgctgcgcggtgcagcactacgagtggggccgacgcggggaggcctccctcgtcgcccgcctctccgacgccaacgccgacgaccacggccccgaccccgcgcgcccctacgccgagctgtggatgggcacgcacccctccgcgccctcctccctcctcgccgacggcctcctcagggactggctcgcgcgccaccccgccgcgctcggccccgccgtcgccgctcgctggggaggcgacctcccattcctcttcaaggttaggcgctaccaccatttgcttccttccaatctggttttgccgcgtcaaacactcgctctcccgtacgactcggcgacgctgactttggcgtgccacgcgcccacacctcctcgtgcaggttctgtcggtggccaaggcgctgtcgatccaggcgcacccggacaaggacctcgccgaggtgctgcacgcgctgcgtccggccacctacaaggacggcaaccacaagcccgagatggccatagccgtcaccgagttccgcgtcctctgcggctttgccggtatccaggtgcctgttcaaactcccaaa

SEQ ID NO: 84868 - DNA, 2373 bp, Oryza sativa
aggggtttggataccattttcctaggcacacgaaacctaaataggtactaacgcatgattaattaaatattaaaaagatcaaataatatattaatatgatactttcaaatgaactttcatattcttcttaaaaaaaacacacaatttaacgatttgggaagcgtgtgcagaaaatcaaaaagtgaaaactaaagagtggaagaaaataacacaccctagtgagttggatttttcgtggcacagaaacgatgcaagtaattaccatatgattaattaaatatcaattataacaaataaaaatgggtctatttagttttttaaaaaataagaaagcgtatttgtttagctaacagaaaatgagtaataagttgccaccatagactcactagtaacctcgtaggcgtgttcgcaggactgagaaaaaaaatcatatggccttttagttttaacacgtttgaaatgcgtggatatttaaatctttcctgtgaaccaaagcagatacgttgattcgaaacgaaaatgggctcgaatgctgcgacggattagtggcctgcctcaaacttgaatattgggagtattgggctgggtccaagtccaacacgtacatcgggatcccatcgcatcccgacctagccgactagttctgggctggttcattcctcgctatccaggtcgggcccaactaaatctaggcctgctgttcgggcctcaacaatattccggtccaatttactctggggcgtcactctggcgcaggacaccaacaattggtcatataccacggagtactactagccttgttacaaaatataagaaactttttttctttttaaaaaagtacattaatatgatttttttaaagtaattttcgtatataaatattttttaagaatttgggaaacgtacacaggagagacgagaaagtgagttaggaactactaccttcatctaggatcttaggacaatatatttggacataaggtatatctagatatattgtctaaggatgtatctcatcccatcttaaattgctacattctagatgaaggaaacacttaaaaaaagaacacaactgccaatcgacggagaaatttcagtcccaaaatctttcctgcttagatgagaataaaactttttagtccctatcatatcggatgtttgaacactaattataaatattaaacgtagattattaataaaaacccattctataaccctgcactaattcgcgagacgaatctattgagcctaattaatccatgattaggctatgtgatgctacagtaaacatacgcaaattatgaattaattatgcttaaaagatttgtcacgtgaattagctctcatttatataattagttttataatatgtagtctacgtttaatacttcaaattcagtccgatataacttggatggattaaagtttagtttatgtttaattccttttgtgttctcgtcttctctcgttggaacttttgtgtctatgcaccgttgaattgaattcttccgatctaccacaaccacgcgcagtcacacacaccggcagtccggcacaacgtatctgaccaaccgatcgatcgatctctgcaattggcctgaccgactacaccctggcgactcgacttggcgagtcacatgctgggatccctgtttcgccgcgcagcgagcgagccagcggtacaggcacattttcccatcgatcatcggtatcatctcggcgatcgatcgacggattttttacggcagcgagggtagcatctgcgtagcgtgacgacgcacaggttaccatggaggctactgcaggtggcgacgtcgctgagatgacccgagagaagggacaggccctctggccaacgacgtgaccgcacccgcaccgcaccggatcggaccaaacgagacgggacgtgcgtatataaggacctccacagcgacagtgtactaggagaggtgttgcctttttttaacggatagagtactccatttgtctcattttaattgacgtcattagttttcatgtctaactgaatggttcgtcttatttatcatctaataacaacacaatactaatcataaaaaaatttcaaataaaacggacaatcaaatttggacaaaaaaaaaactcatagttacagtgcgcttaaaataaaacagagggagtatatcataaggtcaaaaaggtaatttttcattaatattttaatctattttccaagttctttaaaaaagtacttaataagtacacttattttgacagagttctagtaaaattagcatatgtaatgatttattaatatatgatgaattaagtactattaacttaaaaaacttaaaaataaattaatatctattatattattaaaggaatagaaaa

SEQ ID NO: 84869 - DNA, 682 bp, Oryza sativa
cttcgtctacaagaaccacctcctcctcgctgctggtggtggtggtggtggtgacggtttcctcgctgctctcggaggcgaacccgtcctcgagccgcctcacgccaccgctgctgccttgccggtacagatcgatgcgggggttgggcttgtagtgcagaaaccgaggcctcggcgacaggtagttcgtcctgggatcgtacggagccgcaccctggtccgcctccgcggaagcagcgtcgtcgaaggccgtggcgtggtggtggttcttgcacgggggattctccaccctccgctcctcctccccgccgaacgagtgcctggagccggccgccgcggtgaccggcgtggatgcggcgggtggggcagtattgggcgccccatcgaacgagagccggaggcgtcgcggggcgcccgcctcggacgccatgggcttgacgggggacgaggccacggggtagagctgctgctgctcgttgcgctccccgagcaccttcttccttggcgaggccttggacgccgcggagatggtcggcgccatgaagttcttcgcggcgccggccgcggggcgagcgggcttgggcgccgccgccgccctcgccgccgcgtcgcgctgcccgctgttctccttctccgcgcaccacgacgcccgcggcgacgcgttcctgcacaccacggagct

SEQ ID NO: 84870 - DNA, 596 bp, Oryza sativa
acctaacctttttgtgcttctccttgatgacctggcattatctttctgaaggtagcagacgtttctgaagcagtacggcaatatgctgatgccgtaatgttatcggcagagtcagctataggtgcatatccccagaaagctctagcagtcctccgtgctgctagtgagaggatggaatcatggagccgtgaggaaaacatgcagaaacttcttccacaacatcagcttgcaatagctttgcctgataggatctcagagcaaatttgcaccagtgctgcagaaatgggtatttttctaattttcttgtttatacatcctttccagatatccactacctttttctttcgataagcaaatatatattacctttttataatatcatctgatattcgctcatggttactctccctgcagcaaacaaccttgcggtggatgccatctttgtttacacaaagtatggtcacatggcgtcgcttctttcgcgcaaccggcccaaccctcccatttttgctttcactgataatgccaactcaagaaagagcatgaacctcttatggggagtaattccacttcagctaccactgtcaaataacatg

SEQ ID NO: 84871 - DNA, 500 bp, Oryza sativa
tgcaggcggaaacaccagtcggcggcggcgaaggcaagccggtcggtgaagatgtagacgcccaacaacggcggcataataggccagacgtgcaggcggaaacaccagtcggcggcggtcgaggcggccggtcggtgaagacgtagacgcccaacaacggcggcataaaggccagccgtgcaggcggaaacaccagtcggcggcggcgaaggcaagccggtcggtgaagatgtagacgcccaacaacggcggcataataggccagccgtgcaggcggaaacaccagtcggcggcggtcgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttg

SEQ ID NO: 84872 - DNA, 667 bp, Oryza sativa
cttttgggctctacaaccctagttactttgccttgtatttggaggtgtaaagcatatatgaagacaaaagtttttgcttggcttatgtttttggacagaacaaatacaagggatctcgggatctcttagagagaaagcattgcaagcccccaaatgtaccctccttttgtgtcatgtgtaccttaggatcaagagagacaagagatcatttgttttttgaatgcccctttgctgcagcctgttggaatatgattgggttctcatgggatacttctcttgattttcatcaaatgattcaagtgcagaggtttggttttgtctcctttttgcttcatggaaatcttcttagtggctgcttggctcttgtggaggcagagaaatgatcttatattcaacaaagtatctccctctctcagtagatggaaagcaagcctgaaagaggagctagggctggtttggtttgtggtctaaattggccttaccaatttttgtcaatgtcaaattttggcaacttttggcatggctaattttggcaaaggaaaaattgtgtttggattgaagccaaaatagcctaaattaactgttgaaatggcctattttcttaggcatgccaaaatttggctccaaaccaaatagacaataaacactattgaaattgccaaatatt

SEQ ID NO: 84873 - DNA, 519 bp, Oryza sativa
tgtacccatttattgtttttattatgaagttatgaatgatgtctccttttagtattttgtttatttttaaattgtattcctacttaaatttttttttgatctggaacttaatttgatttttcttctaaattttaattaatctcgtgttatgttctagatggaatatttttgcaatatttctttttatattccgaatttcagttttttaaattttattcctacttaaaccctattttccttttggttaatcttagaatttacttcatttgaattttaattaatcttgtattaggttttatatgattgttattcgatatattcgttacttttaattctgaatttcagttatttataaattttattcatacttaaactctctttttctaatttcagaatttattttatttttattttgaatttagttaaactcgtgttgtgttctaatggatggtcatttcaatattccttattatttaatttcaaaattatattactactcgaagtcttgaactctctatt

SEQ ID NO: 84874 - DNA, 556 bp, Oryza sativa
tatgttctttcaactaacaaaattgtggagacttgtgaagtcacttttgatgaggctagcccaggagctagaccagaaatttcaggtgttctagatgaaagcatctttgtggatgaggattcagatgatgatgacgatgattccattcctccacctctagacagtacaccaccagtgcaagaaaccggttctccttcgactacatcaccttcaggagatgcaccaactacatcatcttcagcagctgaggagattgatggtggcacatcaggaccgacagctccccgacacatccagaaccgacatccgcctgactcgatgatcggaggcctgggtgaaagggtaactagaaatcggtcttatgatcttgtcaattcagcgtttgttgcctcttttgagcccaaaaatgtttgtcatgctttatctgatgagaattgggttaatgccatgcatgaagagttagaaaattttgaaagaaacaaagtttggtctttggtagaaccacccttgggttttaatgtgattggaacaaaatgggttttcaaaaacaaactag

SEQ ID NO: 84875 - DNA, 2049 bp, Oryza sativa
tcccacaacgtcgccgagtatgaggccctccttcatggactgcggatcgcaatttccctagggataaagcgtctaatagttcgaggcgattcacagctggttgtcaaccaagttatgaaagagtggtcctgccttgatgacaatatgatggcatatcgacaagaggtacgcaagttggaagacaagttcgatggactcgagctcagtcacgttcttcgaaacaacaatgaagccgccgacagacttgccaactttgggtccaagcgtgaggcggcaccttctgatgttttcgtcgaacacctttatacgccgacagtacctcacaaagatactactcaagttgcgggcactcatgacgcagctatggttgaagtagactggcgagagcccctcatacgatttttgacttctcaagaactcccccaagacaaagatgaagccgagcggatttcaagacggagcaaactttatgttatgcatgaagctgagttatacaagaaaagcccttcaggaattctgcaacgctgcgtatctttagaggaagggagacaattgctgcaggacatacattctgggatatgcggaaaccatgccgctgcacgcaccattgtcggcaaagcttaccggcagggttttttctggcctactgcagtgtccgacgccgacaagattgtgcgcacgtgcgaaggttgccaatttttcgccagacaaattcacttaccagctcaagagttgcaaactatcccgctgtcttggccgtttgcggtttgggggctcgacatggttggcccgtttaaaaaggcagtcggcggttacacgcatctctttgtggctattgataaattttccaagtggattgaagctaaaccggttgtcacaatcacagcagataatgctcgagacttcttcatcaacattgtgcatagatttggagtgcccaatcagataatcactgataatggcacacaattcactggcggagtttttaaagacttttgtgaggactttggaattaagatttgctacgcctcagtcgcacaccccatgagcaatggacaggtggagcgagctaatggcatgatacttcaagggattaaagcgcgtgtctttgaccggctaaaaccctatgccggcaaatgggtgcaacaactgccatcggtactttggtctttgcgaactacacccagtcgggccacaggccagtcaccttttttccttgtctatggggcagaggcaatgttgccgagtgaagtcgaatttgagtctttgcgctttcgtaatttccgtgaagaacgctacgaagaagaccgattggatgacttgcaccgattggaagaagcccgcgaagcagctttgattcggtcggctcgatatttacaagggttgcggcgctatcataatcgcaatgttcgatctcgtgcctttttagtcggtgacctggttttgaggaaaattcaaactacacgggatcggcacaagttatctcctttatgggaggggccatttatcatctctgaagtcacccgaccaggttcctaccgactcaagcgcgaagacggtactctcgtcgacaactcttggaacattgaacatcttcgtcgtttctatgcttaagcttatcattgtatttccctatcttgactgtcaacatcaagttttcttcttgccgttgtcagtcgggggctatcatcataataatggagtgtgattttttatcaatttaatttgcttacttggtttatcattgccttgtttgattttttctacttagtctgcgaggactgaaagtttttaatagcttctttgggttttaggctcaacaaagcttgataaaagcttttaagaaatcaaagacttggctagaactatcaagcacagcataaatacaccagtattgtacaaattaagcctccatttgctacatttacactcagtcagaatcagtcctttcatcatcagagttattattgctcggctgaaggtcgttgttgcggaattgctctacaacatcacttgcaatcttgtcagccgcactctgagcattactga

SEQ ID NO: 84876 - DNA, 743 bp, Oryza sativa
attcctgcaccccaaatttatctcttcacagcccatagaaaaaaatataagagcccatgacgatttatctttgtgaaacaggcccagacttgcaaggagagaaagcaagaaaaaaaaagcccatatacacgtgttttgtccaaaaaaaaataccaggaaaaagaaagacacacagatcacgcctaccgtctgccagcatcacccaccatcatcacccatccaccaccttgcgatccaagaaagaaaaaaaaagaggaggtcagctcaatcgggaaagagagaatagtgtgtgcaaagaaaaaaatctgcatgcatgcatcgtttttttttttttggaaaccccacggggtagttgtattatagtagagggaaacactgtataatagccatgcaggctaggagactacaaagaaaaagagaaaaaaaaagaaagcggtaacggagggtgtaaccacaaaaaggaggtgtacgggttgttggttatgttgatctacacgctgtcatttgcacttccatagttgttcgccgtcaggcactggatgccctttgcccctcccgcgcaccatagccagatctcgtcggtcactttatcaatgattctgtgcggcggagtctctaggtttccgaaaaccctgctgtttctctccttccaaatctcccaggagagtaggattagaatcgatttgacccccttccttttctccttagccgttgcctgaactgtttggacccaccagtcctcc

SEQ ID NO: 84877 - DNA, 643 bp, Oryza sativa
caggctacgcagccagaggggcaacctattacttgggctcgcttcactgccgctttccggagaacccatgtgcccgccggagtcatggcccttaagaaaagggaattccgagagttgaagcaaggcaaccgctccgtgatggagtatttgcatgagttcaacaacctggcccgttacgccccggaggatgtgcgggaagatgaggagaagcaagagaagttcttggcaggaatggaccctgagctgtccgtccgtctagtctccggggactatccggatttccaacgtctggtggacaagagcatccgcttggaagccaagcacaaggaactggagtcgcacaagtgccgcttggcgaatttccgcaatcaacagggtgctaaccaaagggtccgctacaccaatccctatccagggggatcctcctcgcagcagcaacaacagcagcagcaacctcgctccgcgcctcgacctcaattcgtggtgcgcgtcccacagccgcagcagcagcagaatcaacaagggactcgtgcgccccgtcctcctacgccaactgtgcagcctggtcaaggccgcagggacgctcaaggtccgcagcgtctgtgcttcaactgcttcgagcccgggcactttgcggataaat

SEQ ID NO: 84878 - DNA, 679 bp, Oryza sativa
aatgaagatcatgttattgcgattccattcctctacttttctcggtcagtggacatcggagtaacgccggcggcgagtccgaaaggaggatgttttcgggtggtgatgcatgtgcttctacaatcatgtattggttaattgggtgcatgcatgtatgttctataggctgaagggtgctcaccgagatgctagacatggctggggtagctaggttgatgacggcggctcgtgtaacggctcggcggcggcaagaacctccgggtgaacggcgatggctcaatcagctccaagaactatcatgcatgtgtgtccatgaggttagagaggccccagggatgctactgatgcatggaattgggttggtactcaccggagggggtggattcggcaacggcgacggtgaccggaggtggagaagacggtggacgatctccacactcgtagcaccatccttcgagattcttgaggggaaatggagaggaggtcgaggcgaagacgctggcgcgacagcttggcccggcttggtccagataagcgggaacggcgatgatgtcactgcggcggtgcacagagcgcgctccagagctccggtgtgcacggcagcgttcccgtcgattggctgcaccagagaggatgaaatcaaaaggagaaatattcggcatggtgggctgcaggaatt

SEQ ID NO: 84879 - DNA, 2546 bp, Oryza sativa
gtatatactcatgtctactgtgaaagagccatttttcttataagagtaagcaaaatagtttttcgcggtcaaatacacttatatagatttgcactgcaaaatgctttgataatattctaattttatccattacgaacatatacatgaatgagaattattggttgcaagaatgcaaggtactagtatcttgccaaaaaaacaaagttaaaaaagaaagctatagcaggaactatgacaagctctacaattaatcgtaaaagagatgggtcaattattatagctagcaattaaccatactatttaacttgctctaagtttcaatattaatattttttttgaagggaactcttaagtgtcaatatgaacacgatacatttgttcttttttagatgttagtataaagctagatgggcactttttctaaggggtgtgtgttttcgtagggtctagtttctctcttttttttcccactgggtgcattatctatggagtcaaacaccacaaactccgaggcaatctacattgagagagggctcaatattggtcaagaaggggatggaaatgattcttggaccaaaggatctgtttgactcctagtcatttgctgttgtctcagaagagtcgcccccctagtgaaagggactcgattggatttatgtgatggcaagctcactcttgggtcacaataatggaaacgtatcctatacacacaggccctcgcgtgtacacatcgtatacaccaactaaaaattatcataaaaaattctagaaaaattcatacatgtactttcaatagtattacatctacgtgcaaagtcgcatcttcaaattcattctacatagaaaataacaaaaaagataaaattctaacaaaattgcaaccttaaaactgtcagattttttgtttttttgttacggctaaaatataatgaatttgacgttaagattttaactctaggtgtaatacaattgaaagtatgtgtatgattttttctagattttttggtgatattttttagttggtgtgcacgtgtgtacacgtgagggcctgtgtgcataggatatgttgcccacaataattcatagcgtttgacactatgtggtaacccaaaccgacatttttccttctggggagcaaaacaagcggcgccactttattcgcaggagtataactgtgtaagaccagttaaagtacatgcaatgttggtatagcatccttcacaaacgagaggctgcacaattacaatcacgccgaagcaattgtttgcctgcctcccctacactacaccccaaaatccagcacccagctgagccgcttcatccttcctaatctagtaagatccaattttattgtgtatatcttgttgtacttttggttgtgctttttgggggcactacttggtttgaagtttctctctcgtcggcttggaacccggacacgatgtgtatcacaacacttctcatgctgacttccaataactgcaatgttgagagaaagtgtacggtttaggcatgcagttcagtgatcgattaataaagaaatgaaatgagatgtagagtatgaaccggcagataaaaggtgaataatgcttacccaaacatgaaatgtaactcccatggcaaccgcgccatatacaccaggtacatgttactggtccacctcgtcaggtaagatgacattgtttaggtatacaagacgcatctcatctctccaaatctgaaaatcacgcattttctgatcagctaacgcggctagcaagggaacatgaaaattcaagtttttcgtccaacagaagtgaaggaaatttgttcgtaccaagtccctaaactgaaccctgatgtgaggcacattagttttatgaatatcgttccctgtaggtcctcttttgtaatagttcttgccaatccagtgtgcctgcaatagatgaaatgatgatatgcttcacggtgccatataatgcattacttacagagcatatcaagcaataagttgctcaaccataatttgtgaaaaatggtttgtggctgaaatgaatgtaataaggtaaagatcaccaacgagctttgaaagtagttgacaaaggttgtttacttgccttgagagcatgtgaaaaccctgattgatagacagagtttctagctatttcacataaatcacaagaactgagcttccagagctgaaacaaaaaccacaataagtgagtttgtccttttgttcgaaaaaaagtggttagcattttatttgttccatgaacaagcataaaggtgcacactgaactgcattcatgtatgtcttgtacatgcacatatataaacataagtatgtacattagtgtctgcataagatgaatagggtgaggggagagggaaagagggagtactgaagcagcaatgctgtattcttccaccaatggctcttttgtcaggtgaatttgcaatggatcatccgttgacagggaaacattcaggcctcgttggaaaaacattgggaaaggattccggtggtaatcaagaaacaaggagttgttgcttaatggggggtgcag

SEQ ID NO: 84880 - DNA, 5212 bp, Oryza sativa
acaactccatcccaacctctcctaccaggcagaaacagagttacaagcactattacaaaacctacaaactataagcccctctccagagacagcagacacaagagaactcctgtatcccaagcctttgatctcaacggcaaatgcttatagactgctgactttttcatggatccctttggaatccggctgattacatatggatctacacaattcctcagaactgcaaggtattcctgtggctagcttttagagacagattaaataccaaagccaatatggtcaacaaaaaatggagtaatgatccccactgcccaatctgcctggccctggaatcagcggaccgcattatcctaagatgcagaaatgcaaacaacctttggaaaagactaggacttatgcattcggccaacagatctgaaacaatctctgacttcatccaagcagtcattgacaggacccaatcaacaaaaaggttagaaccaatctggtttgcagcatgtgcttacacgctgtggaaatcgcgaaacaacatggtcttcgaaagacacatggaccatattcagaacatcacacaacaaatctgtgataccctaaagctatggtgtctgcgaagcaacacaggaactagccacgaaattcaatcttggtgtgcgtcataggcaacagcctgctgtttatacccctgtaaatccacccccacccccttttttttattttatttctttatttttcctctcaccctgtatctctgtaatcttcttgtttctttccttttctctatctcacttaacctaaaatcttgtaactttgaatctcgtttctattaatgaaatgactataaggtagagctggctctaccttcttcgtcaaaaagttttcagtaatgcactattgaggtaaaacacacaaaactgattttttttttttagacattgagtccccacatgttctaagcatgacacttttttgtgtgttttgtctgctgctttccacagggaactagtaaatcaaagaaggggaaccagatagagatatgcaaaggtcaatgcctgaacaatttcagataattagaggccagctgaactaacgagttaacaatcttcattgatttagtactataaccggaggtaaaaccaaatctgaacattcagagatatagctcttaatctccattttttctgagatctaccatacctagaagattagtaactgcgttattttgttgagatggaatattttttttcaataactctattaatcaatgtaaattctacaatggagttgtttttttttaaaattaccttgcccatgtcagcatcagcctccttggtcatggtgagggaaatcggtgtcatcatggccgtcgatgaaattaagggtgcagatgaggccggggtggctgggaacacgtgttctactgcaactgcggtgctctcagctactggtttggtgatggtgccacttgttcccgacgccgaactcttggtgggtgtcacgtcagccccgttccgagggaagagctgcgcacgctggacatcaaagcaggcagcacccatcatagacgttgcgtccattagtggcagaccgaaccttcccggtgtcgtagcttgactagagtctagaatcagatgagagcctcaatgccccaagctcacggcaagcacctgcactgccactgcaccataggcgtcatagacctgactaagcacctcgtgggtcaccgggaatagaccatggctcacagcgacgtgaagaacagcacttgagtcatgtcccaattggctcggcatttcaccgaacaggtggtgggcatcacgttcggaagcacctccatcaagctgttgaccgcttctctggccatcggtgctatcacacaccatctcaacaccagaaaccccacaaatcgacggccctgatacaatattgtcaagaacccgcttaattctcaacaaatcaagcacaagcacaagagataaatccacctccaaatgcaaatacttagtaactgaggatagaaattgggggaaatagaagtgtaaggtgggaataagcaatagattagcaagaaacaggggatcagaggggtagagaatcagagaaccagattttgaggtggagaatcaagagttcagttcttgaatcttgatcgatccgcccatgggacaatagcagtcagccactctcccagccgagagggcccaatcaggcagcccacatagaggcccaacgcccatggcagcgccacacaccggcacgcgccaacaaatccatcgccgccaacacgcgcgaatcacaacaaggaagaccacacataaaagtttattcttttcaaaatcagtgattaattacatcaatgttattattagttaataatgataaatttttacatacaataaataattaccttttactacatctatctacaacttaactacactaaatgtacaactacaaatctatctatacaataaaaatcacaaagtggaaagtcttcgagctgagcagaatctttgactctcgaattgcgtcagtgcttcttgttcttcttcagtcttgacgacttcacttcgtcttcttcttgcggaggcgctcgtgcaccacgccgcgtcgatcatcgtccaccttgtcccagacgaccgccggcatccctcctcctccctccgaccaaatgccgggacacacgtacgcctgccggcagagtgtgtgagccaccgagtttccctcccggtagatatgccgcacctccacctcggcgaagcggcggaggagggagagaatctcctcgtgcatcgccgccgggatcctcgtgtgcggcttctcgccgcgcaggagctcgaccagcaccaggtcgtcgccctccaccacgagccggtccacgccgcacgacagcgcgagcctcaggccccgcatcatggcgcgggcctccaccacgcccaccccccggtgctccgtcgtctcggcgaaggccagcacgacgccgccgtcgcacccgcggatgacgccgccgatgctcgcttgtcgggacccgtcgtggaacaccgatccgtcgaagttcagcttgtgccaccccggcggcggccgcgcccacctcacgatcagcctcgccggacgaaatggcggcgagtaaggcgaaagtggcgtcgagcagcggggagcaggcggcggcgcccaccggacgagcagtcctctcggctgaaacggcggtgaggatggggacagcggcgtcgagcaatggcgagcaggtggtggcgagggaaagatcgtcggcggcaagaaagccaaaccaccgccgccgccgccgccgtcatcagggccaccgacgcacatccgcttcccctgccagaaccctccgccatcggcggtgtgattctggcgcttcccattggcgttcttggcccgcgcgtcctccaagaacgcggcctcgtcgccccggccgtgatccgcgagaagcatccatggcggcggcgcgctcaggggattgaacctgaggcccgggaggagcccatccgcgccagcagccgacagcgtcatcatcatctcgatcgcgcgcagcagctgaagaatttagggtttttgggaggaaggaagcgtgggcgagaggattcgagatggggagggggagcagaagagagcaggtgcgagtggatcgcgtcggcaaggcgggatttcaatatatagaaatggctgacgtcagcgcgacatagcgttgtcagcacgcgcgcgggggttgagggtttaaccgggtgaatgtgaatcttgattttggtacttgtttgggttagtctcaaaattcgagcagaaatctgagcttatttgccatggtgattctgatttctgtaaatgttagtatctgcagcttagtgccaatccctgaacttttgaagggttttacacaatgtccagttcttccgtttgttctaaaggattttattgatgagggacaagggatcagttctgaaggaggaaaaacagagttttttttctttttatttctgaaaatcatgaaactgaaggtgaaaaacagagtactgtgtatagtatatgatgttaacgaaacagagtacctcttcgagaatataaagatttgatcttgagcatgagaatggtttctttatcggaaggaagtcattgcaagttcagccattacaaacacataaatagatgtcaatccttttattagatataatcaatgaatatgaatacatcgatgttaatgataaatacatctatcatctatgtctacaactgataggaccggaccaatgaaattaattagctctacatgttcaactacaataatcagtaatcacaaatgagaaagcaccatttcgccgagccggccgatcgatcgatttgagcaaaatcctcaactttgccaagccgccgttgctcgccgtcgcctcccaagttgttgctctcgtcacacctgcttgcggctgctttttgggttaaaggatgatttttaatttggtaacaagatgagagacctacaaaacagcgtcgccggcggcttgccgccgcactccaagtggccgccgcagtcgccggtctggcgcttgtttcatcagcatggagacaccatgacacaagcatatgcaaatggatgaccaccactcagcactcagcaggaccagcgcgagtacagaacgaaaagcaaaatactccgtactagtagtagtactccctccttccaaaagtttaattcctatttctttttcatcaagaccaataaacaattaatttattcatcatgtgataaaaccaataaacactaaaatgacttcttaattcctatcaacaatttaatttagaatataataactataaatagaacttagacttttggaaaaaatcaaagaatgaaataggtcttaaacctttggaatgagagagtatattacaatctatagtaatcgaagtgcggcttacgagtcacgaatcacgaacagatgcaggacgctactatctcaagcatcgatcacaaaaaggaacaagcgggaccatttgatttctccgaagctgcacagatgctggaaataaatcgagggcttcgaaacccgacgacaccccggaggagtctatcgatgtcttccttccgcgatgcagaaaagaacaggcagtgcagagtgcgggttacctgctggggcgcattgtggccgggcggggcgcggaagacgtcggcgtcgagcggcatgtcgacggcggagccgag

SEQ ID NO: 84881 - DNA, 552 bp, Oryza sativa
atacctcttaatgaacggtagggcaccgtgaagcgtgcatgaagtcctagtatgatatattacaagtatgaagtagtatagggcatcatggagaggtaaacaaaagcactctatcacacgacatcccccactctgcttgctgaaatatatatatatattgaattagacaggaatgaaaaacatagagaacataactcacgaagtttcattaaaattcacaagtgaaccatcagatggtattgttcctatcaggaaattcatgcaaacattgctgcacaggtgaaatttcttatttaatttgcagcacaaagttagcataacaattcaatggatttatcaagataaaaaaacactcacaatgaagtaagcttcgtcagcttatcacaataaaaaagcactcacggtgaagtgcatctttgcagtgccaagggcccgagaagacactccgtcggcagcagtgatggcgatggaggcgggtaggtggcaatggtgttgtgtggcttcgtcgtctcgtcacggcgatgtggcaatgacggccacgcccatcccgct

SEQ ID NO: 84882 - DNA, 562 bp, Oryza sativa
tgtccaaggaattggggcgcgaggaggtgcattagttggccaaagacttatgcaagctctgattgatgaagacaaggttgataatattaccaacaacatttacagaagtgaaacatatccatttgatacacatgaaattcatttcgaggaaggaggatggaaatcgcattcacagggttataagttggagtctttaatgaactttgaagctgcagggaaaggttctaatggtttgatgttagattctgattggaaatatcatgatgaactatcacataaaggcaataatgccatggagaaggccaaggtgtggcctgagtttcagtacagtgagatgtgcttcagtgataggatcatcattgagctaagtgaagttggtgtatccattgaacccggggtatgtgttggttcactgttcaactgtatcattctgtacaacaattttttttgttaggctggtatagaatttcgcgttgcttgagttaaactattttttttgcatttctatgcatgggttgttacaagttattattttattttaatcctgtgcttttgggcaata

SEQ ID NO: 84883 - DNA, 563 bp, Oryza sativa
aaatgttttgtactgagtgggatcagaccagtatttataaaggaaaccatttgggagaactaattggaacgaccagctcacctgaaagaccacctgaggaattgtgagtcctagcagtgccagggcataataaggcttgccggaactgaaaaggtagcctgaaaaatggaattcattttgtcagaataatgcaatattttatggtgcttcgaaagtactagggtcgccactcgaaaacatagcaatcctcagaataatcagtttgctacggaaattcacaaagatgacatagcaacatttatctgctggacagtttgctgacatgggatgacgggaaacatttctaaagctaattctgaacatttaggaaacatttcttgtttcacagcaactgcccttttatagtttctttaaaactttcgtcattacactggaaatttaaacgacaatatttttaaatagtaaccagatcaaatttccgcatggttgtgcagacctacattgtcttacttaaaactctgcatctagttctataaatacaattataatttgcatccatctat

SEQ ID NO: 84884 - DNA, 554 bp, Oryza sativa
aacagagggagtattattattttccttgccaaatctaaaataaacaatgcttaaagctacaaacatcacatcccacctccccatatttttaaaccctctttttttttcatatgcgtttctatactattcctaattttttataaatcctatgttccaaaagtgcccatagtgattaggatcctaccttcaaaacccatatgtctctaacgttgaaggtataggatattaggatcctgtcccataggatattaggatcctgtcccaatgtcctcaccattatgtctaagtattttgctatgtttttattttgtaatggcatttcttttttttccctcattttacttgttcattgtatttgtaataagtttttttactcttatccaaatttttatgacaatgggttacaacattgctagaatttttatttttctaaaatatgccatgtcttaacttgaccacattctagtttctattttaataggctatatatatgttcggttactgtttttttttcaatcaatttattctagtttctatggagagtttagttccaa

SEQ ID NO: 84885 - DNA, 587 bp, Oryza sativa
agttgatcctccgcaatcatcacataccttatcatccaagccttgaaacaaaataactggacatgtaatttgtcaacaaagttgatcggtgatctctcatagtaagcattttcatttcctgaagagcaatgtagcaaaaggtgactattacattggacatacgggttggattgaatacttttaccaaagcagaaatagtgagactcttatggtcttacctacaagattgtcagtatagtgagactcgaatttgtgtgtctctgctctcaacaaagataagtcaccaatctgctcattaatatggtaataaaaatgacaagtcaacaatctgctcaatagttcttatgtctatgtagagacaaaaatgattgacgttacaaaggtggaccactctgtgaactgcactttaatctttttatcagttttccatatcaaattacctatcatacaaatgcaagtagtgatttaatacctcaatttcacgttataaatcaagtttgttaaattcttagttatatctgtgaaaaacagatcctacaacgttgtgcactgggctgaaaaatattcttgaatattcccatcttgga

SEQ ID NO: 84886 - DNA, 1915 bp, Oryza sativa
catcgatctcctttttaacataggataggattattgcagccttgttggtaatctcatagcatgacatcttcttgatcttcttaagatgcatttaacttccaacttcatccactcatgcacacagacaaataattcatggtggtcgtcatcccatttctcagctctctagctggtccttttatttcaaggcaacctgaagatatcaatttttttaagagagaatggattaaaccggtctttacatccaaacacagccatccaatatttgcgcttatgttgaacagcacaagaaataagttacatgaggaaaataaattcgcttggtaacttaacacccttgaaggagaacacaacacattcagagtacatagttctgatcgatctcaggtttaggggggcacgaatcaagtaataaaaagggcattatttcaatcaataattcatagttcttaagttgattttctttgtcgtttatcccttagtgcagttttcatttggatttagtgtgaaaatggataccatctgcagggaaagcttacctgccgggaccaactagctagtaaaagatcaaatccttaagtatattaaaaactaattgagttctgggaaaagatcatgatatcgtattcaatcgtctagaaagaatttaaatttcgttttatcatgttccaacagaacgagcagaattattaaaattgtcccatctgagaaaatttaaattagctacaaagaagcgacaagggttccagcggaaactcaccctagtttcagggatatatcagaaccatcatcattatcctgcgagcttcccgaatttaatgcagtcatcacagattcagatgattgtccatcttcagtaagaacattttcagtatcaggaaccgccaagccagcagtaggcacctgaggcatctgcatacaagcaaatgcacagaatataaatgcatattccgccgtgcctgatatggagaaaccaaagggtcctcgaatttgcattttattttgtaaaactatgcaaatatttcgaacgcatatacacagtatgtattaattacttggtctctgaggcgcatattctcttctgccagctgaatgccctacaagaacaaataaattgtatcataagatttgtgaaattatacctgattcattttcaaaccaaccaaatcaattttacgttttgtgctgataaatacaaaatattatatccagacataaatgttttacgttcatacaaaattttatcaaaattttgtaattccgacaatcagttttgtattagaataaatttatgaaatctaaaaggttatttttaaaggtaaatccatatatatcatttcttttgtttttaaactaaacatttgagaatctcaaattattgatggtcaactttttaaaagattgactgaatcttatcctaaacattaaatatttaagagcaaagggagtaaaattctattctaaatgtaatccttagttgcattgttggatatcggtgaaaatatcaatttctaaataaataatactcctcataagcctcacgagaaagtttactgtatctgaaaatctatgcataaataaacaggaagctgctgaatgataacatttccatccaatatatgtcgagaaaacatttcatgcctgaaaaattgtgcaataagttcacaacaaaaattgactctcgtacagagatcctatcgaacctcagcatttcattgacagtctattattgatttattgccatcgtataccgtctgcaagcaacattccaatatagtacatgcacatgtttcactcgtcaatataatttttgctatatataataatttttgctatatataaagttccggcactgaatagtgaatattagtaccctttagctagttctcgacttctagtcaccactacagaatgg

SEQ ID NO: 84887 - DNA, 752 bp, Oryza sativa
aaaagtgatgccgaatacgatgcttaccacattggataaatcagtgaagggggtgtcaagcaatgaaacagaacctatatcagagtccagaacaccaagatatgaccttccatgctgcctgtgtgacatataggtattgtgatggaatttttaatatattttcatcaacagaagtataacagtacaataaaaacctgtagctgaaaacaatgtgattgctttcaccaagaaaaccataagagctgataccaaaaacccacaatggccttgtgaactcagcatctagcgtgtaaactgaaataacctcgttggtgtgctcaacctgatgacaaacaagtgcattggcaatgtatgtcaaacaaaatccagatgatgaccaagaatgctgtatttgatcatgcaatgagccatgatcattgaagtcattacttacaagttccaactaaaaagtagagaagtcaaacaaaatcaggacaaaagatacttcaaatgttaaatgaagaagttcaaggattaagagaaaactaattacccatttatagatgttccaaaatccactccctctatcagttaggaaaaacaattcgcctgcaagttcatatgaattagacgaatctttggtagcagagttgcaagcaggatgattataatcatgataaatcaatagtcgcatcactgccaagcaaataaattgctattgctaaagttgcaaaggggttaatgggttatggaaccaacgaatttaatcactg

SEQ ID NO: 84888 - DNA, 536 bp, Oryza sativa
tcctttgagatcactttgggcttgccgtcctctctttttctcttgttaacagcaatggcggatggagcaccctttacagttctcatcggattcagtggtttcttgacgaccaaacctggagcttggccccctttaattgtggggacagtcgcaactgaagcagttggttttgtttgtgaacttgaggattgcccagcattagcttgggaggtttttgcccatgcgtatgcctcttcctgagtgacccatttacctgctcattaagaaagcataaatattagtgagaaatagcagctccctcaaaggcatgacataaccacttaaagatccagatacacatgttaagagaagtacctaaaccgtcagaatagtagaaaccagaatttgagtcaaaatagagtccagtagatttgtcataatagtatcctgaagtagagtcgaattcccatcctgcacaaacaggatgttatctaacagattgaacaaatattgttaaatagcgaaaattgtagtagtgctggcggacagaatgatca

SEQ ID NO: 84889 - DNA, 980 bp, Oryza sativa
gtcagattctcctccggcgcggccttgtcgacgaccgtgccgaattcgaagtccgtatcccacgccgcgccgccgccgccgccaccgagcccggccttcggcgttccgggcctctcctcccaatcgaacggcacggacgaggcgttaacggtgtacgacgcccgcggccggaacccctcgtcgtcgtcgtcgtcctcctcctcctcatcctcgccgtcatcgcggccacccccgttgcccccctcggcgaagtgcgcgtagatggcggcggcgcgcctggggctggccggcgcgctgctgaagtgctggaagaggtcgaacgggttggcgtgggtgaggcgcggcgtctccggctgctgctgcgccgccatgacggcctcgaacgggtcaggcgacggcggcgccgtcaagaacgtggccgtggcgaggcggccacgcgggctggacagcgccgtggcgtacgggctcgccgccgggctgtcgaaccggaagtcgtggtggcgcggcggcggcgaggcggggcgcaccattacttccatttcgggtggctctgactgacttggcttgccggagagctcgtggtggcggagcgggtttaagagtcgtggagatggcggggagggagggagggagggaggaagccgtgaggaaggagggaaatgagatgatagcagggagctgggcctcaaatttgatttttatactttctcagaaaaataaataaatacactatcccacttgcaaagttgcaatctaattgaatttgtaatatttttcaatgtaaatttgatgtatcaaatgatttaactcaccatctttttttttcattcaaagaagaacttcaactatcaactcctcaattaatcatagggtgtgtttagttcacgctaaaattggaagtttggttgaaattggaacgatgtgatggaaaagttggaagtttgtatgtgtaggaaagttttgatgtgatggaaaagtta

SEQ ID NO: 84890 - DNA, 816 bp, Oryza sativa
ttagagaagatcgcctccaaggagcccaagaccaccgccgagctttttgagctggcggacaaggtggctcggaaggaggaggctgggcctggaactctcccggcaccggtgcggcggccacagctgcccccgagtctgccccccgctctaagcggcgagataggaggcaaaagaaagccggcccgctctgatgacgagggccatgtccttgcggcagatgggcccgcacgggccccgcgcaagggaaaggccaccgatgacaagccgagctccactgctccacccagcgagggccggtcggcagacaagtggtgctcggtgcacaacacttatcggcacagtctcaccgactgccgctcggtcaagaatttggccgagcgattccaaaaggccgatgaggagaagcggtagggtcgacgggagggcaaggcccccgcgacctcaaccggtgatcggcgagaagaggccaagaacaaggcccccgcagatgatggcggtgacaatgaggatctggatttccagatacctcagggaaccatcgccacgctcgaccgggggggggggggcgtgcgctcacacctctcgccggagcttcaaggccatgaggcaagagcttttggctgctgttcccacgcacgaggtggctcggaaggcgcgctggtcggaggtgaagctcacctttgaccagagcgaccatccgacagtgctcgctcgaggagggaagttggcccttgtggcctccccgaccattcacaacgtcaggatgaagcgtgtcctggttgatgggggagccagcctgagcatcatttccccagc

SEQ ID NO: 84891 - DNA, 2371 bp, Oryza sativa
atcatcgcctaatttggtttggaaacttgtggattcgatctcgaatcggattcatctctctcctccaactccgaagtttccttctcgccgccggccgccgtgggccttcgccgccgcctccttgcacctatataaggacccccggtgtctcctctacccgccgccaccttttccttagctcgccgtcgtgtctagcgccgcctccgcgtagccctagtcgccgccgtcgttgccgtcggttcagccgcgccgcgccgccgttgcagtcgccgtcgtcggtcgccgtcgccaccatcgggatcgccaagtcgtcgccggccgtcgtcgttcgtcgtttggttcgagggtgagtaccgttgggttcgtctcgtcgtcctctacgtgtacatgtcctccaaagtcgcagccgaccatccaatctccggcgaggtcgccatcttggtccggccattgttgaggtcatcatgacgtcatcatcgtttttctttttcatgtttttctaatagattaaatcttcggaaattcataactaaatcatcgtaactcggttttgagtggttcaagttgctaaattcatctaaaatcatgatctacatgtttgtttactttatatgtactgtttatttggtttttattagtctttttcttcgttttgcgtgttagtttgtcgtttccgtcattgcgaaggttcgtgagtgcgtcgggagtgttcagaagattaattgaagaccgattattgcaaggcaagtcacacagatcctaaacacaatcctttgagcatgttgatcctatatttaaattctctatttatttcaactgtgcatttattttcgaatgtcactgggtggtgtgaacctatttctttgttatagcccttttgttcttgattactttattccttgataccttgggttattataacttgactagttgagctttatatattggttcagctagatattagatataattgcttagccatgcttagaaacattagcacactattgggataacttatgattcactattaattaattaatgatggcttaatgatagttcacgatggtcaatcgtgattggttaattaattacttgccaactaaaacttgataatggtgggttgtgagcacatggttttgagagtcgtgctcatggcaattaaggaccggttcgcgagctactattgtgaaatattaatcgtgccaaccacaagccagcgtgggcaacggctttaccttttgtatagcatggttcattgcggagcaccagactgagaagtggcggagataagcccacgggggtcgctggggagtccatgccttgttttataagggggtgattatgatccaggaatggtgcactatggtgagttgtgttgtacaaagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgggttgagcaatgttttcctgaactctaggagaagaaggggagaaagctctccggagttaaggaacccttgtaactgttaaccatcatctcaaacacaggagtagggtattacgctccacagcggcccgaacctgtataatccgattgtgtgcaagctagctagtagtattagaggcggatacgtgatttctaagaggcgagcctcttcccccggccgaactcacgaaaggggggtctcacgacctcccgctatcgagggacttccctcgacagctggcgcgccaggtagggggaaggtcgcgcgctttgaagtgaaggcgttttcttctgccccaagtttccctgggcccttgacgaccatggtcgaggtcctggaggtggaggaggcggtggcgtttacccccaccccgtccgggagtggggattctagtgggagccgcggccctcgtcaccgccaccgcaactccccaactcctccctgccgcgaaccctcgcggagggaggatgccacccgttcgggtggttcggccctctctccgctcccgggcagggggaggccacgacgcgtcggggcacgtcgccgcctcacttacggcgacggcgattcgccccgaggcgcacttcaggcggcgagtgcccttctgcggcatccccccgtaaactcggagccggagacccctgttcagcgttggctggacgacgtggctaacttggtcacctatgcccagcggcagttggccgcgggcggccgacctgccaccaccagtacgtcgcgtactcctattaccctctcctcgtcggcaacgaggagggcccgccgctcggccaccgcctcaaggcgg

SEQ ID NO: 84892 - DNA, 727 bp, Oryza sativa
aaaggaattgcatattcagcagatcctgggacaacatcaattttagcttcagcccctaaagctagaacgagcctggctgcccattccaaaaggtatatcatcagttatatcactcaaaacttctaaggacgccataaaattacaaatgcaagatatcctgaaaagttattgtacatttttacaagctaaacaaagtaaccacataatcttatttagtggtattgtactatcatacagtttcctaatacagaagatagaaagaagtccgtcataggctccaccactataggataaactctaaagtatcatgattcaggggtggcacaatcgaaggaagaaatgctgcataatcatttggtatttctataaaagatatataaatatataaactattgcgttgccacttgtgaaactgatgggcacattaacaaggcactaaatgatatccgcaaatttcaaaattttataccagcatataacaatctgtccccagtctaaaaattttcacaaagagttacatgaaggaattcaatgatattgtgagagatatatagtttattaaatttgtttgacatccattgcaattctgtagaaagttatcatccgtaccaatcatattcaataacggtgccactttccagatgaacaactccaccagtgcatgatcctccagaatctcttctaaagtgatcagaagggcgcagaagctttacactatccttcacga

SEQ ID NO: 84893 - DNA, 4445 bp, Oryza sativa
ggccccccacgcgtacgccacgtagaccaaaccccccgcgaattaggtcaagggggtaattcgtccggtttgcatagttgggggtgaagaatgtccggttttgtggttcaggggagtaatcaggacgaccgcgataattcggggggggggagggaggggggttattcgtactttttcatatattgtaatcgtagtagtatggtaatcttctttaaacttttatagccatattactaattttgtatgttttaatatgctttattattagtatattatgttatacttttgatctattttattatctataattgcattgtatatattagcatctttagatttactatgtttagaaagaaaattggattggaccacccgtatcttaaatcctaaatccgccatggagttccatactccgacaatcatgatgtgggcagtaagtacaaaatatttttttaagattttcctaaaatatattattcacgtgggtagtaattattatatatgggccttgccccccacattataattccaacataaccatggtgattgttatgggttaggatttatagcgggtaaacaccgcctaccaagttgttataggttagggttcatagggggtaaacaccaccgggaggatagccaggcgatgacagctggtagggatgagagggggacttaggttggagaagactaattctgattcattgcttaatcctatatacctatacaattcatccccactaactgcaattaaaactattttccttgcttctcagtgagccacgtcacatctatcagtttcagccgttcgattcagccacacatcgatctcagacactgatctcatacactcatgatctatcaaccattcaacaagcccataattaccgagctcttacaggcacgttggcttcctcgctccagtatggtcctataggctcttgctatcctgtaaccgctggtgtattaatcgccaaggaacttgagcaggctgtaacggcaaaggtagtgcacattgtgaggagttttaatcattcatcttccatacacatcacctacttgacgtcttcctctatgtatgcttgcctttctcccgcggaagcatagcacgtcgccggcaacccgcatcatccaccaagggcggcctgatgtgtccaacgccataatgcatacacatacacgagttgtcatcccatcaaatactctaatcctccgataatcataggttacaagactcatctcatcccgcttacctatgcttcctcccgttgaatagtctatggattttatttgttctgccaaccagccacagctgaacggcgatgatggcacctttaatttgcattgttcatttccctgtcttcattttccacttctacatgttatttaaatttgagatgatcaatttccgtccatctgctcacttctcaatgtaattggggattgtttgaagaggagaatatcgatgacttctgtttttcttttactgtgattgtgttctccctagcttcatgcagacttggcaaaaattggtgagtcagtgataaaaaatgaaactacactcaactgtataggtctgaatattttgtttcacttgcaggtatttgggttaagcaattgcaggagttcaacgagtcactttggttcgtagttcgtggagtatttatgttcctacggaatcacacaatttctgctgcgcagtgaagctattcgatgagtttcagcctattggtctgcatcaagacattcaggtaaggctatttgttaacgtagtaacttcattcagcctgaaaaggtgctaactacacattgctgtgtgtcggagatatgggcccgggggtatgtgaagtgggggaaagttacctttccatccagccatgtggctctacagcctggccctactcccgcgcctcgtgagtcacagaagcggccgggggggcctcggggtgccacatcgtgcccctcgggctctcccgctgcctcgccccgaggccctcgcctagctgccatgtggcgggaggagggagcaggaagggggcccaggctgaacagccatcaatgcgcagcgccccaactgtccctcgtcacatttaatgcggtaagggcagacgtgcggtgccgcctagttgacccacatcaatcgaacgtgaccagtctgtgaccggcctgttgccggtcacatccgattgaacgggcggccgtgcccccacgtcgcctctgtaacaggcggagtggaagtaggtatgacccgtcccatcaaggcgtcattcagggtttcctccatgagaaaaggaccaccacaagtcttcacccatttatgagggaatgacagggctgtcccccgtgtcaggcggggggtggcgctgggtcccactcaaggacgggctgctgcttagcttccgagcgaaggcacggctcgtggcccggtcaaggtaaggtgggtccccctcccaaggaaggataggtagaggcggtgcatgtggtatccccttgaactataaaaggaggaccttgcccaccgagcaaaaggatgactcccagaaaacctgaactctaggagaagaaggggagaaagctctccggagttaaagaacccttgtaactcttaaccataatctcaaacacaggagtagggtattacgctccacagcggcccaaacctgtataatccgattgtgtgcaagctagctagtagtcttaggggcggatacgcgatttctaagaggcgagcctcttcccccggccaaactcacgaaaggggggtctcacgacctcccgctatcgagggacttccctcgacagtgtgcaagatcactgatttaaaatttagtatgatcataaagtttttcattttaaaggttcactctgggaacattaatgatttgctactcaactaaggcaagagagttacttcactatcacattcttaacactaacagaaactagattgagctgtaactctttaagttgtttcactgtaacgataaggaatcaaggcacgagatgtgatgagtttgttactttcgagaataaactaatttggttagttttatttccacatctgtttatttaaaaagaagcatgtaattttgacaatattaccaaccagcaataacaataataaaccttttcattatatagccttccctttgtttcatttgatatttggacaataagcaatttcatcaaaaaaacgatgcatatttaatcatatttttttagcaatgctacaagattatgtgagcacattagataattgcacttgcattatatgtgggcaagataccttttgtatttttcacattgcacttacaataatcattgagtcccgcaacaacacgcggggtattatcagttagaatgatgatacaatccatccttatatagatggagagaggacccagtctaattctatccaacaaactctatccttatccttagggcctcgatccctcggcccactacccatgacatatacttgtagttggctctctgaacttgattagattcacaaagtcaacaattggtagtagtactccctccgtcccataatataagggattttggacagatgtgagacgtccagattcattgtattaggatgtgtcacatctacccataatcccttgtattatgggactgagggagtactagcaggcaatagcgaccacctgctcaaccagttttttcccctgctcaactccatgtctccatcatctattcatctatcgcaaattcaaatcatagccaaatcactcggcatttggagtgcatcgattttatagaaattcattccatcacatcgctactcgatcctaagccaacgacaaagcccccgcattggcaatggcaatggcgccatcattttatttgcttgtttatttcatcaatttcacgcaacagtgacacgagtacccgatcgacgcgaaggtcgcagcaccaagtcatcaatcaacgagtgacgaaatccacgacgaggtccatcatcttcgccgccgccgccgtgccgggacgcgtgaggtggaacaagtggtcttcccccggcgtgtccaccagctcggcctccccgtgccaccggctcgccacgagcgccgcgtggtacgccctccctttccccgccaggaagtcgtccccggccacggccaccatcaccctcctgcacggcagcgccgccagcgacggcgcgccctgctgcaccgtcgggctcagccgcgggtcgtcgacgcggacgtcggggctcccgcacatgaaccgccactcgcggcggatccggtcctcgagcgccgggcccatggtgttcgacgcgtcccagaagtaggggtgcatcaggagcacgccggtgatccccgcgccgcccgggagcggggcggcggcggcccgcatggcgacgttgtgcgcgatgttcgcgccggcgctgtcccccgcgatgaacacccgcgacgcgt

SEQ ID NO: 84894 - DNA, 1812 bp, Oryza sativa
actataatctcaacgtgctgaccacatagttaggcaaatgaaaacaagcagaaaactttatataccttttgaacatcctgcacaaatctgaatcttgatttttgttgtaatgcaggatcaacgtgactgacctgatcagcttaggcatggagcacggcacatgggagatgagcgaatccaagcaccgggtcgtcctcgcggacaaaacataccacggcgagatcagagtcagctcacgttcacggcttctgcaaaggtaaacaaatcaccagacgcacgactgaattattgattattcatgttacgccccgttgacctccattggtctctcctgattggctgggatctgaatgtgattcgatgttgatgtccaatgacaggctcaagaccacgcagacaggttggaggatgggcgcacagctttcgtcagtagaaagattgtgaacttcaagtctataatcagttggggcctgtgggaggtttagataagtatactatagtactagcaaggtaggattttgtgagtaacaacggcatctaatgcccaagattgatgtggttcgaagtgtatgtatgctgccttttttttttctatactagatgtatattcagaacattgtagagtcatgaacctgttaatggatgtgaattatgatactacttcaacctctttttcgcctttgtgtagcgatacatacggtcagactttaccatctctaacctccaatatattaattagaatgtatgtataattcaagtgtgatgataacgagttgatttttcatcaaaaccacttatgtatcgttatattctttacaattttttattaccacattattaggacgtctgtgtgtataagaaatcatctatttagaaacctagggagcaggcttacaccgggaagtatctactgagaagtaccaattaggtcaaaccgtgaaaaccatcacatatcagagtatcgagaggaatgtctgcatttatccactccataattcatgagaacaaatgcaatcaagtttcttgtgtccttggaaaatccattcttagtgatgtcctccgaaaagaagactagttcagaaataaatcaaaggaaccactattctttcatcgtgtcatcatatacaacgaccaaatataaacataagcaaaaaatctattatattattaaaggaatagaaaaaaggagtctccacgttcgctctcatggcctaaaaattctcacattaatcggagaaaaagaaaaatcagagtccatatagaaatacaatttagaaatagctgaaattcggaattaaaaaataagaaatattagaagaggagactagagtccatatagaaatacaatttagaaatagttaaaattcgaaattaaaaaataaggaatattagaagaggagattagagtccatatagaaatacaattaggaaataactgaaatttggaattaaaaataaggaatattagaagtagagtatagagtccatatagaaatacaattaggaaataatagaaattcggaattaaaaataaggaatattagaagtagagtatagagtccatatagaattataattaaggaaataatagaaattcggaattaaaaataaggaatattagaagtagagtatagagtccatataggaatttaaaactaactaaaattcggaataaacataataaattaaaggtagagttttgagtctgtataaaaatacaatttacaaataactaaaattcgaaattaagaaaaacacgtgaagaagagtttaaagtcaacatagaaatacaatttagaagtaactgaaatt

SEQ ID NO: 84895 - DNA, 1033 bp, Oryza sativa
gccgccagcatgtagaacgtcgcaccggggtacgacggcttggtggtgaggagcacgttggtggtctggcccggggtgatgaggagggtgtccacggtgaatggcttgacgtagaccgcgtcgacgtcgaccacggtgagcgtgtgcccggcgatggagaagaagagctcgtcattgagcgcagcgttgatgagccgcagcatgtacgtcttcccggcctccaccttcagcttgaacgtatctgcatgccacacaatgcgtatgcgtataatcaaaatgtactagctagctagcttatagctgcaagtgtacagcacagtgcaccacctttggcagagcagttgtagagcggcccagggaggccattgatggtgaacgcgtcggagacgttcgggcctccgccggtctgcgtcgcctggcttatcaccgcctccgtgtccgccttccaccactcgcctaccacccaaacaaaacaaacgcaatttaacccctgatcactgatcagtcgccatgtttgttacgcttacgtacagacccacgccacgcgacagtacgtctgtcgtcgatcattacataccgaagacgacggggacctccttgtccggcgccgggaacgggtaggggacgccggccttggggaggatgatgatggggccgtacacggtggcgcggagccaggagatgtgcgcgtgccaccacagcgtgccgcgctgcccggtgatggtgtacttgtacacgtagctgccgcccggctggatcgggcactgcgtgatgtacgccggcccgtccgcccacccgctccgcagctgccggatgccgtgcctgcatcatcgatcgatcgatcgatcgtcacaatgcgcagtgatgagctcgatcggtaaaattttgcaccggaaaactgatcgatcaaacggtgaagcgtgcgtgcgcgcgggtgtgtgcgtaccagtggatgctcatgttgtagggggagtggttgatgacccggatgacgacgaggtcgcctcctcgcgaacacagtcggccccgggaa

SEQ ID NO: 84896 - DNA, 842 bp, Oryza sativa
ccgttgactccgaatgcagtgacgacagctagctgacatgtggtgcatgtgtgtggcaggggtgtggctcatgcactgtcacttcgacgtgcacttgagctggggcctgtccatggcgtggctggtcaacgacggccctctgccgagtcagaagatgtgccgccgccgtcggatcttcccaagtgctgatggctgatccaatggccgggccgggacagattgtttgcgaacgttttgctgtgtgcgccttcgcgttccgttgtgtttgacgtacaaaactctttgatttggaccgacttaattttaactggtgtgtgccgattttgtggcaagtgtttgggggttttgcccccgtgcttaattcctctttcaaaacagaataagatgtaagcaactcggttctgttggtattttttttcgtgggcatttgttattggtgtgtacacagtcgaatccataatgtaccagataacttctatatttaattgttttggtttttgatcatttcaatataaaaaatggcttaagctcgagagtaagaaaagcgatcacattatcttactatctgttataaaaccagccccgaaatcgacgtcggtagctaaacgcggaagaaaacgccataggagatccaaaacgacaacgtcaccgagatacgatatttggtaacggagttcagccgtagcctacatctccagggcactgattacgggcgctcctctccgatctagcatattacagcgtatcagagttacaacgactcacggtcggttgacgcaggcaaccgctccctctcgctatgctaagtcaccatgcggttacaacaagcacgcccctctatt

SEQ ID NO: 84897 - DNA, 1231 bp, Oryza sativa
tctttaggagttaaaaccatcgtttactctttaacttatcagctgtagccaaactttaaattttacaactcaatttttgagttgatttttccatcatagtttatttgttttattgacttctctgagaatacatatataaaaactttacgaccaaatcattttttattggtaataagtgttacgcttataaataattaactgtaggtgaaatgatggaagtaatatattttctcttgattttagatagtttgaattcaagttgtgggaaacaaatccacagatttgtttaattgggaaagaaaatggatactcatgaaagaaaaatataggcaaaaaggacaacgtacaaggagtgttctggaacagtttcatgcaattaatgcccatttttttattcaaagaagcatcaaaacagtgtcattgtatagttgtacacaaataaaagaaaaaagaacaaaataatgtcacaaaagttagctaagaacgggctaacacactaaaatctccttcaggagaaagcaatcgcaaattggcgaacaaatgaaatgaggaaagaagaatcaacggcatctgtggtaaggtcccgactagcatttgggcagatcggacggcggaggaagcagcttctggttcggatggctcccatccaacactagccatgccatcctcaggccccacgtcgtgtgcgcctccaaatgacagtgcatgaaccatacacctgcacgcacataattgcacaacaaaaattattagcagggtagtactatatctaagacgaatttcacgtacactaattgcagagataactaactaactaactcacctgggttgtcagcgaggaaacggatggccacccatccgcggccggcacgccgacggtgttgcgctcgacggggtcgacgaggttgaacttggccgggtcgttcacggcgtcgtagttgccgaacccttggccgatcacgaagaagttgaagccgtgcaggtgcagcgggtggctctcgatgcccaggatgctggtgtcctgcatcaccagctccaccgacgtgttgtaccgcagcaccagcagcttggtcccggtcttcacgttggtgttgttcggcggcgtccccgtgtagttgaacggcgacagcggcgcgacggggaagtccggcgcgtacacgccgctggagagtccggtgaagtgggactgcagcagcgccctcgccgggagcacgaaggagacgttgttcat

SEQ ID NO: 84898 - DNA, 703 bp, Oryza sativa
ttgttcatgccccatataatactttacatccaatgcaacagcacttaattatgcaatgatttctgctgtaacaagtaacaaagagaacactgaaatcacttttaaaattgtacaaaccaacctaggctctcaaagcaaatgtgaaggtttcaaagtgcgcctcagtcacatcaagaataaaatatagcaattatttgcaatttaagaaaaaacagttataagcagttctcatatagaattgacaacattgaccaagccgatattgtttaacatatatataataaaatttgctacctcctgaattgataaaacaaaaagtatggcagcccaacaacaaagtatttgcaacaattttgtttatttatgtactcgtagcctagcagcattgtggatactggatagtttggcagccaggttgcaaaattcttatgtaaaatttgataaatcaactagtagaggcaaatgaaaattggcaccgtaaaaaataccttgtttttcttttccaagcctccgataaccctatcaattgcagattcaaaatgttgcattgtaagagtgtgccctcacttcttgcagcaattaaagctgcctcattacaaacattggcaatgtcagctccagcaaatccaggtgtcaaagcagctaatctttgtgaataaaatgatggttccttgtccagtttcagctttttaaggtagatgcg

SEQ ID NO: 84899 - DNA, 520 bp, Oryza sativa
ggtggcacgcccacttctcctggcttcgcgtgcacctatacggccctctcgtcatcctccccaagcgcggcgagggcttcccgttccctcgcccctacaaggagctgcctcccatcatgttcggtacgtgacgcctctcccctgtgtgatggcacttgaacttgaaattgtgacggtgtttcgtaatgcgtacacttgtgtaggtgagtggttcaatgcggatacggaggctgtcatcaaccaggccctgcagacgggagcaggccctaatatctccgacgcctacactttcaatgggcttcatggcccgacttataactgctcgtccaaaggtgagatgctctgtcctctcctgattggcccatgaattaatcacggatttgtctgtttatgtctctatgatgctcgtggcagacacgtacaaggtgaaggtgcagccagggaggacgtacctgctccggctgatcaactcggcgctcaacgacgagctcttattcggcatcgccaaccacacgctcac

SEQ ID NO: 84900 - DNA, 506 bp, Oryza sativa
ctcggtgacctgctgattcaacatcagaggtttctgtcttcaccttcacaagcttcttctcttgtctaacctcaccaaggaacctactcccctcatctccactgtagagcttatccacatcaatcacaagcttgctctcatcaggaagaaacttgcttgcctcttgaaacccgcggcggaactgcaaagcctgttggttctgcacaacaaaatcattcaggctaacatcaggcaagacaccagccgggctcagcaacgactcgaatccttctgagaaagtaacactgctgccgttcgaagacgcgaacgacgaagattgcgacgggaggttctcacgaaccggcttggtctggagctgatagaattccgtcgggtcgtacggccaggcgccgcccgattccaccatgccccccgtggggatcagatccccgtacagctggggcgtctgcgagaaggcggccgtggggaactcgaggaccggcgtctgcggcacggcgccaagcccg

SEQ ID NO: 84901 - DNA, 682 bp, Oryza sativa
acaattctgtattgctgattcagcccagagcagaggtcgaagctgatcgccgagtgccagtcggcggatgtggtggtgctcacctacgcctgtgaccaacctgcgacgctggagcggctcagctcattctggttccccgaactccggcgcctccaggtgaggctctgcactcactgccggaattgattggtaattttgtggattaattttgtccgctgtggctcatgttttgttctgcttggctcagttggaggcaccggtgattgtcgtgggatgtaagctggacctgaggggtgaggagcagggaactcttgatgccgtgatggcacccatcatggttgcattccgagagatcgagacctgcattgagtgctctgcgcttcgccagatcctggttaatatgtctgcagtcataattttgtgttgataggttgctctgagatagggatgcttggcacattgctgcacataattaagttaatagctacaacactagctagatcataattttattgtattctaggcatgaacttgttgtacttttactgggcaatacttttattatgtactgtgtttattagctaaccagtagcaccaagttggacagactagagtaatattaccaataataattagagcagttttaaaaattatgaaatatacaagaaagtattacacgata

SEQ ID NO: 84902 - DNA, 702 bp, Oryza sativa
atgatggagaacgagagggagcgagccaacggcttggattcgccggagggagtccgtcgggggcggattgcggcggcggcaaccggcggagagaaaagggggaaacggcgacgaggtcacgaggggccgattcccagcggtgagagcatctacacggctacgggaacccattgctagcgtcggattgggcggagctatgccaagcgaggccggcgacgagcaggcgctacggagcacgggcggcgacggcggcgagcatacagcgagcggcggcaacggtcggggcggcgccagctagctacggggaggctactcgtgctactacccgagtctaaggggaggagatggaacgaggagggagaacggagggaggcactaccgggacgaggcggggcgctgagacgagaggccgacggcacgggagtgatctctccggcctcgggccagggaagaggaagaagagggcgcgcccggagtccccttccgcgtcctcgctcgtgccggctcctccgacacgcgcgacgatgaacggagcacgggaggcggcgataatggagtagaggcgatgggacaaaacaagaggagaagggagagagggcgcctgggctttatagggtggcaacgtcgatttgggaaccgacctagggcggtcaagggagggagctagcgctcggcggtcgcggccaaagcggcgacgggggg

SEQ ID NO: 84903 - DNA, 774 bp, Oryza sativa
acaataaaattctagaaatcaaagatcaattttctgcctaacaacacccccacaggtttgtcaagacaaattatatagttcatattaaacactgcgtgctccttatacaagatatgattgctcccagattaatttgcttaatactttacatgcactgtaagcaatctattccatacctagttttgatgctcagaatgcacagatcaatgaatatagagattaaaagaacaacaatatggggtttcctagagtcatgaaagaatcttgcacagtgctacaggacagccacaccaataaatacaatgcgtgtgagttctgaatagagaaagggcttctctttcttgttttgaaaccaatcaacaaataataatttgctaaaaggtcaatccatcaacaaaaaaatacagggttgtcaattgttgtgtcaactcttatcatgcaaagtttgagaaaataccttggagatgaacccttcaaacgacaaaccacccaagacattattttcagcacagttctcgtacagatgagaagaccacggactgaaattccaatagaagagtattgatacaggaaatatcaacagacagattattaaatagtaattcttcacacccttctaatgcaaagaatcttcattacatcaagtccaatagagaaattaatacaagaaatatttaacaattttggtaacctaactttttgttacaatgaaagtatcaagttattaaacatgaaagggcgttctatcagcttcttacttttcaggtgcggttg

SEQ ID NO: 84904 - DNA, 742 bp, Oryza sativa
aattcgagctcggtacccagaaaccgaatacacatgtacaaaacccccctataggaatacgcaaggaaataatacaattggccaaaatagataatgagggtcatctccatatcattttgcatttctcgacaaatataatctgtttggctattctaagtggttctttttttctgggtaaagaggaacttgttattttgaattcttgggttcaggaattcttctataacttaaatgactcagtaaaagctttttttattcttttagctactgatttttttgttggatttcactccacccgcggttgggaactactaattcgttgggtctataacgatcttggatgggttcctaacgagctaattttcactatttttgtttgtagatttcctgtgattctagatacatgtttgaaattttgggtctttttttgtttaaaccgcctatctccttcgcttgtagtcatttatcattcaattagtgaagcataaactcatttgatctcctgatattaatcaaaattagcatcctttttcctttagaaagaaagcctttttccattttagcaaaattctttttttctatttctacctgctcaaggtattcatcattccagtacaacttgtgcagtagaatgacaacagattcgtgtataaggactagattagcttagctacctatctaatttatttgtaaaatttcgggatctgtgattgacatggaaaataaaaatactttttcttgg

SEQ ID NO: 84905 - DNA, 653 bp, Oryza sativa
cattgagattttaaaatcaaacatgattattattggggtttatttttttatttttagaagcttgaacctttaaaaattggaccttatagtttttagagtttattgtcctgttgggtttcatttttttcataatagaaatcctatcaagcgctaccaatatactcctccacgacccatccgccacatactctttattgccattgggattataaaactcaaacataactatcgttggaattcattttttactttatagaagacccacaaccatcggtggctctgccattgtactcatatacgacccgccagctgccttttatttttattgtaattgagattttaaaaatcaaatatgattatcattggggattatttttttactttctagaagccccgccaaccgccttgaccgattgattcacgacctgcccgtcgtccttcgttttaatcatcattaggattttgtttggcgttttattaatagtttttagatgtcctatgaaccgccaccactctgctcctctatagacctgctacttaattaatctcatcatgtgttttagatggtatttttttaattagtcttatttttatcaacaattttagttagtataaaatatattcctagttgaaatttacttttctttttctaa

SEQ ID NO: 84906 - DNA, 699 bp, Oryza sativa
aagaaattagaaaaaccagaaaacctataggctgacgccaaagattccatccaaaaaaaccatattttgactgtgcttcaactatatcaactgtacttgaactgttggataatcatagtcgacgataacatcacagttcccaccgctattccaaaaccgtacatgaaaccttagtttcatacggctcctctatgatcagaaaaaaggaaagtactgtttcatttcgttattatcttcttgggcgtagttagaattatctaagataaaatcgatttcaacgtcctaaattagaccaaaggaattctgtctgctagaataataaaaaacgcttcggaattcatctcatcctttataatataatggtactttttctttgttcagcaataacttaatcttggaataaaacactcgttataacaattaataaacgaaaagagttgggtattagttcatgaagaattctgtatgaatatggataaacgacggaaagaataaataaagatctttttttttgtattgggggattccatatcttttgtcctcaggcatgcaagctttccccgaggggtatttaaaaagaaaaaaggaataaagggttaattcgttcttgatagccatttccttaacaagtgaatgggaacatactctggatcggaatccgaagaaagtactacttgctcatttccaccaatttcaagt

SEQ ID NO: 84907 - DNA, 625 bp, Oryza sativa
ttctccatcgccgggcacacgctcaccgtggtcgacgtcgacgcggtctacgtcaagccattcaccgtggacaccctcctcatcaccccgggccagaccaccaacgtgctcctcaccaccaagccgtcgtaccccggtgcgacgttctacatgctggcggcgccatactccacggcgatgtccggcacgttcgacaacaccaccgtcgcgggaatcctcgagtacgaggaccccagctcccactccaccgcggcgttcaacaagaacctcccggtgctcaggcccaccctgccgcagatcaacgacaccagcttcgtctccaactacaccgcaaagctccgcagcttcgccacggcggagtacccggcgaacgtgccgcagcaggtggacacgcggttcttcttcaccgtcggcctgggcacgcacccctgcgccgtgaacgggacgtgccagggtcccaacgggagccggttcgcggcggccgtgaacaacgtctccttcgtgctcccctccacggcgctgctgcagtcgcactacaccggcaggtccaacggggtgtacgcctccaacttcccggccatgccgctgtcgccttcaactacaccgggacgccgccgaacaacac

SEQ ID NO: 84908 - DNA, 668 bp, Oryza sativa
aatgcaggaccatcactgtatatggattaacaattgtgttggacatgaaaactacaagattttcctagtctttgtgctgtatgctgtagtagcaagcttatattcactggtacttcaatatccttggtttattttagcagctattccttgttaggaaattaagaatgtgaggattaacatttataacaggttctggttataggaggtgctgtgcacagtttgcctaagaatgaacaattaggcagtgattcttctagaacatcaattgtaagtacctcagaagggctgtttcagtcatgctgtataatatgaccttgtataatatgctaagtgaataatatgtttcaaatgtgcagatcatttgcggggtatttttgtgtccactagctttggcattgtccattcttttgggttggcatgtgtatctcatctttcataataaaactactattgaggtttgagaaattgaatccccttggtgtttagggatttattgtttgtggaattgtaatgttgagtatgttggccgtttgcagtaccatgaaggagttagggcaatgtggttggcagaaaaggctggaaatctataccaccatccctatgaccttggtgtctatgagaatcttgtttcagtaagtattattcccgttcttttcttttcatatgct

SEQ ID NO: 84909 - DNA, 536 bp, Oryza sativa
  unsure (1)..(536): unsure at all n locations
gaacgtcgagtgtccagcttggcaagaagcccccacgaagtagctttggcgagcaagccttggagcgcatccatgacaaggacaaagagtagcggcgacaacgggttaccctgccgcagtcctcgcgccggcttgaagctgtcactttcatggccattgagcaagattctggtttcagaagttaagagcagggcagctatccacgatcgccacctggacccaaagcctctgtttcggagcaagttcagcaagaaacaccaagagactgtgtcgaacgctttagtgatgtcaagtttcaggaggatcataggcttctttcttcggtggaattgcagcgctaaacctctgacaaaaatgaagttttncgtggtattcgnaatncngngncncnannccgnggnnataaggcagtctggttttcagcaactagatcgcccattctcggcgccaaccgggacgccaaaatcttcgttgcaagcttggaaaagctgtgtatcaggcttatgggcctgtaatctttgatcaacgtgggcgca

SEQ ID NO: 84910 - DNA, 638 bp, Oryza sativa
aatgtttcacttcttttgttaaatctattccgaagtattttattatttttgatgctattgtaaatagtatggttttctaaatttcttttttggatagttccttgttagtgtgtagaaaaacaactgatttttgcatgttgattttgtatcctgcaactttacggaattcatttgttagttttaacagtctttttagagtctttagaattttctgtatataagatatatgtcatgtgaaaacagagacagtttcataacttcctttccaatttgaatgcattttctttttcttgtctaattgctccggctgggacctccagcactaagatgaatagcagtggtgagagtgagcatccctgtcttgtttctggtcttagaggaaagagccttcagcttttcatcattgggtatgatgtaagctgtggtcttgtcatatataacctttattatattgagaagtattcctgctatacctaatttgttgaaagtttttataagaatgttgacttgtgtcaaatgctttttctgcatctgtttagatgatcatatgattttttttttctccagcactgaattacatttatttaaatttttgtcaactccagatgagaaaaagtaattttccttgtacttgtaat

SEQ ID NO: 84911 - DNA, 679 bp, Oryza sativa
tcctgcagccccgttgttacgcacctcgtcgaatcccgccaacaggctgcccgacgagggccagataaagttgacgtcatccgttgcagcagcagcggcgggcgcggtggccaccgccggcgcgctgggtgccgctgccggcgccaccgtggccggtgtagacgccgccgacgccgacggcttgggtgcgctcgctgccgatgccgcagccaagggcgaagacgtgacggggcgggtgaccacaccggtgtcagatgccaccgcagtcgccgcagccgcagcagggggcaccacacgcagcacctggcccacctcgatcaggttggcgttttccaggttgttccagcgcgcgatatctttccaactttgcccgttttccaggccaatgcgaatcagcgtgtcgcctggcttcacggtgtagtagccaggcttgcccgcgttctcagcaccaggcaagggcttgacctcaggcacggccccggcgggcgccgtcgtgccgctgctcgcggcaaaggtgccgcgatcttccacgggagccctgttgatcggggtgctgcaccccgccagcaaaccgccagccagcacggcaactccccaaaccacaagactacgcgataccaacataagcaaatccttcaggcgatccccgattttagggggacgaaatgcacggcttcca

SEQ ID NO: 84912 - DNA, 723 bp, Oryza sativa
aaacaggaagaaacaattcgatgtacataaaacgggaaagtattaaacaaggaagtaaatgcgatgaattacctatgggagcactgcaacacaagacaggagaggaatcacagtatagctaactaagggttgctaattttaaaacagctgtacgactccaaaaatgtgaacaggacaatgatatctgtacagaacagctatagtataggcaaaaacatatattattactatctaacagcagaaaatatctcgcggtacacgatgttccaagtgcgagtagtgcaattgccattgtcatcttcaattaacacctttaagcctgcgcgagaagtgactcgggaaagagcaacgtataactggccatgacaaaaaacagggtttttcaagtaaataccaactgaacgtaacctttgtccttgacttttatttatagtcatagcgtagcagacacggacagggaactgccgacgttctaatgtgaagggccattttttgctggtcgcagataaggttattcttgggatataaacagtttcccccgcattagaaccagttataatacgcgcttcgatcaccctatcacccaagtttgtaacaatatccttgtcccattgcaaagcccagcggtctgatctaaatttctcaaaagcattatgggaacacctatttttaggcacaattgatgttcaggataattgttaactttgatggggctgcaggaat

SEQ ID NO: 84913 - DNA, 660 bp, Oryza sativa
caatagtactccgccgccgccgacgtcgaagtggctctgacaagtgtacatatatatcaatgtgtggctggcaggtggggccaagggcacagaaggacagggagaggttcccgccgaacaacatactgttcacgctgacgggggcagggttactatggatggggtgggcagggttcaacggcggtggtccgtacgccgccaactccgtcgcctccatggccgtcctcaacaccaacatctgcaccgccatgagcctcatcgtctggacatgcctcgacgtcatcttcttcaagaagccctccgtcgtcggcgccgtccagggcatgatcaccggcctcgtctgcatcacccccgctgcaggtacgtcattcatcacactacacagaaaacgaaaccttattacttaagtgttagctaaaataacttaaaagtaaattattgttattttttttaaaaaaacaatctttctatacaaaacttttacgaaaatgtaccatttagtagtttgggaagacacgtgtatgcaaaacaaaggagttgaaattggaaaaactgagtacctaacatagccttatattaatcaaattgttgtctagtactctaattaactttgggatcgatgaactataacgtgatggcgcgcgtgaaaagctcggatcg

SEQ ID NO: 84914 - DNA, 545 bp, Oryza sativa
ccttatatattagagtttttcacaatttaatttactatctttcatatgctacttatatatgactatgggaatttttaaaaggtttaaatcatgcatgtggcatttacatatgttaattagagtttttagcatttaatttaatataattcctacgctaagtatatatgatgattacaatttttattaattttaaatcatgcagtatgtacatacatatcttaattagagtttttaccaatataataatatcattcatatatatgctaagtatatatatatatattggaatttttattaattataagtcatatatttgcttattacgatttatccacttaatttattacagacaaaaataatttttcgaagtaattgtcattaatctttagtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggttg

SEQ ID NO: 84915 - DNA, 699 bp, Oryza sativa
catgactagtggcatatatctttctctttttttacctcattaacatggtaatttttaggccttgagagcaaatatgttggctccatttaaccttcactaacttatataatactccctctgtcaaaaaaaatataaacaggcgccccctcgctgtcgctacttcctttggttggtcacccttaaccgttgctggatagcggaccgcctcccgagtcgtggtttgtcacacccggatcgatgtgttctttgtgatcaatgcgaagagacgattgatcatctcttggtcgaatgcccggaatcgcggcaactatggtgggttgcattcaaagctatcgggcattcggagtgcttaccgctcattaacactctttcttttcatggttgtgtgactgtcataagaagatggtcaaggaacatcgccggggtttcgacaccatcgcaacattggttgcatggacgatctggaaggaaagaaacaatcgagtcttcaaccagaagagcagaacttgggtggaggttgcaagggttatgacgggtgaagcggagctgtggcggctagcaagagctgcaatccctgttttggtagcccatgttagtggagaagggtcgcaaaaatttagttggagattaggcttttagttttttgttctcctcctgtaccctgtccccttcgttttgtctttttggcgggctgcagga

SEQ ID NO: 84916 - DNA, 603 bp, Oryza sativa
gcacacgtcttcgagctccatgggcatgtcgaggctccgaagcttcagcagcatccccttcgcacgggtatagcggccatccctgatgctaccgagaaacctatcgagttcttgtggttttgcagggcccagactaccgtagtacgcgagaatatggacgggttcctcggctcctattccatcactgattaagatcaacgacatcggcaagacggcaatgatcagacatgcaggactgtgtatgtgcaaggcggtagagactagagagtacgatgttttggttaccttggtgagtacatggcgcttatctcgacaccgggtatgatcctgatggagcactgcttcgcagattcgatggcctcggggacgccggccatggtgtcgtggtcagttagcgcgagtactttcacctgcgctgatcacaagggcattagcgttaggaaacgcgacgatttgcggtgacgacgagtgcaagcgtgaccgagatcgttcgtgttcgcgggcatttcggtgctgtgcttactgcttaccccattgcggtgcgcgcgctggacgagcgccgcgggtgagagcgagccgtcgctgcacgtcgagtgcgcgtgc

SEQ ID NO: 84917 - DNA, 880 bp, Oryza sativa
atattcttacgtgggtgatactgtgatagcactttattccaataaaattctatggtttaaatatcggtctccataattttagctcatgttagttcagtttttacaaaacttctttttttttttgtttagtaataataataatattttccctaacaggtagttggggataaagaaggtgcagtttttggcggtttagttgaggctccattgcagccaaccagtgcaaagaaatatcaggttccacctacacattctgaatttctgataccctttttttctggtttaattaccttatgcagattatgatggaatcttaatattgcaggggagcaatagctgctttgttttcactaatttacacagcaatcctagtatatatcgaccgactggtaatatttcacctcctgttttcatgttctttgcataagaacatcaaaagctgcgaaataattttgttccatttgaccctaccttccagactactagatgtatttctctgtgtagcagtgacttatgattgtttttgtcccctgattcctgttcaatatatataacactagcatactcctacaaaaattctgggggatcaagttgctgaatatattactgttaacactagcaaagacttaactcaggagagcccctgagcattcatttctggtattgcaggtgctaataactatttcacagtgtgctccaccgactatttggcattaggaggtggaggtcatttcgcactttatctagatgccgacctgtaatctcccacctcttaagcatgtctttcacgccgtcaaatctgctggttttattgccttttgtcattgatagctctcatcttttcttctgggttaccctttttcaggttgagtggttcaag

SEQ ID NO: 84918 - DNA, 12545 bp, Oryza sativa
cacgtccaagtcctacaagaaaaggtaccaagctccataaacatgtttatgttacacataaggagcaatagtttgttctatatgttctaactgaatttgccaaacagggctaggccatctcccggtataggagctgctaagaagttgttcaaggataatggtgatggtgttgctgatggcaggtaaactcagcctgtacaacctgtgctaaaagaagttcgtagaatgtatgactaagctattttgcacttacatttcagcggagacaacaatgcctgatgcattgtgggaatatgaagcttttgcttgatacagttgcaggagagtacaccgtcaggttcagtggccttacatgctgcctccagcttcgctacggcttcactgggcaatgtgttatgtacctatgcaaactgtgctattgtgttgctcattgtgtgtttatgagcataatacttttgtaacggaccacgaaaacatctacccatgcgttctgtagttagctaggattctatgttatcatagatgcactgtgataaccatgaatgctggctgttcattgaacgttctatgctggacctcctaagattaattagactgttctaatgttataatccagagcaatcgaactcgatgttgattctatggttgcttggttttagaatccctccatacagctgtttactgaaacaacaatgcgttccatgctcacggcatggcgcgtacaacgtatcacattgtgtcgtggtactgatttgtaccacaaatacatctatttaaccttcaacagccagcgctccacgcaaaatgtgcagcccatgcctgcacactgactccctttttaaagagtgacatgccagcctacacagctagctactcctatgaagggacaacacgacctgctaaaaatgcatcccacactctacacttatttcatttcagctcatcctcttcttccaccacagctcagcactcctcgccgagtctcacagattgaatctgaagaactcctgctcgaggaagaacaactcttttcctaccatcgtttctacgggtaagggtgctcttctctacctctgttccagggtatctctctatgccttgctatgctatgcagtctatacgaaatgcagccttctgtttcgacgtgattgcattgcctgatgcttcggtaataatacatccggttctattttcctagccgcgcatgctgcctgcgcttggcgataggaacaagagctatttttagaaaataaaacatatagcaagaaaaaacctagcaaaacaattaatccggtctaatactattatggatgttctttattagggatgcagtttgattggagcgctgagctaggcgtggggcagccacaacgcccttcttcctatggaaccaatcgtccattactagcaacaaaattctctaggcgcaaggagatatcgcatatgctagctgacatcatatacacaagagctgttgttgttaaggtgtctggagctggaaatccgaccacaacaagaatatcagcgatgataagcgccgtctgcaggtgtcaaattgatgatttcgcattgctccctttccacccaaagatgttcattgccatcttcatggatgccgatctgcaggaagaactgtctgaaagagctttcaaaaaggtatcgttcaccttcaaggcaactcgcctcacatttgagcctttcaagatgaatcttggtagcactgtaaatccactgcgccagcgggttatacttgcgctagaaggcgtgccaccagaatcatggaacaaagaagctatatcagagctcatggacagttgttgttttgtagaggagttgtatggagagcaccatatccaagaactctcaatttttaagttagctgcctggacaacagattgtgaccttatacccaaggtgataagctggaacattgagactaaagaaggtcgtcgaggatcagcaaacattagttggatgcacaatgcagctctgtcagttgtgctggttcatatagagaagctgttcgactacactgacgaagacagcgggagtgatagcgatggagaagttcttagggaatatgagcagcaaaggccccgtgtccctgttgtcaaaacatttagctgggtgcccttgaagattgatctaaacaacggaccagttgaaggcggtacaccagccatagctccacgccgtcttcctcttgaagttcgcaggcgttgtcgcctaccttaattacataaaacactgccctctgttatgtatgctttaaagcctaacattttcacctgcctctccatgctcatggatcatgcgaacagctgcttagtgttttctctacgtgttctgtcagtttttgttttcctaacaattagcctgctgagcaaggcctaaacttccagttcagctaaaatatgattcgtatattcctcttagcaatttactccttttacatcactgaatatgagctgatagggcgccgcgaagcgcgccgcaagttctagttggataaaggacctgtgcagggtggagtgtgcaggaggggcagggcttgaagcttgcagagttgcaggggcgcagtgtccttcgagcgcttttctccatacacggacaaaacggagcccttcccatagaactactccgtaccttccatggtttggcttggccttggtgctgtgttgcactagagctttgttggctttgcaggacttctgcttttcttctcaccgcggcagagattgatcaccgccagatttttgttgggatggtgaagcaaaggatgtggactggaagttgaaaaaaaaaggggacaaatacctttttgagctctctttggagaaggaatttgtcttttctagtatatttttttctttttcgtacttcatgtggcatcatattttgagttttttttgtgtatgtgtgtggtgctactagtcgtagtgttgcacgtcttataatttgtttcacatttttttgtgtgttgatttgatggacgttttgagtttggtagcacggtcgccttgtgcaatctcaaattctcaatactagcaatcgtagcatcggaacgggtagtgggcaacttgcccagccttgttcacctgtcatctccatggcagcctttgacaagaaaaagatttgctcgaaacgcgaacctgtggaattcccttctcaggatgaaaaaagggtaaacacggctaaagtatcgggacgtacggcgaggagcacaccgtgcactcgattctgcaaattaaatggcagtggcaccacgacgcaccaccacgacatacccaacttaattacttaatcgcgactcttagtgatccagcagttgaaaatttggaatgctggcactcgcatgacataacgaattaattacacagtgaaccgggatatgaattaatctctcgaggagatttccacttgtatatatatttttgtctcagattcgatacaaaatggttgtaaaaaagtttcaaaaattaacaatatagagtataatgatgtctatatctgtttaccaaaatcaagttcaaaatcgatctaacacattgaggaaaagaacatattctaaagtgactgcctgactagtactaccattactattttggatttgtaggatttgcatttttttccttcttgatgtatgatttgagttcaagcttaatttttttattgccatttccatattctgctaatggtgtcaacattttaagattttatttaagaatttaatggtgtattcgaacaaaccttgagggactaagggtgtgtttagttcacgtcaaaattggaaatttgattgaaattggaacgatgtaatggaaaagttagaagtttgtgtgtgtaggaataatgtgatggaaaagttggaagtttgaagaaaaaattaggaactaaatcaggcctaaaccagtttccccattaaaccatgcaatgcatgaaataatagacaataattccacttagctaacaaatgagagagttttgcaaagagtgaaatacatgggtgttctctctaaacttatgcaggtgtatcatctatatccttaaactcccaacatgtatttttagaacactaaacttgtcgtatgtaatatataggtccaaacgggttttaacttgcatcccgaacacagtctactctgcttatctaggtgcctgaatgcctgaaaatttaatctgctctcccattcctagacgcgtacgaatccggacgacatcctggacggacgggcggggcaggcgacggtggcgacatggtccggcaagcacgcgcgcgctctatatatattgcccgcgcgcggcggcgtcggcaaccgcggactcgcgagcggcccgtggcacagagacgggcgcaggcgtaggccacctcgcaggccgcgcggcacgcgcgcgtgcagccggcccgggaggtgtcattgccacaccgacgtacgcacgcaacgcaccgtgggcttgatttgagacgtttttcgccatgaacgccgtgcgggctagctgcccgcgcgatcgccgtttcgcgcgcggccgcgtagcggttgtacgcccgcgcacacgtgattcgccgtgcgcggtaaagacgtaactcccccggttggacgatgctccacctaatgcacagtgcgtcagttcatgtgacgtagccgatcgatcaagctggagggcgacgctgctacgcctacgcactgtgtgctgcatactactccgtatgtatgtggagtactcgcctttggagtcgactagagagcgtttctacaggtttggccgtgacgccgtgtgggtccaccgcattggcgagatgctgtttctacagcatgcatcccgtttctttcatggttgggccgttggactaacccaaaccattaaattatgtcttcttaaacttaaataatcgaatttattctttctgcatacatgttcatctctcttgggctaactgtgttccaacttcttatatcttccatatataaaaagaatcagtcctagttttgaaatttttgaaattagatatatgcatatccaaattaatactcccgtcattagatgagatataatagctaggagttactcccgtcattagatgagatatatcagtacaatgcatctagacagagtccgtgtatcagaatatgttccatccaattcggttgctatattttgggatagagagaatattttttttactgtaggtgttaatgagccctattatatatttgttatcggtcacatctgaatgaaaaatgaagtactagtagagtactacatttatttgaaaataagttaatctattacagaatatgacatattataatattataaatctggacaagtacatgaatctgtccaaattcattatattaggatatgttatatccgatactagatcaattcattctaagactaaggagtactctttccatcctaaaaaaaacttaacccagtatgaaatgagacataatttagcacaacgaatttggacaggaatctaactagattaaccaggaatctaaccaagattatatgccactaattatatttttttttggggaatgagggagtggcatatgccaccttccagtcaaacaaaccaagattcggacatgcaacagattcagtgtcgcttattgttcggacatgcagcatatactccagtagtactccttttttattataagtactccgtataaaaataagaaatgtaaactgggaacagattcattgtccaactatacgaaggcaaactagtagtactaatttattaggaaaataatgagcatttcaaatgtacccaagaaaatgtcaagaaaaacacacataaaatttgaccaaacaactcagtcatgtaatctgaccggtatgtgctgtgcatttgttttaaccaagaaatagcatggtggcccgcttagattgcgcggctagcatcattatattttctctcatataatagcatatatgttttttcaatgtattattcaaatatattaaaataacaacataattttaaattttatactaactttacaaaactactaatgtgtaatattcatattgtattttatatacgtgttggttattaattatttttaatattaaattttagtttttttaaattatattcctatatggactctagactcgtctttcaatatttcttttttttaattccgaattttcattatctgtaaattgtatttctatatagagtctagactcttcttccagtattatttatttttaactctgaaattttattatttctaattgtatttctatgtgaactctaaactcatctttcaatattcattgatttttaattttgatttcacctacttctaaattgtatttttatattaactttagactcttcttcccatgtttctttttaatttcgaattttagttatttataaattgtatttttatacgaactctaaactctacttttaattttattatgtttattccgaattttagttaattttaaatttctatatgaactctatactctacttctaatattccttatttttaattccgaatttctattatttcctaattgtatttctatatggactctatactctacttctaatattctctatttttaattccgaatttctattatttcctaattgtatttctatctggactctgtactctacttttaatatttcttatttttaatttcgaatttcaattatttcctaattgtatttctatatggactctatattctacttctaatatttcttatttttaattccgagaatttcagttctttcctaattgtatttctatatggactctatattctacttctaatattccttatttttaatttcgaatttcagctctttctaaattgtatttctttatatggactccagtatcctcttctaatattccttattttttaattccgaatttcaactatttctaaattgtatttatatatgcactctagtctcctcttctaatattccttattttttaattccgaatttcaactatttttaaattgtatatctatatggactctgctttttctttttctccgattaatgtgagaatttctaggccatgagagcgaacgtggaggcttctttttctattcctttaataatataatagatagatagccaataacttttttttccttttgagaggaacattacaccacttctttttttttgtgaggaacagtacaccagaattttttcccatggaagtgcacttgaacagagcaaagatcaatgaacatcaaacttgaaattcagtatcaatatagactagagaaaaaaaagatgcgagtatgatcatcaaggatgctggtgcaactactgatcaataaaacagccatgatgagcatgcatatgagcagtaacacattgcaagacagtgaacgttaaaaattcagaaatgaagaacaatggatgaagtaatccggtcaacctattctgaatgcagttacagtgtttagtgttagcacatcagagcgcatctctcccgccattgccaacaggaggcatactatctaggtgaattctttggcaggtaattcgcttgctgaagacatacgtgttccatcaaatttgccgactcagttgctcaagatagagtagtaaaccccccacaaaaaatcaggcacgattatgcaacaaactcaccagaagctagcacctagcaccggaaggccggaatgttcttccaaagacgcacgaatcgggacgagtggtaagccatcggcgggtgcagcatctcgaagaactgccactccaggaccctgcactggcccagatgcacgccgaacagccgcgagtgcaggaagaagtaggccacatcgccggggtgctccgggtggatgagcgccaccgtggggatctccggcggcagcatggtcgccttgtaaccctcgtcggcccagatcgccttgaagctcgcctcgcagtcgaagctccacgtcccggcatcctcgtcgagcagcgtccacatgctgacgatcgggccgacgccgtcgcgctcgtcgatctccacgtaccgcagctcaccgaagttcaaccccacgcaccggctcttctcgaggtcccggccgcccgtgcccggtggcagctcgcggccgaccggagcgggacgaagcgcagctcacggtgggcgacgctgagatccaaggcgaggaagccgtacgagagatccacccaccagatctccttgggccacaccaccacgccattgccgccccatggacggtcgcgcggcgggtagttgagctccaggttgctccaggctccagaggcagaggagtacaggagcagcgtggcgtggtcggcgccgacgaccgtggggtggagatcggcgacgaggtaggcgtcgcgcgagatgctggcgaggcaggcgttgccggggtggaggatggggaggccggggtcggggaggcgggtggacttgtgcgtgcgcgtgtcgcagatgaagtacgccttggggagcaagccatggcggtgatcgccgtcgccgagcggccgacgatggtagaagccgtccaggacgggcggctacggttcgggcccctgcgtggcgcagaggaggaggcggccatggcagtcgccgccggcgacgtaggggtggtcgtcgatggtcttgcggcgcggggcgatgctccggtgcacgacgaggcgggtggcgcccgggggtaagcggaacttgaacccgttgtcgaatcccggcttgaagtagccgtcctggacgacgtgtggcacgcaagcgaggaccatccatagctcgctcccgtcctccgtcacccactgccccttccaccgcttccacgccgccacgtcatcatccattgcaagcgtgggtttgggtcgttggagaggcgtgtgcgcggagcgtggagaaggggcgaaaagaattttccggcagtttggtggtcacgttttgtgctgcggctgtccccgtcactcgtgtacttatatagtggcgactcagcgtgcgtggcgtggtggtttgcagcttgtgagatggcgtccgtggacgacatgagacacggccgtacacgatctgtttcgtttcgaactgaaagtacagagaacgcagttggttgcagctttgtgagatggcgtcgtgcactcgtttggaaccccgcgcgcaccaatgcacgagtacgagggacagcgccgctgaggcgcacgcgtgacaacgtgagtagtacgtacctacgccacggcgaaaaatgcgcgcacgggcacggatagatcggctgatcaagttcttctccttgcaccgctgcaactgcgtgatggttcaaagacggaccaacgcgccgcgccgagcccatcgcagcatgtgacgctgaaatgatcagcgcgtctcccgtactggagcggggatgtttgtgacatcaacacgctgcaccagatgtaacgtttccgacacaaggatgtaagtggatagttccgctacctgcataaaaacccgtttgttagtctattttttatatggtaatataatttttttttaaaaaatgaactagaagtgaaataaatgggaaaaaaaaggtccggttgcccgctccgcttgcacccctctggacatagcaacaattaattgggcataattctcttgagcaagtggcaatctatcacccagacttgtcgataatggatctgcagactgcagttgcacgatactacgatgataatccacgagagagagagagagagagagagagagagagagagatctcgcaacggggattcggacaacatcgttgcagctttccaccagctttccaagagattagatgcaaacaatcgaagaaccaacaaatttaagacgattgacaatctacatttaggaaaaacaaatggtgctatgaaatatcccaacataggtccacgaaatacagaatgcataaatgttccacttaacgatactcatggtcattagatcatttgttcaacgatcagcaaatcatcaggacaaagtcatgaccggccggtgagctagacttagctgaattcctcgtactcaccggaggagcacctttttttccccccttttaatcgtcataaccttcaaaacatgcacaaatgatggaaatgttacaacaaggtaaatttacttccatgaaactaattatcaatttttaggggaaaaaactttcatgcatgtgtagtttaatcgagagttatttacactaattactaaggtagtttacacgttgtttgttatctaaaaaactttcacacgtccttatctaaaataaaatggttcacatgcatctgtagttacctcctcaaatacctagaaactttcttgattgaagaggtaccgagaggtgtggtacctcgtcaaagtatctttaaaaattaattttcttgactgaagctagcactataaactatattttagaaaataaacactgcaaactattgcctcacaaattcccttaagttagataatgcatatgtacatgaggcttaatatatgagagtagcgtgacatacttaagtcttcaaaaaaaaaagcgtgatatacttgaatatgttcacctttgtctaattaagacgcgcggatccctcgttcgctgggcgcgtaagtaccttttttctgattgttagaagcttcaagacaagcaaacagatggaaatgttaattcaacatttccattactcttatttatatttacttaatcaccttaaagagttcacaagcagttagcaggattttattgctactaggtaagaaaatgcatcttgtcatataacaagcatgtgcagagttgaaaaatgattccaatgttcaagtatcttgaaaaaaaaaatcttcattagattgtttgtggatgaactccttaaacctacacaatacatacgtacgtacgtgaagcttgattatataagagtatcatgtcaaacttggaagtagttgtgacattatccctacattcaggtttaaactgcctttgtactcggtccaaacaaaatgcataagcagattactttgtgcttggctgactaaacacgaattaaaactgacaaaaaaggaaatttgtaccacgatatgataattaatatgacgatagagaatcttgcagctactgatcattaaaacaaagacatgaccagcatatatatgaacactaacacagggcaagactgggttggaaaattgaatctagcattcaccgaagtactatatcattatatgtcgcaatgagtgcttaatccgcaagaaagaacttgcaaaactgtgaactgcaaagtgccatatagtaaattcagtgaaacttatcgctccaaaaatttaagaacactagacagagtaataccatcaaccgcgtgcatgaacatgaagttgtaaagctagctacttatatcacagagtgaatgttgactaggcctagctaagtgaatccttaattaggtgttccatttgcatgttttttttttgagcaaatttgcttgcttaattaagagccaagacaggcatgttccatcaaatttggcgcgattcatgactgacaccaaagtactagcagctcacaggggtagttaacacaaatatcaggcaagattatacagtcacgtaccagaatttgagactgggagacgccaggcacgcacgaatcgggacgagtggtaacgcatcggcggattcagcatcgcgaagaactcgcactccaggacactgcacgcgcgcaggtcgacgccgaacacccgcgagtgcaggaagaagtaggccacctcgccggggtgctccgggtggatgagcgccaccgtggggacctccggcggcagcttggtcgccctgtagccctcgtcgttccagatcgccttgaagctcgcctcgcagtcgaagctccaagtcccggcaagctgatcgagcgtccacatgctgaccgccgggtcgccgtcgcgcttgtggatctgcacgtaacgcagatcgtcgcgcctcagccccacgcagcggcacttgtcgaggtccgccgtgcccggtggaagctcgcagccatcggggagcgggatgaagcgcagatcgtgatggatgccggggacgacgcggcggagttggtcgaaggcgaggtccgcgaggaggccgtaggagagatccacccaccagatcatcatctggtgcacgacgacgccgttgccgccccagggacgatcgcgcggagggtagttgaccacacggtccttccagactccagaagccgagttgtacatgaacaggatagcctgttggtccccgggcgtagggtggagatcggtgacgatgaacccgccgctcgcagtgccgacgaggcaaacgttcccggggtggaggatggggaggcggcggtcggggaggcgggtgcacctccgggtgcgcgtgtcgcagatgaagtacgccatggggaagccgtggtgcacgccgagcggcccacggtagaaggcgtcgaggacgggaggctccggttcgggcccctggctggcgcataggaggaggcggccatggtgatcggtgctggcgacgaagtaggggtggtcgtcgatggtcttgcggcgcggc

SEQ ID NO: 84919 - DNA, 552 bp, Oryza sativa
aataatcatatatacttagcctcgtatattgtctcgggcaatttgtttccctccggaagaatgttcttgacgagtttcaataaatcgccaaatgccttgtcactaacaccattttttgcgttccattgcaagaactccaaagtggtatccaactttttgtgcccctgctcgcaacctgggtacaacgacgttctgtggtcctctaacatcttgtccaatttatgggcccccttttcactttcgcagtcctccttgacgtcctgcaatatctgaccaagatcatccgcaacgtcgttaccatcagcatctctttcctcctcgcccgtttgatttccttcaaatccaacgtactgagcaaagtccggaatattgtcgtcttccacttcattttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccttttgcctgtta

SEQ ID NO: 84920 - DNA, 671 bp, Oryza sativa
aaagttgaataactcatcaagatctaaaacttttattttggtcatttcttcatacgacaaagtgatagtaacattgttcacaaaattgacatatctcttatctggttttataaactataatacatatatgtaaaatttgtgaataatattactaacatttcgtcagatgaagaaataacaaaaataaaagttttagatcttgatgagttattcaactttgttgttgatgactttttcaattgaaatcatttagtatttgaaaatgttgtttgaagttgtcatatttttaaattcaaattcaaactgttcaaaaaaatgttatattgaaaaatgaccaaactaaaagttgtaaatattgataagttatacaactttgttgttgacattttttccatttgaaatcatttactacctgtaaaattatttttgctatagttaacttacaaatataaacatttcatatgaaaaatggaaaaatagtcatcgatgacgggctttagttaatgcccgatagagattaagtatatagcccgtcactgatgagtcatctgtgacgggcctagttgttatctcaaacgggcctcaagttggtgcacgtcacagatgatggtcatttgtgacgggccacaacttgaggctcgtttgagatatggaatgttatctcaaacggg

SEQ ID NO: 84921 - DNA, 648 bp, Oryza sativa
aagattcagctaccaatttaaggatacctgtagagtgtacttctgcaatacgtgatggtcttttttctgcctcaacttatgaatatgcaaactttcaccgtcttgtttatagcatgaatcacaaaagttgcagcctaggcaaaccaagcaccgccatgccaagcattgatccatggcacggtgacaagaagaacaagttgaatcatgtagatgataaagaatcatcattgtggaatgttttgccctccggagagtatcaaactggtattgattgtcttgacaatgcttcaggaaatctattctgctgtcaaagtacttgctttccattgttggatctacatcatccgtttctggaagaggttcttcctctatctgtcaaaggagattagtaatctggttagtatttccatgcaggcagattgtagctaccttaaatagatgaattcatatacgtactctttcaaatgcatgcttttgttttggtgtagctgggtgcctgtccttcaaaggggtattcaacttctcagcataacaactacgaggacaaataagaatggcattataaataatgggtgcccttaccaccaagagttattggataacaaccaaagaggtggaatgttgatcattttgcaatttgacacgcaa

SEQ ID NO: 84922 - DNA, 532 bp, Oryza sativa
agcagatactactaaacaacgcagcaaaccgcaacaacatgcagagtagtaacacgaaacaagagcagagaaaaccgtacctgaattcctctgtaaactgattctggtttgggtgctgtgcaattgggggcacgcaacgcaggtgatcggcacggaggcgagggcggtgtacaacaacgggcaggcggaagggctcacgttctgggcgccaaacatcaacgtgttcagggacccgaggtggggccgcgggcaggagacccccggcgaggaccccacggtgaccggcaagtacgccgccgtgttcgtccgcggcgtccagggctacgccctcgccggcgccatcaactccaccgacctcgaggcctccgcctgctgcaagcacttcaccgcctacgacctcgagaactggaagggcgtcacccgctacgccttcgacgccaaggtggtgacccgtcacgacacgttgttctgtcagcaaatggtctggctaattgggtgaccctgccattgacgaggctctgagtgatgcgat

SEQ ID NO: 84923 - DNA, 2085 bp, Oryza sativa
gacgtgatcaccaacctcgtcctcgccgggcgcgagacaacggcgtcggcgctaacctggtttttctggttggtatccggccgtcccgatgttgaggacaatatagtgcgcgagatccgcgcggtacggcgtgcgtcctcgagcaacggggtccaagcggcgcggcgttcagcccccatgagctgcgcgacatgcactacctgcacgcggccatcaccgagtccatgcggctttacccgccggtgtccctcgacacgtacgtctgcaaggaggaagacttccttccggacggcacgttcgtcgggaaaggatggcaggtgacgtactgcgcgtacgccatggcgagggtggaggacatctggggcacggactgcgaggagttcaggccggagcggtggctggacgaggcgggcgtgttccggccggagagctcgttcaagtacccggtgttccacggcgggccgaggatgtgcctcggcaaggagatagcctacatacagatgaagtccatcgtgtcgtgcgtgttcgacaggttcacactccggtacaccggcggcgaggggcatccggggctcgtcacctcgctggcgctgcgcatggagggtggcttgccgatgcaagtactcctaaccaatagggggcaagcagtgtcgtgctaggccagctgttctcgacgacttcattagtcctgcttttgttgcgtcgctctcggctctcgcctgttcttctactgttagtccttttatcttctccgaactacgaattgttcacatttctgggagctagcatgagttgcatactgctgtgcttggctctgccatactaatactagtggattttaaacctcgagggaatattttcttattatttctatgtcacttaagtagttataaaaaaaataaaaagtaacaagatagattaacctgtgatatattactttacaaacatataagctaaaattaaaattttacaagttataataaaaacaaattaaactatatggtgaactaattgtcggtattagttccgagattgagatgttcaccgagtgggccggaaaggcactcagacggccacaccctctatttctccaattacgtgttcaactgtcacatctcatgcccctgtatggctgtattcatcgccggatcgccccgtcacgctcaatagtcaatgttattgtttacgagtgaccagtcacacatacagatttcgcgttaacagaatcaccagctaatgacgttattcgctcggtctcaaaattaattaagcactttgtttgatattgcttgaatttttattacgaactttttataattgtttgtttaagggttttttttttctgaaatgttttttttccaaatccattattgtttaataaacatgttctatttgcacaataaagctcatgccctctaattagttagctttttgttgcatacttattgcagtctaatcatataagaactaaaaaatgatgcaatgcttatgctaatgggtaatacctttatatatcaacatttttacaaatatgaatcaacttttgtgtaaacatcgatctaatactaaaataggttcctgttgtttatttattcatggattgaggggattcaaaactatgttaaatacatatacttgtagagtccaattctagtgtgcagtgtaggagacaacccataagtgtacgaggctagcgagaacacaattattggatggctaaatataactacaaatatatgcggttatgttgagaggaacaaatatatgtggaaacttaagatgccgcttaagattaagatctttatgtggtacttgtttaaggggttgtgttgaccaaggataatttggcgagacggaattagaatggtagcttaaggtgttgcttttgtatgaaaaatgaaactattcaatatctcttcatagattgtcattatgcaaaattcatatggagagcagttcagttttcttttggttttaatcttccaactagtatatttcatatatttgatgggtggcttttgggggttgacaagaaaaagagtaaactgatactggttggagcttcttccatttgttgggctctat

SEQ ID NO: 84924 - DNA, 650 bp, Oryza sativa
aaggcctgtcctacaccttagcttttgaaacggacagggataggaacgcagcaatcatgcttgctcgtaaattgcctcaaattgcaatgtaagtgcttttgccttaaaattgcattttgtttctaacgataatgtggtcaagaatccgtttcattcacttgatgttaggaagcaagttattttatacccttttgtttgctcaatgcagattacgctcactggtccaggtgatgaagttcatgctggtagctgaatttacagtgttcacggtgtgacagcaggagtatacatgtaggctgtgaattgtgtactgtgtcagtttgtgttttcgagagtagaggttgtacactaggctttcctctttcagcatacattctcaaggcaattctttttatttgcctgccagcagctgtttgtggtgttcgtcaaacatgctgtgcaaaatgatgattattcttgagcattatatctattaacgttcgaaaagtgatagtttgcttagaaggagcttcccttgaataatcaagaaatgtacatataatcacttccatctatggtgcgtaactggtcgcacgaagtcagtggtgattgtgttgtattcaaaggatcaactattgtgttatctggcaagtgattctaatagggcgttt

SEQ ID NO: 84925 - DNA, 633 bp, Oryza sativa
acggcccaaccagatgttcagatcagtgctgcgacagcggaggcgtctggtggtccgaagcagcagctcagatgaaaccaattccaccaccgaagagaaggtatatccacacgaccacacgcctgatgaattgaaaaaaaattaaagcctgaacccaactgtgacgaccatgttttgttcacagacgccattcggatacacgaggaaggacgtgctgctcatcggcgtcggcgtgacactcttaggctacggcctcaaatacgggctggaggtgacgtctgttctttctctcttctccatcactactccagttcgctgcttcttggctttgacttcatcatcaagtacacttcactgacgaacatgtatgccttccctttcacatccttgccacaactgaacacagctggtcggagtcgatcccttgcaagcaggaaacgccgtccagctgatcatcgtgctcgggatgacggtggggtggatctcgacgtacatgttcagggtggccaacaaggacatgacctacgcccagcagctcagggactatgagaagcaagtcatggaggtttgacacttgttcattctagtatgcagtgtttgttactaccaagagtatgagtgactgacctgaag

SEQ ID NO: 84926 - DNA, 1109 bp, Oryza sativa
cagctagaatatcatcagaagggatcaaaatggattgaaaccatgcaatgatgcaaagcaaccaaaaaatgtatactaacatgagaagttctattgatgtcggattctaatcccaacccgaaccaaccatatatgatccaatagtattttgtgctttggcttctgtctttccttcctcttggccggcaatggcttgccatcattgctaataacgactgagtggagagtgaccatgatattcatttgataaaggtagaacaatcactttgaaagaaaaacaatcctgtctttccatacatcattccataagggataagctaaatgcatagaggtttgtgtctcttacctctgccctttcctgtattatcttttcttttttctgctcctgagaattgtatgcaggatatgaaatactgctcggatgcctcatcacggtggtgattgttggggtagtttcaatttcgtgccatcttagaagaagagcacacaacctgaaacgatccaagaaagatattggtaatttcactaatcatgcaacccctttgcacatactggtttcttttactcagtaatatcgcaatatagttcatgcatccttcttgcagaggtcactgctgtatctgttgagtatgaggaggttacctgcaaacagatgtgtaccaaagagatttacgacgcaactgaaaacctgagtccactgaatgtcattggtcagggaattgcaggtaaatgacaatattagtcagttggacttgaaatccttattccatcatgcagatgcaatacataattgtgatgtgagaaaatgagatatgtaagataatagccatgtttaacgggttatttcttgccctgaaagtgggatgtatcttctttattatgtgatttttcagggaaagtgtacaaaggagtgcttgcaaatggctggcctgttgctgtaaagcacatcgttaagaacgagcatgcacactctttcctaagggaagttacaagcctctcacatgtgagacatccaaaccttgtgtcactaagaggttattgcgatgggcaggaggaatgttttcttgtatatgagttatgtatcaacggtaacctgtcacaatggctat

SEQ ID NO: 84927 - DNA, 647 bp, Oryza sativa
gcagtagctttaataaaccaagtagcacagataagagaaagcaccttcacggaagcatgtgttgaaatcaaactggtactttgcaaggaagtcaatcgatgtggtctgacacagaaattcatgtgttgaacaatcattcaggggctcattccgagaaaagataaagaagttatgcctggtaaagtgagaagaaatggttatgtcttgggaaagaatgtcgatggcagatctgattgcgaaacaaacaaacaaagagatattttatggtgcttcaaatgtactagaagtaccttcactttcagaaatatcaaaggttgagatgttttacgtgttcttgaaatgtactagaggtgcctacactttagagcgataaatggctgatatttcttcaaagtggaagtaactctagtaacttgcaaggaccgtaaaacatctcatcaaattattaaaaaaatgcaaacctgccataccaaaactctctccagaagggatatggagagttatagtttataaaagaaatttgcctttctagagagcactcattcaataaccattctaggttttctgagttcctgatcaatttttcttgggtgttgtcttactccgtgctctgtgagcataattgttgaataccagttaacttctca

SEQ ID NO: 84928 - DNA, 560 bp, Oryza sativa
aacccctttattcatcctcctcctccctttcctgcctctcctatactttctctacctgtaccaggataccaagaagcagcctgcaggttccaatggactcaagtcctaccctgtagtcggcacgctgccgcacttcgccaagaacaggcacaggtttctcgagtggtcgaccgacgtaatgaagcgcagccccacgcacaccatgacgttcaaggcgcttggcctcacaggcggcgtcatcacagccaacgtggccaacgtcgagcacatactaaagactaactttagtaactacccgaaaggcgagctctccgtgtccttgctcgaggacttgcttggccacggcatcttcaactccgacggcgagcagtggctgtggcagcggaaggccgcaagctacgagttcaaccagcgctcgctgaggagcttcgtggtggacaccgtccggttcgaggtcgtcgagaggctgctgccgctgctggagtgggcgcggcgcgacggccggacgctggacgtgcaggatgtgctcgagcgcttcgcgttcgacaacatctgccatg

SEQ ID NO: 84929 - DNA, 7740 bp, Oryza sativa
tgctcactccaaacaggaattgattgaagttatttcgaagtctatgaaggagactagtgagtgtttcttaacctcactgcgattaccttgtggtcgccgcaaacaattggatgatggaggaggacttgaacaccaacaagaagagctggaggtagaaagttctgttcaagaattatgctgttgaggttatttcttggaatgtctacagaaagcccaacaatattattatttcattatagcatagactatatgacatcactgtcagtccgcatgttgtgttttgtaacaactagcaattgtatgcttttcttgtcaggaacctttctctaacaagtattaacgaaacaatgaaccaaaataacacttttgacactcctctcatgaagacgttggtaatacttttaacaagtattactgtgtacttgtactgactatgattattctgttcaaatttgaaatgtgcagaagctaaaagtgtctttcaacgagatgaagcttcaagttgaatcaactcgatctcagtgggaggaagacttgaggaggctaggtgagtaatggattcagaaatgttttagaacattttgtcctttgatcgctaaacatttgcttaatattgcagaaagttattttgaggctcataatcacaatgcttaccacaagttactcgaggaaaatcgtaagctgtacaatcaagttcaagatcttaaaggtaatatgcgaataaattaacttcatttcactaacagtgagatatttgtactgataaattgaaacatcttttaggtagcattcgtgtatattgtagagtgaaacctttcctgaaaatgcaaactgatcaaagatctaccgttgatcatattggggagaatggtgagataatgattgtgaaccctcaaaagcaaggaaaggaagggcggaagatgttctcattcaacaaaatattcgggcctaatgcttcacaatgtacatcatcgacatttctcattttttttcatttctcatttactgcaaattaattgcattccatcttgtagtttctaattgagtgatgacttacaagatagttatgcatttatcccaaaagttaaacagttcattgaaaatatgactatttagttgagtaatgcatgataaaaattgcatacggtttcataagaaaagaatggtgcatattttggagggctggctgatatttattttgagagttatagtttgacttttttttttctttgtaacagctgaggtttttgctgatacacagccattgatcagatctgtgatggatgggtacaatgtatgcatatttgcatacggtcaaacaggatctggaaaaacatataccatggtaattctttgcaagtaaatgtactaaagtttcaataattacttttgtgaaaaattctcaaatcaatgaatccaatactataaaaaaaataaagaaatttactgctaggaacaataataaaaacagatgctcttttgtatgctacttgtctgcattaagcttcaatctatttgtatttttctttctttatgatgttgtaacatatctttgttgcatatattactcagagcggtccagatattacaacagaggaaacctggggcgtgaactaccggtcacttaatgatctatttgctatttcgcaaaatagagcagatactaccacatatgatgtgaaagttcagatgatcgaaatatacaatgagcaagtgagagatctattgatggttgatggtgcaaacaaaagatatccttttggttgcaaaagttattttttctcaagttgccgattgaaaacattgtttcaaataagatgtttcctctatgaagttacttgcaaaaatcttctatatgttttcacatgaaataaattatcttttattgctctcagcatcaaaaaattgtttaacaatatttccttccggggttgttcttaaccatgaacacattagagatacgaaacagttctcatgtaaatggactgaacatcccagatgcaaatttagttccagtgaagtgtgcacaggacgttttggatttgatgagagttggccacaggaacagggcagttgggtctactgctcttaatgaacgaagtagtcgctcacacaggtatcccaaaactaatgcaaaaaacgacttcctctcagaatgtcccttctccctagtataatatctttgcataatatttttctttcatcgtctgagcaacaggcatactcactacatactgtaattttgttgctcttctgtagtgtgttgacagttcatgttcaaggcaaggagatagcttcggggtcaactctaagaggatgccttcatcttgtggatcttgcgggaagtgaacgggtggataagtccgaggccgctggagaaagattaaacgaagcaaaacatataaacaaatcactgtccgcacttggtgatgttatagctgcacttgcccaaaagagctcccacgtcccataccgaaatagcaagctaacacaagtgctacaagatgccttaggtatacagaatctcttaagagcctggatgtgtttcatcaagaatgccagctgattatgttttcttgtcttgtgatgtaggtggtcaggcgaagacattgatgtttgtccacatgaatcctgaagcagatgcttttggtgaaacaatgagtaccctcaagtttgcagagcgtgtagccaccgtagaacttggtgcagctcatgctaataaggaagttgggcaggtcaaagatctgaaggaagaggtatgatattgtgttgttttaaatgttacacgatcatcatcggaactttgtttctgtaactcatggtgtgtaattgtctatcagatttctaaattgaaattggcattagacgacaaggaacgtgaagcatcaaagctaagagatatcgcgaaccgtgtggcctctgaaaagagaaatgcaagaacgaggtcacctctaaccaccaccttgtcctcgaaacctgaagctggtcaggattccagtgtagacacttgtacaagcgaggtaccacatactagaagcagtttcttgcaagttacattacagtatacaaaagattactaatttgaacatatgtctaccttgttccatttgcagatcagaagctcatcatctggaaagcagagaaggttccgctctccattgtcagtgagagaactggacgagaagtcacctgtcatcaaccgggagttatacttgagtgccaagttcaagactccatctcctccagtaagaagttcattgtctgccgagagagttggcattgccaaaagcgtggagaggtctgaaaacatcgactgcacaccagtatcaaggattgaagtgcccccaaaagtacagcacagtagctctaggaagaccccttcatccgtcctgacggctcaaagcttacggaaattccgagactccgaagaaaatagaagcgcaaagccatcggtccgagaaagcatgacaaaaaccaggctcgacagtgcaacaaagccgcctcagaaagaagagcaaactgcaaacaagaacacaggtactagagtgaggtcagaagccaagatccccaggaacatatctgacatagaaaacgagtttgcaaacagtgagcccaccttccattccaaccgaaaggcatggaagctcccaccacagtccacaagacagtcgcagagcattgatcttaggtactaagattcttcactggtaacaacatgacatgttttccagttttcctgttgcatacaaatgcatctgtagatgtctctctctttttttttgtgagttcgcttacaaagatgtctctctttttttttttggtttgggttgtcacttttggcagagcctctgtccgggagatggaacctctgactgaagggaagcctcgccggagcaaggcgccccacggtgatagaaccaacgtccccttaccggagacccggcgcagcgtctctctgccccgcgggaagatggctctcgtgtgaaaaatctagttttttcgtcaggcgaatttcattgtaccctgtgatccggctatatctgtaggtcttctacggctgggtagacgaacctgagaggaacacaatcattcattggtttgttcttttttttttcctttcatttttgaagttcgtgtgtctgtttcgtacgaacctcacgcccttttgtacaatgtaaatgtagcaattgccattattatatctcattttcagtggcgattgccttattggaagctgaaagcctgaaaccactagcactttgtatcagtatcaccgttcgtgcagatgttcggagttctaacaaatgatttgctcctggtctttgctactgcagtgcagcagactacaaggcttgaaaagctagtttggttttacaaattttgctatcgattttatattttcagcgaaaagagagagagtttgttttttttttcgaggaaaaaagaactgtttacccccgtatgagcttttgcagttgcagccttgcacctccctcccattaacttgtcctcgctcaccaaggtgcccacgtcgctgcgcgcacaaattcgggccatggaggaggcagcggcgccggagcggaagcggccgcgcgacggcgacgtgggtccatcgacggcggcatccggggaggcgcagtacgtgtacctgcccatcgccgacgcgctgaaggcccccggggcccgggtctgcctcttcgccgccgtctccgagatcggcgcggccgtccgcagccgcggcaccggtgagcctccttctcgcccgcactttcgagtcccccccccccccccccctgagagcagggtttagggttttggtcgctatagcggatttggagctgtttggggttgctactggactaataattttcagtgctcaaatgtgctcggtcatggtgggggagattaggtcgagtttccgcacccgatttgcgagctgttctgattgtaaatgctagggaaagaggaagatgtggggttttaggtgtaggcctatagccatgccgaagttctgaacactgaacagaacagggtcatttttgggggatttttgctgttaattggatgaagaagcaaacctggtgagttctaatggctgtatctgaaatcgccaattatagatgagcttaccatgttccaccttggaggagtttctttggttggttattgagctcaattgtgattatattcttatccatttgctattgcagaaatgcctgtatgacaggtttaacaatttttgttttttgttgattcttttgtgattatacctgcaattgacgtcgtgctacttatccatggctatcatttgtgcagatttcactcttacgttgaggattgtggatcactcacgtgcatctgcaatctctgtgaccttctttgctgataacactgcattactgccctgtgttaggtcaagtggagatgtgatcagtctccataatgttgtggtacgactgaaactaaacactctactgaaatgtactatttgttacattccatggaatctttatattatgtctttgaaattacggtgaattatcgtgtgacggtcctcacattttctaactcggaattgtatttgcatacttttcttcaatgtcttccattctgcagataacaatgcaccatggcgaattctttgtcacatataacaaaaggttttcttcatttgcgctatttgaagggaaagtatctacgggatgcataccatatcagcattctatgaaataccatggcagcaaacatgacagtgaatttttgactcacttgagaatgtggattgtatataatcctccaggtgagtatgtgactgctagttgaaaaattattgttgctcatttttctcttgtccactcataagctatacggatgatatgtcttgtgaagttgtgatactccaaaactttgcacatctacgaatattataaggaacaacatgcctagaagctcctaacccacatgagaatatgttgttatcaattcctgattttaccagttgctgtgaacatacatcgatatatgactcatatacaatcattagtatacaatcgataacatactctcctttacccaaaagttaagcattattacataaacacgtgtacaatagaacacccattcttttctttacaaccttaggacaggatgcctaggtttcggtcaaataaaataaaagccttcaaattggttgtcagctctacatttctttctaatttttttaaatttttggttgtcagctctttagcattatcatgttttattgactgcctgtcctagcagtacctgttgagtatatgattcacctacttttggatactcgtccgtctattataatgtggcttatgctcaacagcatctactgatttacgtctatgtattttgcacaaaatgcagattaccgaaatatttatatcttctctgctgaatacatgcactacaaatatctgttgcaacactctttctttttctaacaagctattttgctctctaggtctgaaagatcttgaactgcagttaaggagtataaaatccgattctacttttgatctagtatgcaaggttagctctatatgaagttacataatattcaacagttatttgaatagaggaaatctgatgttcctttttgttaggttctagatgttcatgaagcttccaatggcgtatggattttgtatgtttgggatggaactgatacacctgtgaccgagttcccgacgtaaaaattagacattggtgtcactgtttaatttttaattcagaaataacttaaaattaattctgcaaaataggatggtgttggtgcttataacattgtgttgaagtaaattgtgcctctgccatttctttcataacgtatggcataatatgataataacagttcatttttaactaaattgcgcctatgttgtttggcttggttgaatgcagcttggacaatgaatcagtttctccaccccctctacatcttgaaggagcacctctgccaagggaggttttgtgcacattgccttgtgttgggagtgtgctgagggttttctcaaacaggtttttcaaggaaatgctacacttgcaaaagggtatttattgggccaggttctgtaatatgacgtgcaagcagcagtttggcatgtggaaagggattctgctgccttctagcagagtccgccttttatcaaatgaagatggcagcgttgctgatcgtctgaagtaatcttctgttttctcatgaatgctgattgccatatgaaacttgtttctaagtattaaccaagtgcattaattattacaggctattcgacagtcgcattgccacccaaattcatcgtcagccaatggcaagcctccccaatgcttctgatattgctggtatggacaattgagcttaactttttagtcagtcttgcatgattgctctgagcttattttgttacatggtgtgaagttctccgatgcatgtgctggttgttatccttctaattgtttgcaaggttctagtatcttctgtgcaggtgctttgaatgctatgatttcctcttccattgactaaatttctgttcactggttaattgaattgcataagaacaaaagaccatgccaatctctctcatctttctttttttttaatgcactaccttttcacagatggtgatatctgtctgctatttctgtttcatcttactatacttcttgttcagtggttaattgcttaagaacaaaaattctagcctactaagt

SEQ ID NO: 84930 - DNA, 551 bp, Oryza sativa
aaagcgtctatacatgttagaattaaaagaaggattccatatggaagaaaaggacgaaccaattcaagaagatgatcaggttgttggaaccattcaaaaatatatgaagcaaaaatggtacacagaagttatgtatcgttttatagacggatcctactttcagtatatcactttaattgattatggtgctgatgtcaattgcattcgagaaggtattatccctcataaatatttctgtaaagccgcccacagaattcgtggggcagatggaggacttttaacagtagaatatcaaatccctgaaatctatatttgcatatctgaagtttgcattaaaacatcttttctactcgttaaaaatcttaagcaagatgttattttaggaacaccgtttttatcactcattcgtcccttccttgtcacaaacgaagatattcaatttgagataatgggcaaacaggtgagcctaagattttcgtctaacacagatgagattcttgaccagcttgttcagaccaaaagagaacaagttgtgaatacaatatatctac

SEQ ID NO: 84931 - DNA, 720 bp, Oryza sativa
cagccgggaggaaggggttagggtgatcaccgacgcgccgctcacatcgctcgtcgacgcgtcgatcaccatagttgacaccgatcctggggatccgcggaaccgacgggtgaaccaattcaaggttgacttcttggttgccatcagcaacctgcttggccgcctcaccagcgtcagaaatctcgacctgactgggctcaatgcaacggttcgttctctccgacctttctctgcaaagtatatcacagtataatccttcatttggcacaacaaatacatacctggaaacataacaaatttaattttacagttaagtattactaattatttcgccgattgctaagtctctcttcaatggcaaaaacttctgttcacccataacaggagagtagcatgaaaactgctgctcattactctgaagtttgaaactgcagcctaatcttgtatactctgtctatgtagctgaaagcctgaaattatctcctggtttcatatgtttcaggcactgctggataataaatcccaggaattcccgatgttcccctacttgacaaccttgctcctcaacgagtgtgacattggatacaagtaccacgtgttgaggagcatccttcagaacgccccaaatctggagcagcttagactacacaattgcaaggtatcatttggcgaagttaagcatatggttcatttagctcttataccgtcatggttcggcat

SEQ ID NO: 84932 - DNA, 1400 bp, Oryza sativa
gatgctcagtcaagtgaagcattattatcagctcttcactgtctggatctaatatgtaacatatgtattcaagaggtaaagaaacctcagatgaaatttggaagatccaaaattcaggttggacctgaatggttgaaaagttccgtgttagtatatgcaaagaaattgtggggagtaaaccgttcattccacgaaaaggtttcaatttcttccccttttcatttctacctccatactactggtatgataatatttaaaacgtttcgtgaccaattaatagataaaatatgctactaatatgatcaaccaatagataaagcatgccatttttgtgttctctactcatagtgatatctgactctctgtggtatcaaaacttttggaaccctggctggagattaatttcagattttgttctattccagactgttaattgtgttcttcagaaagcctggttatagcatatcttttgctgacaatctcagtgatttcttatggaactcttttcatggcagggagatgacagatattatgttttcaatctgaagattgctgaaatatttttgtgcttgagtgcatgtatggacaacaccatatttccagctgatgaattttgccagtttgtatcttctctacttgcaaaggttgtctgtggctgccagtttcaaggactgatttctatcactggctagttgaaagttctttagtccgcttgtgcatgttgttctatagctatcgtcttatagacagctattaattattcatttattttgtcaggcaaaaacacttcgcaataaggataccatggaaaagcatttgagcccacttataactttcataccagatcttgtatccaatgccccagatgactcaaaaggatatttattagaggtatgactaattttccttttactgatctctagaaagtatttgggttactttttaacgttacgaaaaatgagagactatattcaactgcaggcatttacagatgcattctgggattgcaaggtggattgcaagctgattttcccatatttggatgcagtgggaaaaatgctgtttcctgtaggttccttctatgggatacatactaaacttcctttgctacataacttcttctctctttttttcttttttttttttttgtgggtgacgtgttcaggttattaagaaataggacttgatgaagagcatgcctagtgaaaattgcctacttggtgctaacacacaaatatcttttagggagaaatgcatctccacatgtacatgcattacatgcactattataactgtaagtgcttgaagatttgggtgatggtatgaagatctgtaggttgatttgaattttcagtgttcgaatctggattctggaaccacatttgatggtgatgttagtt

SEQ ID NO: 84933 - DNA, 661 bp, Oryza sativa
ccctgtaagtttcagcccctatcttcattaaaagaaggtgcagttttcatcttaggccttgttagatccaaaaaattttggcaaaaaacgtcacatcaaatgtttggacacatacatgggatattaaatgggaaaaaaccaattgcacagtttgcatgtaaattgtgagacgaattttttgagcctaattacgccatgatttgacaatgtgatgctacagtaaacatttgttaatgacagattaattaggcttaataaattcgtctcgcagtttataggtggaatctgtaatttgtttttgttactagtctccgtttaatacttcgaatgtgtatatgcatacttcaaaaaatttacgcccaaagaactaaacacactcttaggaaagaacagtaggacactatttcaattagaattcacgaagtagcagaattcactgactgtgcatttataatttgatttcagaaacattaaaacataagatgattcagttagaaattgtctagaccaaactgaatattgaaacagtatgtttggatcatccaaagttcttggaagcatacgatatcttaatttgtttcaacaagaacatacccctatatttgaatccccaatatttgtcattttcaagagtagaaaaggtgctacacactcgaaattg

SEQ ID NO: 84934 - DNA, 1137 bp, Oryza sativa
aagcaacgccgcttctcttgtaaaaatgcctctagtttacttcagataagttacccaagctcaaggctgggaagtactcatcaacaaaatcaccacaaacagatcgtactagcagacctgcagcgatcatcatactttaaatgaatccactatggtcttgagaactttctccgacgactgccactgcttgtcgctggcacttgcgacgaagagcaccaccgtgttccccttggcagtcgccttcgccagattgtgagaaccggtcagtgccaatggagtctctagcacatagctgtagtactgcacctcagaagaattgcccatgcatcagagttcagaaacatttagcactccaaagactgttgattcaaatagctgcacaagtagtgtgcaagttgttagggaagtgatcaagtgaagcttacagtttggccatcgatcttctccacggaggtatcgacgagctcgtcggagtcgaaggtgttcccggtgacaaaaggccccagagaggcgattagcctctcagggctaccgatgtcctcaatcgtggcgttcggcctgttcgtcaggcggatcaacggcgaggccaccacctgcaccttgccctgcttgtcgtcctcgaatttcacctccacccacggctcggcgcacttgggctggcagtagttgccggacagaatgttggccactcgcgtttgcttccaggtgggtggcagaatgaactcgtaaggttgcacattgcctggaattggtgaacaatcatattgagtggattcaacacatctcagtatgtcacacaactaaatcaatttctccaggcagagacgacagctaaccaaatcagaagccagaagccaagcaagcacttaccagctcgaagtgcaggagtgtccttggaagtagcccggaagaacacgaacccggggttggacgccgccggcggcaggaccgcgccgacctcgacctcacgcgcctcggccggcaaaggcgccttcaggaacgccgcgcccaatgccgcccccagcaacagctccctcctgtggctgacaaccgccgcgaggggcgccggccgcggggcagcgccaccagcggcaacgacagcggcggcgctgttgtcgtgggtggcagaagagcgcc

SEQ ID NO: 84935 - DNA, 638 bp, Oryza sativa
ccacaactaggaattattaccctcgaccaacttatgcagacctacagtttgaggaaatgcctcagattcaaaatatgacttactacaatggcaaagaaattgtagaatggaacttagatggctttactgaatatcaaatctttactttatgtcatcaaatgattatgtatgctaatgcctgcatagctaatggaaacaaagaaagagaagctgccaatatgattgtcattgggttttctggtcaattaaaaggatggtggaataattatttaaatgaaactcaaagacaggagattctttgcgcagttaaaagggatgatcaaggaaggccattgcccgatagagatggtaatgggaatccaaccggtaacatttctgatgccttagccactttaatctataacataatttctcactttgccggaaactatcatgatatctataaaaaaaatagagagcaattgataaatttaaaatgtaaaacaatgtcagattttagatggtataaagatactttcttgtcaaaactatataccctaccagaacctaatcaagacttttggaaagaaaaatatatttctggtttacctcctttatttgctgaaaaggttagaaattccctaagaaaagaaggggga

SEQ ID NO: 84936 - DNA, 1616 bp, Oryza sativa
tccatgtttgtgcatcattctgaaataaaaatagttggtaattctgcttatccagatttccagacacgtttatctttggataacccaatatttgaacaaaataaacatctgaatacataaattgctttcacaacaaacatttcggcgtgctccaccactcttacactctaaacttgctaataaaacagtaatgaatagataaactacttgtgcagtagaacaatatcattatttaaatctcatcagaactgcagcgaaaatttttttgttagaaataacgagataaatgcattaacatatgaatttccatgttatacttcaattgctttggtattgtgtcgggcaaagaggaatgtgcagaaaaatccagagggttctgagcaaccgtaggaagtataacatggaaattattcatcactttatctactccaataccagggaaaaagaactgatgtatgttatgtattacgaatttgattgaatgaatctgaatctttagctgacgttgatcctcagcagggagtgatcaaatcccagcatagcatgattcactaataaaaatgcctcttatggttagtacaaggtaaaaacaactgtaggatgcatgtagtactacattaaggttaacgaaatttccttggaaacgatcttgactgaataattctttgtttaaggaaaagaaatagggtacaatacttgcactgttgcctattaagcagcacggagtatatgcacttcacctgaaggttaacaaaatttccttgcaagtggtttgtactgaatcgccatttatgttaaggaagaaaaatatctatacaatacttgtctatagaaacactgagctcatgaagattaacaaaggaaatgcgatctttactgaatcacccttctttaaggaaaagatatatacatagtgctatcaagtaacactgagctacatgtattacaactgaaggttaacaaaatttccttggaagggattttgactgaatcgcctttggtgaaggaaaagatttacacattactagtgctcttgagcagcagtgggttgcatgtgctacattgaacatcaacaaaaaaaaaaatctcctaagcaatgtttgactgaatcatctagtgatgtagagagaaaatatcagataagagtagaagattcccttggatacataccatgttcttcgacaccttaatctcagagagtagatcagacgagcacttcgaccttcttcttccccttgaggaagacctccctgtcaacaagctcacgcatgtatccatcaaactccacaggaactccaccattgagcctcttcatctccagaaaccacttgctatctctcgcccagagttcctcaaacgcatctaggtaatgcacactgctgtactttgccttcagcgcatccaacaagaccacgttgatgccctctcccgcaacatacacctgccttcctcctccattgagtctctcctcaatccttcttctgaggttcccatcattgccaccaacatgaacagagtcaaaatctacttgcatccttgatatgataccatcaacaatgtccatcaagcttggcgccgtgcgtattgctccctgcggtggacggaggacatgctca

SEQ ID NO: 84937 - DNA, 1854 bp, Oryza sativa
catgtaaaaatcaacggagtcatatataaaaaaaataaaatagtactatgtaatgcggacaactactatggtatcactctatcacaaatatagttatttctagctttcaattttttttacttcctccatcccaaaatgcatctactttttagttcaaactagaaagtatagctatattttgcaatggagaaagtaaaatgtagctatttctctatctatatctcttttttaacaaatcagaattgtccatcattttatttctataccaactttctcttctcaacgaacataatatttcaccatttaattccactaatttctccttctcaacaaatcctaatatgaacttgtgaattttcaaaatcacacgagttgcacgcacaattatatttaaattaatgcaagtagtagtctttaggaagcttaccacgattagatcttggggaaacgcttcccacgatcatgcgcccattcctcggtctctccgtcaaatgatttgatcaatgacaagtaatgcttcttatcggtatttaataacaaggaaaatcttcaaataaagattttcttatcttttcaactgtttttttttatcaaatatacgatatggttataatgttatattccttttattaagatctcacaacaaaatcttacatttctatattcaaatgaaatctcgtaataataatctcatataattatattctttgaagtgtttacataattacatgtgaattgattttattttttataaaattcctccgacttatattagtgacagtacagatttgaagtactttagtgcccatactgaccacagaacatgaacaccacgttaattaagcagggttcgatattttggttttagaaacttcggtcccgggtatgaaattatttcatccgaaaattttaattttatgaatttagtaaattttatacaaattttatctaaattttaaattaacttgggtagaatatttcaaaatctccacaatttcagatcaatcgcctctcttcctcgattgtttttcctttccaaaatataaaaccatgccattatggttccgttgtgggctacgcctctccatgttgtgggtcgggttgtcgagctgcggatcttttggccaactatattcccccgaatggcgaatgtctgtacctgttggagctcacatgaattgtcgtgcctgagcctcttcctcgccacgacgtgccgatctagcacggcacggcccaatgatcccccgctcccataggccgtagctcgtcaatgggcggcccaaagagatgagagatgcaaaatagatgtattctagatatacaagacacgacccaaagaaatgagggaggcaaaatagacttattgcaaggacgagcacgttagactggttgtgccttcagaccagcatggcacagcctgtgtcatattgggtcgtaggtgcaaccagtgggcgagcacggcctgactgactgatctcagaccatgctttggttgtgctaggccaggccgtgtcgagcgactcatttggccatctatagggaaaacaagaaaaccattcatgctttatttctgggatcaaagcaagagcaactctagcaatgaagtggacgatgattactccctggtggtcacttgcatcggcaggcctccttccattcgcagagtcgaccagagcacgaaccctgggtgtccgtcgccaccggcgtaccggaggctgaactgctcgagcacgcacgccacgatggacttcatctgtatgtatgccatctccttgccgagacacatccttggtccggcgtggaagatggggtacttgaacgggctgtccggccggaacgcgcccgcctcgtcca

SEQ ID NO: 84938 - DNA, 586 bp, Oryza sativa
gtattgaatttctaagattattggatttttggtctaaaggaaaaggatttaattaaatcctttttggaaaagaaaaagaaaagaaaaggaaagagggagggattatagacttttcctcgggcggctagggcgcggcccaagggaaaaggagcggaccggccgagctaaatgggccggccggcccaaggcagcccaagtgcgcgcgcgcgggaggggaggagagagagggccggtggaccgggctcaccgtgcgcggtcccgggtgggacccgcttgtcagcggctcggctcaccgtgcggagggagcacgcggcgcggcgctagggtgggggagggacgcggtgcacgcgcgcggtctgcggaggaacggatgcggcgggcccacgcgcagcctcacggctcgcggtggaacgcgcgcacgggaggggctgaccggggtcggcccgtcccgacctcggctgggccggcgccgacgtggcgcctacgtggctgccacgcgggccggcgggaggtagacgacgacgcctgccggaacggacggcggtcgatagcggcgagcgacggagcaaaccacggcgatacaggc

SEQ ID NO: 84939 - DNA, 530 bp, Oryza sativa
aaaaaaaaagacagggagaagggcaatcaatagctccagctctagctactatactttgatcgagcgaagcatgtttcgcagggagaaggggcacttctgatcaggctgggtgatatccgtcagctttacatcacatctacttggccaagttgcatccacggatgtaagggtgatcatactttatataccttgtccaatatggtctgtacttggtcatacttggtcattgccaactccagccatggcttcatgttaccgttgtaatcaacaacggctgcattatctatctctgagcggtcaatgcttgggttgtatcctaatccgaggacatgccacgacttgtcaaggggatgcgtcaacttgaagaaggtcaagaggccgtgtggaagtgtcccaagcttccaaagaacccggtcttcgttctgttagaagaaaaaaaaaaaaagcaacattgatgttagagtaaatcgttttgcatgacatctctaaatcaatgagatccaatcatggaagtagtaatctcaccatgt

SEQ ID NO: 84940 - DNA, 720 bp, Oryza sativa
ctgatgcttcagaggaaactgaaaagatggagacagatggtcagaaccaagaaaatggggcggatgagaagaagcaaaatgaagaaagcaccccaattgaagaggtaatgataatatttgctgtatagttttgcttttatttcatatgccatcatgatatcaattgcttctccttacaacttttgtattattttcacaggattgaaggcatatgcacacactgatataatctggcaccaagttggtgttagatttccgttttatttgtgggggcaaagccacattgcgatgcctgatctcgttgaatgctctcgctggtctctagcatagtaccggtatttctgtatcttgtgaatgctaacatttttcagaagatggaaaaactatttgctgtgtttaggaaacaagcttggggtattttataccttccagtaccgctagatttcttgatgttgtagactgtagacgctgtttcatgtggggcatgcgagatgttcactcttattttctggaaatttcccccttattgctctctattgggaggctttgagtgagttgtttgaatgcatggcaccatttcaaaaattccccgtagatcgcgaaaagaaaattttttgggtgtcacatcggatgtttgactggatgtcagaaaggtttttcggacatgaatgaaaaaactaatttcataactcgcttaaaatcgcgagatgaatttataaa

SEQ ID NO: 84941 - DNA, 1346 bp, Oryza sativa
ccggtccccgaggttcgccgtcgtcgacgtcgcggcgctccgggcggtgcgggtggacgcggcgaggggcgtggcgcgcgccgaggcgggggccacgctcggggagctctactacgcggtggcggaggggagcggcgggcggctcgggttccccgccggaatctgcccgacggtatgcgtcggcgggcacctcagcggcggcgggttcggcccgatgatgcgcaagtacggcctcgccgccgacaacgtggtggacgcggaggtggtggacgccgaggggaggctcctggacagggcggccatgggggagggcctcttctgggcgatcaggggcggcggcggcggcagcgtcggcatcgtcgtctcctggaccgtcaacctcgtccccgtcccggccgtcgtctccgccttcaccgtccaccgcctcctactccggcgaggtggccacgacgagcaatctctcctccgcctcctcaccaaatggcaagccgtggcgcacgctctccccgacaacctgttcgtcaaaatgtcctggaggccaagaccacaacgacggcgacgactcaactgtcatccattggtgacgttcaaatcattgtttcttggaaattgcagcgacatgatcacccaaatcgaccaccatttgcccgaactcggcatcaaaccaaccgattgcagggagatgaactggctgcaatccatgctgtactcctacggctacaccaatggccaaccagcagaggtgcttcttgacaggacactgcaacccaaggactactacaagatcaagctcgactacctaacctcaccaattccgacacccggcctgatcgaattgctcaccaagatcgtcgaagacgaagacggctccatcgacattgacccacaaggcggcgagatgagccggataccggaatccggcacgccgtacgctcaccggagcggatacctctacaacctgcaatactttgtcaagtggggaggtgacaagaatgtgtcctatgaggatgatcatctgagctgggtgagggggttgcatgagctgatgacaccctatgtgagcaagaaccccagggctgcatacatcaactacagggacctggatttggggcagaatgtggagggaaacacaagctatgaggaggccagggtgtggggggagaagtacttcaggggaaacttcaggaggctggcaatggtgaagggtgaggtggaccctgatcagctgttctggagtgagcagagcatccctcctctggttgtgagcacaagggatgctggattggtttcagatagctgatgatggttcagtctgcagcttgatgtatagtaagaatctgtgcctt

SEQ ID NO: 84942 - DNA, 723 bp, Oryza sativa
cagatttactgtcaccataactactccctctgtaaaaaaccaacctcgtattaggatgtgacaatgaatctagacttcgagaatatccaaattcgttgtactatgttatgtcatatcctaattaaacgaatctcatactaggattttttttagggagtagaagtttttaaaaagatataggtcttgtttagataaaaaaaattggcaaaaaatgtcacatcaaatgtttggacacatgcatggggcattaaatgtgggaaaaaaaccaattgcacaatttgcatgtaaattgcgagacgaatcttttaagcataattatgcaatgatttgacaatgtgatgctacagtaaatatttgctaatgatggattaattagggttaataaattcgtctcgcggtttataggcagaatttgtaatttattttgttattagtctgtttaataattcaaatgtgcattcgtatactttaaaaactctacacccaaataagtaaacacacccatagataataggcaaaatttgccacaggacacacaaaaaacgtgtaattggctgggagacaccgcaaacgagcaggcggccgctccgcgcagcagcgcgctagcagggactggacgcggaggcaagcaggcaacagccacgacgggagcacgtgacaaggagccgcctacggtggagcttcgagcagtcgctagatcatgctcctccacctctcgtccct

SEQ ID NO: 84943 - DNA, 729 bp, Oryza sativa
gttgtcctttgcgtgtgcgccatgcaagcgcttctccatcccatcaccagctgcgtccaaacttggacggcttgagatactagtttcctagtacttatttatggttgtttatggtttaatttgttctagtgagggggcaattagttggttagcgccttggtggtgagcattcagttgagttgagcccttgaatgagcgcgcgatgcgatgtttggtgttggggcgattagcaaggtttgtaagtcatctgattagtcttgttgggactcttgctagcttattgttatgaattcgtagggtaaatgccggtatgcagttagtcttgcagtaatcagccgtgccaagtcagcacatttgtgtcacctgtttggtccaagctccttgaaatgaagcaatccaggagattgtcgatagtatgtatcgcttggatttatagttctagtgctatgggatggaatcattagtgatgtgctgccgctttagataattgaggcagtagatgtcatgaacctgtttgttttagtggtttttctttctttgttgattgttgatgttctgccttgcctcactggttgttgctacatgacagcacggtgcttctcttatggaagggagtgatcctgtcaccggccacataatctccacaacgattggagggaagaatggagaacctaaaagggtaaattataacataaatggaagccacaatatgttattcaatcttatgtg

SEQ ID NO: 84944 - DNA, 1034 bp, Oryza sativa
ggtcacctttggtgatcctaccaacttccgcaccgaacggctcgactttgatgtggcggatctcaatctgccctacaacgcggtccttggcaggcccgcattggtgaagttcatggcggtcacccattacgcctacctccagatgaagatgctgagccccggcggccccatcaccattagtggcgatgtcaagatcgccctgacttgcacgaagcaacgtgcaatcaacctcgcagccggagaacggcggcggggggcctgagacttccacctctcgtctcttgaagaagcggatgacttctggtgacgaggtgtccgtcaagaagattatccttggcaatgatccgtccaagaccgaagattggtggtaacttggacgacaaataggaagacgcgctcgtctccttcctgcgggcaaacgccgacgtctttgcctgaaagccgttggacatgcctggggtccacagggaggtgattgttgacgaaaaaatcgaacacaccggcctgggagatctgcttaactccagtgcaggtccaaagattggtgagatgcgagcgtgccagtcagtttgatcctgcaactgacaagatatacaaatagtagatcaaaacagccgatcggctgacaagccgatggagtagttccagccgatagcgataatagccgatgccgataccagccgatagcgatagggtttaagcaatcggttatatgtccaatgtaaataataatataaatgcaatcggctgatgatgatgtaataaaataacaatataatccagtataaaccaatcggctagcaatgatatgataaataagcatggatccgaaggttaaagcacacatcggctggaggtccgatgtcatgaaatccacaagattagattaaacagtgaaacctttgttgtcatcggctaaatccaacttatatgtatgtgcaatccttatgaaccgatgcaacgtccagataactcatcggctgaaaccccgatgaaacccttatgacaatcaagaagcaggtagagattatggt

SEQ ID NO: 84945 - DNA, 738 bp, Oryza sativa
agattataaaagatctagtccatggtctgcttcaaaatcgagctcaatgctctttagaaatcacaacaccacttaaacaaaagcatcaatgtttatgcctcaatcaaataaacatctatagcattagcagtatgctaacaattcctaggtaccaaatgaattgtcaatgacccgagaacacttaaaaaaaccatcttcaggtttagcacttacaactaataaaattctatcacttgtaaacatcaatccaaaacaaatctattgaatgaggcaatttcaagcaaatattggaagcgctatcctaggtcacaaaagggaatggagacaatgaatgctttaaaatcttctaggcacaggactaacataaacaggcagatacgaaaagcgaaatgtttcatccgagaaagagtaacggggcctttacttgatgccaagatcaatgtgctcctggataccgaagccgaagcatccggtgtcactgaagttcctcctgagcagctcgtactccttgaccttgagcccgctctccagcagctgcatcgccttctcccctctcaccgtcacgtagcacgcgatcttctcgttacgcctgattccgaacgaccgcacggtgtacctcgctgcaaagaaagcgccccccgcaaactctcgtcatcaccacaacgaagctaagagtaaactagagtagagagacggcaatggcggagagcttaacctacccttggagaacaccggggt

SEQ ID NO: 84946 - DNA, 1336 bp, Oryza sativa
aaaaggatgagagccctagaatttacaagttacaactggtgacatgtgatatctctgcagtttattaaaaccatttttgttgtatgtgttcaccttttcagataaagtttttggccctgctactactactcgtcatgtatatgatattgctgctcagcatgttgtaagtggtgctatggaaggaatcaatggtactttcaagtctccttttggttcttaaaacatagtactaaatactttcaaaccgtaagtgcaaagttactgaactaggaactgtccattgttacatagctatgaacatttccaagtcgtaaatatcaggattccgatgccacctttaccccctcctctttgaaagaaatcatctcccaaggctgctgagatgagggccctaggtaggattatttttgtgttggtaggatcagattatagttacaatggcaggaatgcaagataatttgataacgtcgttatatgaagattgtaacacataggaacatcattataccattctgtgcctaagtgtcatcagaaccagaattcactgataatattttaggatattatgagacagatcataatcctgacaaacttggcctctactttttgctaggacttaaagcattggtagttgatgatgtttatttttgtctcttactctagtatatgtagtttattcagttcagtaatattgttctgttccttgtaggcactgtttttgcgtatggtgtaactagtagcggtaaaactcacaccatgcatgtaagtatcagtaccgttgttatgcttatgcatctgttctctttcatgcatctaatacatgccaatgtgttcttattcattaaacgcgagacatctctatttcatatagctagtatcctgtgtatatttttttaatgactatcgcttcaatttaattaccaattattttttttacgacacactcgaattacagggggaacaaaaatcacctggaattatcccattggcagtgaaggatgttttcagcattattcaagatgtaatctgttcatttctctgtgaacaattaaaatggttgggatcgtatgacaatattatttttttgttcacctcagacacctggacgagaatttcttctacgagtttcatatcttgaaatatacaatgaggtacttctattgccaagccctgtctttgtttcacactaatgtgcaaagatgtgttacctatttagtacttacttaccctgtagaagccaatatgtttccaatccgtattcgtataagtttgaagtcatgtgatccataacttgcgctcactctttttgttgccttgatcacttctaggttatgat

SEQ ID NO: 84947 - DNA, 519 bp, Oryza sativa
gagtaatattaatcattaattgagcaatttcatcacgtcttattttagcaatactgatcttataagatgtgcctgtaattttttttttttttgcaattgatcgaagttccgtaaacaaggaaaaaaaactgaacaactccttagttacggtttactgtttaccttacataaaaaaaactgccactcttctcacatataattataattgaatgggttatgtttcatttgtattattttcttaattcttacacacaagtatatttatacaattagactcattaagaattcatattcccaaggggcctctgaatctcttatgtttacgaagaaaaatatggactgcatgtgtttgtgatccctttcttctcatgggctcataccatcaatcacacacattcaccttcatccttttaactcaaccaaaaagatctaaagcctctatttgagattattgagcgaattattactactgattatctatttataaatttaatattttgacaaatacatttaacaaga

SEQ ID NO: 84948 - DNA, 3552 bp, Oryza sativa
ccacaactctagtacttttgtgagagagctctacccaactccactcccagttttggtggagctgaaactgtttggctgagctccagctccaggaggggtagagctggagctggagctgtgccacacagaccctaagataaaaaaattaccttatttttcgttagcagtataaactgctaaatgatgtattggatacgaaaactttcttatataaaaaatgttttaaaatatctgataaatttatttgtaagaattgtaataataaaatttgattaatcatacgctaatagttttcttgtttctcgtgcttttagctttatctttggatctgatcggtagtgcttgttgcggctgcgaccagcccaaatctacacaaaatagttgatttgaagtcagcataaacgattaaggcctttatctctgagaactccaccttaattgaattaaaatggagctaataactagggacagatttgggtttgaaggaggagagctagtgtttggtgggcattagcaaacgcgatctccttaattgtttggtgatcctgcagcgaaggtgtagataggtagtggcagggagtgcttgtactgaagatgcacaaacacaccatgaccagcacgagcacgagcaagaacacgaacacgacgcgtgatgatgtcagtggcagttgatggaatcggaccgggcaattaatgcgttgccgccccatccacgtcgtcctctcctccccctccggttaattttttttccttccggtgaaaactttttcggacagaacagtgacacacacatcctcctcctcctcctcctctctctctagtctctgccgcagctacagcgccgttgaaaaatcaaccggtaaaacaaaaacaaaggggtgtttagataaaagtttccgtgtgtcacgtcgatattatatagggtatcgtatagggtgttcggttactaataaaaaactaattatagaatacgtcagtaaatcacgagatgaatttattaagcccaattaattcattattagtatatgtttaacgtagcaccatattattaaattataaagcaattatgcctaaaagattcgtctcgtaaattagttataatatgtgtaattagttattttttatttaatactttaatattcaaatgttcgatggatatggtaaaatattttgggacgagatctaatcagagccaaaacaaacaagataaacgccgtgaagaaacaagatggccattgccactggctggaaccagaaggaaggagaaaacacggaagagacagagcgagcgtgaggtagtcgtcgcagcagcatagcagcacgcgggggccatatgatatgcaatgcgaagcgtagggtctagtcgcgtcgcgtcttggggcagcgagcggcatcgcagctcccatcttgtccgcgctttctgtttgctgcagcggctgcggcagaggcagctgcagggcgaggcgtgtaggagtagaggctagtactgctatagtagctttcggttttgtttgcttgttcggatcaaaaagctgccgcgagaatcatttcgctcccacctgcttcctcttcttcttctctcctcctccactgctgcgtcgtctgcgtgtttttcttttgttttcttttggttccaggggcgctgacaggttgatcagatggatggaggggatggaactggggcttttttgcctccccgtctccagtctcctaccactactgcttctacttctactgcgtctggcagcttgtgtttcccgacgcatcgatctgcatgtttttgggacttgggagcgatcatttgctagtatacgaatacttgtacgcgagcgacacggaatgatggagcgctaatttttcagtgtgccggtgtgtaaatttgcactcaatgaactctctctgcattacgacaactacagttttaatggggatggttgttgattgttttgccgtcaagaaagaaaaagaagaagaaaaactcaggctgacgatgggcttgtgataggggcagtgttttagcgcggttaccgcatctcgtgttaaggtacggttaccacgaaaaaatgtgtggtaaccacgagacataccgtggttttaaaaattaaaaaggttaccgtgcatggtaaccgctcggttttgtatttggcccttatttagttcccaactttttctttaaacttacaacttctttctttaaacttttaattttaattaaatttttaatttttaattttgacatggaactaaatacactcttaaccttgggaactcgggtagggggcaccctggtactacacgatcttttaatgccatgtctcaggcgaatgattccaagttccgatcagcgatcaacaggacaccgtgattgaccggtgcacagtgaagctctgtcaatatgtcatcagcgtttgttgtgaaccgaagaccttgcaaagaccttcacgcggcttctgtttgttgtgaactgaagacattggctgtgtttacgtcagcgtaaagtttaaattttggttaaaattagagatgatgtgacctgaaaagttttgtgccaaacttcagtccttttccatcacatcaacctgtcatacacacaaaacttttcagttacatcatctccaattttaactaaaatctaaactttacactgaactaagaacacagacttacgcgagatttctcagtaaccaccattggtaatcaactacaatgatgatatcgtgctatggcaaggctggagtccatccagaaccaccgcagaaacggggcgcttccgcttccgcttacgcagccacgcgcgggcgacgcaacggccacctactccgccaaatttgcgcagagcgcacgagctgtcacgtcgcgtcatccgtaaccgacgctgggtcaatgggagagcccgtaccgctgttccggcgagaccacggtccggcttttaaccgctcaagtcaatcccgcattcaataaagtacagcgtcaggtatatatatgcatacgctatttaaacatcaaataaacaccaagacgactactagtactagtactaaactgcagctttgctacaggctacaactacgagtgtacgcgaaaaaaaaccacggtacagtccgttcggctgtctccacaaggagatgtacggcttggctacacgccttgggcgtcaatcgtacctaagtccctaagtaaatacagtaaccgtgctacgatcttcctaagtcaaatgaagctgtacaagaagggggcagcatactgcggattagcaccagggctgacagtcagaaggcataaccacattccacttccatgagattgcttaaactccgttgtactagaatcgtcagtgctgcttcggctgctggagtattgtgtggtgtggtgtgaatggatcaacgtcagctgatgaattggagggcaactgcaaagctgtgacctcgccctgctatagcacctgatttgccatctgtgaagcataaatgaagatgagccaagcaggggcagaaagatactttgcaaacaaaaccccaataaatttcaggagctaatgtgcgtatgttagtc

SEQ ID NO: 84949 - DNA, 548 bp, Oryza sativa
cttcatcagactccgaaccaccttcgttgacatcactgccttcctcgtcactatcaccatcatcattgccatctctcccctcataatctgattccgattcctcatcagagtcacccacccccgactctggcgatgagatgtcctccgtgtagatccgaattcccccaatggacaaaaatccctcgttgcgcttgcccttaggcttctccttcggcttcctcggcgtcactaaggtggcctcctccaactccacctcttcgttgctgcaaccccggaatcccaatccgagatgcagcccagcctcaccagcctcctcctcctcatcctcctcctcgccgtgaaaccccagcccgatcccgccaaccgggccgtacgagtacaccgggacggaggcggaggccgggtcggcgcagggggcggtgtcgatggtgacatccagcacctgagtcgccccctcgaaggaggcggaggggcggagcgcggcgtatctgaaggggacggcgtgggaggacgagtcggacgcggagttcgacgacccgcctccgccg

SEQ ID NO: 84950 - DNA, 2410 bp, Oryza sativa
ttcctgcaccccccctcgggatctgttgacataagggaaatcagatttgatgaaatagatgatgaatatatagttacaggagcaatgcccggcattgcagcatccaggaggatcgccagtcattacaggtgtgtgcatataattttatttttcttgctttctgttgctattaagaggttatattgccaaaaggacatacacttcagctctcaaaagacttgaccgtagccgaaagctgatatgaacgcatgaatacgcatgtcgacaccaaatgataagatgcgaaaataggcagagttttgtttgacattcttccttgagaaaaagtttattttctcactaggaaaataggcatagggcatgagacaatcactaggaaaactctattttcaactcttgagagaagtcttgagtgtgtactttgaaaagccagcacaattaacacaactcttgtttgagctcgacactttctgatgcgccttctactattattgatctttgcagggatcctagatatggacgcagacgttcatactactaggatgaaccagccagctgaaatgtaatgcagtgcagccacaaccagaatattgtgcctctacccgcctctttttcttgttctctcaaaaatctggaagatgctatcccagcccaaatttggtgtgcatataagatagcagcaaacccttcattgttgttcatttacagcaggtttcaacatcttaggttcctatgtaaatatgtaaccactaccctatagcaatgttgatccaaggtttctctccgggaatccattttatcttaaaaatgtttctctggaaatacaccaaacttttacaggaaaagctcacaaatttgccaagtcaatttgttctctctgctatctctctaacacgataattgtcggaaaattcagaattttgctgatgtttcacatggtgacacaagtgtgttggattgtgagaagcatacgcatgacaggaacagcctgattgacgctttgcttctgatgctggttttgtagagaagatttcgtgttggagtgtgctgagatttgtaaatgattttgattagttaaaatgttgcttgttgcttaggctgttcttctcgcgaatggcagaaagcattcgtgctaaatcatctaaccgttgttttgctgggttttcagagctttttcgtgcaggataagaactgctaatgttgtcagaatgctggttgcttctttggcttatctacttgattctggttgacttccattagggttgcgtcaatggctttaagatgcctgccttgttcaggatgtgcatcttaatctttatttagttcttaccgtctttgtcaatcataggtaaggaaaattaagacccaaaaacatgtgaacatatgttgacatttcaggatatcagcaaaatctccataaacattggcatattaatgtttaattgctgcaaaagacagatgtttgtatggaagcaaaatctccatgttttccaatgatcaatccaggtgctttcagctacaatcaaagttacaaaagtataaccgtgtggtctatgtgaacagacattgtcatcacaatgtttaaagattaaacatacaacacatgtgagagaggagagagaaagaggggggggggggtgatttctgcagatatggtgtcctttggtaattgacactaaatgtattgccagagaaaaaaaaatggtgtacaactaatcgaacagttttgcatgttcaacaaaagatcgaacaatttatcagaaatattggatcagtacagcatcatcactatcattttggcctttgaagagcatgcttgttgcattgcatcagagcttccaactatacaattccagatccttttggttgagtgtaggaaacatctgatgagaacaaacagataattattaggttatgggtgataattattatctattattttgtagtaggccaaacaaatagcgacgcagagaagcggtgagtaaccagataagtggatctactacttgagactagtcatcatctctttccaaccaaacacaaactacccttccaaggagaataactcactttgcttgcacatttcaattgtgtttctgtgtggcttcaacggtgaaaatgtccaggcttcggtcaaatgaaaacaatagcttctctctgtatacatcatcacttcaatgaagctggaagcctgctggggacttgacttccatcctcagactaaagagcttaccagagaaagctcatgcagttcagttagtgtccactcctctccagtttgtcctccaagaactatcgcctttgtacctcccacaacacaggtactgtggccccaggcaaatcgcggagggcggccaggaacattcagtatcctccaggtaggcttctcttcagtcggatccagcaggta

SEQ ID NO: 84951 - DNA, 6089 bp, Oryza sativa
tggcaattcctccaaagaacacaccaaatgtaactgcaagaatggctttcttgatgtgtcgttttttggagatgtatgatgtttgagctgaactgcaatggtttgcaagcataggaccacataattttggattgccatcaaagatagaacttgggaatgtgctaagctgacctacagttggaactggtccttctaggtcattgttagaaacattaaatgctgaaaggaagtgcaatttgttcagtgcttcagggattgtaccagtgagattattgtttgacaagtcaagcatctgaagatttgtgagattgcagattgattctggtatctgtccagacaatttattggagctcaaattgagtaaaagaagtgccttcaactgaccaatctccttagggattgcgccagcgaagttattgatgcctagattgagcactttggggaaagcactgtttattcggtactgaagtgattgggctgtaaaaattggcagctcaaagacttttggtgcaacattgtctgtttttagcattggcatctccattaatgctgttggaatttctcctgaaaggctgttgttcgttatgtctagatagaagaggaagtttaggctgctgatccagataggtatttgtccagttagttggttgtcatgtaaaaataacatctccaaatttgtgagctttgataaccaatgaggtattttcccagacaatgaacaaccatacagggaaagaacctgaagattctcaaaaccatcaatgctatcatctaaaggtatggtttcgtgcatgaagttgatcgcgattatcaaggttgtgaggtttttggagctctgaagcatctgaagtgtactggttatatttgcaagagagttcttaacaagtgacaggaatgataaggacttcagattacctattttctctgacagctgcccacgaaagttgttgaaagataatcgtaatgcagttagattgctacatgagtaaatgctttctgggatcgtcccattgaatttattccacacgacatctaaagtttttagattgggtagtgtggagaagttaaccttggtgagctccccactgaagttgttcttttttaggtcaatggttacaaggtttgtgcagtcactcaacgttgatggcagctcccctgacatgttgttgttgtccagatggaactcctccagtctcttgagctgtcctatggaatgtgggatgctgccaatgaacttatttcctccaagatcaagggtgaccaaatttatgagcttggtgatgccgtcaattgatccttctaactgattgttaggaaaagagaggtgcttcaaagaggtaatatcaaagatctcatatggaatagccccagtgagattgtttttgccagagctgagcaatgtcagtgtggaacaattactgagccctggagggatgcccccactgaattggttataactaatatcaagcaaggcaaatgatggtgcactggcacagaacgaagttggtatcttcccagtaaagctgttattgctggcgttgagcgctacgagactcttcatcacctcccatgttgttgatggaaaatttcctgtaaacaagttgcttgatatgtttagtacctgcagaggccggtcatgggtcgaagatggcagatcgcttaagtctcctgtcaggtagttaaaactgacatcaaggatcatgatgctgctggatgacaccaattccagtggtaagccaccagacagtgagttgtgggacaagttgaggcgcatcaagcctatcaggttgccaagggaaggtgagatgatcccctcaagccctctagtagccagaaacacctcattgactgtcctatttgggttgcaggtgatcccttcccatacacagcagtccgtgccattcttccatgacatgcccaggccaccatcctttgaaagccaagcgagaaactggatcagggagttgctctctttctcggtgcaagaactggtgggagaggccaagaagagcagcagcgcaagagcaagaccaaaggaagttatggggaatctgttgctgtagttcttgttcgagaactggaggggttgcatggttttctccataacctagcatcagagccaatagtttgaagaagaatgatcatgatatgaagggaacaagcagctgctgcctcttctttgttttatcttctcaggtcaaaatcaccacatttatgagtcaggactaagctgctattggttagatgtgacatcactttccaaattcactgttcacaccagcaagctgctatagtctactggtaagtctgacttccattcactaatggtttggtaatacttataacagacatccatgattcggccattattgaacttttgtagcgtgcgttaatttactcgatatgacaattatacaagtttcattatgtttaacttttgctattggcataaacatttaagactaacaaagatgaatagaaaaaaaaatccctttttgctgggcaagaaagtggctctctcaaaattgcaaggagctaaaagagtttcacgaaaatgaatgagcccgcaagcattgaccataccaatgaatatttgtctgtaactatcagtatatttcagcatgtcaggtaacttttttttctcgaaaatatgtcaggtaaggatcaaaaagaaaaatgtaggtttttttttcacaaagtggttattacagtcccattaggccatcaccaagaataaaatgtttatccatttgcttcctttttttttattcgctaggattttttttttctgagaatatgttagttttgtgctctctaagaaaacaaacaacaaattgattcatatattttgttactacatggtaatcatgtgttgagctgtcacttattaaattcctggtatttgcctcttgaatcatgggctctcgataatgttgtgaatcttcgtgttgtttatcgaattctaactacagaatagttacaagaagggaaaaaatgggtttgaattacaaaatagtaaaaaaagataattcatgagagactgtgcaaagtacagtgcaacactcagcttctctctgcactctaaagtagatcatcatgtgttatctaattctattttaattgagttttgttgtctgcagctcggtgcctatgatgtcaggcaggagacaccctcttgtatagttggtctcattccaggattatgatttacacactggcatgcaacttcaagaaccttcaccatctgtttttcatatcctgtgcctcggagtgttggatccaggacctcaatatacgttcggtcagatatcatctcctgcacccactcgacaagttgttttgatgaagacaagattggaacaggccgccttccggtgagcactcgagcaggactactccaaagctgtacatgtcacctctcaatgtagccacccacccttgtccatactctggggggatgtaaccgaaagtgccgactagctctgttgtgacatgggttctgttgggaaggatcaaccttgatagcccaaaatctgcaatgtgagctttgaattctttgtcaagtaaaacattgctgcacttgatgtcacggtggactatttgaggcttgcagacatcatggatgtaagatataccctggcttgctccttgtgcaatcttgagccgcattggccagttaagaaacgagctggcatcatcattcctgttatgaagccaatcatccaggctgccattctccatgtaggaatatatgagcaacattgagtttccctggatgcagtaaccccacagcggcacaagattgtcatgctgcgctgtagagagtgcgtcaacctctgcactgaattccctctccatcagacacatgtcgctgttgagcttctttatggcaaccatcgatccatcagataactcagctttgtagactagcccatatcctccacaaccgatgatgttctccttgtcaaagttttttgtagccttcagatcagtgaatgtgagcttggtttgctctccctttccttgtgacagcatcaccaaggtttgctccgacttgatgttggacaatgtttcttcggtgccatcgtttctgcatctcctgttctcagtcacgaaattcttgcccctcaagaagagaataagacgagctagcaagaacaggatggtgatacctccaaaaaatacaccaaatgcaagtgctaagatggctgtcttgttatgtcgctttttggagacatacgatgttttatctgaaccacaatggtgtacaagcataggaccacacaattttggattgccatcaaagctagaattcggaaacgtgctaagttggcctacagttggaactgatccttctaggtcattgttagatacattaaatgctgaaaggaagttcagtttgttcaatgctgcagggattggaccagtgaggtcattgcttgatatgtcaagcacctgcaggtttgtgatgttgcagattgattctggtatccctccagagaatttgttggagctcaaattgagtaaaagaagtgcctttaactgaccaatctccttcgggatgacaccagtgaagttattgatacctagattcagcacttttgggagagcactggttcttcggtattgaagtaatggagctgtaaaaacaggcaactcaaagacccttggttcaacattatctgttttgaacattggcatctccattaaggcttttggaatttctccggaaaggctgttgctcgataatctagatagaagaggaagtttagactgctgatccagtcgggtatctgtccagtaaattgattattatataaaaataacaccgccaaatttttgagctttgataaccaatgaggtattcttccagacaacatacaattggccagggaaaggacctgaagattctcaaaaccatcaattatatcaccctctggcattgtttcttgcttgaagttgcgaccaatgagtaaggaggtgaggttcctgcaactctgaagtacctgaattgtccttgtgatatttgtaagagagatattaacaattgatagaaaagagaggtactgcagatttcctattctctctgacaactggccatggaacccattgtaagacagccgtaatgcagttagatttctgcatgagtagatgctttctggaactgttccagaaaaattgttccaaacgacatctaaagttttcagattgggcagtgtggagaagttgacattggtgagcttcccgctgaagctgttgctcttgaggtcgatggttacaaggtttgtgcagtcactcaaagtccatggcagctccccggacatgttgttgttgtccagatggagcttctccagtcttttcagctgtcctatggaatctggaatgctaccaatgagcttatttcctccgagatcaagggtgaccagatttatgagcttcatgatgccctcaattgatccttctaactgattgttaggaaaagaaaggtgcttcaaagaggtaatattgaagagctcatatggaagggtcccactgagattgtttctgccagtgctgaggaatgtcaacttggagcaattaccaagccctggagggatgcctccactgaattggttattactaagttcaagcaaagcaaaggatggtgcactgacacagaacgaagttggtatattcccagtaaagctgttggtgctggcattgatcgcgacaagactcttcatcacctgccatgtggttgatggaaaaattcctgtaaacaagttgcttgatatgttcagtacctgcagaggccggtcaggggttgaagatggcaggtcactcatgcctcctgtcatgtagttaaaactgacatcaaggaccacgatgctgcttgatgacaccagttccagcggtaagccaccggacagcaagttgtgggacaagttgaggcgcatcagacctgtgagattgcaagggaagtgagatgaccccttcaaggcctctagaagccagaaacacatcagtaaccatcctgtttgggttgcaggtgatcccttcccatgcgcagcagtccgtgccattcttccatgacatgcccaggccaccat

SEQ ID NO: 84952 - DNA, 2666 bp, Oryza sativa
ttcctgcagcccacatgacaaacaacatcattcagaaaaagaaaaggagcacatgttttgaagcagtcatcgatgtcaagatccacatgtgtacgggcatggaaagaacggattaatggaggaaatatttcccagggctctctcgttgaccctgaggcgtttacttttcttgccgttgtcagcatcaaagctttggttttggttaacatctaagttgcaaatggcaattggtttacgatggttttggcctttggactgcgactcttgaagtctagattagcagcaatgctggaccagactgcagcatcattagaggggctgagaatcgattagtcaggttaatggcagtgttcatgtgatcattagctggtatttcagtaaccagcaaaaagattgcttgcatttgtcttttcctttggcagataaggagtacttctgatgttgatagaatatgctgtttctatggctatgataatgtctgtcaaatacaaatgcagaagggcacaagtggctatcattaaaaatcaaagttacaaggagttaaaaataagtttcaggaaaatgaaggcggcagcaagaattgaccgtactcttttcatttttatctagtacttcctccgttttataatgtaagggtttctaacattaaccacattcgtatagatgttaatgaatctaaacacatatatttatatgaatgtgggtaatactagaaagtattacattatgaaacggagggagtgtaaattttgtctgtaactatcagtatgttcttttgccgggtcggccgaacgaggcagaccaaatttcattatggtaaaggagaatgtaaagaactataagcatattccagcatgtcaggtaatgaccaaacaagaaaatgcttgtatggaagatattatatcagcttttggtccgtcactttcacagatcggtttagatacacagtcccatcactatgtgttaagttctctcttttctctaagaaaatgtgccaatatggctgtgtgcatccgttttgaatgtagatccgagttttaattcattttttaaaaaaataaatgtctggacagcatgatagcaaaatcgaaaagaaaacgagacaataaaaattaaaggaaaaggctaatgggctcacaattcctggccaactttattgttacagttgattagtcgatcgtaaaatagaaaacataattagcatatagggcttagtgccataccaaaacattagtaatcaatactttgggctctgatagctgcagtcagcaaaccaagcctcctgttgcaactacagaaaattagcgcgcgttaggttggttggctgcagttgcactgctacagccaacaataccgatcaacctcttggtagggtaaaattcttagtaatgtgtttggattgataccaattaagagtcaaattttatgttatggtgaagaaagttttataactataccaaattaagcatgtgcattactatctattcggcttcaaaccaaaccatcatatttactattcaaactaacaaaatattggcatcgcacattttggcatcatccaaagtggcccataattagttgaatattaactgttaaaaaataaaaaaagttttatttaataatttaagtaaattatatatataaattttatttttaacaaaacatatcttttaacaatttttaaaaaaacttgctaatgcgttttagaagttagaacagaccctagtataatttttatccactcaagtcattcaaagtacggtgatatgagtgggacctactacaagtaacttgcactgtgaagcatgtagctcagtgtgtgtgtatatatatatatatgaaaatgattctatacacataggagtacgtacacctgctcccatctaccgtccatcgtagcaagccccgataaagcccggatgcaccgaacggatccgttttcatttttaacgagaaaaaaaatccgtaatctcaattaacccgtggtaatcggaaaaccggatcgataaataccagctcattgggtgatctcgataaatcagttatcagtggagagctcgatattcggaggggttggcagcgatgcgacgagggcaggatacatcgttgatttggtgtccacggcgagtcggaagcgacggcgtgatccagagtatcataatatatatatatagggaatctaaagcattaaatatttttccttataaaaggaatcataataaggacttgaaattggtggaaatgagcaagtagtactttcttcggattccgatccagagtatgttcccattcacttgttaagaaaatggctatcaagaacgaattaaccctttattccttttttctttttacatacccctcgggcaaagaagaataggacaaaaaaaatatggaatgcaataaaaaaaagatctttatttattctttccgtagtttatccatattcatacaaaattcttcatgaactaatacccaactcttttcgtttattaattgttataacgagtgttttattccaagattaagttattgctgaacaaagaaaaagtaccattatattataaaggatgagatgaattccgaagcgttttttatcattctagcagacagaattcctttggtctaatttaggacgttatatatatatatatatatatatatatata

SEQ ID NO: 84953 - DNA, 1593 bp, Oryza sativa
ggctagatctctttctcatctgtggccaaaaacattcaagatgaaacctccagaaggacaagatattggactgtgcttcattagttctcttcaaaggtatgacccttcaaatcgatgcttctactgactttccttttgttcctctcacttgtctcaatggcatgtggacctactggtgtggacccatctcattatttataaaataaggacgttttcagatgtttaattggtggcatgatagaaattaatcctcagaagtatcaccaatgattttagtgggttcagtcatatcatttgtcatatactaacaagtcctacctccgtcccagaatataagaagttttggggttaaacacgagtattaaggaagtaggtggaattaaatgggtcaatgttatgatttgttgagaaaaggaggtagggggagaaattaaacagagaaggttttgattggttgagagaatgtaggtggtaaatttgctatattttgggatggattacgaatgctagaaattactatattttgggacggggggagtattcatttcagttaccggcaattgaaaaccaattcaacaatttatcctgaaaaaatgaatgcgagttcttttggagtttaaactctttttatcaactacaggatgcagctgtgtgcatgaagcttatctgcatttgtgtgttttctctctttttctttgcagaccaaacgggagttctgaccatctcctgaaaaatatttctttgcatattgggttacgaaccaaggctggtgctactaggtgctgatattttcatccaaattgcttacccaagaataccaaaatatgttccatgatcctttttatgtcccatttccaaaccatgtcatgtatccccccataactgacaatgcttggacttggtatgcttaaacaaactgatactgtgatgcatccatttctcaaagttgctatttggtaatcttatttgtatgaatattttttaaattcaattttttttgtaatacctgtttttgatttgtcgcaatagtttctcttacaaccagatgaaatcacatggagtttgcatgtgcatagctatacagtccctgttaaatattttaaaaagtagtatgcatgtacaaatttatcatctaaccttttttgtataattaccaatttaacaggaaaatgtaataagttttacttttggggtgttttcggagagctgcacagatactataatcaaacaggtaatgttaagattggcaataccgactcgtgagacaaatttgaagatattggcatgaacttggacttgacaaatggcaaagagttaaagagaggcaaatgtgggagttaaaagagaggcaaatgtggggttgaggtgtcatttgagaggcacaaatgtaaggaaactggcaagattttggagacacaagacaaagaaacatagaagggaaaatgtggggagattagtaataaattggatgtggcagttagcaggtaaagagataggatcaacaaatgtatgaaaatgctgaagactcctgatccaaatgctgcggcaagctctttaggtacaagtgcttttttctttgagccggcacatctt

SEQ ID NO: 84954 - DNA, 719 bp, Oryza sativa
tcctgcaccccctgcatatttttcaacaaaaaaaaggagagaattgcttgtttgtccatgtagtcgggaaatgatacttcaatagtgctcttgtttggcgatatatattgacagagttaacctggtgaaatagagaagttttattgtttacacgcaatgaatagttgcatatttttctgtatcctgtcatgatgaagtctgataaatagcatttctgaaacattgaatttctttattcctttctagatataatacacaagtattgttacttattccagggatttgtcacacaacaacttgtctggaccaattccaaattttctagggcagcttccgttactaatgtttctgtaagttttattgttttgattttggaattctgacataatagtctttcttttttggtatatcatgagatatttttcctttgtagggacctgtccagcaatgatctcagtggaccaattccttacaatcttcttcaaaaatcacaaaatggttctttgtcactaaggtatgttctatgttacaaaaatatagaatgcacggataactgaacttaaattatgctttgaagaaaatattccataataactttattacttaaactttcaacgtgattgaaggatgcagttaattacgaaagtacttaacaattaaaatcatatattattttttcaatttattctataaatttattcttttttggctgtgtgcat

SEQ ID NO: 84955 - DNA, 2240 bp, Oryza sativa
atgatgagtatatctcatacaaggtgagctattagctggctgttcttctgagccacctgtaagaggtagcagagatagctgctagtacattaactgttgactaaaacatcacagtgccaacataaattaacatttcattggaccttgatttaaaagttgtctgttcaagagagattcactacctgaaaagcaaactagatagccaaatatgttaggcactcaccaggtgtcgattcatgttgtgacgtggagaatggcaatggcaggaataccagggctcatggcgaactgttcaccatttgaacattgcacccaaaatgcaatctgctctgtattctacaactcaataaaaacatctgaagtggcaatatgccaatatcacatctgaagtcaaaatatatcaccaaaaatcttcacaggagcagctaccgttcctaaaatgatggaaccgatttccatccctaatgtcaatttgtctcttggtgacatgagatacaaacttgataaaagtatgacagtcaccacatattctaaggttcttcagtatctgtataggcatgcccttaggtgtagcaagaaggcaataagcaacagcaagcttctcactgtggtacaaaagggagctctccttctgctcttcatcaatgtcatggagaacaaattctgtgtcaggcacatagcctgtagcctttaacaaagtgtacagttcttcgagggtagcaactatctcttcaatctgctcatgctgcttatcgccagtgacaaaggagtgcattttgtcttttatctgtgtccagctgcaaccaggctcttttatcacaccttgttgcttcataatttttcgtacctctgcaacttcaccccacatccctagggaagaatatatatttgacaacataacatagttgccagcattcgatggctcaattctgaagagtttctcagcagctcttttaccaatttctgcattcttgtgaatcttgcatgccccaagaagagcactccaaatcactgtatctggctcaatgggcatatcataaataaattgttccgctccttgcacatcacctgttcgcccaagcaggtcaaccatgcaagcatagtgttccggcagaggagttagtccataatcttggctcattgacttgaaaaacttccatccttcatctaccaaaccagcgtggctgcatgcatttaaaagccccacaaaggtaacctcattcggtaacaccccagcagattccatatgttgatacatcttgatggcttctcttccaagcccatgttgtgcataacccgtaatgatggtattccatgtaaaaatatctcgctcctccattagatcaaaaatcctacgagaatctgcacagccacacttgaaatacattgatatgagagcattggctactataagttctgaatccattccaagtttaatagctacagtgtggatttgctgcccaatcttagaagcacctagactcccacatacaccaagaagtatagttaaaattggtgagttgggtaactcatgttcacaaaacattgttttgaaagcccccatggcctcattggattgctcagcatgtgcatacgcagatattatggtagtccaagaaacatcgtcccgactgagcatattgtcaaatgtgtttctggcctcatccaacagatcattctgcacaagtgcagcaaggaaagagttccatgacacaatatccttagttaccattcggctgaatacttgtcttgcgtactccatgtttctgcacttgccatacatagtaatgagtgcattacatgcaaagctattgaactggcaaccaacctttactgcaagggaatgcacttgtgttcctgtctcaagtgccacaatatttgaacaagcaaagaagatactagtcaaactagataggctaggcaacatcccactcctatggagctcttgaagtaaacccagagcttcttcacttctcccattttgtgcataccccgcaatcatcccagcccaagatattgtgttccgaaaaggcatcttatcaaacaactcctttgcctcattaaccattccattctgcatgtacccagtaatcagggcgttccaggacacaacaataggttctggaatctgttcaaataaaatccgtgcatcatcaatcctaccacattgagcaaggcctgtgataagtgcagtccgacaagcaattgattttacaaggtctctttcatagacagcaata

SEQ ID NO: 84956 - DNA, 3250 bp, Oryza sativa
ttagatctgatttacgtatatagagaaaaagttttcttctatagccttttcaattgagcatactctcttcattttgaataccatggaagcatattcctaatgacaatcactgctttcttttgatactgtcagggttggttataatgcaaaactatgtggcaacgatactgaatgcggatcaggtcaaaagaaaattaaagggtcacttctttctgcaataattattacaatagttgccactgttgcactaattgttgtcttatttcttcttctgcgccgaatgctcaaggcaaaaggtaataaagtcaggaggacagtaggagatatctgcttagtgcattacagattgtttgctgtttttcttgccttgttctaacaatagcatttcttgcatttaactatgttcctgatatttgctaaaatgtgttactgacatgtcagacaagagaagagctgctggtcctacatatgaatcagcattacttgagaacagagaattctcttacagagaactgaagcatattacgaataactttagccagcaggttggtaagggtgggtttggagctgtgttccttggttacttggaaaatggtaacccagttgctgtgaaagtgcgatccgagtcatcttcacaggggggtaaagagtttctagctgaggtattagtaatttttaatttggagaagttgtatgtatcacagctctttcataactcgtaccattttgtctacaatatactgtcaaaaatgcagtttgttttccttacacatgttttttctgtgtaaccatctgtttctgaattctgatgaacgaacaatttcaatatttggtggttttgtagataaattatgctacttactaatcactctcatatctgctatgcttgaattttctgaattttatatttcaggcccaacatttgacaaggattcatcacaagaatttggtttccttgattggttattgcaaggacaaaaatcatttggcccttgtgtatgagtacatgccggaagggaaccttcaggatcatctgagaggttatccatcttattatccaaatatagatgcttatgtagagctttgaccctttgtttgtgtcatgctagtaaaagataaagttggtttatcatgaaaatactgttaatggctaatataaatacaattatacgaacataagttgttctgaggcctgaatggagggagattagctgtctgttatatctttagaatcagattatagagtaatcctacatttttctcaaaggagaattgcaaagacacaagaacagccacggttgctaaatgaaaaccacatagatatattagaaagtatcatttccatggatttctccaaaatctgcaataaactgattatgttcattttctgttgatatgtgaagctactactaataagccactcacttgggagcagcgtcttcacatcgcccttgatgctgcacaaggttaaaacttaactagctactactattaattttcacccggcaaaatactactattagttttctgatatttcattcatacccgcgcattattagtttattacctaataaaagtttaatatctgtgtatctcaggattggagtatctgcatgtcgcgtgtaagccagcactgattcacagggacgtgaagagtaggaacatcctcttgaccacaaatcttggagctaagatcgctgattttggactgaccaaggtattcagtgaatcgagaacacatatgaccactgaaccagctggtacattcggctacttggatcctgagtaactcctctaactctcgtatactgaactttccttttcaatattgcgcgtgaacaatcgcattgtttttctttcaaaatgaaatatcttcagttctaccaagtaactgaacttccatgtcatattctgcccatcttgttcaggtactaccgcaattatcatatcagcgagaagagcgacgtgtacagcttcggtgtcgtcctcctggagctgatcacaggccgccctcccgtcatccccatcgacgagagcgtgagcatccacattggtgagtttgtgcatcagagcctcgaccacggcagcatcgagagcattgtggatgcaaggatgggaggagggggaggctacgacatcaactcggtctggaaagtcgctgacttggcgctgcattgcaagcgagaggtctccagggagcggcctacgatgacagaggtggtggcacagcttaaggagagcttggagctcgagagccatggcgataggaagcacttggtgactggtgatgatgacgtgagcgtgagcaatcttggagaggagactgcacttgaggtagaagagcaatctggggagatatcaagagtttctcctgggcctgcagtaagatgacagcttccatcttacatgcgaaatggaggttcgatcttacatatataaattttctactgtttatcttcaaaaaaaacttaggtttgtgtcgatttcgtagttgtagttgtgaaacttgaaatgaaactttcatttgctccagttcattttctttttcttttctttgtttctactttctatgaccatccatttcgcttgatgtggtgatggtgtccggattttgaagtttttggtgtaagatatattaattagaggctgtccttgtgtaaattgcttgatgcagtacgcaatccaattaaacatcaaacctttgagtaagcttctaattcattcatcccgtgcacgcaactgtcaacaacatttaaacaaacgcaggactgatgcatctgcttaaaattgtcaactcagcaattttatcctatatataacaactcacctatcaactaattctaagcatgcaaacttgtctataatacctggatgtaccaacacacgcagtcaacacccttccatcgcttcctctctctctctgtttttttttaataaaagtcatgctcttgcttaactggaagcaaaatataggttttgtgatcttacaaaaccaaaaagaaaatgctgggtataccagctcacaaattacaacactatcacaaaccaactcccctgtgaggctgtgacaacctacatcaactcagtatcttcaatgacaaaggaaattctgaaacatacttatcatttgtcggggtcttcatccactcattggcctgcaccatatgactctgcaatctcgtgttcaaatctcctacagctctgatctgacatggtgtacaactgtacaagcatacaagtccatgcgcaa

SEQ ID NO: 84957 - DNA, 5772 bp, Oryza sativa
tcttgatgttattaagtattcaactttctttccttttcaacagccttgttttgaaatgctgagggaatgttcagcaaatgctcatgacatataccattgttgtaggatggtaacagcaaagaagctgaagggcaaggatgaggctgtactgttgagctcttggcaactcaagtaaaaggtgagttatctatgttctggactatgcacttccgctgacttcaaaatgtataaaacctgctcgaatttggttggatcattgacctgttgttctccatgttatgcacctgtaaaattttctcttcctttcaagcttaacttaaaatggttctccttacattgaattaatcgatttaccacttgtgatttgtacgctgttagagacttagatcaacaaaagcagggctaaatgttatttgtccttatttgcaataactttgatattttggtttgggttaattgatgtcagaattagacagagtgatcaactaaaggcatttttcattcagcaatactcgaaatattaactgtcaacttcatgccaccaaataaattcagttcatttatccaaactatttgttgctgaacaggtctgtcatagcctcacacatatatggtttactttattccttgcagaaaaaggtgtttttttttattttacagagaacatccttcaagccttgaaattagttgttgttgtgctaatcttgaaatgtttagtatatttggtgaattatgatgctctattgctctgcaaaacatggtttctgaatgcactattttggttggacaggttaaatgtgttgtaggagtatttttgtttttactatttcgtgaaatcaaaatataaattgatcattccagtgaagcaccctattgtgctattctcaatcttagcttaatatattttccaagcaacaatgattgtaatgcaggctcaatatgttactctggtaaccggtattagctgaaccaaaagcatcaacgcagtttacgctaggattacaaagatttaagaggattattatagcctcatataataaagatatcccattagccttattaattgtgtaccaacatcaatttatgtttatcaattcctataatgtctcgctattatcctgaaattggtgtgctgtggtgtttaacataattctgcagttgacatagctctatccacctcattatagatgattgataaacatttttttctcaagaactttatagtaatatgacctaaataaggtaattctaacataatcctccctaatcctttgactccttgcccttgttgacctcaaatgttcatcttttatccctacttgttcatggatcacaattcaatccctctagagtcgtgtccaagctagctctacctgtgcattaggatttttacatgctcatgagtttcattctgctttcctggaaagaatgtagtttatgtgatcagccaggtgtgattttggatttcatttgcattatgtcgaaatcgccctgatgtgatgcatgaaaagtgtattgcgtactgtttgtcctcctctttatactgtgccgaaaaatcgcctgaaaaagtgctctattccgttatctgagtcttggttgatttcgcttgttggcatgtgcatttgatgatgtcagaggagatcaaatttgttgctgctataattttgtgattgctatgcatctcaaaattgattaacttggcctgcatttcgttgtcttcgtatcaggggtagaaggctcgggtgattcaggtgctgctgttcattgtcggaataaacactgtgccaactggtcttcgggccttgtcttctggctctgatgcaaggatcgtacgccgttgttacactgagagtttccattatactggctggccatccccgcaatgaagcatgtccttatgaggttgtgtgcagcctagatttacctgtgtattaagattgttgcatcctcatggcttcatgagtaactgtgcatcccattgctaaatcctgttgctagatggttgcatatttgattatatgtttttatatttattgatattctgatgtttaggaagttttttaccataggagtaggtttatgtattaaacagatgtgattttcgatttgatttgcatcacgagcaaaatggtcttgatgtgttgcattaaaaagtgtatttcctacatttttccctactctttatctgcactcggtgattactccccaaaaataacctgaaaagtactatttcgctatattagctttggttcattccgtttgttggcatgtacatttgaatatgtcaagaggacatttagtgtgttactactatcattttgtgatgcctttgcatgtcagaattgatgaacatggcttatattttgttgtcttgatatcagggggaaaagggtcgggtgatccaggcgctgttgctgctcttcattagcgggattaacacgctgtgccaattgttctttggatcttgtctcctggctctgatggaatggttgtaccctgttgtagatctgttattacaaataatctgggattcataaagttctttgttaggcaaggttgcatgcttggattggagtagttcctggagagttttggtgcctcgcctgaagtgtttcctgagatttgctttgcttggaaatgaatgtaatctttttttattggcggtttttgttggtttgtaacttactaaatacatgtattgctcatctggtaattcagactcaagtgagttaacctatgctgatgatgttatctgctgctatgtacgtatactactttctttgtggcatctacttatgaactcttcctaattacaatctgctatccaaaataacaataccgtattacaccacagctctcttcaggcggcgcgccagtggcgcgccccatcctctagttttaattaaccggcgcacctcttatggacggttgcccccgcgcgcgcaacgagtaggagaagttagcagccacgtgtaaaacaacgagatagcccaaaaataattaaaaaaatgagaaaaacgatggggttaggggagttattgattgatgatatattaaagcgggtcaatatgccacaaatttgctcatgttatcagcagatcaaacaaggaaaggcttaatgacatactagctgatggggttattgtttagtcgattcctattccgtgttgttgctagaagcttagaacgtaaataagaaaaaaaaattgtctgacataacgtagtggtagattttcggagtgctaaatagctggatcgctcaagcagtttttagataccatgtttacaacaaaatttggtggtagagtgctctgttaaaccgtacacggcaagtaacacaattctgatggatgaaagggataatagtaattgatggatattttacaaaatgtatatggccacttccaagaggtttttgcatactgaagtgttgctgttccagacgaacaaaggttcaagtcatggccattacttctcaagcaagggcctacacagtgcagtttcagctggtggtggtcatctcaccttcctgtagtgaaaaaactctctaaactggagcaattgatcatagacgttcctctctctctctctctctctctctctctctctctctctctctctctctttctctaaaattaattgatcaagattgcctgcaagataattgagtaaaggattagattaggcatcaagataaattattgaactcgttgcattaatcatacacgttttgagagattatttaattaggtgtataactgataaatcctaatcactccaaaaggtgcatcacatggactcagaagaattgcatctatttttagagagaatatagtgctcttaatctcaatatttcatttttatcatttgaattttgttcttgcaactggggtttggaggcagtagaatggtaaaaatgagaatgccatttaaacaaccataataaacagaaaaaaaaagtttcaatctagtttctatcctgcttattttccaattaaaattatgcttcattagaactcttcaaacaaaagccttgctaattctagcctaaacgcaaattagttttttttaaaaaaaaacttgaccacagtaacaccttaaagaataatacatgaatgaattacaacagttagggaagtttgagttatcatccatacacaaaacctaggtgaaatttctagtaccattgaaactaaccgcccattataatttgttctcaaaatcttcagcctaacagatcaaacctagggttgataaaaaaaagccagattgaatctaatcaggtcaaacgccactaatatcatataaatccttcacacggtactttcctagtcgaatcccctcattcaaatcatcacatacatagagatcaaatcccaagcccagaagagtgtggacagggatcaatgatcgaaagcaaaagatattagggcaagcagtaggaacttacctggggttttacagcaacgttattgggcgaagaccggcttatggcgatcttggtggaaatcacatgatggcgacttcggtggtcaacacgttcgcccgttggtttcactgcagtggctggttcatgtatggaggagaggaggagaagagataaggttagtgagaaagaaggaaaagatacatgataatttcaaacagccacaaagatgtttacaacaataagccattctcctccattatctatgacaacagctccaggttactaattaataatataagaaatattatggatcagcctagtctttcaagttaacaatagatagaaatgtatgtgtttatgtggcatctaaattgtcagcggtgaaaagtaaacagttacaggataaggtaaagatgattgcctctcttagaactgggaataggaagttcctactgagtttaaaactgatagattgtagaaatcagataagccttttgtcttatgttctagagatcatttagttctccagttctcccaatgccttcgttcagaaggaaaaaaatgcatgtaactctaggtaataataaaaacaaaataaaggtacatgatgattatacataccagattccttgttcttctgtagatgtccagagctttgataaccacaagttttttcatgtgaaagaactgcaacagttcaaaaatagaacttgattaggatcaaatccaatggatctatctacaattgaacagaagaagaaaccggtaaatgatagaattaccatttccacaagggaccggccactggcagcttcggcggcgggagtgtaggccgctgcttgatgagcgcaaaaacgatggagtcctcctggagcaaagcatcgcgctccaccgccaagctcagctcctgattcatcaccaactatctctctttgagtgtgggctttgctgcatctacaagggataaaaggagtgactgtgtgacggcagatggcatgtggcattggagattcaatttaataaacaagaccatgaaacaacagaaccatgaaattcagcacaattcaaacaagcattggtaaaggtaacaacatcaagtggcaactaaaatcatgcagctagagcctgaagttaacctatgcagcgtctgatatcaacagcaacacgaggtcactgccagaaacagtctcccaaatatctcccaaggttccactctcttcagaaaaaccagcagcacgtgcttcatcaaatgacttggagcctttccggagaccaatctgaaaggaaagggcataatagaatgctggactaacagaacaatgcaaaattgcataagtgaggag

SEQ ID NO: 84958 - DNA, 2502 bp, Oryza sativa
taaaatgctatcactgaagatctgaaaattttaccaggtgactcagtcagagagagcggaaaccatcgatattgttcggtacttattaagttacgcatacggttctccggtcagctatttgaaagataaggaactgactgattcagctgtgagaaatatcttggctgagtttgtaagttttagtggatttcctcaaacctccagttacgccgaatcaacagctaggcaaaatacattgggctctaggcctccaggacaaaatattgaaatgaagcgaggtgactggatctgtacaaggtatgctagttctctacttctgtctttttattttcttgtttgaacagttgcatggtattgatcaccttactttaaggagtcaacctactgaatgttgtcagttgtcacaaagtatattgtcttaacaatcacaaccaagcaggttttattttgcatcctaccaagctttgaacttttgataacttaatttatgttcaaccaaacatgaccaataattctcataatttagttcaaagagccaatcattccacaatgttgacttgtttgaatgcatttgaggatatttgcagtttttgattttttttattactaatgaattgtttgccccctcttcgtctttcataatattacattgaaaatgtgatttgcaaccttgtctttcatactattccattgaaaatgtgctttgcaacctgcagatgtagctttatgaatttcgctagaaatgcgagatgccttgagtgcaatgagcatcgaccaaagaagatgttgactggtggagagtgggaatgccctcagtaagagatctggcatgcttgttctaaacttatgtgatttgagattcatttttatttcaaattagcttacttaacttctttcctcttgccaaggtgtgtgtattataattatgggaggaacatgtcatgcttacgatgtagttgtaaaagaccaggaacaataccaccaaatcctgctggtgctggtttagatggagtggcacagtttcttaatacatccattgttggtaaatctgaaattgagagaaaactcgctgaaaatgaccagaaggcagaaaggtggttgaacaaagtatcccaacttgatgattctgctgatttaagtagtctagcagccgacgaggattttcctgagatcatgccgattaggaagggggtcaataaatttgtggttagcacacgcaagacaccattggagagaagactggcaaatgcacagtacagcagtaacaatagcccccaagatggatcatctgactccaagataagtaaaacattagacaggattcttgggcgttctacatctacttcggtgcagaacaatcaatctggtgatggagatgtaaatactagttcaaataaaacaacaagcaatcttggtggcattgatcctgttcctttcgtgccattatctgcagatcagtttgctaagccacaaaatagttttggtgatggacaatcagacacccaaataagtacagaggctgattccatggcaaaaagccaaatggattcaatggagaggagagatgacaagcgatcatttgataccactgagaatggtccaagaaagttgcagagctcagtaatgtaaaggactttccaagtgcaatttctgatcaagactttcctgagattatgccaatgaggaaaggtgagaatcggtttgttattagtaagaagaaagaccgctcactgacatcgccacagtacaaaaggcgcagtgtgctcgagcatgctgataattccaatttcatcccatttgtcccattccctcctgattactttgccaagaaaaataagcctgtggagaattcatcagatgcaggaatagtgccagaaggccctccatcagctgaaaaattaccagaaacaaaatattcatctggaaatctgggaaattttcagaacagctcacaggtgatgggcagtcaggcagcaaacaacatgaacaatgagaacaggaacggaaattatccacatcaaaacttgagtacaagtggttatgggtatggtgaaagcatcacttatcagcatcaaccacaatctcaagggatggtcggtcgttctggtggtgcttctgaaactggcactcggaatgcaaacaacaaccagggaagctttagcgaaagcagagatagatctacttacaacaggggaagccattccgcacagccaccttataagtcaggttatggtaacaataacaatgcttggagcagtaacaacaatggcagcaataatgcttggagcagcaccagagattatgacaatggtggtcggagcgacaacaatccctattacaacagcagtacttggagcagcaacagcacctatagcaacaacgctgcctggagcagcaatagcagctacaacagtaacagcgcatggagcagcaatagcagttacaacagtaacagcgcatggagcaacaatagcaacaacagttggagtggctcatactctg

SEQ ID NO: 84959 - DNA, 2138 bp, Oryza sativa
taacctctcccccactctccctctcctcatttcttcttctcggcgaacggcggcgggacaacgacgaggagtggtagcaacagggctctcctttctccccaccctggcccctttggctccgggaactggcggaggcgacatctggcagcgagggcacagcggcgggggcgtcgcatggcagcggtgggagcggcgggtgaatggcagtcccggccccttccgccccggcgctagcgacggcggtgtccggcggcgagggcgcggcggcgagggcccgatggcgagggcgttggctcccaggcccaccttctccgtcgtcaacatctctgccccaccacgcgccttccgctcggccctgccgtgcgtcgtccgcatgcgtcggtgtcggacttttttcgcccatgccgcctccaggaggatggcccctcgccctctcaccggagaccgagggggacgacgtcgccaaccggggcctaccctccacctgcgcgccggtcatcccccacgagcccgcctcgacgaccaccccaccgtccgcctctccaccgccgccccgccccttcccggccgcggccacagagggccctatgccgatctggtgggccgctaccgcccaccacaccatcggaccccctcgcctcctccaccgccagggggacgggacccctcacttcttccacccaacgccctccgtcggcactgccgccgcctgggggatctgtttccgccgcccctagggggatgaccgcctcttcaccattgtcgacgatgctctggactccgccaccttccccggccaccgctaccacagtcgtattctgtgccatcgcctcctcttccgcgccggccacccacctgcccatgtcgccgccgctccagagtccaacccagttcctcacagacggcaacatggggaaagagagagggagataagggcgagaaagagggaattggaagaagggttggaaagaggatgacatgtgggcccaacatgtcagcgggtcctactatgttttcttgtgtgaatgacaaataggtcccacatgcttatatttaattctaagatcatataagcgccatgtcactgtcacatgggatgaagacaaagtcaacaccgccacatcagcgccatgtcagcaaaaccgctattgaaaaccactaaaggagtcaaattacaccagtttcaattatatggccaaaaggcccgaggcccgacggcctaagcacggcacggcccatcaagggtcgggcccgtgccggcccggcccgaccaccgggccgtgcctgggcctctccgccggcacgttgggccggcacggcacgatgggccgcatgccaggcccgacacataaacaatagggagtaaaaatagacatattatatgccacggtcgaaagaatagggacgtaaatagacttattttacctatatatatgtcagcccaaagaggagggacgaaaaatagacttttttcactatatatatgtcacagcccaaagaggagggacggaaaatagacttattttcgctacattatgtcacagccaaaagaggagggacgaaaactagacttatttaaaaaaggcacgatgggccacccgcgccttcgagccggcccggcacggcccgacagctggtgggccgtgcctgggtgggaggcgcagcccatgggctggcacggcccggcccgatggctggtgggccgtgcctggtccgggccgtgccgggcgggtcttttggccatctataatttcaatagttcggggagtcatcctatccggttttctggttaaggggtataaattagattcggtgtactttttaagggggtcaaagtggacttcttcccgacctaaaatgattgttggccctgctacccgagatggctggcccgtttgcttgtctgggctgaaaaggccccctttgctcaagtcccgatcgccatcagttgatgctgtaattgctttagtggtgtgattacatttgtcgacaaattttctcctaaaaatttgacagatgtaattatagtacaatcgtagtgtaattacactgtaacttatatgtaattacactgtaacttacatgtaactacagtgtaacttgtatataagtttcgtaacttgtatataagtttcacg

SEQ ID NO: 84960 - DNA, 691 bp, Oryza sativa
cctctccctgtactgattaccaagacgcatcgcatcttatattttagctactgcttattagtaatttagcgctacgaaggaacagcaggtaaactagtaataaccatgtgatccttctcttatctatttcttgatccggcgcaccttcttggcgccccagacctccatgcgacccttggggcacccgcagggcgagcggaagatgagcacggtgcggccgttgggcggcgccatcttgcggagctcggcctcgagctcgcggtgcgcgtccccgagctccacggggtgcgcccccgcggccgcgagcagagccgatcgcgccgcgggagccgggtggccgcgcacgcactcctccgtctcgagctggatgtcgaactcgacggccttcttcaggcccctgcaccgcggcttgccgcacttgcgggcgtggtgccccaccagctcccacgcgagcaccgccgccgcgacggccaccgcggccccggcgaaggcggcggccgagaggcacgacgcggccgggtggagcagcgcgcccatctcgaggagcgccatcttcgcgtagggcaccacgaggaagcccagcgcggcgaccacggcgaggagcacgaccgcgtcgaccgcggccatcggcgagtggtcgcagagcgccgtgagcgacgacccgccccgcctggatcgggaggaggagggc

SEQ ID NO: 84961 - DNA, 540 bp, Oryza sativa
ctgcaaaacttgagtacatgggaccttgcaggagcgtcaaagacaggtatgttttgtcatttgtgtattcttttctgccagtgccacctctcattcatgtcttttcaggattggattaagcatgattaatgatgctgaagagaaaggattaatttttccaaacaaggttagattatcctgatagtatttgcaatactaccatcatgaagattctaacttgtgcatatacttctacctatgcagaccattttggttgaaccaactactggaaatactggtataggcctagcttctgtggctgctgctaggggatacaagctaatagcaactgtaccttcatcaatagatgttgagagatgtgttcttctacgtgcatttggagctgagattgtgttaactgatcctaacaagggactaaaaggagctcttgataaagcagaggaaattgtttcgaagacaccaaatgcatacatgtttcagcagtttaacaattccgctaatagtgaggttgaaacttaagacatatcatttgctcatttt

SEQ ID NO: 84962 - DNA, 1469 bp, Oryza sativa
aaggatcctgatccattggatatgtctgaggaagctaaggccgagagatggtttaggagggcagcacagataaaggacatctccgagctcgccaacatccctgacgaggacttcccggagataatgccgatgaggaagggcgtgaacaggttcgtcgtcagcaagaggaagacaccactggagaggagattaacatcacctcagtacagaagaaacctgcctatcgtaagttctgaaccgaacgaagacgctaactaaaaaaaaaaggtgtggttacgaaatttccagtgcaacagcgaggagttaaaacaccaagggcattctttacagcagttttgtgataataagccagcacaagacggttctctgtattgtaaaatttttgttctgaaccttccatttattttgtacttccagggaatccatgttgtatatgaaaccttcgatactgaaactctgcatgacactgttgaactattacttttctgcggcttcaaatgtccaatctttcaatgaaattgttctttgggctctaacgttgcatattcctgtggaagatgtttttttatttccgaaaattattcgccatttttttcagttttcttaatcacgtcatttattcaatttgacttagcccggcatcgatgaagtttgtcaaaagaaaaacgaaaggagaaaaaagaaaaaaactccagagccgacccagtaagccgtgggcctttgtatcgagagaagcagtactaggtttcctctggaacggcccattattccagaaggcccatctgcgaggtcatcaaaaccctacccgagcggccacacccatttccctactcccaccccccgccgccgccgccaccaccgcagctgcgccgcttcaaggtaaatctcccattcttctccccctcgctcgcccttcctctgcgtcctcgtagattcgtccgtgcggaagcagttcgtgcggtgattttgcctgttcttccgttggatttgcgagttctggttggtttctgatccaaggctaagcaaccagttctttagttttgccgttctatattgggatgtgttcgtccgtatcccgtgcttgagtagttagtacatgttttgttgttcctgtgatctgcatgtgtgtccatggttcaagcgctaggaattcttctccgaagcgtaaatgatttgcttgctgtacgcgatctctcttgcacaggcacttggtcaccatgctagctgaagtcgtgtggtggcctaatcttattgctgtgcaagatggacatgggtgcacagtttgcagcagtgacttctttgtgtctctgctgttagtagttacccaacaatcaatcagtctttggcttgaagggtaaatgcctgactggtgatctggttcatgctggacacagccttttcttgttgcttttatacttttagtgttaactgaatcagagcacaagtactgaggcacgggctgcaggaat

SEQ ID NO: 84963 - DNA, 1906 bp, Oryza sativa
  unsure (1)..(1906): unsure at all n locations
tctatcacatcattccaatttcaatcaaactttcaattttgatgtggaactaaacacacccttgtactaccaaattaatatattataggataaagaaagtagattattcggtgaccggtgaccagttagtaagggccattcttcgtagttagtaagggtcattcttctcaatgatttggaactcatctctcgcacacgtaaaacaaaatgactcattaatacatgattaattaatattaattattttttaaaaaaaataattaatattttttaaataatatttttatagaataattttataaaaaccacaccgtttaataggtataatatttttatagaataattttataaaaaccacaccgtttaatatgttaggaagggtgcacggaaaagaaaaaggagtggagtagagaatattaagtaaagaacacggcctcagccctgctcatgatttagaatgggtcgtcagcctttcgacacgtactatgtactaggtagggtgacaaatcaaaaggactatgttatcaagatatcatttgatcaggcgttagtcctatctttgctatttgtgtcctcgagtgtacgatgctgtggctcagttcaatgaactagccgcaacccaaatttgccattacttttcacgtgaaaatgcatgtctccaatagttgccgcgcagttaatgtgacttgtgtgcggtcactgtgtaaatcatagatctgtcagatcagaaaagagcttgtggtcacttcagtgattaattggagggcaaatgcgaacaatgcaacatccatgatgaaattaaacagccttatcttcttttataagataaaatttaaattttcaatcttaaattgatagttaattttaggttttatttttatcgtaatttatttttcagtttttattttagatcgctaagaaattttttagttacaaatatgttgtttaatttattccctaaataagctaaacgatgaacttaactaattagagtatctagagaaagctcagcaaaccacacaatcgtagtaatcatataacttcgacaaagaaaaacacaagagttcggttttcttatggtcgctggagactggtgaggtaggtgtacttgtgaaaaacggcgttccacaggaggtccattgagattggcgaatgatcagataacaacaccgggaattatagccacacagacacagcctcagtncgacaaatcagcagcaattcacatgcgccgtactgtactattgtccagccttggcccttggattcaccttcttgttttgcagcacgttgagctagcatggcatgaaaattttcaccgttggcaccgacgaaccgcggcggcaggcggcagccagccaagctatgtggtcgcagagtcgcagtgcggccggcccaacacagctgcgggcctgcacggccgcacaggtaaactcgcggtctgcgtgcgaacacgcgcgacgccgtgcataccgcgcatactaccgtcatgcgttttaaatgacatgtccacctatagcatgcgcgtggctcgccgtaatcgcagtactatccagtatttgcagcattggtacagcaaggttaataatacagtcgacctattagctataaacttatttctagctttctctcagcctaaccatataataaatagctctttacaattaatatagggcccacttatttctatcacagaattcttggttcttgtgtctaagccggctgtaagtttacaacccgcttcttctctctctcatctctttttcagtatttagccggcttgtagcctactattatacttgctctaactactgctacttgcgtcgctgttctctttatgtcgataaatgctcgaggtaagatgagtttttttaataatgaaagttttattcagacccaaaaaatt

SEQ ID NO: 84964 - DNA, 2004 bp, Oryza sativa
ctgcagcccttatcaaagttaggtaaggtagaattggtaaaacgcatttcaaataacaagggaatcgcaaggatacttgagcaagaccgagattatttcagggcatacacatcacacacctttggaaacatcagagagcacaaatggggccaccccagacccctcaatcgcatatagttataaatgatttaagattccacaggtgataatttcagttagtttaaaatccttctatggctgtacaatacaggaaaactcaacactcaacgaaaatgtgtcaaaacactaatctggcccttaagcggcaagctacaggcaaagcatctggctagcttatctaaaactgaaccgaaaaactctgcaagaatgggttgtcaaactgggctcacaaagtgtcagccctgcatcatgttgcacgtctgacatgcctatctacaaacagcatgactatgctgcaaatttacagtgaattacaattgattggtatatttcggagtacaattactgtatttaaagtggttccatagacccactctttagtctctccattcgtgcttgcaggccagataacgctctctcgtccatgggtggaataatattttgtgtttgtgggtcagcatccaatcgtgttcccccatggagtgtattaccattcatgctcggcaatggacgagcctgaactccatcaaaattggcaccaacagcagcagcttgaatgcttttcatccgttccctaagggcatccaacgtccctgctggcatagaaagaacaattcatacaatcagattataaagcttagaagtgcagcttaacagcaagtatgacagaaggcagacctgaagattggtatctgtcggtctgtaggttagtagtttgtaacctattatcaatctccccttgacctctgaaggggtgtgtgtcaccaccagcatcatcttcattacaatcagttttgttatttatcgattttgtgtgaaccggtgaaggtgcaaattttggagagggtataggtgcaattggcggaggtgtggataatggaaggctggagggagttcttccagcagcagcattcttctccacctgcatgagccaaaaacgataatagccaatcagttaaaaacaccaaaactagcttaaacacctccaggattgaaatagcaaacctgagctagcccatctctgatataggttctaaatgcttcacttgcattctgaagctgagcaaatatatcaacctgaaaatagttcttgtttcaggaattaaaatagaaaaggtagcttatgcgacatacattataataactggctgaaataaacaaactcataaccaataacaaacaaaaaaaaatcaaaactcttaacacaagaacacaaaaagaatcaacaactagggttcatagaacttttggattcacttgatccaccaggaccaggtgaaagatgaacaaattgtacaggacctggcaattactttatataacatcatgttgcactttcacgatgaataatataccttggggtacagttgggttatccggtagagttcataaagaccaattgtacatgtttgtttgtcaccaattttcttgaatacagcagcaagctcttgctacccataatcaaaagaaagacaaaatagaacatcaattgctgtacaaatttgcaagcagtaatttacaaatgttatgttagttaagaatcagtaatactaccttcaactgtgcgtcagttgaatgagttgatgggtttggattattggaccctgcatcaccccagtgagtttggcccatagttccagatggagtcagcattctagctgccgcaagggtctagaacacaatagtatcaattaaaaaaaggatgtccatgacagtttgttgtggaacaacaaaaggatgtattttttttacctgaagattaagatcaatgtatgccaaaatgattggctgaggttcagcatctataggaaccattgaaaggtgacctttgattgctgtaccacg

SEQ ID NO: 84965 - DNA, 2017 bp, Oryza sativa
gaatacagactataacaagattaacaagcaaaataactaaaaggcttacatgcaaaattacaagaccattctgtctgtgtgcattaataatctcagcaatccatacagataaaaaaaaatccagtctagcatcatctttctaacaggttccaaatttcataaattgtccattcagcaatgagccaacaatatcatggtaaactagataccaggaataaaaaggataaaactatctgtcataagttgggaagtaacagaaaaaatgtatatgcttgttctcaatcaaaatcaaactgttgtagaacaaatcaggaaagcttgcagagcaaagaaccttgaatcattgataaaacataccagttgctgttgaagtggtccacgaaatgatggcccagccatgtcaccaggagagacattgaaaccaggggttatatccccaggggttagtctttcaggttcactgctaggcaaatcctgtaaaatgattcaatatgacaaatctagcctttatataatctcagagttattaaatcaaacatgctcacctgtggacctctggcttcagcatgtggaacactaggcacattgaagtgattaggtgctacttgagagatagtgttaaatgtgaatgagtcgttgggtgtgttcccagtagatgcaccaaaggcattccaaggctggaaaatagtcaaggagaaatagtccatagtaaacatttgcaagcagagcaaatctctaacaggtcatattccaactggtgaaatacctgtgaggtttctttggagacaggggtcttcacctcttcagcatttaaactccactgatccatcataagcgggtaactttgtggaatcaaagcatttggtggcgaagttggcaacattgactgattagttcctttagcaagactctcacttggagggaatgcagctattgcggtggctacctgagcttgcacgtttgaaatggaagtcggagatacgtgttgaggtgtatcgaggaagaaagcccatccttcgtcagcaaccaatggggctgcctgttgactttgctgaacactagtcgtaggtggcagttgttggtcaaagccagcaaataaatctattgactgaggggtagaggaaattgatggttcggctggttgactttgctgaacactagttgtaggtggcagttgttggtcaaagccagcaaataaatctattgacggaggggtagaggaaattgaaggttcctgcaaaggcgacagactcaagagatcatgatggacaggatgagatgtagagggtgcttcggcttgaacaggtggtgaagatgccacggctttctgaaccacaacgtcatgcagagtttctttaggaacagaatggctgcctacatcaactgctctatggggaactgatggagcctgttggttaaagccagcaaaaagatctattggtgctgcagaattgaccggatgttgcattgactgatcaaagaagtcctgatttgtggaagtcgttggctgtgttgaaaccggcggctttgctacagagaccatgtgaacccttccatgttgcacagattccctggtgggagcagtttggctgactgaagagtttatattgctctgtgaggcatacaattgtgctgaatgagccatggggggcgcaacagactgacgatttacagcagaattcactggcttttctgtaggtgcatcaggtaaggcacctgaatcaactgacttattagatgctgagctaccatcaaatgatccaaaacttcctgaagaacctgttctctgcacatagaaagatggtatatttatttcaaaccactctacctcagaagttggttttaagtcaatgagcattagctggaaacatataacatgaatggggagaacattaacctgtgatcgtcggactccattaaaatcaatttgagaagttgcattcggatgccgatgggatggaggattttcagaagacacattccttgaatggtggatagaaggactgctgtaccctgt

SEQ ID NO: 84966 - DNA, 1109 bp, Oryza sativa
aaattaaaaaaggaaaatttactaatatataaatatacaaccaaatcataaactgaattacctctaattacagatgcagtgcatagagtttggtctgtatatatattagtgactttatgttatattatatgacaactatagtatgcagaattttacttattttttaattttgtttctttcatgccaattagtgttgcatcttacttttgtatcagaccagaatagtaacacatgttaattgtatcaagtcaactcctagacatacagttgaatgaattaattgaatagcacaatcaatacatttctgtattatagccttactataattgaaaaccaactaaaattggtgcataccatgctggtgttctcctctttttatttgatgttgcagtctcactagcataagcatctgagttataggagtatttgtatgttggagcaaaaaaaatcttcccctcattccaccccttaaatactctcccagcatcacgttcgattttgagctggagtgttatacaggacataagtgagggggaaaaaagtattttgcagaggaaaaatagctttcaataatataatggaagtatcaaaagatttgcatatttcagatttcacttgttttaaatttcaaaaccagtaagcacagaggagtaccataatggtgtctaaggaaaaaatgcttcctataatattgttttgaaatagtaattgtttctcaggtacatgatattgctattccagaaaaaatggatcattttcctgcaacaagaaatggaagttacctgatccctttcaaagagaacatcccaattattttccatcaaaaaatttttggtatctgcatagctcagtgcgatacgatagttcagatctccgaaccatatcaccttactgaaacaaacagcgtatagcttagaaatatacgcttgacaagatacatatatttactaattacaagcacactaaaagcacattcttactcatgctcaagaattttctctgggatttttcgcacacctctcctgcaaatccttgaaaacagtgtaagcctcagtatctcaagaacatcagagttcctccggaattcatcaccttctttctgacctgaa

SEQ ID NO: 84967 - DNA, 636 bp, Oryza sativa
cttggcagttttttatacagtccaggtcgtttgagagatcagatgcatgaagatcgatttgctaatgagagtactgggtcaaggttttctgatttttcggcctcaagcactggtgacattagaaatgatgtgctttctcctagctctcaggatacagggtacagcagtccttctatccaccattcaaggaatgtgtcttctgaaaatcctccatcccatcggcatccgaatgcaacttctcaaattgattttaatggagtccgacgatcacaggttaatgttctccccattcatgttatatgtttccagctaatgctcattgacttaaaaccaacttctgaggtagagtggtttgaaataaatataccatctttctatgtgcagagaacaggttcttcaggaagttttggatcatttgatggtagctcagcatctaataagtcagttgattcaggtgccttacctgatgcacctacagaaaagccagtgaattctgctgtaaatcgtcagtctgttgcgccccccatggctcattcagcacaattgtatgcctcacagagcaatataaactcttcagtcagccaaactgctcccaccagggaatgtgtgcaacatggaagggttcacatggtctct

SEQ ID NO: 84968 - DNA, 2518 bp, Oryza sativa
catattaattgaccagaagaaaaggagctggggggaaatgttcatgaaactcgtattcaagattaggtgaactgaaacattcaaacatgcatgctaatgctagctccagaagttgtttgatgttttcctgaagaacaaaaagggactcgcggcacgatgtcttaagaagcaggcacaattacacgcgcgtcgttggatagagtcagtcgacgagatgactagaaaccgagtactccaatatgtaaacaaacgtgtcttaacttatagacttttgctgttgctgacttcaacgatcgatgtcactttgctggttggcctacttagtaaaataaaacgactgtcgttttgatggtcataactaattaggcgagatactaataccattcccaatccaaaacattaggtatagttttcataaactctacatcatcaagaaactagtactagacaccactcttccaatacaaacaccactattctatacttaaatttaatgctacttatctcacatgagttttggatgttgtgtagaaaccatgtctcatgcaagacatgatttccttctctttcctcatttattcacttgtcacgtcactttttattctatgtggcagcttatttaatactatagacatcatcatagtcattgggttgtgaatggcgtaaagaaccaaaaacaatgtaacaagtcgcagttctttttttttaaaattaacaagtcgcagttctagttacacttaacacagattatttaattaccccacttaattgttcagagaaaatcttggcaacaaagccttgtgcagaagccagagtaattatagcagaaccgatctttctgggagcaactgatactttccaggaaatcttttaaaagaagatagtactgctagtaggctgtgtttgcaaccccacattttcaatccctctctcttgttttctacgtacacgctttttaaactactaaacggtacattttttctaacaagtgtctatacgaaagttatttaaaaaattaaattaatctattttaaaaaaaatagctaatacttacttaatcacgcgctaataaatcgttccgttttccgtgcgaaagggttcggttccatccttatatccgaacacagccgaagataaaagtaagatagggtgattagcatcttccagggtcaccgttttgtctcctctcgttgaccagcaaccgagattagcacacgccactagctttgagcggcgttcggctgagttctaaagtgccactcgcaaagcctattttcttatttcttacaataaattactatacatacgactcaactattcaatacacacaacttaaatttaattaacaaatataaatagttgtaatgcatatgaacatatttttctttgattatttatgtttgcatgtctctgattgtatataagttgtaccactaaaaaaattatttcatgttaagttatattatataaattatttttaaaagatatcaaataaatctatttttaaatatctttgctcatatcgcgtttcgccgaaaatcaaggacgattgaggccctgtttagttctcacgaaaaacttttcgccttgtcaaatcgaatgtttggacacatgcataaattattaaatatagaaaaaaactcatatgtataacttaacatgatataaatcttttaagtctaattacgccatgatttgataatatggtgctacagtaaatattttctaatggattaattaggcttaataaattcatctcgtagtttacatgtgaaatctctaatttattttgttattagactatgtttaatatttcaaatgtgtatccgtatatccgatgtgactcgtcaaaatttttcacccatgaaactaaacagggcctaacttgtactccctccgtcccaaaataagtgcaattttagcaatattcatgtttaacatttgaccgttcgtcttatttaaaaaaagattatgattagtatttttattgttattagatgataaaacataaatagtactttatgtgtgactaatttttttaatattttttataaaattttcaaataagacggatggtcaaagtgctaaatatggatatctatggctacacttattttgggacggaggtagtatgttccaaactcgaaggctatcaagaggcgagaaagccaaggcggaaacatgtgggaaaacggctggagaaaaggcgactcggctgtgtgtttgcaatcccatgttcctaacccctttccctcattttccgcgcgcacgcttttcaaactactaaacggtgtattttttttgcaaaaagtttctatacgaaagttgcttaaaaatcatattgatccgtttttgaaaaaaaaaattagcaaatacttaattaatcatgcgctaatggaccgttacgtttttcgtgcggggagtttggttcccaacttcccatatccgaacattggtttattcaatggtggacaggtggagagagtataaagttagagcatgccctgcagatcatcta

SEQ ID NO: 84969 - DNA, 2761 bp, Oryza sativa
aatcaatcaatcatgataagacacgcagccatgcactactaagtgtatcacacataaattgaaaaaagtgtatcacgcataaattgcaaaaagtgtaccacgcataaattgcagaaagtgtaccacgctaaattgcagaaagtaagtgtaccacgcataaattgcagaaagtgtgtcacgcataaattgaaaaaaaaaggaatttctcactaaatgaatcaatccaaacaaagtaggtgcgattatcagttactagcatttagcattagtttcttttaacagtcaaaacaagacataatgtaactggcataaatagcggacttctgcagaaaggcaccaacctcagagttaggtcatgacactgctcttagcgtaagcacaaatttcttcctccccttgagaaaaaaggataaaacttgagccaggaggtatctgaacaaaaaatgtgttgcacataataatataagataattgccttgtacacagacactagagagtaaatccgagcttctagaggtacttacaagaaatgtttcacctaacgttttgggatgaagggatagctggcttcttctctatttgatcataatggagaacaaagttgtcctgcagaaaaacatacacaattataattcacaaattttcacaaaagtattatgtgatacaactttacattgaccaaacatccaaaccttgcggattgtctcccagttgtttggatcaaagcaaccataagatcctcgttcataatgaggtgttttgaccagaggctcaacatttggaattctggtgagccacacacgcacttctttatggtagaaccatcctcgagtatacctgcggaaaagatggacatataccatggttcaattcaacagttaaaacaaaagtaaaaaaaaaaggtttaatctccatttggtatttggttgtgctgtgctgcacctcaaagtgggtaacacatatttgccgtatgtattaagatattaataaattctaaggaagtaaatgcatatccaatatcaagcctcatgaaacacaaggaaatataataatcaattacatgaataacatgaaagatagctaattgatagattgaaagattcaaagccttaaacatccagaataattcaggatcatggaacatgttctggtgttgtgcaactagtagtcacccatctggattacgaacaagtcctaagcgtaccctttcaaataaataaaatacacaatattacttgtaaaaaattgctgttgatcctaaaccaattggcagtccactagtcccatactaatccaagctggtctaaaccagcctactccatccggtttcaaatttcttgacgttttagatatgatctcacataccaaggagtgtttaattagggtgcctattccctgttatacccatattaaatactgccatatgcttgaattaatcaatatttggatgtatcctagtggttcgaaacaacaaccagatgcaaagcatgcaggttcgaatcctagcgtcgcttcgtttttctcctttttctttccacgcgtggattttctctacaattttgcacgtgcagcacacgctggctggtgtgtttttctcgcttgtgcgggggacacgggagactactcaactttaaatggaatgcatgcataagaggcaaacaattccaaaataacctaataaatcccaaacgtcaacaattaccatactttggatacaaggctagaacgtcaacatttttataccggagggagtatgtcctacacaagcccaacaaaatgcaaaacccacgaatacagatcaatttaagtccatggtctatccaagatgttatattagataatgttggtggacggagggcgaagatgtggccaatctagttgtcaccattaacttggtttgcacccatcattaacagaaggattaatgatgcgtaaccagtggaaactatgctacaaataaacatggataagcacgactatgcaaatcaaaaccaacccctagcaacaagatgtaaatgagaagaccggtgaaaccatgtactcacagctcactagcagcacatagctgagcttcatcccttggcatgctgcaaaccaaagaaaaatgataaatctttcataaaaaaacaaactatactcacattatttgttgcaacaaatggactagcctaatagaattgaagtgggacacacttaatggtagatgtacctatagaagatgtaaaacagtgttggcgtctggaatttctgaaaatgtataggctgcaagaggcagaacacaattacaaatatataagtcataacatgaagcaaatacattgagacaataaattctgcctatgtttaagaacaactagtttaggaaattatgatggtcaacatccaataaaagatggcaaatgcacagccagccattacatattaaaaaatagcacacagtgacaggcagcttacttgtagtggtggaggttgctcagcggagtagcaagctggagtatgaaactcaggttctccttttgctggctcgtttgaccatggagagccaaatgtcttgtacagattgtctggtgagttcaagtttaaacccaatgttgtcaaatctattcctaaagcaagagatgataagtcaacatcattcatcctgataactcctagcaatcccatcaagccatatggatcagatggtgtttggcccccctggatggactttagactctgatccctatatgactgggtagctgaagacacctgctgcaatctg

SEQ ID NO: 84970 - DNA, 861 bp, Oryza sativa
aaaattcagaaacagggatgcaccggatattgttgcgcttgcataacaggtacattatcatgaagttgttccttgtgatgcaactccatagcataatctgtagtgttgcctgataattcaaaaggttaatactttgcacaactcagcaaagggcaaagaaaggaatctgttatagtagcgaaatacgcaccaaaagagtaactaaaggaaaagaagtttaaaacatggtaaagaatatccaatgatcatggaataaacacaaggcaagtaacaggtttcgaccatccaaaacacgtgccaagtaataaattcgagacaggaaatagattatggccaaccaaaatacgagacaccgacaaaatataccaagaagccaaccaaacataaaagcggaaggttattttataagatgattcaccagctaagtttagaaacattttcagcacaccaacagacacaataaaacaaagctgtgatgttcagtgcatcacaaagccgaggaattaaaggtgcccatgtactgccaaatcgacagctatggcactaaactcttagcaccaaatatgcatcaagctttttaagtgactttatccgggaacatcccggaattaaatccatgatatccataaaccaaactcaagccacgtactgtaaatattgttatatttagctagcctaaactatctcaattgaccattgcaaatttccggcatgaggaaaatttgcaggtcctaatattctgccaaaaaaaatttaaaatattgttttcagcatcatgaaccttcccaaataagtttcatattttttggattgcctcaaggcttcaatcacagattcgcagctgcctcgggctgcaggaat

SEQ ID NO: 84971 - DNA, 570 bp, Oryza sativa
caaaaagaccacggcacagatcatccttatttccgccagctggagacctgcgccgggggctggcttggaagtcggaggcgcgcttcgttggcgaggggggtgtagaaccagtcgctcttccagtcgtcccacttcttgcgaagggcgcaggggatgtagcggttcaacaccggcccccgcggctggaagtagcagccgccaaccaccgacggcggtgacaccgactgcacggtgaagaaccaccggaacagctgaaaagaggggcgcaccccgatgaacatctcgcacagatgcgcgaagatggccaatgtcatcaccgcattgggggtgaggtgcgccatctggaggtcatagaactccaggacatccatgaaaaaatgagaaaatggcgggactagcccagccattgcgaaggggaggaagaagatggaccgccccgggtagtctggtgccgggcgcccctcgcccagcatcactatctcccgaccggtggcggactccggcatgaaccggcgcggcagtccggcgtgcctctcattaacgatgcgggaaggcggtagtgcactgccg

SEQ ID NO: 84972 - DNA, 549 bp, Oryza sativa
agcttcatagataagaagaatgttgtttgtacaatctgaaaatacttttttttttgtggggacaatctgaaaatacttaaccatgcgtgggaagcagactcactgatccaatgttagttccacctagcagaaatcctgataagcatgaggattgtgcaagtagacacagcttatcagccattaacttattcagttttataccagtcaggcttagttccgaaaacctgcagtgatgatggctatccattatttcactgcacatctattcccaataggtatcaacagtaattgaacaaatgttagcgaaccttttcagagaggcaagtttggagagaaggctaagcattgtatttccagaaattggattgttgtttcctgtcaaaaatatgaaagtttgaaacataagaatgtttatgaaacatatctgatagtttcaattatgcagagcaggagtaataaaagtacctaaggagagatgtgaaaggacagacccttcatgcagtgcatctgccatcttctgaactgttcttgatgtgatagaacattgct

SEQ ID NO: 84973 - DNA, 1031 bp, Oryza sativa
gcgtcttttataacgctgatccaactacttctcatccatcaatccttacaatcagcttatctctatggagataggaaaataatagttatgggaagttgatccttaggatcagcttatctctataggagctagtaaaacaatagttgagtcggacatgagtcatatacacagattgtacgtatagcccatttcagaagtagaactaattgcagtcgttatctatcaagacccattatgcatgtccaaaattgagatgttacaaggaatgagcgaggttacagttgggaaagaagtccaaatcgaaggaagggcggaatgcaatggtggaagtagagaagagaggagctacctcggttgcagcttggcaaggaacctgagatcgggctgctgcttctggaggacaggggtgacgcgcgccagcagcgacggcttcttggccttggccgggaacagaaaggactgcaggggcaccttggacttggaggcgacgcgcgtcaatggcagcggcggcggggttgtggctccggctccggctccggctgcaggtccgtcggcgtcaggcagggtgacgcccccgtgctgcagcttcttctcgatctgggcctggaggcccttgacgtggtcctggccggcctgcagctcgtcggaaacccggttgttctcctgctgcatgttgagcacctcgccctggaacttggccgcctggtacgacgtgaactctcctcctcctcctccttgttccagtgccgccgtgatctcctcctgcacgtcgcacagggccgcgaacctgcactgcagctcccctcgcagcatcgcgttctgctccgaccacacctgcagctccgtcttgagcgccctcagctgctgctcctgcttctgcttctgcttggtgtcactgttgccgtcggtggccgccggctgcagctgctgcatcagctcgtcgtgcttgcgctggaactcctgcacccgctgcagggacgagctgaacttcatccagaactcgaggttctcctccagcagcgtgtcgatgt

SEQ ID NO: 84974 - DNA, 1749 bp, Oryza sativa
aatttacgacgctatattatatacatacagttcgatttgcagtttttattcgtcgagacaccgacggacggatcgatcgatcgatcaaacatcaaaagatataaattagtaaaggtgaatgagtggagcatctgtggagtgtcaattcttgttccccctctatctatgtagatctctgtcaatggctacccctatgatattgcaattactagacgatcgtttacttttacaaggcgtatattgattactagcatgcagcatgggagtatatatatggctgaccatcgctcgcatcaccaaaaagttaaactgcgagcagtgacgaggccgatgataaggatatggagaacgatctctcctccattcttttcctgccccaacatatatattcctcctcataacaacaaaggcaacgcaactttgattccaacagttaaagcatcacacaacaggagcaattgatagatacgtctgcgacaattattgtccatcactaatcacgtactgctaaagctgaaattaacactacacacataaagcagggccagtcacatatacaagagctggaaaacgatcgatccatctcttattattactgcattaaaatttgcatatgcgtggttgctaatactatttttttccaacaagtaagagtagagtgttattcttcttgggggcacagatcaacaacaagtagtatgcagacttcaggtaaggtaattgaggaactctgcagcggttgcgatggctcccccagtgatggcgttcttcaccacgttctgcctgtggctgttgctcgccgcagacaccagtgctcctgttacggcgcctccaaccatcgcgttcttctgctcaattgcatacacacacatcccaaggaaatgcaagttaacatccagatcgatcgtgcacactgcacagacagcagccagtatatattcatgaacagatgagtacattttccaaaactacagatgctttaatcaaactatcacaaaactatatatttaagagtgcgtctgccagatttagtactaaattatcaccaaactacaaatttaacatcaattttattataaaactgtagcttttgtaactttcagaaaaacaacaggctattgatttaaactttaaaatctgtagttctttgataaattcattacaaaatctgtagtttcgtggtacaagtcattaaatttatagttttgtgatgcacaacattaaatttgtagctttgcgatagtttggtccaagtattttgagatttactccgaccaaattaatcaaacaccatatgcgtatattacctagtccctgtgaccacggattctttcgattccatactccatgcccacatatacacccgcaatagtacctgaatatgtgtttcttccattgttagattaacaaaaatacaacacatgcgcttgagtacgttgacagtagtattttgttagttttgagcaaagctgagttaatagaaaatcaagtactccctccgtttcacaatgtaagactttctagcattgctcatatacatatagacgttaatgaatctaaacacatacatatgtctagattcattaacatctaaatgaatatgggcaatgctaaaaagtcttacattgtgaaacggaggaagtaggagattatatatgcagatgagttgattatttaattataccccaatatgcgccttccttgcaaattttcttgagctgcatacatataaattcaggagcgcaagat

SEQ ID NO: 84975 - DNA, 1658 bp, Oryza sativa
gttttcttgaagttggtgctgcagctcttctagttggagatatggaggcgaagattaatgatcaacaatggaaatattcttttatccaggactttcctgatattgatctgttgcaaccttcaacttctacagcaagtacttttgcatcatcacagagtcacttgaaagcaataactgcctcaaaacgcatgaaatcaggccctaatcaagtttggtaggttttttaaagtgatgtatagatgtctctgcatcagtttgcatgaaacatattcacactgctttacattctattttcatttcttttttttttcttgaaaagaagaccccttgacatatcgatgctcttcaagaatttaccctggaaaatttgctgaacgtttctggttgtaattataattctttttgggattattgcttttgacaccagtggtgtatactaattgttttatgtatatgtccttatgagtaaaatcgtcatcactaaaccagttattggacataatgtttatgttttttttgaaatcaacgataaatgacaatttcttatctatgggaccatctacttcttatgtaggatgaacatacctgcaaatactttccagcctcgagcacgtcccctttttcagtataggcactacaggtacttttcttgtttcatttattcactctacataatccagggcagcatttgaaatgcttatataaggccggtttcagtgttgcattacagaaattgaactgtaagtgtttatattacagacatacagattgatgtagacaatgaaaagaagaaacaaccagtgcttaattgacaaacctatggagacacaaattatattttgtcaaatgattctctctctctctctctctctctctcgctgcccctatatcaatttgccatattaattgtagatgatatgatgttcttctataatcaacagtactcgtttgagatatatataactgttcttgaatatgagtttgtctctttatctattttttatggtcatgtttaacaatgcgcttgaatgtcttgcttattgtgttacccacttttaccagtgagcagcaacctttaaaattgaaccctgccgaaatttccgaagtcatagctgaagtttgctcagaaacaacttcaaactcaaatcagttcagtgctccatcaagattgaccacccagagtcgccaaccttcagcagatgtggcattcagtgtccttatcaaacttgttatcgacatgtaaataacattacaccctattcatttcattttgttttgtttcattgtcctccattcacacacctgtaaatgttcgtgatgtatttcatttacactggaatccttgatagtgtggctgcgtagtttcttttagggcttttactgatagctcaattgttggcaccattacttattcttatatcatgtctcaatgaatcatttattacctgaataaaatatttttatagttgaggcagcatttagagtataaaacacatactgtatctcgctcccattgaattagtagttcaagtaattaattgctgttcctttgtgtacatagtaatgttgtgagctacttcaggagatacacagtgtagatatcgatatttctgagtaaatatgaacacatctcagttaaaatagttgagattatcttg

SEQ ID NO: 84976 - DNA, 1274 bp, Oryza sativa
tcctgcaccccatgggaacatgagaactctttatatctttgcttccaaaatcaacagaggtataaacctaatacttttatccaaaagatatgctaaattcttgttaaatatgatatgcgaacaagtctttaaccgagttggttagttgattcaagtagcacttctcaactcctaggttgactcccatcgtttgtccgatgccaaagtacaggtcgatggtcgttatcagatgagctacagtaccgctatataggggtggggctgaggttcggggttttctcaacctgcgtgagaagatctttttctatgcaaaatatagcaacttatttgcctatcttctatgcaaaatatagcaacttattcgcagatatcaaaactattatctgcttcatgctagaaaaaaactcaaaattttttcttctgttgtattgtttagatcacatgttttaagctatttgttaacttccaacatatttagtttatggtcataattaagtagataatttgcaggtttgtggtggcgcagttggctagcgcgtaggtctcatagctaatctgagttatcctgaggtcgagagttcgagcctctctccccccaatttcctttattttttcctttcaagatctttttgttctcttcgaatataaccaagcttcttgggagataccttttttttctatctgaagatttcttttctctggatataagcaagtcaacgtaagccgtagcccgtaggcccgtgtaagagcctctcatctgcgccacatttgcagcgtgagtttctcactgtcaaccaaaccaaccttcctaacaagttccttcaaaagagaaccgaaactgccacccgaaaatggttcagtttactagcagcacacatctcataagattctcaaatcacctgctatacaggcataccaattgtttaggacaagaaagaaacataagacaagtcagattaaatagatactgggacacacaccaggctggaaaaagaagagggaataatcaagacttgtcttggtcatagttgcatgcttttctcaatgttcacatgcactccgcatatgttcctttcttttcccacaaatcttctccttttctttagactacttcagcagtaacatcttaaaaagaaaaggatacacattgtcatttctttctgatgaaaagaatctcccgtttttaaccacatacctaacaagtgcggggcaccagaaaaaggctgaagcctcaagatatcttgttcacatcacagcaacataaaatattgtaa

SEQ ID NO: 84977 - DNA, 617 bp, Oryza sativa
tgcgtcgataggggatagcacgatcctcaactctatatatctgcccccgccgctatctttacgtcgttgggtgtcgcttacatgattctgtcgagaacggtcccgtgggtctatcgcgcggtgagacccaccctcgtgagcttaatcattcatctgcaattttgcccgttctctatctcgctcttgtttgtgttcttcgattggcaaacagggattagccttatcagcgaggtcatacgagtttcgacacgggtgattaccagaggagacgtggtgcttctattgcgaggctgacgagcgtgcgctttcaagaagctggatcgattcttgtttcgactaccgccgaatcgatgtatatcacacccttttgaaagatcggaaaccctactgcacatcacatgccaaggaccagacgaccttagggcatctccaacagtctctacagccaaattttggccattcaagcacaaaagagagatccaacagactgaccaaccggatggccaaactcgctcgctggctagctagatttggccagccaaaacacctcgcggcggcggtctctagatctggcaacccgaggggagctcaacggcgctcagctgctgggagtggtc

SEQ ID NO: 84978 - DNA, 616 bp, Oryza sativa
catcattaacatccgcgattcttgcccttaccctttgagcctatatgtgtattgctgaaaatattgatagctcgtaatggatgctttagactgtatttgattcattccgagctgcattcttaagaggaaaattctgtcaaacaaaagacccatctgatttgttttactttagatccttctgccccctgttaaaacaaaggaggttttgtgtgatgaatgatgatcctcagctcttactgaagaacaatttgtttggtttgcaggtagcgataaaagaggtgccaagacaccacccccggtgaattcagctgcaaaggcgaagagatggctgtgagtctgaagagaaatactaagaaagtttcacttcaagctgagggggtacaagcctttgccaaggctgaaacattcttccaagtcaccggtgaactttagctcctgtttatgctgaaaagtctcatcttcataggaaaccccatttttcagacttcagagtagggcaacatctaggttacattctttgtaacgattgggactttttaggaggttacaaagattgaaccttggaagatgggaaggcgaaacagcggctatgtacttgtcttgcgttctgatatgc

SEQ ID NO: 84979 - DNA, 639 bp, Oryza sativa
tttgccttgcctgctggctagtgaatcacctcacctagctacctgcagctacgcccacgaaggcgcaggggcctcctccgatctattcccgcgcgcgaggtggcgacggctcaacgcgcgggggcggagatggcgtggaggcgacggaggtcacgcggtgggctaaatccggtggctaccgacgatgtggaggacgatggcgacagtgcgaaggacggcggtggtcatagggtatgcgaacggagggaggcagctccggcgcatctctcctccatgccatcgtcgacacttggccagcagcaagtgagccgatgcaagagaggagccgtcaaggagatgggaggaggaatgtatgtggggcccacagttggccagtgacttttggcttgtcaagtttggctagtggagggttctgacttagccatctggttggagaggctgttgaaggatatattttggctggaatggctaaaatttggcttagagagtcatttggagaagctgttggagatgctcttatgctgtgttcggctatttatattgggaactagtcattcacgcacgtaaaacgaagcaaggcattagcgcatggttaattaattattaactttaaacaaatggattgatatgatttttttt

SEQ ID NO: 84980 - DNA, 706 bp, Oryza sativa
ttcctgcagccctgcctaagtagacatgccatgaagatgaaacttatcagagtgtgagacgtgatattcttgcaatggaattacatcatgagtgcttccatctggcatggcctggacttttggtgagaattcaacaatgtattcgcagatggagaggaggcagtccatctccctgttccacatcgccttcttctcaggaggcagtggctgcaacctgtggcaggttccaaacacagttgctgcagccaagaacaagcacagaggtcaacccactgttgcctgcatcaaagaccaacttaacagaagattcatctgcaattctcagaactaccatatagattggtgatggcattggagatggccacagccgtgcagacacccttcccactcccagacatgtcctctccaagaagcagcttggtgtacttctccttcatcagctccatctctgaacaacacccatcaatcaaccaccagaaacaccagaggacactaccagaaatcaaaacaggttggcatatctataccttcatcctccagggacttctcgttcacaacttgctgcagcttcttcatgctgagcttgctcaccgatggcgagaggcgtggtgccgtggacgtcgtgcggctcatgcttctccctcgtggcggcgatggcgtatagtgctcctgctcctcgccaccgccattgtcggagaacgacgac

SEQ ID NO: 84981 - DNA, 611 bp, Oryza sativa
tatattgcagtgaaaacgacgctatataattgacaatctgaaggcaacctcttcatatcttctttcccactagcacacaacacacgaaaatggaagcctattcattggtaatacgtaatctagatttgagattatgtagaacattcttcactacaattttacattttggcagcaaaccaaatatgatcaaatgcaattttaccttaccaaatatttggtcgtgaagaaaaatttggcactaacaatccaaatatgccctaaaaattaataaaatatttgtacggtaacaaaatatttgtacggtaacaatccaaatatgccctaaaaaataataaaattgtattttaccagtcttggagattttaatcttgtatagttttcaatataaaaagatttgataactattgatatttatacaaaaatatagagcacagtacaaaatcgcccttgcggagggcggcaagggggccgcctgcaaaattccatgccccctcgccgcccatttgcaggcggccccccgcacagtagaaaatcgccctcgcggagggcggcaagggggccgcctgcaaaattccatgccccccctcgccgcccatttgcaggcggccccc

SEQ ID NO: 84982 - DNA, 645 bp, Oryza sativa
ttcttaatcgaaacagctgccttagcacataaccctggggacagagcaacaggaacatcactggtttcttcaccaccaccaaaacattttggctctccactattctgctgcaatagtacatgataactcaatccagactcggagccaactgaagccaggtcagctgataatgacaatggcacatcccagtaaaccccgtttttatcaatgaataatccaggccaagatgcttctaatgtaatattttgatgaggaagctggaatcaatgaagaaatcttcagttttaatccaaaaaatttagtaacaactatcattagttaagtaaactgattgttccataaagaaggatgaaattttccatgagtcaagtcaaaccttcataactagatacctaatcaatataggaacataatgtgttctattgagaatcccagtgtaagcaccatgaatacccacaaatagctaatatataccaaatagcataaaaagtatccagataatttgccttgtgtcgaaatattgctttgccccgatcccccttcttcagattgtacagctccagtagcaaagtggtatctggtgtaatcaagagttctgtgccaacacctagagacataacatcatgcaggtgccttttgatatca

SEQ ID NO: 84983 - DNA, 718 bp, Oryza sativa
aattcctgcagccccaattcaggctaggttttgtgttccttgaaaccagacagtaacctttgattggccttctctttttaagaaatgagttttgagtggtgtatgtttcttgctctagacctgtagatcatcatgttaggccatgtttagttcccacgcaaaaactttttatcctgtcacattgaatgtttgtacacatgcatggagtatttttttttaccttgtcacatcgaatatttgtatacatgcatggagtattaaatatagacgaaaaaagaaactaattacacagatttgtgtgtaaattgcaagacgaatcttttgaacctaattgtgtcatgatttgacaatgtggtgctgcagtaaacatttgctaatgacggattaattaggcttaataaatttgtttcacaggttacagacggactctgtaatttattttattattagactacgtttaatacttcaaatgtgtgtccgtatatccgcgacacgctaaaatttttcaccctcagaactagaaaggccttccttatatccttgccttaccttatatccttggaaataaggtgtaactgtagtgaagttgatcaattgaaaattctacggtgatcgtctctggagtttcctatggttatggtacctataaatcacgctaacaaatgtaattaaatattgtttcactgaattgcgacgaaccgatcaatgtgttacttga

SEQ ID NO: 84984 - DNA, 680 bp, Oryza sativa
cattggtggaacaacaacgaaccatatccatttgaaaatatgaaagcaaaacaaaagagtaaatagatcacatgaatttgtgtcagggtaatcttcatacagaatggccttctagttctagctttctaggtataaaagcacaagctgatgaaaaaggaagatgtgattcacctgttgttgaagagaaacaatcacatcaggacaaacatcacagaatgtctctaaatcagggcgtcgagagaagaagaaatcttgtgcaagctgagaagcaccacgtaagaacaatgatcctgaggatatatctaaccgggcgcttacccttgtcaaatccaggagaagcctctgaaaattcccgtgttgagctgtaaaattaacagacgcaaagaggtctgcaaaggcagcaaacttgttcctctcatcaaaatatttaaaggcattggattttagtatttcattttgcatggacattctttttgagcaatccccaaaagaaccactggctactgcacctgaacaaaaagaaagtagaaatagttattttgtgcacagctgataacacgtaaatctaatagagagggttacagaattaaaaatataattaattcatgtacccatgcaactataggtgttcatgattcttcaatggacatagctcccaacacttggcagtaaatcataca

SEQ ID NO: 84985 - DNA, 3270 bp, Oryza sativa
ctaaccacagccaaagtggcgaagcgcaaatctgtaacttacacatacggctctggatcccctggacgtggctacaaatacatattcgcttcgtccaaaaaaaaaacagaaatcttagaggatgaaacatgaagcatattctaatacgataaatatagataaacatatatctatattcgtcatactagaatatgtctcatccccaacatatattcatcatactagaatatgtctcatccctaacgaatatgtctcatccctaactaggttagatgcttttgggacggaggaagtaattacatatactgaacagtgaacatccacaactcagttttatgcactaaaacaagatactaacagtagaacgaggacaggagcagttttatgcgcgaaaacaagatactaacagtagaacgaggacaggagagaagggagagaaaaacgaaatgtttcaacaaattgcgacggttactgaccaacttaagcaactattataatgcaaagaccaaactcctcgttcttacaacactcactcaacgatacatcacaagatataaacaggggcgagcgagcaaggcaggaggcactagagtgacaccaagcgattatacttaattacttatatataaaccatgcattccagacacaccattcatcatcacatacaccaccatggcacaagaccagaacgcaaccccctcctccaggcaggagatcaggatacattcccgacttcacagcaaaattaaatcaggaaggaatacttcgctctaagctcaaccagatctaggagtcccatgttcttccaggctgctgcctaggctgcgaggacgattatcactatgagcaggaccaccccgaatataaccagcaacaagcatatctgcaacataaaatgagaatcgaacaatgtttcacatgttgaagtgagtgccagtgaaatatattaatgagtgctaaaggagtctaaaagtaccagcgaagagttcgacttctgagttttagcagccttagagagttggccttttgcttgtgtagtcgctataacagcattctcgatatgggtgtcaatgtcatctgcagtataggaggagatacacaatcagatataacataccagatatatgagcagcctcgtgcttcaacgtatcaaatagcacataatcccatctatcatccccaacggtaccacataccaatcatttgtccttgatcgtggactagaacagcaagatctttgaagatttcatttacttcagtaatttggtgctgaatttcttgtattccctgatccctctcctcaatgacggcctcattgaacacgatctcattatccaagaagactaattcttgcctacagtaaagaaaaaaattgaggttatcatgttcacacatttgcaaaggagtgaatttgttcattcatttcaaaacaagtgaatactttatagaaatgttcgaaaacaaatagtccaaagcataaccaaatagtactatcaattcaccttcttgattctagaagcgccgtgcgtgctcagccaacttatcagcaccattgttcacctcgctcgagttatagctgcaaagaacaagccatcctagattactcatatgttgacaacatactggaaaaactttgacaatatattatcatagaccagcctcaaaaatatgttgttattattattacagaaaattaacatataatgaatgtgaggtacaaaattttgcaatgatctaaagtaccattgaatggagataattttaagaaaataatgttttgctgttttacttggaagacccaagaagacaggctacacttgaaagtggttttattattctgagttctatgaataagacaaacttcatcgcaagtttagtcagaaaatgaatttatgatattgaaagctagggcctgggggctgagaaagtggaccatgaacaaaacgctagatatttaagggtaaaacaggcagagaaacttatacgctacagtagatcaaaacagcaatacgaactatttggataggatcaaatatgaatgctcatcctgtaaatgcgcaccagaaggtattgtattaggttggaataaaccagggcattaactattagggtcatcaagcacttggcagattaaaagcactaatccagtgttattattattccatttacctcagaaaacataatccagtgttaagtccagtcaaactgaaaatatttttttcatgaaatttttttaaaacttgacgtagaataatttatttgttcaagagagagtatgcaacaaaattattctgcagagtaagtaaaatgtaacaggatgctgtagcattagtacactaccaagaaaatgataaacaatatgccatgaattatattattgtagtaagtgcacttttgttcaaaaacataagatgccaggaagaaaaataagcaagtatttacagaaagaagtacaccagctgactagcaaactacctttgtggcaagcccgcttgagaaatgaagggtgcataagcagcttctctttctaccgctaaccgttgagctttctgaaattctttcagaactgcttggaaatcctttgctagcttcgcatcagcaatctttttgctggcctgtagttccaaacgaggtcatcaacacacattgtgtaatacatcagcaaaaatggaacatagaaatgttccttaaaatagtaatgatcatagattcataggcaatcaatactacataaagcagctcatataagaaatgcaaatgctacatttgatctctacatgattctaaaatctgcttgtagattatttctccagtggcatggcaacacacttgaaaatatcatgactggagcatattgagtatttaagaaaaccattcggttgatgtgctgaggcaaatcactgttcacagtagtcaggcaaaactaagactgatacagataaaaaatgcccaaattagaagtgatgtttccagtcagaatataaggactgggtaggttcagtttccaaaccaatatgcattattacactcttctgtactttgaaggaaaatgtcaaaattgaaggttttctggttcaaaaagtagcatcacatgttgcaattccatttcattttgatgcaaaaggtgaagagtactgaaataattctggtttcaaacatacaagatagaaacagttccaattctgttttgagaaaaaagcaacttggacaaagatgcaagagaatacttacgctgacttcgacacgatgatcagcctcgctagcttgttt

SEQ ID NO: 84986 - DNA, 524 bp, Oryza sativa
agcctgttactttgaaagatgggactgttgtcctgcagtttgaagtgaggcttcagaatggccttgagtgtggaggtgcatatcttaagtacattcgtcctcacgatgctgcatgggatgccaaggagtttgataatgagactccttacacattatgtttggtcctgacaaatgtggatcaactaacaaggtgcatttcatccttaagcacaagaaccccaagactggcaagtatgttgaacaccacctcaagttcccaccttctgtcccatatgataagctctctcatgtctacacggctatcttgaagcctgataatgaggtgagaattttggttgatggggaagagaagaagaaggcaaacttcctttctgctgatgattttgagccatcacttatcccatccaagaccattcctgatcctgatgacaaaaagccagaagactgggatgagagagctaaaatccctgatccagatgctgtgaagcctgatgactgggatgaggatgcccccatggaaattg

SEQ ID NO: 84987 - DNA, 2635 bp, Oryza sativa
attgcatacgtcttagagtgattgtcaaaataaaagagtttagtaaaaatgttaattagttatgtaaaaaaaattgtcttatagagtaactgacatgctacagggatataaatatatttgtattacttagcaagcatagcagtgcagaatatggtcaagagaataaatcagggatcatgaacggttcaaatgtgccatcaatggggctatcctatatttcctgaaagagtcatccactgtttttcctttttgatagtagtcaatgacacaacgacaaaatgttcaatgggataaaagagtaccaataggattaaactgtttttttaccatcatgtttttacagtgagtaacgagaccaaaactccaattggttaattagtacgtaccaattagagaaatcttcaaaaaatgaaccaaaactccccgcgattaccttccacaattccaccttttcttctctacacaagcctgaaacagagtaaacatttgttttcacatggaaaaaattccatcaagcagttggccataatgagaaagagcatccaatcaagctatgtatcatttttgcactgcactaaatatcagagatttgcagcatttttcactgcactaaatatcagtaatgtaaaatattattaaaaaggaagcttaacataaacttgttagtttttctttgaatgaataaacttgttagttcttacgtacatactacatacgaacgaaaataagggaggaccagatgtgcattcagtgatggtggcattcatgaacctgagcagtttaaaaatgaagaaatatacatcgcttcagaagcaccagaaaataagatagaatgaacctgagcagtttaaaagtaaacattgcacatggtacaaaagcagaaatcgattaatttccgggagatataatgagcattgcacaaagcaatggttgaaaggcattataatcatacagtccaatttgtcagatatttttaatacatacacatatttgtctatacgatatataattctaatcatggaagtgtatatttcatcgtcgataattaactcacttttccttaaactaactctagaaaatcccaataattaagaatctaatcagaatctgcttgcaagtattgggtttttcattaaccaatcaaccaatcgcagcagaggaaatttagggggagaggataaaccaaggcaatttccgccttaccttctgcgccttatcacgatgcgaacaaatcgattcgtcaactacagtacaacactaactacctcatcctgatgaaggcatgaagcagagaagagaatctgaatttattcagacattaaacatctgatttttttttcataaattcactaataaactggtaagttgttcctttagagtttagacaatacattgaaagtgcttgcacattactaatgcatggcattctacatattcaggtgtcatgaataaaaatgtaaaccaaatttgactttttaaagggaaaaattatcactgcacaaatcagaactttccatgtggttcaatagagcacaattccaccattgaagtaaaatctcattatgtatataaccttcggtacacatcacagaaaatgtatacaacggaaagtaaaagaagctctcaatattggcatcatgatttagataattaaattcttcttttaacttggatgtcaatttggatgttgatctcttaagagagcacacaacatgtctatcaatttaattggtttcctgggttatgttgttgaccaagcaatgaagttcaaaagaaattatctaaattttcagatataaacatcccaataatgacttaccttgttggcgagcggatcgcagcctgtgcgaggccagtgccggggttgagaaatccgaccaccgggacttggaatctcgaactcgcacgcggccagaggaaggggctggtgccgggatcaaccgcgaaaacagggcggcatcactaaggccagatcggagcaagagggaggagcgctaaaaatcaaatggaagacatcaaacccaaatcgtgcttataacttatttaaactgtataactacgagaatccagtttgtgagtattttttaagctctgttgaacacatgataacatcataatattatattcgcatcatcacaatacatgatctatttaaattgagaaaataatttacagaaccaaaagctggtctgcacctgaattgccagcatcacttgtttcaatcccacataacagaatgaccagcacgcatgtttattgtactataaaaatttacaccctacttatcaaaacccaagacatcataacctactctcattcttcagtaaaattagcaaccagaaattaaatgggcatcccacaaaggaatttaaccttctcacatcacaagaacatgcatataatttcatatacaaaaattgcaaaatattatatccatgtgaattaaattcattcttccaatatagcaagcaaggtgtacacctcagaacaagtaacaatgagtgtaacacatcaacagaggcggcttatcaccatattgggttcaggaatgatctcctccagatggtagattgtctaacattagtcaattgacgggtgacttcagagggaattcatctgaaacaaaaggctgggc

SEQ ID NO: 84988 - DNA, 674 bp, Oryza sativa
tttatttttaaagaaaatgttgtgtaattattagtctaacataacattcagacaacgaaagttacctgagcatacaaacacttgagagtgccccaaatgcatatataatgtctccttttttgcggggaatgtataatgtccttaactatgtgcgtatttatagtgtgctatacagacaaggtgaaaatttgcgtaggactttacattatcatgaccgtcatatgaatacagagtgagcgtgtcacacagattatgctgacaataataaaaaaattgtgcgtgacaagataatgatttaaccatggcttatgtagattgatttgagagaaacgcccatagaaaatattctcctcaattgaattaacctatcctttactagacaggggacttacgtgttgattggatatagagacacctgtggcagatccataagtctctatctgtatggccaaatcaataattcaagtcgcacactcccataatccaccttcttttctttcgtaaaattaattttaactatttgtattatttgtatcacaatagttcggagttgaagagaagtatctaaatgacatatcttattttagaataacccatatttatagcaataaaataccacaacctacctatatgatatcacgatacactcagagccgtatagatgcaaactacaa

SEQ ID NO: 84989 - DNA, 658 bp, Oryza sativa
ttcgtttcataatactacctccgtttttttatagatgatattgttatatcttggacacacgtttgatcattcgtcttattcaaaaaatttacgtacgcgcactcacccctacgtcgtctaccactgaaagcacaacaccgttaaatcctggaaaattcgttcccatagggagtcgaacccaggatctcaggtgctactgaggctcttgtaaccactaggctacaggtcctttcgcagatttatatcttatgtatttgcataaattttttttaaataagacaaatggtcaaatatgtccaaaaatcaacggcatcatctattaaaaatacaaagcgagtatttggcaattttgaaaaggacttgcttgagtttgaccactgatatcattaatttaaatcgtctgactatgataaacgagatttatatgttcacatctaccacgtcgtacttgatatgtattttttagtatttataagattatttacagaataggaacgattgccaagtctactccatccgtcataagatataaggtgtgatcaaaactgacacggtctctaaaattatcatttaaccttttgtcttctcacatagtaactatgctagtagcaacaaaatcatgataataggaaagtgtacatttaaatatcaatctaat

SEQ ID NO: 84990 - DNA, 678 bp, Oryza sativa
attcctgcagcccccgctactcttctctcttattttttatctcattaaaatatgtttgtagctggctaatagtcccaaaattttttgaagtatacggacacacatttaaagtattgaacgtagactaataacaaacaaattacagattccgcctgtaagctgcgagacgaatttattaagcctaattaatccgtcattaggaaatgtttactgtagcatcacattgtcaaatcatggcgtaactaagctcaaaagattcgtcctgcaatttacatgcaaactgtgcaattgattttttttcgtccacatttaatgcttcatgcatgtgtccaaatatttaatgcgacggaatttttggaagtttgaagggaactaagggtgtgtttagttcacgctaaaattgaaaatttgattgaaattggaacgatgtgacgaaaaagttgaaagtttgtgtgtatgaaagttttgatgtgatggaaaagttggaagtatgaaaaaaaagttgagaactaaaccaggcctaagcacggcctatctggtctaagctttcacaccttctaagccttatattcctttcatcttccatctaagaaaaattttcactattgtactagaaaaccgttgctccttgtattgagattgttgctacattgaaactgttgctgattgagctaattg

SEQ ID NO: 84991 - DNA, 867 bp, Oryza sativa
tatacaatgtctcaattaaatcagcacataaaatctggtgattcggaggtggatggctcagaggttgagcgccgtggctttggagggcatccaatgtgtgagttttgcaaaagcccattttatggtgataatgaattatacacccatatgacaagagaacatttttcctgccatatatgtcaaaggtattctgcaagactgcagtcattatcttatttggtgaggcaacagcataatgctgactttgtgattgttaacaggcaacattctggacaatatgactactttaggaactatgatgacttagaggtatgctatatatatatcaagctggcatacttgtatgaaatcaagtactgtcttaaattcaatccggacatggacacagaccctgtgaatttcaaatccaacatcaacattacattagagaaaaacaggatgagatgaaatgttgcatgaaaagtgactggtccataaccatatccaaataagtcatacttgaattatgttaatgtgttccatctaataagttgaattatggccatcttatgctactaagtttaatgctcacttgtatttgatttgaggttacaatttagcattgtgcttgtctgtattcagatgcatttccagagagaccattttctctgtgaggataaagggtgcttggagaagaagtttgttgtctttgaaagtgaagcagagctcaaggcaagtgaatacagttgtgcacatcacttgctggaaatgtcaccattctactttttgagtgtctatgcttagttgatctttcattcaattctcttattccatccagaggcataatggtgtggaacacgggaagcacatgcctggtgctgttgacag

SEQ ID NO: 84992 - DNA, 695 bp, Oryza sativa
aagagtctggtgtgaggatctttgtagcagatataatataccacctttttgatcaatttactgcatacattaagaatctgagggaagaaaagaagaaagaaagcgctgaagaagctgttttcccctgtgttctcaagattatgccaaattgtgtttttaacaagaaggatccaattgttttaggtgttgatgtccttgaaggaatagccaaggtattttctttggtgatttatcactgtcttttttgtgtggttccaatcccaatgcaagtagttgaagtagcaagtagcatatgaaagtttaaatactcaaagactgggatgctatgttactcacgaagtcatcttttcttttatcttttcgaataaatgtctggtgtgcagttccgctaactcatttgcctttgtatctaggtgggcacacctctatgcatacccactaaagaatatattgatattgggaagattgcatctattgaaattaatcataagcaagttgacatggccacaaaagggcagaaggtggctataaaggttggtatttctgataatttgtggctgttgatccttctcttattcaattatattgttaaatatatgtttgctgggatgtgaacagattattgggagcaatcctgatgagcagcataagagttttggtaggcattttgacatggaagatgaactcgttagtcg

SEQ ID NO: 84993 - DNA, 620 bp, Oryza sativa
tcaggatttaattgacaggttctctacatctgtatatatggatggaaaacaaaatggatgttgggtaatatcagattacaatatcaggcaatagagatggatgcagtgccctttcttcatacgaagtatataccaatcaatgatagggctaatgcaagcaagatgaagtatttacctgccaacaacaacagcaaggtcacccctgatggttcctggttcagacttctgtgggtctgtagcaccaatcagttttctcccgtacttgataacaccctctccttcccaaacctgtataattgtggaagcaattcgtgtattgttacccagcagcacagggcatagtataaaatgtactaggtgattccccgcactttgctacgggaattactaagtaattttcaatatatatttttttcgttagaatcaagctaggggtaaaaagagaacaaatgaaatatcagagcttatcaatatttttcatgaaacaaacgaatgaaacacgtgctttaatgtggaacatattgataagttttgttaaatattataaaaatgatagatagatttgtaaaaatattgtgaaaatgatgtgaggggtgatgattggatatgtttgcatgttg

SEQ ID NO: 84994 - DNA, 781 bp, Oryza sativa
ggcatctggagatgaggtgagacagtcggcatatggaagtgctcgtttgcaaattgcaactgcagatagcaaaagctttatgttgttgcacagcactcattgcttctgatttctccatgattgccaagatgtgaggttagggactttggcatgagtactaccataccttctggaaggatctgccgagcagtagctgcttttggtctgatggtacaatccataccacaaccatactttcactctgttgttgtgggctcatcagttttctgtccatcctgtgaatcttccttggcatgcaactctgcacctgaatcgttggatccagttgagccagcagtatggatatcacctgtgtctggtgaagctccagccgaagcattgttgggctcagatgatgggctgacaggttcatccactgctatccctgtacccatatccccgcatgatccttcagctgcatcttctgcctgtatgtctacctggccatctcgaacatccacgtgtcgctcagattcttcagcttctttggacaaatcttcctcttcagtgcacaatagtttctcgtcttccgtgttagaatctgtttgtttacttacatctgctaagtccccggcctcctcaacagggccattttcaagagagacactttccagttgtggctcgatgctagtgtcctcaccaatttgcacctcatcagtttcctccgtgtttagagaagtttcttcagaattgggagatgaagaagggacagaggcagctaaacggtcatttattcctctat

SEQ ID NO: 84995 - DNA, 899 bp, Oryza sativa
atccaccaaatttgtgcacactgttccagattctacatcacacactggactgatgccactgttatctagttcatctacatggatagaggtaaaacctttatccaattgaccatcctcaaccttctgatcataagcatgtgtttcacttgcatgatgtgtagattttgcactagaataagatgacctcaatataatgtttgaagtagaatcagggatctctacaggttcacctgctgcaactacctcaccacatccaccaagctgttgattgccatacgcattgggcaacacttcaatagctttactgctaccatcactttgtgatgcttcattcttcactaagcagttgcttccacgattggtttgaatcccatccaactccattgcaacatgttcatcagaagctgtactcttagttgcattttcacgcttctgtcctgcttgttttaaaccagaaacagaacgtgcaccatgcccatctgcctgtttttcctgcatttcaccttttgcatcttttggttcagaacttttagcaggaaccgtaggtgatttgactgaagtaatctccctacatggttttgacctgttgcgtcgaacatatgcctggctcttcactccaaggcgtgatagaacagaatcctcagcttgttttgcattgttgtgaccatcagtgggcaagggctgcttggattgagcagcattagttctctttgttcctctttttacaatcttctcctctacaacgtcatttttatctccacgaaagagcataagattgtctgctgtgttggtttcacggcatggtgaacttcctggtctgccgttactctcaccagaatctccacgaggcgaagcagcacaagcaaaactacctttagcatcactacaaatgaaggaaa

SEQ ID NO: 84996 - DNA, 1119 bp, Oryza sativa
gatcttctcaaagaaaactatagagtaagtcaacgtttattgtttatgtttctgtgcattttgatctgcattctccgaatctatttgtaccaaactacacgttgacgatcttaaaaaaatcatttttgcaggacgatttgtcaatggatgactggaaacttgttgttaagttgaagagcatcttgaagataccataaaatcgttaagcttgcggaagcccctcaagcctgtccaccaatcggcaaaaatgaaaagttaatggtggcatctgggctactggggtagcatccataaaattttcacgttactcagacttggatttgccgggttgagaagttctattctgacacaccgatgttcaagctgcccagggagtttttcaattttgatacggttttgttttattgtaatttgttcgaaatgcggttgatcaaacattttacaaatataagtgaaactacccgattttgaggggttcttgaaagaggctatgtttgtcttttttttttccctgaacacaaactgttttcacatcccgttgcctggtatgagtggttatgtaaagggcagccggtaagtcaaatggagtatataccaggctgaatatttacactgggtaagcctattaattcagcatttgttcacgaaggcattagatctacatggtgttagcattgggatcggtccgtataaaattcattcctgaataaaaaccttataatcaatattaatgtattaatattaatgtgtcatgagtatcagtattacgatcgatgctcacaatgtttgtaaaatataaatattaaccttatgacaaattactatttttagcctttcgtgtgtattttcataagccatggccttctctaaaattatgagtattaattttgtgaatattctggtcctaagactttcgtaattttcaccctttggcagataaatttctgtccattccttttgggtaaagtcacaacattttttttcagggccaaaatttatgagtatttaactttttatgaaaaaaatgaatattttctctagccatttcctaaaaaaatcacgagtattagcatcggaatcgttgcgcactaaattttcctgggcccgaaatgtcacgag

SEQ ID NO: 84997 - DNA, 1159 bp, Oryza sativa
caaaaggtgtacggtttggtactgccttggtaggacttctatttaaaatataaacggcagtattaactgcttcagcccagaaagatttaggcatacctttgtcttggagcatagaattggccatatcattgatcgtccgatttttccgttctgcaactccattttgttgcgcactatagcctgtcgtcagctgtcttcggatgccagcattttcacaatatttctcaaattcttttgagatatattctcctccttgatcactgcgcaatactttaatttttcgattactttgattttccaccatgaccttgaattttttgaatgtctccagggctgcagatttttcttttagaaaatatacccagatcattcttgtataatcatcaataaatgtgataaagtaccaatttcctccttctgacattgttggcactttaccaactatatcagtgtgcactagttcgaatggtgcacttgctctccaagctccactgtgtgggaaagaagcccggatttgttttccaaatacacaaccttcacatgggtcagacttgagagtaataaatggaaggccttgaaccataccttttgtcctgagtagcttcaatgctctgtaattaagatgacccattcttttgtgccataaatcggaaatatcaacttcacttctgagagccatttgagttgtatgattcatccttaatagaaaatttctattcttctccatatttattttagcgaccagacgattatttttacggtccaatattttgcaagaaaaatcttcaaaataaaccgcgtacccgtgttctagaagctgcccaatacttagcaaattttgctttaaatcgggtaccaacaaaacatcttttataaattttggaccgtctgctgtttgaacagcaaccgtacctttgccttcactttgggctatagagccatttcccatgtggatctttgcatgatacgatgaatccatttctcgaaataaatttggatcagcggccatatggtttgtacaaccactgtcaataacccaaacatcatctttttcttcttgagcagtatggcaagagaaaaccatttcttcagatttttccttttcttgtgaaaaattagcccgattaatttctcgagttctgcaatatgggctgcagga

SEQ ID NO: 84998 - DNA, 715 bp, Oryza sativa
tctatatactatctccgtcccatattacttgtcactttggctttttttcttgtaacgtttgaccattcgttttatttaaaaaattagtgtaaatataaaaaataataagtcaaacttaaaagtacttttgataataaaccaagtcacaaacaaaataaataataattctaattttttttaaataagacgaatgatcaaacattataaaaaaaactcaaagcgacaagtaatatgggacggaggtagtattatataaaaaaagagttttggttttaatttgtaaaaaaaaaatatttttgcctttctaaaattcagtgatttggctaattttgctccctgtgaaaatatatttttcatgctaacaaagaagggctatgtgactctatcaaggtttcaatctgggtatgtaaattgcgagacgaatcttttgaacctaattacgccatgatttgacaatgcggtgctatagtaaatatttgctaatgacagataaattaggcttaataaattcttctcgcggtttactgacggattctattattagtttttttattagtgcccgagcaccccatgtgataccctatataatacccgatgtgacacgccaaaactttacacccctggatctaaacaccccctatatggctaagcatatagaaaagaatcaaatcctaactaccaatctagacaagactatgtcaaaattcaaattcat

SEQ ID NO: 84999 - DNA, 1706 bp, Oryza sativa
cggcctccatctcttccgcgtcgccgcggcggccggacgtggtgaacggcgtggggcccgccggcgtagacggcctcgcgggtccgcccgtgcccgtaccggactcccccgcccccgcctcccgtgatctccactggctgcctcgtaagtgacgacgcggcggcggcggcgccggcggcgtcttccgtttgtcgaagtcgatttcgggggggttgggtttgagggttctgctatcatctcgttctgatttgtgttgtgttgtgtggtcaggccctctcaccagcgccgacctgatgggcgtcagcggggaggggctcaaggttgcctaccaggtgctcgacgaaacgcgcgtgttttatgcagtcccgtttcgtatcagtctccgtgcggccgtggctggttgtgcgtgggtgactgtgtttctgtctgttcatctaaacgttgttctgttctgatgatgaatatctcagggttgccctggagcgtacagcgaggcggcagcgaagaaggcgtacccaaattgccagactgtgccctgtgagcacttcgatactgcattcaaggtattgcagtggaaaacattgcaccttgtgtgctgtttatgtatgctgtagatgcagcattgaagatgatacacgtacaaaaaaatgtctacaaacatattagaaaacggatgtgcacattgtgattatatcttgatttttcataactaaccactaattatatccatcggttgaaatctttgttagttagagtttagtaaagattctttagtatgtataacactactatgcttatttatcacattgttatgcaaaggaacaatcctttgtttgtccttaaaagttttttagacagtgttcagtgctacttggcatgtcaagttctggaaataggcatgtaagggtccttacataatgaccagatattaataagttgttgtgtaacaaaatattattttctaaaaatagtatttggtggacacttggacaggcatgtatcaaagactgagtaatgttatgaacattatgtgttcttgtttcccttttaccttatgtacattgaagtttgtgaattatgtactccataaatgttacttgtgtggagtatttgatttaattagctgattttcccagccaagtttgacattttattttagttctgttttgcaaacaaaccaaagaagtccatatttgaggtgcttgatttcatattctattagcacaaattgatcttgagatctctgtccctatgttagacagaggatttgagagatcacctattcgttctaagcttttaaacttttggatccaccaaatgaagggcttgttttaactttttatgagaatttctatcatatttattatacttttatctatcaactgtaaatcacctgcagtcaaattttattgtacacaagcaaatagacataatgtgcgttgatgccccttattgcttttacaggctgttgaaaactggttagctgacagggcagtattgccacttgagaattcattgggtggtagcatacataggaactttgaccttttacttcgtcatagattgcacattgttggagaggtccgtcttgctgttcgtcattgcctgttagccaatcccggtgtcaagattgaaaacttgaaaagtgcaatgagccatccccaggtcaaactcttgcacaagatggcctaaatattctttatttt

SEQ ID NO: 85000 - DNA, 808 bp, Oryza sativa
ccgccgcgccaactgcaacctcgcgtccctcggcgccgagccgcgcgcccagccgccgacctcctccgcccctcgccgccggcaaccccggggccgcacgcccccgcgcttccctcccctcaccaccaccagcccgcgccaggtacgcacccggtgcagtttttaaccaacgctagttacagctgtttgttaattaacgtgcgtcgtccacggtcgtactgacgagtgagatcacatgcctttggcgagcagccatcgcggtggggtccaggggcgtgtcgccggtgccgtggtactaccacccctccacgacgccgcctccgccgccgccgccggccgcgcactacgccgcccatggcggccaccaccagcaataccacggcgttctccccttctaccccgccgccaccacctacgggtacgtgctctcctccccttctaccgtactacaattctactcgatctcttcgcgcgcacaacgtttcgaacccaaacggctccaaaaaaagaagaaaaaaaaacggacgagaatttattcgatcgacatcggaaagcttcggatctaaatcgcacaccggcggagctccgttcaccggcaggcggcagcccaccctgcctgcttatctccccgagcaattctcagctctgagccgcaatctcggcgccgcgtcgagcacgcgactaacaattcagagcaccacctcggttattcctcctcaatgcatggctccatccatccacgcgacgaatcgatcgaacagcctgtcctagccgagcacccggatcgcgcatctgtggtctgataagc

SEQ ID NO: 85001 - DNA, 3231 bp, Oryza sativa
ctcctctaacagtaacatctagtggatcatggtacacagaaatgaatagcaacagagcttttatacttctaaatccaaaaccttgatccaactaggacatgatgactttcatagacattagagatggttcagggggaattattttgcagaaagtatttacttccaaacaaatatagctgatctgaagtttctaaaaaaaaggaaaataacgttttaacagtgatactttgctattttaaaacttcaaacagcagaatatttgaatgcagcacattactccctctgttacaaatctctggtgtttctggaattgtacgctctccaacatgtgcctttgactgttacttttaatttatattctgagagagtgagagtattattttacagcaaatgtaatggtaaggctttcatctgattaatcttgatagtgttatgtgggttagcatttattgtctgagagttcacggcacacatgccatgttgacatacatttgtaaacagaggggacaattgagaattgaaatggagtaacgtataatcaaatagaatctctatatggattctctctcgaaataaaaaagaatctctatatggaaataaacaggaatgtctccagcagctggagaaaagtccaaggaatttgaatacctcactttgcaatgcagaagatgctgttcctcgatctgctggatcaactgaaagaagaacatccactaacgccacagcaggcggaggaaaatctttaaatgtttctgatacacgcctagcatatggatgctgtggcttaaaaattgtggcatgaggaagtttagacttcctccaatagtcctctgatggtgaaccacagagtttaaatattttatgtaactgctcaacctacaaaaagaaaaaaaacaatatgaacactatttcaagacaaattcaaagcattcactaatagcgtttactccctctgcccactaatataaaacgtgttttgattacagaaattcaaatttgaaagattttgaccaatgattagttactacctctgtcccaaaatataacaatttttagctatgtatctagacatacccctgtccagatacatagctagaagttgttgtattttggacagagggagtaccatacaagcacatttagtgtgtcaaacttatagcattagattcatacttcaaagtaatttcacataatattggttttacagctattgggattatatttaatgagaaattagtggtcaaagtttagtcttaaaaacattctgcaattaaaatgcaccttataaacatgaatggagggagtacttccaagtaaaatagtggtcgacagcatacctcagttctaccaggcatgataggcttgccagcatataactcagcaagaatgcagccagaactccaaagatctacagcaacaccataatttgtggcaccaagcaaaagttctggtggtctataccaaagtgtgaccacacgactagtcaaagggtgacgttgttcaggatcaaagaaacttgctaggccaaaatcagctatcttcaaaatgcctcggttgtcaatcaaaagattggaacccttaatgtcacggtgcagaatgtgacgactatgacaatgctcaaggccacagagtagctgctgcatgtaacatttaacctgcaacaacagaatgatcattgcccgcttgctttactcgtattttaagtaaacagctacttgaggcttttttaggactactataggatgcaatatattcctttagtctttctttacagctaataagatttaataacgagtacagattccagaagaggtaatatcaatatacctgagactcagtaaatttcactccaggaaaagaagctagtccagctaggtcatgttccatgtactcaaaaacaagatataagctacaagacattcttgaagttactagaccctccagcttaataatatttggatgatcaagccgtcgcaaaataaggatttccctggccatgaacttcacactctcaggttccaaattatcaaaccgcactttctttagggcaacaatcttctccttttcaagatcgcgagctctgtaaacattactgtatgttccctgaccaatctgtataaacaaaataacaacaactgaacacaccatggtataaagggcgcaatcagtccaggtgcaaagtaaagtttaacagtgcacaatctagttacaaagaaaaagggacataattgtcaaccaaatagcagttcctaaaattttgaagttcagagaaataaagtatcccgtagcaaacaaaacaggaaaccgcggtattataacagctaaacaccagtgattcagctaaactgaaactggatcaactgttagcagaatatattacattattactattactatttaaattttaaaccaagtttgcaggtgaaaaaaaaaagttgccaccatactctcagatcccatagcaatgtagtactactactagaatagcattgttcaccccaccccattaatagcagggcatgagttgctagtaatgcccactgttcccaggttccaaggtccaccaaaattatcaagaaatccaaaataaagaaaatgccaccgcattttcgcatccaacgtaaaaggtgcctcccactaataacagatttgtactgtttccagtcgtcctagctaccaagaatccacttaatagacaacccaaataaaaacatcgcgatagtacccaccctcatcaatcgtcagtaaatatccctgtaagaggggtaaactccccacattttacagcccaattttaccttttttccttccattagagaaagtatgaaggtggggagcacattgttaatgcatcaatttatattctcaacgagaaacagaaatccaaaagggggaattcgcagcccgcattgctccaaattctcgccgttccaatgttccaaattagagatcaaagatgagagcagaaaatgaacagagccaaaatggagatgtagagagagagagagagaggagaagagagtgtgtgaccttgtcgagcttctcgaacgactcggcgcggcgaggcacccacccgcgcacggcctccgcggcgacggagacgagccacggcggccaccccgccgccacctgctccccctccaccgccctcggcacggggctcctcaccctgcacgccgccatcgccatcgccgccgccgccgccctcctcctctccgccgcctcctccct

SEQ ID NO: 85002 - DNA, 2673 bp, Oryza sativa
ataagccgccttctgaaaggaatcagactctacttttaactttagtctagtacaagttaaacggctgcttaaaaccaagacttggtaaatgttgactttagtcaatcgaagaaaaaccttgcgcaaacagcaactactgaatttagcaatttcgattggtaatatcagaccaaattccattcactctattataatttgaagtatggtgaagcttatacttcttagaagaagactaccaaaaatggtagattttagcacatattttatatatataacattggtaatttcataccaaatttcattcactctattataatttgaagtatggtgaagcttatacctcagaaaaaaaggctaccaaaaatggtaaattttaacagatatttaatatacataatatacatttatgaagtacacataagactacgatttagtctgactcaacatttacattactcgggcacacaatttcagaatcataggactcacaataaccactgaattttgcaaatttgaccgaaaatgaataccctgagtgcaattggaacttgacaagttctgatcatgtttggttccattccacagcctttcctagcaagtactaggcaagatttctcatcaacttggccacatgcaggacgtacattcactgcaaccactgaagttttgcaaatttcactaaaatgaaaccccacgtgcaactcggaacctagttaacaggttttggtcatgtttggtcccattgcacagcatgtcttagcaaggagtaagcaagatttctcaataacttggccacatgtagggcgtacgacccactagcgtggggtacactatacaaaaacaaggaaccaagcatgcccaaaacttcgtagatctaattcacacagcatacctagcaatctgaaatatacaattgagctagcatttcagcaaactgaaaccagaacatggagaattgccagcctcatgataatgacatctgtagaacacccaaattgccgctaaattaacaaatggccttcttccctctccttcaaagttttttttcccaattaaaaggcatttcacagctagactttcctgtacataacgtgatatatatcccccggaaatatgggggaaaggaagccaataaaacttctcttgcaaaatcacgtcgatacgaaattacttgctaagcattggccttactgctgcatagctcgatagctggagcggcttgaagggaagaccggggcagcgccaaagtcactgggtcttaggccaaactgatgatgcccatccccggagtgcccatggcctctccttgctcttgacttctcaacccgggttcggcggaagacttcttgaatttggcggtcattttccttcagcatctgatcgacattgcctgaagggcaaattagaggcccagaatggtggatcttgttaccctttgatccatagccctgttcagacaagaaatagtcaattagaaatctagacaggggaacaaagtaaagttatctgacatcaaagctagtgctataatatttttcggtttttccaaatgtgttaatcgtgaactacaaataatgctaggtaaacctcataataacctgctggaactgaatacataatatatgaggaccttggatttgctgaaagaaacttttcaatttgacaactgagatttgcaaaaaaactgccaactatgaattaaatggcataacaaactgttttcatacttttgctacttaggtctggagatacttacaatagctccatccaccctgctactcctgtcatctttctgctgaaatacttgatcatactttccactactactgaaacgctcatttatagattcagacagcctccgttcatgcggaaaggcttcggcttgagtaaccactgttccattgccattatctgaacgaatatttgatcttgttgatacaaccacacggaagtccgatgcgtttgcaacaccagaaagatgaatatcgccattttcactccgtccagcctttgaaggtttattttgattaactagaggcccagaatggaatgttcttgtgtagacacgttgagagtcttgagacgattcagcaggatgagttggcctgggtggctcaatcggaaagccagatgcagagtcttccttgctgggattgaacatctcactcctgctcttggcattgacttggttttgtcttttctgaaattgtacacaaaaataaatatattcatctaaaaaaatagaacaacttggatagcaagattgtagaggaaaaatacacttggaatgtgtgctggctattaaaggcttcatgtacttgtggaaaaaaaggagacaaagcgcacagcttagacacatatgaagatcacaatatagagccagtgattactatgtatgtgaatgtaacttacaaataagcatatacggatatacctcatcaacctaaatatgaatagtacaatatattcaataacagtcaacaaggtattacctgcaaagatgacactaattctgcatttgcgtcaggtgcaggaactgctctcgactctctagtccgtctttcaggatcatacttgtgttgctttcctccagcaataccttgcctacagaaatgtgcaaatgtcaattttgaaagaaaatgcaggcattgcagattcatgataagattgttt

SEQ ID NO: 85003 - DNA, 676 bp, Oryza sativa
ttcggccactctcaaaaaatagtgcacgccgtcaataaactctttggaccaccggtcagcgtacatccattgccgatccatctacatgagtcgagaaaaaatcgtacaaaaataattattcttacaataatgacagtcatacaataattataagataattacaaactgtttcaacagtcatacaataatgacatatctttattcatacaaaaatcataaaatactacaccaaataattcttatttactatttctaaagttttaaactaattttaatgtgttttacttcttttaattttcattttagtttgttttctagtattcaagattaactctcactgtaattttccttctcaactattttataaaaccttctttagcaaatcaactaaatttctatatattctttcttccccacacaagttttctccctcatcaacttacaactaaattttggagacaaaaaagtgtgcaaaacatagctgcaaatgtaatatgacaaaaaaacattggaggatgaagttgcaaaccttttaggcacctccgatttgtatgtaatcaccaaaataaattcactacaaattttagcatgacctcccctcttttttgaagaaattttgaagcttgctcgggcagctggaggaggaagaagacatatatataggggtaccaaccgg

SEQ ID NO: 85004 - DNA, 935 bp, Oryza sativa
acaaatcacttcttccgttggcgccgaattgcttgcgagcccggagtgtacctacatttgaaaatccaatgtttaaaacattttaaaaacaaaataagggaaatcaaataacatttgagaatggtaagctcattttacctctttttcgctgcccgagtggatcgcaagttgtattgcgtgggttgcgtcccctgaggcgcgtcgggaagctgcgacatgtctatctcctcggcgtctggtgcgacgtagtcctcatcctcctcgtcctcgtcgtcatcgtcgtcactaggtggagccggcgccttcccctttcccctcccttgcggaatgcgtgacgacgacgagccaccaactccttcacgctcttctattctgatggagtgtcgagcggtacttggacgcgcggattgaggtagtggtggtggtagtctccgcggttggtacacgtcgtctaatccaaccgacctgcaacctaatcttgctgcaagtttccggcacctttgacgaactttctgcatttcaaaaaaaaaagaagtttgttaggcataactcaagtaatgcaaagtgctaaataaattttacctctaaaacagtgcggagtgtgttctccgtgtcctcaccacccctcggagcttggagggcatgccccatttcattcacactcctgaggagctctctcgactgaaagcgtgagaagatatatgttagggtctagggtgcaaatggaaataactttgacaaatgcaaaaaaatttacgactctgtctctaagtggggcgtgctccatttgatatccaactctagtccggacatcatagggattccgcccctcatcggagtcgcggtcatcctctatgtcggcttccgtccaagtagggcggaggaacaatctatatgtcctatgcagctaatgaaggtactctgagaaaagatga

SEQ ID NO: 85005 - DNA, 1534 bp, Oryza sativa
gcatcagctgataatgcagtcatcaaggcaccaccgtatttcccagttaggaaggttgcatctatagctagtactggcctacaatgcttaaaagcctcaatggaaggaccaaagcaccagaatacacgcataaaaattttcttggtcactccatcaacgttgacaaccctatcaagatgagtatcgatgtggtagaccatactgggattcctctgcttaatggcttgcagcaaagtgggcaaacggacatacgcttcaccccattcaccgtaaatgagcttcatagcctcctcttgtgccctccaagccttgccatacttcaccctatactggaaaacctcaaatatatacaaagctaacgcagaagcagagagtgtaggttgcagttttatggcattgcataacctatttgctatgaactttgatgtcagctgccggtggctccctgaaccttcggcagtagcacaactatgttccttacctacccgtgatatcctccacgtgccactagacctcttagttgcatggaccttctatttgcaccgtgggttttcacatttaacagtgtacctcctatttgcggcagaattgacaacacggtatggacgatggtgcacgatggcgtactcctggagccatagcttcaatgcgaccatggataggaactctaaaccctttctgagaccatccacctggaatggttctggcaactgatttaagttgatgccgccatctagtagtgcaccatgggcatgtgttaggtctctaaactcaggaatgtctggcttcctcccaaacaccttctcaaacgcatgacattcctctaatgctaacttgtcattattagtaagtggagggaatggacggtcatcatcagagtcttcagcaaattcaacatcatattgctcaacacttgcctcctcatcaacatcatctctattgacttctactgagacagaatcgtgaccaccactcaattcgacatcaaagtaatcatctggattcacatattggcctgctacttctgtcgggtattcagggttgcctccatacgacgaccaatgaacactcgccgacaaatgttcacttagatcaagcctctcttgtactaactcccttttcatctccctcactgcatccacatcatcagtaccgcaatgtctctttgatggtcctgtctcccataaatcatttccaagcaaaggtctcttcttctctccttccccctccaagtcttcttgtaccaactcagtcttacttgcaccccctccacgacgagaataatatgtcacaaaattcttctcaacgtaatgataagaaggagatttgtttagatccaaattttctacagtacgaactaactttgatgcaaacacctctagagatctaaactgagactcttttaccaaatcaaagtaaacttcccattccaactgacctatcacatttaatatatacttatgcccttgaccaacatcgtatctcccataaaaacgaatctccacatatcctcggtccatccaagaacttcttt

SEQ ID NO: 85006 - DNA, 2315 bp, Oryza sativa
ctgcagccctcgcatgacatggtgcggaagatggtactcaactgcccagaaacaaatcaatgggcactggtacatgaattagtcagagtcttgattgcacatcgagttcagggtcaggcttgaagtctcatttgtgtggtatggtaaccactcaatctgcaaaagttgaagagatgtcgttggttagtatctcaattaaagaagtaaatgtctaactagaagtgatattggaagtacttacatgttgaggctgtaagcagtccatctcattgacataatgcttgtatgccacatcccggtgagcatgtgcagtggcagtactctcaaaaaggtaggccactctcttctccatgtctggctcattgtagggccaaggagtgaagctttgcctccacttaggccttccaaccggtaatcttaaccacatccacagctgaatcaatagcacacaaccactcatgttggatgatagtgcctgacgacaacaggcctcacagagttgtccatatgtccatgccaacactgctgagccccaactgaaacggcccagatcaccaaggttgggcgaccaaaggaatccatatcgccgaagcaatgtcacccccagcattaggaaacagaacccctcccaacaagtgcaagatgtatgcacgagcataacactcaacacgccatggctcagcatcgtcgtcaagatgtgagaagttctaactcagccaagacaggggtattccattctgcttcttcttccccccttgcccctgctcaatgttcagtggaatgccaaacagctgctccacttgtgcacgccatccaggagtctctgtcctgcccgtcacggcatgcccccgtaatgggagggccaagatcatagccacatcctgtagagtgatagtcatctcaccactggggaggtggaagctatgtgtctcaggcctccatctgtccacaagtgctgtcaacgcaggagcgttgaacactggcattcctctgctcacgaccaaggccaccccgagcaacccggccgcccttaggtacgggatgtacctatcgtcgaacactggggggcatgagctctaactcggagcggttgaagtacctgcattagcaattgtaaatcaattagttaatataatgtcaaatacacgctaccgatacttatgtacaagtgaatcaatgccgattcataccctccccgcctcgatcgcagccccgcgatgacgggcctcgtagtacgcctccaaggctgggtaagtcggcggttgtccctcctcggccatcctacatgaaaaagtaataaattcaccgttatttacctccctaacacttatattttttttggacttcttcttttttggacgcttaggacacttagttttcttgtgaccctcctggtgacacaacgagcatctattttgcaccggcgcagcatcaagttgaatgcatgaaggtggtttccttccagaaccacccagacccgagtccatttcgttcttgaatcgtttcgatctcctcttccctatttttttaatcttcaaatttgggtcagcaacaaattcttcaccatcgtacgatggccactgtgtggggtcgaggtatggctcaaagcgacttgcccatgtgttcacaacggctcttgaagagaactgatacggcattcggttgggagattcctcatcaattgcatgaattagataaacgtggataagatgtgagcaaggcatatggtagagcaatggcctttggcaagaacatgagttcacctcaccttcaactttgaaagctcttgcgccaaatctaacaccaccacgcgttataccacccctctctgtgacctcgtatgtctttttctgcttatcgaaacaccttgcagtgtgtttgttcaccttacttttttgcaccttcatcttactatcaaccttggtggaccaacgctgccctacctggactcgcttcaaagcttcatcatgtctgttcacaaagtagtcattgcacttcatgaacgtaaatgatactatggccgtcactggaagcttacgaacaccaactagcacgctattgaactgttcggccatgttggttgtcatgtaaccccaccggcggccatttctatcgtatgcacgggaccaattatctttatccaacaactcatcttcaagccatttacgaggaccttcgggaatacgctgccttagtgcctcaacgcatccctctcaaatatccacttctcgtcaatctgacatatccttaggagctcttttgtctgatgcttgtccgcaccggccttgtggaaattagcattgaagtgcctcatg

SEQ ID NO: 85007 - DNA, 1121 bp, Oryza sativa
gaatgattcagtggtaagaaaggctgtgatcctttcttcgatgtggttaaggaaggctcataatgttcatagtcattactgattccagctttgccttcgtcatcttattttaggctaccgctcaaccttcatattttgtcgcagaagagcctgaagatgacaacatccttcgtactaggacatatgacgttagcatcacgtaagctcttttatttgatcttcatgctttttaagtcttttgttagttggttagtattagttgccttattatgtgttattagtttccatattatcttcctcctctttctgagtctgtatatgtttacacagaacttctatagacattaccaggatttatcttcaatcacatgttctttcgaccatccaagttttatattttgcatatctgctcctcggcacttaaatatagcacataacacactatctgtgaacaatgaatcgtagttggcattatatgccttgatttcaaagtatttgcatgtacaacattgtgcaagtgatattgctgttgtcttgaacttctccctgttgcttctgagcaatgatgttgtcctcttggttattttttatttgccatagtattgtgtgcctcagtcttctagtttaagaaagtaacaagtagttctcttatttcagatatgacaaatattaccaaaccccacgtgtctggcttaccggatatgatgaggtaagtcattttgccattagaagtgtcttgttgcagtcctgaagatgaagttgattcatttaattttattgttgttgcagtcaagaatgccactaaagcctgaacttgtgtttgaagatatcagccaagatcatgcacggaagacggtactttcattcattttagtatttgctattgacatgtaaaatgaaacatgaatcaacttgaactggattggttcaccaatatccttaattttgttagtactgcttatattttgaaccgagcctttcaatgtcatagagtacacactacgcattaagccaatgaaaagtatttgaagtattcattttttaaaaaatattttatatcagtaatgtctccagaaattagattttgcaatggtagcataccggaattattggcctccttt

SEQ ID NO: 85008 - DNA, 708 bp, Oryza sativa
agccctccgtgcccctggttggtggtgtcggctgtaaagcctttgtggcgagccttcggaacgtccgttggcccccaaggttccggcccaccatcgccgaaaaatatgacgggagcgtcaaccccgccgagtttctccaggtctacacgaccgggatcgaggccgccgggggtgacgacagggtcatggtgaatttctttcccatggccctgaagggacaggcacggggttggctaatgaacttgccacccgcgtccgttcactcttggaaggatttgtgccaacagttcaccatgaactttcaagtcacatatccgcgccctggtgaagaagcggacttacatgcagtccagcgaagggatgatgagtcacttcgctcatacattcagcggttctgtcaagtccgcaacaccataccatgcatccctgcacacgcggtgatctacgcgttcagggggggtgtgcggcacaaccgcatgctcgaaaagatcgcctccaaagagccccagactaccgtggagctttttcagctcgcggccgagtggctcgcaaggaggaggcctggacttggaacccctccggttccggtgtggcagcttcggccgcccccgggtccgccgctcggtcaggccggcgggacaggaggaggaagaagaggtcggcccattccgacgacgagggtcatgtcctcgccgtcgggctgcagga

SEQ ID NO: 85009 - DNA, 2275 bp, Oryza sativa
tcacttcgagctacttcccaatatattgtacatatgcaaagatgttcacacatgcattatctgtttcttagggcctgtttagttggtgaaatgaaaatttttgagtgtcacatcggacgtttgaccggatgtcggaaggggtttttggacaggaatgaaaaaactaatttcataactcgcctggaaactgcgagacgaatcttttgagcctaattaagccgtcattagcatatgtgggttactgtagcacttatggctaatcatggacattaggctcaaaagattcgtctcgcgatttacatgcaaactgtgcaattagtttttctttttatctatatttaatgcttcatacatgtgtccaaagattcgatgtgatgtttttgcgaaaagtttttggggaactaaacagggccttagtggagttggatttttttggggtgaaagataaacattgtaaaagaagataacattagcatgctatcggaacaattctttggtttggttcataagaaaatggtatttgtagataacaaaaataacgcttgtatcatttggactatcaggttttttagctttagcttgtgtaagagaaaattaagattacatgttaattacgagagtttttccaaagtggagagtgggaggagagttgtacttttgagctctcaatgcacttcctttaacttatgtagaaaaaataaatcacatcgaagtcctcaagatgcttgcctttttgagaaaagatatttgccctttttctgtgttagaagataattaaattgtatgtcagttatctgttttttttacaaagtggatggtgagagtgatgattgtagttttaatccctcaaatgtgcccccttgtacttatctggcaaattagctgagtaaaatctcttgtagattatatttctgaatcaaattattcaatgttctgcagatcgtgaaagaggaaaactgggaaacatgcattgctgattcactgctctatgctaaggtgcattgatacagaatgattctgacctctcatcccatgattcattgatgcgaaatgatcaacttgatttccggtttgatatctaatagcatgcaaaagtagggggaaagtggaatactagaatcattgtagtttattctacaattaacattgcagagtgttgtaaatcttcctttaatttttcttattttgatctgtagggattattgctggcagttactttggttatcgattattggctgactgtctcctacttactgggatttgttggtatgaattttttttttgcgatattattgcgtaatgagtaatacctgtttctgaagtgcaatgaaaatatttgatggatttggtaccctccttgactataaatttacctttcacgtgttgcaggaacttaaaaggatactctattcctatttaagttcctgtagtgtacattctatatttgcccttttattcaagatgtacattcatgttaatgaaatgctgcaatctcctattgtctcttaattatatggtactgtataatgttctttggcatatttagttggagcaatcatgcatcagtctcctggtttgaatgatgaaactattataccctgtcctgcttagccaagttagtctatccattaggatatggaacctgtataccagatttttcatgcttatgcccaaggacaactcatcagagagcgtaggtgtgcgtttaccctgtctgttgaacacccttctcagttttatagaatgaagaaactggttagattgtgtcaaatgttagattaaacctgtggaatttcatcccaaaaaagtgctcacaacatttcctaccttattgccaaggagtgtaagctgcaatacaattttggcccaattctgtgagtaaattatccatctttttcttcatgcatagcccaattttaacatgaaggaccacaaaagcactgcccctggtttatctttgtaagcaggatgagaacaacttgtttagcttgctctctcatactctgataacaaatttgaggtgtagcctatctgtcgcctcctgttcccctatcagtgattgcaattgattccaattgttgtagtgtagcgatgctgatgctagtgattgtgcagtaaatctgtgattcagtaatctggttttacagtcactacagcacaatatcaatgtatgtttttgtcatatgggtcctatgctagtcatagtagcaattggcaaacacattaatactgcccatgatagattatccaatatgggacacagtgatagtggatt

SEQ ID NO: 85010 - DNA, 644 bp, Oryza sativa
catgtcactggttaaccggccgctccctgcactgtatggaatttgcacggcctcggcgaagaccagagcttggtggctctgcagagatggcaatctcccatcaacaagtcgaatttcttgcacagagccatcgaatgggggttctgtcatggagttggaggtaatggaccgcaatgagcagacataccatgagaattcttctgcttctgaggatgaggacgatgatgaggaagaggctgtagagtggagcaaagatgagcttgatgccatctcggcactctttgaccggccgatgcgccagaagccaccaaagccgccaaacccggtgaggcagcgacctctcccgctgccactgcctcacaagacacgactgcccaatgctcctgcaccaaagcagcatatcaggctggcagcaagggctgcactttcttcacgctcttcattcagtgaccaggtgtgcaagaacccggaggtcctcattgggattgcccgggagattgcagcgctgccaccggagtctgacgtgtccattgtgctcgatcggtgggttcggttcctccggaaaggatccttgtcaatgaccattcgggagcttgggcacatggggctcccagagagggcattgcagacactttgctgggctc

SEQ ID NO: 85011 - DNA, 791 bp, Oryza sativa
gatatttcaagcttaggctgcgttcgttactttgtgttcccaacacagctgctgcgcacggaaaacggagcggtccattagcgcatgattaattaagtattagcaatttttttccaaaatagatcaatatgatttttttaagcaactttcatacaaaaactttttgcaaaaaacgcaccatttagcagtttgaaaagcgtgcgcacggaaaacgagaggagtgagttgggaactcccggtaacgaatgcaaccttagttacctcgccagatatctcacacaaaatgaaaaggcaaagcatgaataaaattcttactggtaattgagaaaaggaaaaatatgatgtgaaacaaattaccagccaaaatcgtgttgttggctcctccgttagtaggccttccagttgcaatggagtcaaatgatttgaatgacctagataaaaaaaaagaatgccttcaatccaacttaagaggaaactgctgtgatttttcaatttagaatcgaaaacgaggaaagttaatttaatacttctaatcaatagaacaaaagcaatccagtaatttcattttatttaagaagttaaatgaatgcatgaatagggatacgaatgggttgacctatggggtacccatcgactaacagtagttcattttccttacaatttttccacctaataatgaactagaaagtggagggaaaacacatttctaatagaatagtgtgggtcatggggtaccggtacccataagtaggcaaacttgcatccctaattccctatgcatgagtatattc

SEQ ID NO: 85012 - DNA, 895 bp, Oryza sativa
attcctgcagccctgaaaactttcagctcgagatttaaaaaattttaagttaagatttgaaaatttttaagttaattttaaaaactttctacaaagacatttgaaaaacacgtgttgttggaagattaaaaaagtaataaaatgtgaaaaaaaatcacggaaaaaagaaagcgaaacttttttctaaaaataatcgaaaaaaggaaaggaaaaaatcaccaaaaaaaagaaaagcgaaaaaaataagtaacgctgtcggcgcgcgcgccggcgggcccgcgaattagctctaccgcacaagtataccctataaatgaacgcacacacgggtattcggtattccatataaaaaaaactagtttgtcatattttaagatgacacctcgtcgcctaagactgattcaaacacctatgcctaatctagaacttaaacacgaatggagcacaaagaaaaactaacatcttgtgtcatactctgaatctgatgcattcagattcatcaattataacatcagtaaaacattcctttaaatgattttggaagttctatcttgcatgatgtgggctgccatttctacaaaaattggccgttattgggccccaatccacagcagaggtgtaaaaacaatccaacaaattggacccagtaactatttcgatggaaccattatcacagcaggatacattagacacactgagctaacgttacaaggatgaaacagaaactcaaaattgatgtactacagcagttgcagccttgcaggctaatcaggcaccaagagatttttgcttcttcgctgtgttcatgtatggccgtagcacaaactcgttttgcgcctccgcttggtcgacagttcctcgcttgatctgcaagatcaaatgagcaaagaattaa

SEQ ID NO: 85013 - DNA, 561 bp, Oryza sativa
aataacaataaaattttgtttcccctaagtggcgaaaaaaaccgtagatccgattcctataaaaggcaaaaaaaagtggtgaaaaataaaggccagatccgattcctttaaaaacagaaaaataaagtctgattccaataaaggcgaaaaaatctgaaaaaacatctaaaaaaaattcgtccgattccctaagaaagtggcgaaaaaatggttcgtaaaaaataaaaatgcacgcgagaaaaaaatggaaagggcgaaacaaattccgatttcttatcagtatatatctcttctctatctctaatctaatctaactatttaaaaagagaaaatgcacgagaaaaataaaaacggttcaaaaaagtgcgtgagaaaaaagcacaaaaaaaatgctaaaaaggttttccatcttccataaaaaaccgtgcgagaaatattatttccatcgtcggtaattttttttaaaaaaaacatgcaaggaaaaaaatgtaagaaaaaatgcgccatttctaagaaattatttgaaaaaaccgcgcaagaaaaaaaactgtctattaaaaa

SEQ ID NO: 85014 - DNA, 544 bp, Oryza sativa
ctgttttggttttccatcacatacccaacaacaaagaatgagtaaccatccagatggtaggtctgaacaccagtgtcattgttctgaaagacgatctcgaggaagcccttgtacgatgcgttcagcgtggatgaagccatttttggtggagcattgcctggcattgtggggaagtcagtcttgtacactccagtcaagttgtggagatcagcaagcctcagtggagtctctggtggagagtatgagaccccgtttatcgtccttcgacgctttccattgatgagcaaaggtaactcgttcttgagaacgaaggtctgagtgatgttgatagagtcgtagcggaatgatccctgtggatttggacgtgcagcaccagcagttgtattcattctgaaaaatacaattgcaatggttatcaatggagaacatgtcatcttgagatgtagtcactggaaatgacaaccttgaaactagatgattcttacaatcaagaaaactatcattaatcaacagcatcatagttactaataatgcaaggatattt

SEQ ID NO: 85015 - DNA, 662 bp, Oryza sativa
atctttgtatgttctaatgttctcttcaggatttctaccaggtctctaccatcgatgctatcaatgttgggtgaacaccgttgcaacatgtgacgtaccatcttcctcatgatgtcagaagcgttgaacttctgagacactgtgatccaaatatggcaatcaaactgattcttgattctctcatcttcatagatactattggcaagagtggttttcccagatcctcccataccccagacagtgataaccgatgtcgaacatgtttttaaccagttcatcatcattgttctttcttgttcaacacccaccatctcatcagctgggtaagaaagatgatgcggaagccggtgatcctccacatcggttgaaactctattgccatttggaagctgaatctcatactgcacccacaaattccggagattctgaaggtgacattgcgaatccttcagctctctagcaattttgtgccaagaagttttaccgagtttacggaagtaactcatgaactccccattgaaaaacctgttcttgtgcttaacagacaggtaaagaaactcatcgatgatgtcctcaatttcaaaagctgcttttcttacttcctgcaggtagacttcagtgggctcgctatagccttcttgtttttgcgcttggcgcaggaa

SEQ ID NO: 85016 - DNA, 1374 bp, Oryza sativa
ccctacaaagccagaaatatttgaagacccttctcctatgaaagaccccgatgtgccacgagtgcttaggagccatgactccaagtccaaagatgagaacaaggagaagttcatagtaaccgtcttcagagggggtaaggaacgtgccaagctcaaagatgacaacccccagaaggctgctgaactagccgggccaacatacttcgcaaccgatgattgcccggaaaagtacgaacatgggaaagcactcttgccggaatgggcactgaaagaagcactatgggagatgagaaggttacataacttctacatggaggccagcaagaaaggcttgggcaatataacagcttgatcacctgcagattgtttcggcgaagaaggttacgtatggctagatttctcagatctccacgccatatatcgtcgggataagatggacgtcaattacgtcggtgtttggtgcatgtgagtatgagttttaattaattagatgaaaaaaaatgtacaatacaaatccatgtgattgttactaacaaacttcttctataggatgcaatacatggatgctaagaagaaaaaagaacccatcagcttcttgtatccaactcggatctgccaaacacagcataccgtgatgctagcaccagggtcaaaccagctgaagggcaagaatccaaaagagatagcagaatacaagaagggcttgcacaaggagaaattgattactgtcgcatagtacattagatgagccttcttgcactttcaaaataagagagtcgttatagccgcttataattttaagtaagtccggtacatttatcttgtacacatatgtcttattttagctggtactaaataactataatgttgttaatatgtagcgatcattatatctgtttactcatccaccctaaagacggaaccatggtagtcttggatcctctcgattacagtcacaagcaatacaaagaatttctaacaatcttacagtagtaagttattatgactcttgcatttgtatatgaatgtattacaaataaatatcctccttactctgaaacggtacgacatccatatacatccatatagtgcataccaatactataagttcaagggtggagaacagacccgaacacgggagaagctgctagtacgtacctattggccggtaatactccactcactttatgtattccaattgtttcactaattgcaaattttaactacttttttctatgatatgtcctgaagtgtcacaagcaaccgcgaggaacggtcctttgcaggtattatgcgtgcgaattccttaggggttaatggacggtacaggactaacgcggaggatgtaagtctctatactatgtactagacagc

SEQ ID NO: 85017 - DNA, 676 bp, Oryza sativa
aattttcagacaagaatgcattcagtaacaaaaccttcaggcaaaatacagtcataagctatatacctgcatgtttccaataagatgtgagaagaagacgagtcccatgatgcatatcaggatgcagaaaatggtttctcccctgtatgtgctgttctccaagttctgtccatacgaactaacaaacaattcgcaggaaaaaaaacacatcaatgtacaaaattatgcatcattatctgtatcaacaacaatctgcgatcaggtgagaagaatgcaagaattcagagatacctgaggttcctgaacccccaccagaggcagtagagatacttgtcccagaagttcaccttggcgacatccaggttgagcgcatcggcgaacaagccgtagacgtaggtggcctcagggaggagacactggtggtcgatctcgctgcgcgagtgccagtccatccggatgggatcctccagcgtcttgcagtccaggtagctcatgtagcacttgggtatcgccgggttcgtgccgttctccctagtgcacacgtccatccagcatgtgtactgcctctctatcgacagaagataccacagcgccccaagaacctgcatcacaatatgatgcatactatgaattcattatattcgggttagaatctttaatctctactactccctcc

SEQ ID NO: 85018 - DNA, 649 bp, Oryza sativa
aaagcttccgaagtaagtactcactacttatcatataaaattggctgtgtgtctattggcagaggccggagatgtagccacttccattatctgaaaaaaataactaacctgttcttggtgagattggccctgtttagttcaggggtgaaaagttttgacgtgtcacatcgaatatacggacacacatttaaagtattaaacgtagactaataacaaaacaaattacatattccgcctataaactgcgagacgaatttattatgtctaattaatctgtcattagcaaatgtttattgtagcaccacattgtcaaatcatggagcaattaggcttaaaagattcgtctcgcaatttacacgcaatttgtgtaattggtttttttttatatttaatactccatgcatgtgtccaaacattcaatgttacagggtgaaaagtttttgcgtaggaactaaactggccattatcaatcagttggccttagaggataaaggtgtttttttttaagggattgcatgaagctgctggccatttctatgcctgcaaggcaatcctgcactgcagtccacattattgtcctcatgtactggtgactttttgctgtgaaacagagcaaagcagcaggggcactagacactacccaagcagt

SEQ ID NO: 85019 - DNA, 1299 bp, Oryza sativa
ggaaatgaaatgttgggctatcctgtttctaacaaccaattttattcctagcaatataaactggtaaattttgtttttacatgttttagattggcatcaaatgctcgtcaatggtgccaagtccttttattttctgctgccgtcctatctgaagaagtggagatcttgaggatcagtctttcattcctttgctttgcatacagtacaatcttgagtaaacgccattgcttgttgtgaccaatgtttcgtggctgcccatctcgaccacctcgcctttgtccatcacgacgatcacatctgcacttgtgactgtggatagtctgtgcgcaattgtgatactcgtgatcttgttcgatagctcaccttccttgcttttccactcctttgctgccagggagctcatcaccaccttctcggtttcaccatccagcgcacttgtcgcctcatctaggagtagtatgactggcctcttcagtatagttcttgcaatggctattctctgcttctgccctcctgaaagttggcttcctttgtccccgaccaccgtgtcgtacccatttgacaggccactgatgaactcatggatgtttgcctccattgcagcctcaactatttctgtttccgatgcaccttcatttccatagctgatgttctctcttatggacaaattaaacaagattggctcttgctgaactagtcctatctgttttcttaggaacctcagattgtattctctgacgtccttaccgtcaacaagtacctgccctctgcaaggatcatagaatcttagcagaagagatacgattgtggattttcctgcaccactgggcccaactaatgctaccctttggcctggttcaatagctagactgaatccatccaatatgatcacatcttgtcttgatgggtagctgaaactgacatcttgaaactcaatgttgccagtaattctgtcttcacaatgcacttttggttcatctggcacgatctgcgtttctctgtcgagaatgtcgagtgcaggatccaatattgcgatggccgatataaccatagggatcaaagaccataactctgtgatggaagttattgtcagtgcaattgcttgataggcccgtacacagttttcaaatgttgctaggctcttgtcaagtagcacaatggtgtaactcaatgcgatggcatgtgtcatgtgccacaagcagagggaaaccccttgtaccaccccatactttatgctctctatcctgcttgtctgcattggttcttgcagcgacaaatctgctttctttagtatttcct

SEQ ID NO: 85020 - DNA, 2885 bp, Oryza sativa
atgtgggaagagcactgtgatctttcctgttcaacggttctatgatcctatatcaggtatgcttctatgatatatctctatcaccgagcaaaaaatgggttgaagtgtatattctacagtctgtgtgctttttagagtacagaagagctagagtttactactttacatgacatgctttgcgtattaaattataatttctagagaaaaataaaaatggcatgttgtcactgcctacaggatccatttttttctaaaaatatgtgctgcatagagataaacttttagatcttgcttttgttaattagatgatgttataatgcaggtaatattcttatcgatggtcaaaatattaaggaacttgatctgaagtccctcaggagaagtataggttctgtctctcaagaaccatcactattttccggtacgatcatggataacttgagaattggcaaaatggatggaactgatgaagagataattgaaatagcaaaatcagctaatgtgcactcctttgtatccaaactcccaaaccaatactcaacggaggtaaagactccatgctcgtgaaaaatgagagttgtaaaaaccttacaaattgaatcaaactatgtcaaacgatgcatacatattcaaatagaaggacaaaattcaggctatgtttcaagttttggaccaatatactgcttttagttgttcccttggaaattcatctcgatggcagtaatgtgttatgttctttttagaggaatatgctgaatatgcccaaattaaatagacaagttttttgagtagttatatactgaacctacaaatagtaagcaactaagcatcagtacaaatccaagcatccccgcttatcttcaataaatgaaaaacttagtattaccaatgtattaaactatggcaatcacttcaggtaggagaaagaggtgtgcagttatcaggaggtcagaaacaaagaatagcaattgcaagggctatgctaaaagatccgccaattcttcttcttgatgaagccacaagtgcacttgattcagaatcagagaagttggttcaggaagctcttgatggagctatgaaaggaaggacagttattttgattgcccacagaatgtcaacaatcataaattcagacaagattgttgttgtggagaatggaaaagtagctcaatctggaactcatgaagaattgctggagaaaagtccattctactcgagtgtatgcagtatgcaaaatctagagaaggaatctggcaagagtgaagaaaggtaagcataattgattgcagtcttttcacaatgtagaatgttcatttatggaatccatcatggcattgtacatatgcaattacgaatgaaaagtattagaaccaatacattctagaagatgcataaatataaagcttaagatgtgttctgctctttgactagagaaacaatacctaaatcggttgctagaattaactgaatagaccagagtatattttactccttattatgatttgtgtggcatcctaattaattttggggaataaattttcagatttactgatcaggtcagagaagaacaagacaatggaagtggaacaagcaatgagccgtcttctactgcacatgaacaagagaagagtctagaactgaacccaaaccaaccgaagcaggatatcagaaacagagcatctgctttctacagaatgttccttggaacatttatgctggagccaggaaagattcttctgggctcaacagcagcagcaatctctgggtctcaaagccaatatttgctttctatatcatgaccgttgccatagcatactttgacccggatgcaaagagaatagttgccaagtactcgataattttgttccttattggattgctcacatttttcagtaacatcttccagcactatatatatggccttgtcggtgaaagggcaatgaataacctaagggaggccctcttttcaggtctgaaactcaagcatagcattttacatatcacgcaagtttgcatttagtagagaagtatatgatcggttgttctttatattgtgacaccatttctctttgtgttaaacacagtcattctgcagaacgaaatcggttggtttgaacaacccaagaacagtgtcggtttcctgacatcacgcgttcttggtgacacctccatgattaaaaccatcatatctgatcgaatgtcagtgattgtgcagtgtatctcttcaattttgatagctacaggattaagcataggagtgaactggaggatgggtctggttgcatgggctctgatgccatgtcagttcatcgctggcctcgtacaagtaaggtcagcaaaaggttttgccactgacacctctacatctcaccggaagctcatctcactcacttcagaggctgttagcaacattcgtacagtggcctcttttggtcaggaagaggaaatactaaagaaagcagatttgtcgctgcaagaaccaatgcagacaagcaggatagagagcataaagtatggggtggtacaaggggtttccctctgcttgtggcacatgacacatgccatcgcattgagttacaccattgtgctacttgacaagagcctagcaacatttgaaaactgtgtacgggcctatcaagcaattgcactgacaataacttccatcacagagttatggtctttgatccctatggttatatcggccatcgcaatattggatcctgcactcgacattctcgacagagaaacgcagatcgtgccagatgaaccaaaagtgcattgtgaagacagaattactggcaacattgagtttcaagatgtcagtttcagctacccatcaagacaagatgtgatcatattggatggattcagtctagctattgaac

SEQ ID NO: 85021 - DNA, 2922 bp, Oryza sativa
tgggagacttgcaggtgccaatcggggacgggatgacaatttgtcggaagctagtagatacctgactgaacaacatactctttctagatatggattttgggcgtgtgcctttttggcttctcgcgacattatcttcaaagggtatctatagaaggatgcaggtaatgatgttcgtggccttttgtgattctgttaagtttgggatatggaggttctgtctcggaatgagggggcaacaatactagtggcttcattcaggcggtacttgttactaattctttaagtccggggttaaatccctaagtctgaccttaattggttgtacttggcaatggatttctttctttcttgaaggcattgtctggagttcacagaatttccctaggtgaaaacctatggtctgatcttagttgattggaacatgacaatgatgacgcgtgcacgcgtcatttcctcattggaggcattgttttaaagggagtccgtatgatagtctaagtgttgttttggtggagataagagatgaagattacttgtggttgtagttcgctgtggcacggttgtaatagttgtgtcgctttttttccttttcttttataatattgataggctgtgtgcatcctagctatgcagaggccgagggtggtcttagaaaaattgtatcctctcgatgtaattgtttaagatcaataaaactctctttatctaaaaaaagttaacttcccctggccggaatcaagctctcagagatcaagctgctttcagccaattgggtaaaaaagatgacagctgagatacacacctcttgtgacatcgcacatatccatagatgatagatgcagtaagttgtgtatgcccaaggtagtactaactgccatggaggcatagacggaaccaaaagttatatcagatgcctgttgttgtatcgaggaacaaaagtactggcaaggctgtttttttgtccaaatgcacttggaactgagcctgccaaatgaaagctatagcttcaagccctgtagcaacagaagcagatgtattgggggtattgcatgtccttgtgatcagatgaacaagtcaatgaactgtttatcgattgcttcattgcttgagggcagtttacttttccattgcaattgattgattttttgtttaatagggatcagtacatggatccaattgttaaaaaaaatgtatttgtgtttaggcaactgccccttaataaaaggggcagttccttaatttccaaaaagattatgtgatccagtatttgtctctaatactcattgacgtttaggcgctagatgcacatgtcagagcaggtataataacaaactataagccagctataaagacatttcgagaagatcaaagaggagagataggagtagcgggctacagatttgtagacacaatgtgtgtatgataagtgtagtatagataactattgtataaagaggtgataaaattagtaggcatggcgtactgtctccatggaaaaaaatatttgttgaaaaaaaatattcacattttgtttagaataagtcaagcttgtagactttgactgtgatgttatgttgtttatttgttttgtttcttgcttgtgttttcttcccatcttttattggatcaatttgcaatggactgactttgaattcttcttgaaaacttgatttctttcaagtcttgctcaagtcaagttgagctggacttgcgttcataccacacttgaattcttgattgccatgaatttcaaccctctctaatgacagtcagacatgtcagagtttgatgaattcacaccactgttaatttgacaacaaaatttattaatatagaatcacacaataaaaaagtgtattaatataggagggatcaaaacaatcagttggtgtagctatcttgacttgagtaatacaatggcagtggatatatcccaacaaaatacccaaaaaaatgcaagagaagttatgtttttgttgcttttcaaagttaacaaatgttgtatacttgtatattcttaatttttttccatgatcgaaaagtttataaaaccatagtaccgtgatagtatttctgataattacctcccatataatttaaaatacattacactaaggtacaaattatacatgataatgttgtcatgcatacggcaattgaaccttttatgtgaaatttctgtataataaatattaggagtattatattcctatgttccaaacaaacagtaggcctatagaaatggaactatgtttgaggtaaggtttgcagttttttgtgccatgaatgccgagcaccatgaatgatctttagtaatatatgatccgtttacctcttgagaacctcaactggtttcttgaaccgaggttagggatgtgctatgggtctatgtctatttcaaaacgtatgttaggaagtgcattacggatgtaagaatatgtggcgcgtgtttagggtatccacaacacgaagcaaaagtagtccataggcaatattatattccattcagctacctattacttttgtgcaactagtccatatagagaaaataacaaaaggtatccataagcatatatggactacctatatggaataaataatattatctatctatatttctctctcatctcctaatgctatcttgtatctatatacattgtgaagattgctatagttaaaatctcttttttagtcctatctatatggatcacttcacgaactatagtggtgtgtgcacacgtctgtaatccaaaaaaaaaaggacagcatgactcaagaaatagacgataattagtttagggtgtgttcgatactcaccattttcaacttcggctacctcatttttcatacactttacaaactataaaacggtgcgtattttataaaaataaatatatagaaaagtttctttaaaatttttat

SEQ ID NO: 85022 - DNA, 948 bp, Oryza sativa
ttttcaccaattgcatcttgtatagcactcatatggttggttgctccagccatgacgtttgctgtggttaggtcagtatcaaaagctccgatatcttgactcagcactgatctcaagtatgccatccgcatgcgtgacatttgtctctgactggtatacatccaacatgtaatttctgcggaaggatcattgtcgcaaaaaggtaagatggtttctttgaatctactccctccgtcccataatataagggtttttggagggatgtgacaattcctagtactacgaatctgaacagcacatccctccaatatcccttatattatgggacggagggagtaacattctaacattattttcatttttttttgttccaatcatgtgatgctcttgttgctgcagacaaacagacaagtagtaacatagggaatggtgttgctatgaattgctcacttttaaagtcttaatctttcgttttctctgcacatttctgtgtcatgatgctctgtactcagggtccaattttctttttcacattttccagacagttatcttcaggtgcctagtagataatatattgttaaggtatatgctacaaatgttgacaatattctaaccaggttggggcatactagattcagtaggttggcctaagctcaaccaaaaagccacttcaccaacctttagccacagtgaaattgctcgaccttctgtcttatattctgttctgtatgcacttatagctgtcaaacaggttatatgatctttggattttgataggttcttcaggcttccactatgctcttactttaaagcataatttaataggtaataacttactttcagtatcttacaaggtacagttccaaatatagaaaatttagaagaatgcactcaccaatcattccaccaggaagtgtaataattgccaatgcccacatataaggaatt

SEQ ID NO: 85023 - DNA, 2448 bp, Oryza sativa
aaaataagcaaaaagggttgatttcagaacctctcttcttcagacagctactccaaacaagcaagaagtttatttagcaacagaagaaactaagaattgaaagcttgagtaactcacatcacaaatggtgagtaattttcttcaatcaatctctcatcgatcctatagtccagtgtagtataaaaacgttatttacacaaccataactaacataagcaataataattacacgctagtactctgtgacaatgacctattaacccacatatccatgaacattatattatattagctccccataccattgatattttcttttctttatagaagattgaaccactagccactgggcatgccaagttgccatcctgcagctttagtaaaatgtctgtatatttctcttctcttttttcgcgagtgatttttaattatatcagcgtatactaaggatatttcttttaattacatgaatatacgatatattatattatcaatttttgtggttgggctaattgcaaaacaagaacaatatgtagtatgaagcatttaaaagcaaataatattgatcatcctacaattattgaaatcaaaatataatgtgactacatgcacatgtttgccagctgcttttttccctaaaaatccatgcacatattgagcaacatgataacgtatagcttatctgtcacgtgtggaaaccacaaatttaaaacgattttctgaccacatgctgccattgcctaactttcagccttagcttgcagctgttcaagggcccttctcattataattatttgcctacataaccattagattggacaacaaaatcgctttgtttctacttcaaagatgatattattttacaattttattgttaaagaacaacctagttaaactaaaaccgttcttggcaatgatgcttcacccaactggtcagagatagaagttttgtcacatattggacaaatttgaagaggatggggcaaatccatccggggtaactaattgcgcaaacaacgatcaagaaaacaacgttttgtttccctcaacttttaatttaaaacaacattctagctgaccattaattaacattcaccatatgcaccagcaattttagctagccaaattctaaaaattagcagcatatatggttacatgcacatctctatttccatgtcttcataaatacttgtcaatactccttccataagtatagttttagttttagctagttaatggtataatccctccagcctaaattgaatataagacgcaaactaccattaatacacataaagaattattagcacattctagtttgaatcgctccaataaatgcaatgcatgcacctaatgagattataaatttaaaaaacgaattaaagaggagagggatttgctagttaacaacacatcacgtcttaaattatgaaacatcgaaaaaaaataatggtattaagcaagagattaaaatactactatgcccctcattaataaaacaagttaagggagaagacgaggtggaggagagattaggattaattcaatggctaaaaatgagaagaaaaaagatgaagtaatctctccatttcatattataaatcgtttgacttttttttctagtcaaaatttattaagattgatcaagtttatagaaaaatttagcaacatctaaaatgccaaattagttttattaaatctaacattgaatatatattgataatatgtttgttttgtgttaaaaacactactataatttcctataaacttggtcaaacttaaagaaatttttctaggaaaaacgccagacgacttataatatgaaacagaaagagtactactaaagagatctattggaccactccaaaactaaatttactgaggctaaactctaaactacacttatttgacaaagagagtatttgttaactgttcatcacttcattactagtatttcaggaacatgtactgaaccatacaactgaatcagttaccaagaaattaatcaatacagtactacaaaaccaacatggattcagagacacacattcggtatacattaattacctgaaatgactgtacttaattgctaattgctgttcagttagtggtgatgtatctacctgcaaaaattttctccatcccaattaattccccaaggagagtacatttagtctctctctctctcagagaccctgattggttcctgctgattagttatggatatctacatcatcgacctacgttcttggtactactgtcatcatgcaggaattatattgtcgtctgcaagttgagaggatgaaatttcagtactcaaatgcagcaaattcagtagtacgattttcgattgaatgcgatcagcgtcaccgcggagctaacgaatacagtgaaggccaaggaatcgatcgatcggtggatcaatcgagaggatgatcagagaggagg

SEQ ID NO: 85024 - DNA, 732 bp, Oryza sativa
tcctgcagccctgctgagtcatccacacctgcaaacaaagtaaactcatgtgagcaacctgaagatagcattccaccgttacgacacaatgcagaagtgcactatatgggatcaaccaaggcaatctatgcgcaaatataatcacacatgaattcctgcttcaaaggaaaccatctcagaacagagttcccatcgaatgccaacccacgcaatcacccttttgagtcatccacaccgatgcaccgccacaaacacgaacaattacagctcaggacgaggtttcctccctttgagacatcaataccacgctcaacactacggacgataccaaccaaccataccaccgctccgcccttaaataggccgcccggacaagacgaaaccgcacagacatcctcctatttgttgtacctactcctgcaatctggagtccaatcaccattatccatcctgaaattcacaaaatggtgatgcaggactgtgtcattttacatgactaaccagaaattcataacacatgatcacatggtaaaagaaactgttttggttttccatcacatacccaacaacaaagaatgagtaaccatccagatggtaggtctgaacaccagtgtcattgttctgaaagacgatctctaggaagcccttgtacgatgcgttcagcgtggatgaagccattttctggtggagcattgcctggcattgtggggaaagtaagtcttgtacactcca

SEQ ID NO: 85025 - DNA, 553 bp, Oryza sativa
ttcagagactgaaataattcaggctgcaatggaggcgaacattcacgaattcatcagcagcctaccaaaagggtatgacacggttgttggggagaaaggaagccagctttcaggagggcagaaacagcggatagctattgcaagaactcttcttaagcgtccagtcattcttcttcttgatgaggcaaccagcgcacttgatggtgaatctgagagagtggtgatgagttctttaggggccaaggactggaaggacagaaatgagggatcaagcaagattacaagtatcacagtggcgcatagattgtccacggtcataaattcaaacacgattgtcgtgatggagagaggcaaagtggttgaacttggtaatcaccacacactgatcactgcagatgatggtgtctactcaagactgttccatttgcaaagcaacatgaaagattgatcattgatgacaccatctgatcaagtccccattgggggcaagctacttaatgaaatacaataggtgctttccaagattagtggcattgcttaaatgcatttacta

SEQ ID NO: 85026 - DNA, 607 bp, Oryza sativa
aatctccagagaatttatacgatgtgatgtcccagatgttccttgtgaagcctagttcacagtcttggtcagtagcaggtgaaccagtacgaggaagccaagcccaagcaagaaagtttgccccttcatattttcaactagctcccacctgtaagtatcaaccagtagacagctgctggtaaagcctgtttgaaatttcatctttattactaccagacgatgcaagcagtaaataaaaacaacaaatattagcaatgaaagttcggtaggtcaggtgaatcgcttgcttgccaggtccaacaaactaaaaagaccagaataaagcaaacacattgatcgttacattttcttcaagtgaataaattgatcaatagatggacattaataaatcatgcatctttcaatgattgatcctgcgattaccattctattccaatataggttcacataatgatgtgagggttgcttaccagtttccagctgaaaaggaactctgttccttagtggcttcctctactgcaaattcttctaacagggcacgttgacgttcattaaccattctgcagattaaattgtgttgatcagaaatctaattgaagtgtgatgc

SEQ ID NO: 85027 - DNA, 694 bp, Oryza sativa
ttctcaaaccgaggtaccgtaagttaaataagcctgccaattcttctggcagaactgtgataggaacatcctgcagctccagaacattcagataccttgcacttcttggtgtacccacagatggaaaagaagaacaggttacatcgaaatggtagagcgagcggagtcgagaaggatctgaaaccgacttgatcctgtcattgtgctcatgtatcgacaaacgacggcacctgtattcgggttcaccggggtgcgatttactatgtgtcatgcagaaggtctcgtcctctgatatggaaatggccagctccctcacaatgtcatgcatctggaattccttcacctttctgaagtgcttcctctccacaacctgtagcaggcatcggtctatcagctcattcaggtactcctcggcgacttcttctactgttcttctcttttccggcttaatgaggccctctgcaacccatagtctgaccagccttttctttgttatcatgtaatcctctggaaagatgctgcagaacacaaatgcattctttaggtggctcggtaagttcttataactcagtttcagaatcttcatcactgaactcaactcctggtcgcgcaatctgtcgcgtaattcccaggttagctgatcattgcacttgctccactcttccatatcttgtttcttgaatgagagcatgtt

SEQ ID NO: 85028 - DNA, 764 bp, Oryza sativa
ttacggtacctcggtttgagaagaacaaagatcaagcagttgccacaatcagtcgacaagctgttcaatctccaaacacttgatgtttaccttacaaatgtagacaagttgccaactgggatcgccaagctgaagaggttaaggcaccttcttgcaggaaagttgagtgctccactgtattgcggcattgttgagaagtccagaggtgttcaagctccaaaggtggtgtgggagtctatggagctgcaaactcttaagggtgttcttgcaaacctaaatcttgtggaaaatttgggacacatgactcaactgaggacattggcgatcgaagatgtcggagaagaacactatcccaagctctttgcatccatcagcaaaatgcgctctctacgcacactgaaagttctttcagctgaaggtaatcaaggtctgaactttgaagcactgagcttaccaccacagaatttacgcaaactccatcttaccggaaggtttcaccatgctgtgatggaatccaatttctttcagacagttggagctaaactggagaagctgtatctcacaggaagtaagacgaacattgatccattgatctccatctcctgcctctccaacctgaaagtgctccagatcggagatgcatacgacggagcaagcttcgtcttccagagcggatggttccccaagctccacacactcatcatgtgcaacttgttgcacatcaattcgatgatcatggagcagcagacgttgcagaacctcca

SEQ ID NO: 85029 - DNA, 1238 bp, Oryza sativa
gacaacttgaggattggtaaaatggatgcaaatgacgacgagataaccaaagcagcaagaacagctaatgtccattcatttatatccaaacttccaaatgaatacttaacagaggtgtgtatgctttcagtagaaatgcaaaaaacaagggggaattcatatattcgccggaggcttatccagtatctagaaaaaaaacctctacctacgattttaattaggacaggcaagggcagatgaccttttaaagttaaaaacaaaaccataaatgtgggtattgttctgatgatgaaaaactgatttgtttttttcaaaattgatgactgacgacatgcaaattacataacagaaaaataaataaacaattgctaaagagagaataacaagtattttagtatgcaagtgacaatatcatgtaaattctgtgttcctattggaaaatcattcatgtttccatctttcattatatacatgaccatttcttttttggttcaaacatactttcctagtgcctcacaaaaatctttgttgattcaggtaggagaaaggggagtgcagttgtcgggaggtcagaaacaacgaatagctattgcaagggcaatgctcaaggatccaccaatcctgcttctggatgaagcaacaagtgcccttgattcagagtcagaaaagctagttcaggatgcgcttgagaaggccatgagtgggaggactgtcatattgatagcacacagaatgtctacaattgtaaatgccgacacaattgttgtcgtggagaatggaaaggtagctcaaactggaactcatcaagagttgattgagaaaagcacattctactcaaatgtatgcagcatgcaaaatattgagaaggaagctggaacgagggtcgcaaggtaaagtaaaacgtagcaaaatggaaagcttcatttcaccaatagtttatgcttaccattgataaaaatagcgcatgcatgttgggtaccgaaaggatcctttcctgcagattgtgcaagctgaaagtgaatggtttgaaatcatcagctaagtctcactattaaaaagatctagaattacaaaacttaatgaaaacatataaaatcaatggcacaaagtttagtgaatataataatactatatgccagtaggattacttcgctcaaaaaagaattagtactaatttttacatttcggttgattaaacagctcttctgataatgtcatagaagatgaaattgatgaag

SEQ ID NO: 85030 - DNA, 2212 bp, Oryza sativa
aaggaatcggtcaggagggagaaagaatgtgttcagcatctgctcaatgcgaaaacagaggtaaaatcgatcgattcagcacctgatgtttgatggattagtggattgatgaaattgcatttgtacttcatgacaggaattgtcaaggaagtcatcagaatgtggcaggttgcaggagaagggcctctcattggcgaaggaacttgcagcattgaagctgtatgtttgttcatttccacctgaaagatgcaaatgtttgtgtttgataagtggaatgtatttagtttttagagtataatttgttttgtccattaggtcgacagatatgaaccttcaggaggaagagatccttaagttggcatcacttggtaaccatggaaatgctgcgaatgcggttgatgttttgacgagatctcttgctcttcggaacaagtaaaatttcctctttattatacttatcttgaagcggtgtgtttatggttaattgcatgcctttaagcataattaactgatgatagggtttattaaccacttatgtacttgttatgctggtaatagttgaccaataactgaaagcatgctatctgctttagctttctgtgtcgaatagtatatgcaaatggatgcagagctttgtactttatcgaagtgtgaggttatcaaacataaattgtagtgagtgcttgtgttacaagatttatgggggttttatggtcaattttgagaatgaaataaacattctgataagcgaaatagtttggattgtatattgattagtgatggtaataggctaatagcacttacagaatgtactgagggatgcagatgatttttttcctagtacaattagatgcacatactcaacacacaatacaatgcgcacacataggcatgcaggttatatacaggccaaagaacatacttaacttcattgattgttcaaccaagctgttctctatgccaattggatgtgtttaacactagtgaaaattttactgaacatgatgaagcttaataaggctactgctccatgattggaatgcttcagtaacacgttattttccctctaaaaaaagtaacacggtctttttaggagctacaaagaattgatgatccaatgcaatgttctgggaagatcagaatctcgttcccagcagaggtttgagaaggcaaaagaactcattaagaagttaaaggtaagtccatacggggggtatctttttgctggatgtgtattttcagtgcagataaccctttttaactacaggcaagagtacaagaccttgagaaggaacaagaagaaaaagaaaatggtgtgattagggacctgaggtctgcaaagaaatttaaagctgaccagacaaattcaggaaataccacagttaataatggtttctcgggtcttgctgctggatgtggagattatccgatgaagctcgatgaagtggtgcaggatccatgcgacaagcctgggccatcacctgaagctaaaaatgacctgaatataaaagacaaaatggacgacaagcatgcggatgtgattgacttagatgctgatgattctgtcttccaacatgaacacaagaaaggactttctgccaaaccatttgggaacgatggtaacgatttggatttcaaaagtcggtctagtcttcaagaacattataggaaggaatccataacatgcaagacatatgtagcagaggaaaattcctttctaaaaccttccatggtaactgaaagatcagcacttcaggagagctttaccacaaacaaacttcaaagctttcaagaaactcctgttctaagaagtatgaaagctacaacttcgacatgggagaaagaaacactgacgattgatggcatctctaaacaagctactagaatggctcctggcactggaccccagcaggttcacaatttcaattctctttcaggtaagttattgtatggtccatcaagcagagataacttctgaatttaagttgcataataatatgcatattcaagttcacagggctatttttcttttcaacattctaattttcagggggaagaggcatagaacataaatttgaccaatatttctaatgaatgagtacttgattctgaaaaaatgcttaacaaactttctgtttaatgacctccttttcttattaccaattctttgaatatactgatgttcctttttcagcacatgtacttaacaaca

SEQ ID NO: 85031 - DNA, 1696 bp, Oryza sativa
agtggaattgtatgtgacacctgacatgcatcaactgacaaattctttgaagcatcgattcgatgtgtacataacgtgacccatatttgtatgcacgcgtgctgattcattacagatgtgaagtagtactaattcctggtgtatatgcagctagaaaaattaactgacagtagaagcagatggctgaacaaatgctgatgcttttcacaagaaatggtgatactgatgagatctcaagctgctgaactgcctcagtactcggcagctagtagctagcccaggttaaatgtttttgtgtggatgatggaattgtggtaaaaggaacatccccatcaaaaggaccaagcttttctttcaaacaaatcaacatggaattagatcgaacaaaaagaaaaacaaatgtgtccattggttggttggttaatcctgtgacgactaagccaccagttaattaaccagagcagcatgcagatcagctgggggtcggacgaaataatgaaagaactcgttgattaattacagatcgatggatggacattattattagctaattaatggcaggaactacttgtgctgtaaacgagtgccatgacgtggtcagtagtagccgccgccgccggcgatcgccggtgcagctcaacaagatcatcctcgccgtcgccgtcgtcgtcttccctgcagcttggtcgcagtgatgagcaccagatgctgtctctgacatttttgaccagcaagaagggaggaagaagctgccctctgcatgtcagttccacctggttaagatcaagatcaaccacacgtacatgattttttttttattttctcacacaatatatacatgcatgtacatgtgctacaacaggaacaaactaatatatagagctaattaatgaacatgcgcatgaacacatgtgcaagtactagtaattaattaatctctttaattatattcttccatagttcattggcatgcatgtggcatatgaacgtaaacatgcagatcaacgaagctcacacatatatattattacaagctactccgctatgtttcaggttataaaatgttttaactttggtgtttgactaagtttataaataaatatagtaatatttacattaccaaattagttttattacattagtaattaaatatatttttataataaattcatcttgggtaaaaaaatgttactatttttttctataaatttagtcaaatttgatgcagtttgacttttaccaaaattaaaatatcttataagctgaaacggagggagtactattctatatataccctttggcattaattgcacatcgcatatgcatatatatagtagtatatagcacgcatgtcgccttcacgttgtgatagtttggagaagccaatcagctattgagccactacacttctaggcaaaaatccaagggaacaaacaaataaaccagtagcgaaaacaaattattacatcctctccgtccaaaaaacaacaaaaaattataggcacctctaattcactaatcaaaatttatctaaaaatagtatatttctaataaagcagagcacaaccaattaattagatgaagatatcctatctcatgccctcccacaatattaagtggcataattgcctcaaccttccttttattctatgcatgctattatttaggaataaagtacacatggcatattgatacg

SEQ ID NO: 85032 - DNA, 1855 bp, Oryza sativa
tgcacccctgagtgagaagcagaaatgcatatcctaattctgccaagaagtagtggtgtagcaggaaatccaaccggaacaacagcaacctaaaagtatggaacatgccacattagttaaaactgcaaaacttttttttaataacacaaaaaagagttacagggtgtaactcaaatagtacaaaactttggactattttgagacaaatttgcattagagatttactaaacggacaagattgttttatcaggtttttaatagatttgtggtgcacttgaaaaaaactcacattttgcttcaggcactctcttgagaatgcaggcattttagcaggattgtagaccatgaaaggcatgacaggtgagtcattatctccaagaacctcaaagcccattttctgaagctctgaacggaagaaattgctgttatctctaatctgagcaatcttcttggcccctgtttacaacaacattgcatcatgaatttcctcaaaacaggagaaattatgagtcaatttgttcaaattttggaagcagatatatacctctgtcagttccatcctccccaagaataaccttcattgcagagatgacctgctggactgcaggaggtgacatggatgtgccatagatatgtgaaggacatgtaagcttgagatgctgaataatctcctggtaaacatgaaaaaataatccaaggatcagttttattatcaactcttttgtcttctcagacaagaactggtaagtgaatctgcttaattaattcatacttttgatgctgcaatgtaacctccactcgatccaaatgactttgagagtgtgcccatcatgatgtcaacatcagccggatccactcctagtagctcacacacacctcttcctgttttcccaacagctccaatactgtgtgcctcgtccatgtatgtgtaaacctattcatatgttttactagtcaataccatatagtacatccctaccagtttgaacaactcttaaaagtttcagaaaaaaaaatccagtaataacatacccagaagaagagttctttttttcttttgttgatatctatcggtagtactataatggcagtaaaatactaccagttgagaccaccgtaaaagttttgggtaccttcacgatgctctttagtatttatcgtcgatagaaatgatcttagattttgatttatgagctctactaccggtacaaaaaaaaaatctactaccagtagttgacgttgtagtataaataaatatgattcattggattagaaaaaaatggtctagattgttcttctacccgcaaagagcattataatgcctcaaaagtttccccttttctctttttctgaaagatggtactactgttcttttcttactagtatggttcagaatgaaactaagaaacataagaagaattcagaaatttagtagtaagtggaattaatttctccaattaaccttgtacttcttgcagacagatatgatctcagggagtttgcatagctccccttccatgctatatatcccctcaacaatcaccaggatcttcttccatgccctgtgtgttctaggctgtccacctgaaatctgctctctcagtagtttttccaggtgagcaggatctgcaaaagaaattaatgaaatttggtgagatgaattgttcagctaataactaattacttgcaaatgcaattgacagttgtttgtgagcttactgttgtgttcgaacacccgaatcgtagctcctgaagctctagctccactgactatagagttatggttcagtgaatcactgattatcagtccaccctgaaataattacagtacattaatcagctccaggatgcacga

SEQ ID NO: 85033 - DNA, 712 bp, Oryza sativa
tggatcccctttgtcgcttccggcagtacggtgcaccacagaagcaaggcagctgacaatatttccatcaggcccaacaacactgtccaagacatagccataatcatatgaaagctcctgcaatgcaatggtggtcactggtcaggacaaaacatataaatagctgtaactgcagaaaccataaggagctgaaataagctgacctgaagaggaagtatagtgtcagcagcaaagagcgtcacctttgccagcttaacatcattatgggagctcaagacacactggacaaaaaggttaggctcgcagctgtggtttataaaccttgcaaagttgccaatagagccagcatcaatgcaatactctggtgcaggtggatctgaatcattctccgcatgaagagacggcagatgcatgtcagagccagcccttttctgcagaaataaaggtagctggtagtcaggaaattgtgcaaagcagcatttattgatatctcaacatgaatgaaaacataagtatttacagtacttcactttgcgaaggagcaaaagttgagcaccgaacagtgacattaaggatgtcacacaatggcagcaagggatgatagattgcaattgaacgattgattcaacattgagtactgaggaaagagaaaataagtacctctcttccatccagacccttcatagtttgaagacaatcaatatcaaatatg

SEQ ID NO: 85034 - DNA, 1514 bp, Oryza sativa
cttgcgcgattttctcaaaccattcagaaatgacgcatttctttctaaaagatttttctaacatgatctttttgcttttttatttacaatgaaaaccatatttttctctattttttgcttttcttttctcgtgtgttttttgcctttttttgccaattattttctcgcgtgtttttttgcttgttttttttcaaatgttatttttgttgctttttttaaaaacaagagaatatagacgaaataaaagccgtgtagtaggtggcaaaaaatcgatggatcctatccgactcagagcgatttttttaatagacggtgtttttttcttgcgcggttttttaaaaccatttgttaaaatggcgcgttttttctgacagttttttccttgcatgttttattttttaaaaaagttaccgatgatggaaataattttcctcgcgcgtttttttatttatttatggaagatggaaaacctttttagcgtgtttttttgcgctttttctgacttttttctcacgcgtttgtttgaaccgtttctattctctcgtgcatttttttttaaaaaatagttagattatattagagatagagaagagatatatattgattagaaatttcgccctttccatttttttcctgtgtgcattttttattttatacgaacaagcgttttattttttacgaaccatttttttcgccactttcttatggaatcggacaaacttttttagattttttttctgttttttttcacctttataggaatccgactttttttcctgtttttaacggaatcgaatctagtattttttttcacttttttttgccttttataggaatcagattttttttcgttcggatctacggtttttttttgccacataggggaaacagaacttttgttgttgttgtttttcttttttttttgcagctttcctttttctttttatgcacctttctgcttttgttctctcttttattattatttttaacaaaaacggccccaagtaccttattgcaagattataggaactcaaatataaatataaaaattatagggactcaaaagcaaaagtacaaacccaaaaattaaaatcatataaaaatggaatgctctcgacctgtaggttctgttttattaaacagatctctaatccggcacatcattttgtttcaccaagatatgtgagatatcacggtatagattaagaatcggatctatagtcggactttttttttgtttctgagagggaatcggataggagtcggacctttttttttagcttttttttttacagacgaaggaaacatcttttattattttttaagtagtagagacagagatagagatagagattttttttcgcttttttaacatggaatcggattattttttcgccctttttttgggatcggacatttacggttttttttctcgctcgtccgtttttttggggcggtttttttgtcgccctttttcacagaatcggacttttttttgcccttttttattggac

SEQ ID NO: 85035 - DNA, 664 bp, Oryza sativa
actgcatgacacctccatcagcaattctaacagttaggggttgttgcaaccttctagctcccatcaacttaagtgcaatttgttcatccacaaacgaatgtgtgctgcctgagtcaataagcatgatcagttccattccctgcacccaaccattcaccttgatagactgatttgattcagttccccacagagcttgttgagatatggtcaataaagtgccatgttgttctggtgatgttcccaattcaatgttatcagaatcactgtcaatttcaggttgtaacactgccaacagttgttccactacatgaagctgaactgtagttgcacacttatgttctttaccccatcgttctccacagacaaagcatagtcccttggacctcctataagccctcagagcagccaccttatcatctttagctctagcagattcagtgccccttctgtcttcagattgattcaaattgttcttagtatgctgagtaactcccacaataggtccagttctatttgttttgagcataacccctgggtctgacctcctgtaatgactggccttaacaccttctaaagcttcctcctgcagcagggctatggcacaagcagaatctaaatcctggggcctctgaaccataaccactactcttatctcatctttcaa

SEQ ID NO: 85036 - DNA, 1586 bp, Oryza sativa
ttggtttctcaacataggtcagatcctcttggacttctatctgttcaagattaccttcttccgtacgtacccttaaacacttcttcaattgcaaaacatggaacacattatggactcctgccaaatattgaggtaacttcaactgataagcaacctctcctcttctactgacaatcttataaggtcccacaaaacgcggagccaattttcctttggtgtgaaaacgatgaactcctcgaaaaggcgtgacacgaatatacacatactctccttcttcaaaactcatatctctacggcgattgtcggtataactcttatgacgagactgacccactcgcaatctttcctgaatgattgtcaccttttcttctgcttcccttaggatatccgtctcgaaaacctgacgttctcccgtttgctcccacagaagcggagtgcgacacttccgaccatacagtgcttcgtaaggagccatctgaagactagcttgataactgttgttgtacgaaaaattctacatagggtagattcttatcccaacttccaccgaagtctaaagcacaagctctcaacatgtcttccaaaatctgattcaccctttcggtttgtccgtctgtctgcggatgataagcagtactaaaattcagcttagaacccatctcttcctgaagtttcttccaaaaatttgaagtaaactgactgcctcgatcagacactatcttcttagggacgccatgcaaacacacaatccttgccatatacaattccgccaatcgacttccagaataagttgtctttaccggaatgaaatgagccactttggtaagtctgtcgactattacccaaatagagtaatggcctgatgacgttctgggtaaaccagtgataaaatccataccgatttcttcccacttccattcaggaatcttcaaaggctgtagcaaaccggcaggtttctgatgttctgccttgactcgctgacaaacatcacatactgctacatattctgcgatttcacgcttcatacttgcccaccaaaatctttccttgagatcctggtacattttagtactaccagggtgaatggagtataaagtatcatgagcttctttcagaattgcatcttttaagtctttgttgtcgggaacacaaattctttcacccaaccatacagttccttgctcatcctccaagaaaccgatagcttttcctcttctcatattcttcttgatttcttgaatatccggatcattaatttgggcttctctgacttgatcaattagagtgggcttcgcttctaaagctgcaacgaaacctctactgacaattcccaaatttaatctttcaaattccttgcataattccaatggcaactgtcgtccttcggtagcattgcaatagcctttcctgctaagagcgtctgctacaacattagcctttcccgggtgataatgaattcccatgtcataatccttaattaattccaaccatctccgttgtctcatgttcagatccggctgagtaaaaatatactttaaactcttgtgatcggtgtacatctccgtacgagtaccgaaaagataatg

SEQ ID NO: 85037 - DNA, 1738 bp, Oryza sativa
tgggcttgacagtccttgaagtgcgccgcaacacgggttgatggtccataactcctccctgctctgcatcttcagcttcagcttgcatcttctcatcatcgtcctgctctgcttccaagctcagttcttcttcagtatcttcctcagcactgtcagatgacgatctgacaatcccttccccttgagttttggcttgtccccaagccaaagcattaggaaatctggccttcaagtcatgcagatcctcccaggtagcttgtgctggaatagtgtcagaccaatgagttagaacctggtgaacagtatggttaccttttttggtaagacgatgatccagtaatgctataggatactggacagcagagtaagttggagataatggtgtatgcactgatggctggaacccctttgcttcctttaaaagtgatacatgaaagactggatgaatggaacttgtggctggcaactgaagtttgtaagcaacagtacccaacttctccaggatttgaaatggtccaaaatatttgaaagccagcttgtgattcgctctgggggccactgaactttgcacatagggctgtaacttgagatagacccactcacccacctggaactgtcgaaaacttcttttcttatcagcaaaaagtttcatttgttgctgtgcacgatgcagatgttgttgaactaactgttgcatcaattttctatcctgcatccaagttatcaactcactgttgtcacagtccctgatgctgatcccaaaatggcgaggtggatatccatacagggcttcaaatggagttctgtcaatagttgaatggtatgagttgttataccagtactcagctaaatgcaaccaagaaggccatttggaaggtgctgactggacaaagcatttcaaatatatttccaggcattgatttcctcgttctgtttgtccatctgattgagggtgataagcagaactgtaatgtaatttagtgccagatctcagaaataactgctcccacaattggcttgtaaaaattttatctctgtcagagatgataatttgtggaagtccatggagtttgtacacattactcatgaaggcctttgctacatcaattgcagtgaaaggatgtctcaagggtatgaagtgggagtatttagaaaatttgtccactactactaagatgcaattgtagtgactggacctgggaagcccttcaatgaaatccaatgatatagtctgccaagcacctttagggactggtaaaggctgcaatagtcttggataccttgatctatccggttttgcttgagcacaaatttgacaattggcaagtgtttccttaatttgggatttcattccattccaggcaaataattgtttgattcttctgtaagtcactggaaatccagagtgccctcctactggactggcatgcatctcattaatgattttaagttgcaagtcaggactgttgcctatccaaatatttcccttatatctcaagactccatgctgaagtgaaaaatgaggcttagaattagggttaagtgtcagggcagcaactaactgagtagcatgtggatcagtatcatagctctgcaaaacttccatcagccattgaggaacacactgagaaatagcattgaactcttcctcagattgctgtggttttctagaaagagcatctgcagcagcattagtactcccctttctgtaacaaatcttgtattgtaaacccagtaa

SEQ ID NO: 85038 - DNA, 557 bp, Oryza sativa
tgctgtataaagtacatacctgagatcacaaaattaagggggatattttggagacaatgtctctgaatattgcaaaaattaagaaagcaacaactttggtaattcaactgaacataaatagagtccacttcttttactaggtcttactaacatgggggtttccacagtaacgtttagataattttctacataaaaacagttttttttttcaaagtgtgaaaacttcaatgcaaaagggctcttaccagaaaagaaccaagacaaatgtcgcattcttgtaaaagttgtagaggatcatatatgacattctttgataattccaatggccatgaactaatagaagagggaccaagaatctgaattggcccatcgcaaaatctgatgccattacagcccaatgccctgcttcttttgaccactgatgccaacaccaacatcagccatttgaatcattgaaacatcatttgcacctgaacaacaaaaagataattagcatatatcacatgtacatagaatggttctcacagaatattatatgccataatagcagaaccagg

SEQ ID NO: 85039 - DNA, 2213 bp, Oryza sativa
ccttcttgaattttgttcaaattgattcaaatccagtcaaacattgtttgcaatttaaatctctagctagatttcaccgagagcggcatccctgagaaaaggatccctgctcaaggtatccgccggctgacccatgctaattcatttggtttacagtttatcaatctgaaatgagaataagtagaaggcaagtgcatttataatctaatggcatggattatttttgtaccacaagtgggcaaacttatgcccctaacgaggtgtgattgctgtttgtgtcaaacttgatgatgacatacccgtcgatgacgagagctgcccctccgatgaggccaccggcggtgcatatgttgccacgggcatcttggctggtagcatcggcattggtccactggactggaggaccatcatagcagctctgattgatggccgctggcatcggtctggatgcgcacaccagagcccgacagcaatgacacgctccatctcaaccacatcatagtcattgttgagccgcttgtcagctgcgttgtgaatggctccctggccgtatagatcccagacccactcgactagtcggaagagaccattattttgatcatccagtagactcattggtctccttgcacataccacttctaataaaacaaccccaaaactgtagacatcagattcggcacttgctttaccagtgatcacacattcggggtcaatatagccgggcgtcccagaggggtgcgtcattgtctgtaccccatcagcatggtcaatgagccttgcgaggccgaagtcacctagcttcgtattgaaggattcatccagcatgacattgcttggcttgatgtcacggtgcacaacacattgctcccactcctcatggaggtagagcagggcggatccgagcccaataacaatgttgatcctgcaacatccaaacccaataactgatcagttcatggccatttgtcaattgcacattagcaaaaattctaatgaattagggaaatcaattacctcattggccatgtgaggaaggtaccattgccgtagagatggacgtcaaggctgcggttggggacgagctcgtagacgaggaggagctcgttgcggccatggaaccagccgatgagctgaaccagattgcggtggcgcagccggcttatgaccttgatctctgacttgtactccctcctcccttggttggaggaatctttgatgaacctctttatggcgacgtcgaggccctgctctcttagatagccccggtacactgcgccgaatccgccctggccaagcttctcctccgccgcgaagctcttggttgcgttgacgagcacatggtacgcgaaccgcctcggccccatcccgttctcgatctccatgatgggatcgccttccgtgtcatcgtcgtcgtcgttcgcctcctccgcctccctcatcttcttcctctgatgtcgtcgtcgtacgagtacgacgactgctaccatggccaagaggagcacgacgaacagtgctgcgccgacgatggctcccgctacaaccccgccacttcctgaaccggaggtaggcggtggtgacggtgacggcggcgccactggtggcggtgtggccttgggttccagcgacgagctgaagtaccatgaacgtagctgatgcagctcgacggatgtggacgtcgcggcggagaagccgacggcgacctgctccggcaacacgctcttgaggtcaaccttgtagctaaggttgtaatccggccggtgacgggggccactaagcccatagccgaggtgcagcctcatggccaggatgctggagacgttgtcgtactcgacgacggcggtcatgttcccgacgagggtgaagctgggcaaggtcaaggtcgtcttggacacgacggagttgacgtcgacgccgaggtggtcgtaggtggcgtcggggtcgtgcacgatggtgtcgttgaaggtgtcgaactccacggcgacgaaccggtcgtcgccggcggccacctagtcggcagtctggttggtgaggccgaggttgtaggcgtaggagccggcggacgggagcctcgacgggaagccggcgaggaagaaggccatgccggcgcccttgttgttgatgccgccgtcctcttttggcgggttgatgacgaaggagaagccggtggtgaagctggcaacctcgccggtggcggcgtcccagagaggtaccgg

SEQ ID NO: 85040 - DNA, 519 bp, Oryza sativa
aatgaagatgaattgataactattttaaagattttagtgtctacttattgaatgtgtgtcactaccttgttttgccagatgaactttgatatcagttttatgctctgggttgacgtttagtcaggaacctattggagtgtgttcttcatcagttgtacggtgtgcccactcagtcagtcagattagtttccattttgttattgcctagctgatatactgtaatgtaccactgttgatttttttcacgaatagccactgcatgttttatggtgtttgtagatttacttatatcctcttctacaagactggctcgcctactgcggagatttgttttggttacttgcaataggtctcaatattcggatcaatctatccttatttcttatgtgaaatagggaactcagggtagacttcattatacttgctggttacgtgaaacttataccggttgagctagttcaggaatatccaaaatccattttgaatattcacccttcactactcccagcatttggaggc

SEQ ID NO: 85041 - DNA, 606 bp, Oryza sativa
gtgtcacatcagatatacgaacacatatttaaagtattaaatgcagtctaataataaaataaattacagaatccgcctgtaaaccgtgagacgaatttattaagcctaattaatccgtcattagcaaatgtttattgtagcaccacattatcaaatcatggcgtaattaggattaaaagattcgtctcataatttacacgcaatctatgtaattagttatttatttaatactctatatatgtatcaaatatttaatgtgatagggtgtaaaattttatgagggatctaaacatggccctatatggtttttactgtatatttcttccgaaagtgcagtgcccagagcgggtggggggctcagcctcgggttagcttggctacacgcctacgccaccacccctcggaactcggagcccattgcttcctcggccccctccctcggaaggaaggcaggacaccgaggcctctgcaaaagccaacgtgccgagtgccgacgagcccgacacgttcaaacgacaggaggcggcgtgccgcaacacaatgccaccaccgtgccccggctacttaaccaactgggggcaacggcgcacatgcccaactgttact

SEQ ID NO: 85042 - DNA, 516 bp, Oryza sativa
aaccagtccatccctaggatgacatcaaggtctttggattctaacaagataagattggccagaaatggtactcctttaatttctattctgaccgaggggctacgttgcaaagagagtgcttgattacttggggtactaaccatcaaaggatgtctaagatcttctacttccatcccatgatttcccgcaaaactcatagataagaatgaatgtgtagcacctgaatcgaaaagtactgttgcaggaactgagttaacagggaacgtacccaaaatcacatctggagaatcttgagcttctgcagcagcaacatgattgacacgggcctttgatgctggtacagcagagttactctgggcagggacaacctacacgcgacggggcttcggacacttgtcagcataatgtcctgggtctccacagttgaaacacaccacgggcttgctgccttgctccctcttggcaggctgttgctgtgttggagctgcaacaggacgtggagtttgattgcggatg

SEQ ID NO: 85043 - DNA, 688 bp, Oryza sativa
cttgtgtgagctgtgggcttgtggacatgtatgcaaagtcaaatatagaacaggcaatggactatgctaacaaggtattcgaaaggatgcggaagaatgatgtcatatcatggactgcactaatatcaggatatgtgcaatctggggttcaggaaaacaaggttatggtgctgtttggagagatgttgaatgaaagtatcaaaccaaaccatataacatattccagtattcttaaggcctgtgccaatatttctgaccacgattcaggcagacaggttcatgctcatgttatcaaatccaaccaagctgctgcacatactgttgggaatgctctagtcagcatgtacgctgaatcaggctgcatggaggaggctagaagggtattcaatcaactctatgaaaggagcatgatttcctgcataactgagggaagagatgctcctctagatcatcggattggaaggatggacatgggcatcagcagttccacatttgctagtctaatcagtgctgctgccagtgtaggtatgctaaccaaaggtcagcaattgcatgccatgacactgaaggcaggatttggatctgatagattcgtaagcaactcccttgtttccatgtattctaggtgtggttacttggaggatgcttgccgatccttcaatgaactgaaggatcggaatgtgatctc

SEQ ID NO: 85044 - DNA, 751 bp, Oryza sativa
ccagtggtggacaatatattcccacagaacccaagatgtatcaaatttgaggcagaagacagtgcatgcaaggcaggatcagacaagaaatcactttttaggaacaaatatttcagtgctctaagggatgctaagggaggtataacatcatccatcagctgtgtattattcaaatttaggctttccaggtatttgagttcttcaagcgcagagagagacagtactttcacagagttttccatcatgaaacctgcaacatgattaaaatgagttactcgaagatgaggtacactgatattatcatataaaatgctgggcaagagaatcacaacctttgatacatgtgcgactcaggtttaaaattctcagtgaaggcatcatgcttatgtataataaagcagaatcatcaatttttgtatgagctaaagacagtgttgtcagacttggaactgttcctgccagaacacacagtgcttgagaagttacttcagaattactcaggctcaaaaacttaaggttcattccaatatttgcaatatattcaattgcatcgctaattattctgctgtagctaaggtccaagtgctctagattcctcatatttcccaagaaatacaagttgcttgaagagcaacttgacatatccaagtatgtcagtgaacttggtaggatgcttgaaaaaacttcatcaatgttgccaaatgatgctgcggagataatcaacttttccagatgaataagaacttggaat

SEQ ID NO: 85045 - DNA, 696 bp, Oryza sativa
tgttattacatttcaggatgttgtgcccttgacgtagctgtgtgagaacgtcaaaccagatttgcttcgagatcgggcattcgaacaatggttgacagtttcaagattccggaagcataactgacagaaataattatttggtcatctcctgatctgcaactggttagctgtccacacccggttttgaagcactagccagctgaaaatcttgcaatttgctgaagcccattcctcccaggacaactttgttgatggcgatagtaccattccgttgaattggaattgatatgcagattttgcactatattccccatcggttgtccatcgcaagacaatcaaatcttgtacctcctctgttagttgtggggtgtcacgggctagaacttcccataagaattcatcaaggagggggatagtgaggttgtggcggatgtcattgatccatcttctttgttgcagagcttcctggatggtgctgtttttcctcttcgaatgcctatagaggttcggcacttgacattttacactttaggtaccaaatcaattagattcttagaagctcgccttttgcccatcaccaatttggactttcatcgatgcatcaaacgtatccttatccaattcatcgcaaggagttttagttccaatccaaggcttttctgacgtgctccattcaaaccatagccaccttagctg

SEQ ID NO: 85046 - DNA, 1987 bp, Oryza sativa
tggaaaaaaatattttcgcttttattttcgaaagtatacttatctaagcacgtaaccatgaaagattataatttagatttttttatatgaatattttagctttttaatattacggtcaagattattcttctacttctttaaatatgaattcaatctaacttttgaattaaaaattaatacttttgcgtcgaagctaaagcagaaattttagcaccgaatggatggtacacctcacatccactgaccacacagattattgtttaattgttaacgccattattcggtcctatccttttccgtttacgcttttgcaaattgcactagaatacgacatgctctgtactttgtgcttctggtggtactacagtatatatactggtactccgaagcctctgagagtcaacttgcccaagatattacttatttaatgcgctaattgtacaattttctcacgcaatcatgtatttctctgcgcattatacgcaccgttcggctatcaacgtcgcgttttcctacttcatttcgtaggccactaatacactaccaccccaaaggttagtagctcatgcgcaaggcccaatgcgtagataaggaagtttgatagcaatgtgtcaccaacattttatcaccctgtggctaatacgccaacgaatcgtgtgcagctttgcgcctgacgcctgacaaggtgcatggcttagatcgctcgatcaaaagcagtagtattactattgcacaatacagagagacactcgtacggggtgaagcaagtatatgcgtatttttctttttctttttttttaaaaaaaagaagtagagattgcttcgcaaattgcatggtgtatgggtcaacggaaatcacttcagattgaagacaaatggaatgccgcagtaaaaaaggcttacttcgaatgttggatagactttgctggaacgttggcgacgcgatcgagtcgtctacgtcgtcgtactcgctgttgccgttgccgtcttcgacctcaccgtcgtcgtcttcttcatcctggctgaggaagtccatgacagaaactgggctccgccgctgcccctgttcgagctcttcgtccaagtggcacgtcgcctcgcaatccattttactcgcaacctgtttctatcaatcacaaaaatggagtttgcgatcaatcaagaagtagctaaaagcctaaaaccgagtaagatcaagagcacaaaaagaaaaggcgcaatcctttatgaagcaatcgattgccaagagagcagagagcgcacctgagtttcatggctctgacggccggcgacgccacctgcgtggcgaccctcccagctcctcctcctaggcgacattgccggcgacgagccatcatcccttccgctaacggcagccgcagagcagctatccaccctactgttcacctcatccccctcccctctccgcttcctccagaacccgcgccccagcctcctcgagaagctcttggacagcgcggcctctcctccctcccgcgctgacgacgacggccggatcaacagagcggccctcaccgcggccgacaccctctcgatcacggcgccgttcctccgcctgccgctccctcctcctcctccccggagctccgcggcgagctgccgccgcgggtagcacccgaagccgtcgcgggagagctccgcgctggactccagctccagccactccttgagcatcagcagcggccttgccctcccctccagctccatggacgcagctgcggtcttgcactctcttgtgcgccggggaagcagaggaggagacgcgagccgcgcgtgcacagctagtgtaagggattggcttggggtggtacgtgcgtttttagtctggaagctgcaactctgagtcgagtcagaggcgcagagggtgagagggatgtctggacattgcaggccgcggttaattaagcatgggaaagggcgaggatttgggagggtttgcagatcaaacagcgcccacatcggatgc

SEQ ID NO: 85047 - DNA, 1013 bp, Oryza sativa
aggtattttgtagcgtatgggatgcggaattgattttgaagaagtcaaatttggtacgattggttatgtaaagtttctttcttgtactagagagtttcctaaggtgtttatgactcttagtatgagtttggtttgtggctttaggctgcctacctcatgtataaatagaaggggagcatgaggcttcccggtatcgcttttcatagcaatagagttgagttttgagttagcgtttcgagtttagtcgaaatttttgtaaggagtgctgttggtgcactttgtaaacacagagagaatcaataaagtcgtcatctactttaagagttcttcgatttgtgtttcaccgggtttcggcggtctaaccggtaactcaccggcggtcagaccggcagcaaggcggcggtcagaccggcggcggcgatagcgaatggcagctgatctcggcggtcagaccggagatctaatctcggtcagaccgacggcaaccaggcggtcagaccggcaggacaacttcggtcagaccgcgatctatcgatttcgagggtaacttttatttccgctaaacgttttcggtttttgggtataccaaccattcacccctctctggttggtttagttcttgtgattcgatcctatagtcgaaagagttttccaacaaatttggcaagtttacttggtttctatccttctgaaaaaaaatttagaaaggtcaccaggggaatctaaaggtcacccgggggggattcctcgcctgaatatcattaactagattaagaggaaggttacagttacacacagtttaaggttacacacgtatccttctgaaaatgactctaaagtttgctattgattggggtgaccctgactgaagatgacactacaaatagtatttgttctattgtagcggttgactgtaaaggagtatatagatttttggttagaatactctgactagtcaaaagtctcttacacgatcctttatggttgattcactgccatggaagataaagttt

SEQ ID NO: 85048 - DNA, 2187 bp, Oryza sativa
gcaggacccaccacataccatgctttatacggaatcatacctcgtatatagaaagagttccggataaggaagaacgaatagagttatatatgaaactataagtactattcgaattgtatccatattggtctctctagtactatttgaacaagggaatatctataggtataaaaacaagaccttctagggggagaggagaacagatcaacatgttagctccactttgagcaagtttaatagtatagctaaatgttagctccaaatcatctatagctcatctaatagcacatttatacaatagttacctataaaaatatacttacaccattaatatatggtcccacctctcatatatacatagtgtctggttacaaatctataccacgttttcttctctctcttttcttttcttcttgatatgtagttatagttggcttatagcctgctattgtacatgctcttcggagcaagtgagttttagatgtagcggcaatggtggttaggacttccacgttttctccaagagccgtggtatttctgctttcatgtagtgtcaatgttgttatataagttcaacatgcaagttcctttttttttacgataaatatgcagagtttttaagcagctcttgaataccattgatcatgtgccattatttaggacaatctatgaagtacacagagatggtaagatggcatgcatttttagcacgctttaatactgttgatttactatggtatgtgttgaatatggaataattttctactacctacactctactggtgtaataggtagtaatgctaattctcatgcaaaataattgtacaatgaaattacaccccttttgttagttagtacatgaaaaggaactgcacaggccgccttgtaacagcttatccctacacatgatccaaaactagtaaattgaagagtaaacagcaaacatgtgagataatagttattacatccgtcctaaaatatagcaacttttagctatgattcatagcttaaaaatgcttatattttgagacggaggaagtatattttatgacgaagcaagtagaaaaaaaattgaccgcaagtattggtcgtgaatgatattatatctgtcataaaagtggaaaaaataagaaccacatattttcataaatttatattatcaaatcatttatttttttttcaaatttgtaaggtaaattttggcggcatacaacaggatgtgagtttcaaaaagaaaaagaaaaacaggatgtgtcaaagcctttgcttccaatggaccaatgtccaatgaggtaacacatgtacagttccaacttccaaggataagcttataaaagctagtactactgtatattgcagaatcgccctatcggccaaacttgatctatgatcatctagcaattctaagattaattacccatgaacttctgccttgatgtcatcagccatactatatatcgatcagagttgcaggtcaaagattttctttccatctcgtgctgcttgcatatttcagctttcaacctcgtccaaagaagtatttttctcttttttttagaggaaaaaattccattatattactgatgactgatgaggccaaatcgctagcaaccaggtcctccgaactaggaggtagacaatcccaggatagactagaaagaggactattacatcccaaaacaccaatttcatggcccagtttgttacgatcatgtgggtagtgagtgacacacaccgagagaagcaaaatggagatcgatgaacattttgatttcgttgaggagacctcccattggcgtaagcgtctagttggatcctcttagagcttggactagcatcatagaatccgagtcctgctcaacatggataattccctctaacgtattttctcattgccagcagtacgagcaatcaacccaactctccaaccatttcagcaaccaaagaccagaagatttcgccctccaaatcaacggccagcagctcctgtccgacctccttgaagcatctccaccgcccgatccgctcaatctcctccacctccgcctttccatcaaacctcgacgagaaatcctgatcatccaaccatgccttggcaatctccagcagcaacttcgctctatctggaccgtccaatctttctccctgccaaggtggcaacccgtcgtagaagaaatctattagaag

SEQ ID NO: 85049 - DNA, 962 bp, Oryza sativa
tgaaaacctgatgccgtctattgcttcatgaactagattctgggtatcatcatgagccactttgctactgactctagtagtctctggatcctccttaggcttggtggcattatcagtagcttcttctgtcatgtagaacacagcacatgattcgggagattcaatagttagtgtatattcccatgtctaacacatttcaaggtgcaaaactaacaacataaactttgactcactagatatcttccgtttcttgcaggcgtaaaaactcttgagaccgggtgctctgtcagttgggctgatgtttttatctctaattatatgcacctgaatgtaaggcatgaagaaacaagaggtaattgtattgttggattagggaagactgaacccacaagggaactcaagaaatgggtatgaatgaagattataaaggaacaatcaagtagtagtagtagatttggaagaaagttatcaagcatttcagaaacacttgccttgaattttgttgtgctcacaagctcaaagaccacaacatcgccaaccttgatatcatggttaatcgcaaaacctctccatccagcactgagtccctgcttaccacccaggtaatttgtgttatggttgttcccattctcatcttcgagcacaatgtcagtgtcatgctttgggagatacttgttgcagaagccagctggtagaccctgcagaggagaacaataatcagatgcagagaaaaccaaaaagaagtttctaggtggcttgtgcagaactagtgtcagccattttcataaacacaataactcaagcagtaagagctaacatgcaagaaatgtacataagttggatataacttgtatgtgtgagacttctcttcctaaaacaaaatttaatgaaaaagattagaagtttagaacatgttaatagggtagtaggaagttttaaataagatccataacacgctttaa

SEQ ID NO: 85050 - DNA, 641 bp, Oryza sativa
  unsure (1)..(641): unsure at all n locations
tctaagggagtaaaagtgaacttattcccgaccaacatattccatgtttgtcgatgacaattcatatgatcgatcgcctaccaatagcaaaatgtagaatttctcttcatataatgctacgtcattgctatataaatcaatttttttcacaataaataaataaatcactttacctggagtaatgatgatatttttctcctcctcatcacgaagaaatacaatctggatcaaaaaatcgtatggaaccatgacgtatagcaacgtaacctgggccttgggccgtcgaagcaagcccacctaaccacactcccagcgccgccgccggccgtacgccggagaccggagcctctcgggaacaccgccgccgcttggccatctcccctgccgacgacacgaccgcttccaccaccgcctctcctcttctcttctccactcttctcctccccccgccgccgccgccccacgcgcgcgcgcgtcctcttaaatttagccgatgcctcctctcctctcctcctctccatccacctattctcgccccaccctctcctcctcctcctnctcctcctccgcacccacatccaggccgtcccgccgcggctggatgaaggctcatcgatcccttgccggccgccgcgaccgcg

SEQ ID NO: 85051 - DNA, 1037 bp, Oryza sativa
ttggcaaagatttttgggaaggaccttaaccttggccggccttcagcaggcccaggaactggcgtgtcagaggcagatgaaaggtcgtgggaacaaaggactggtggtgggagctcattgctccccaatgtccaaagaggtttgcagaatttcacttggagtcaggctcggggcctgaattctcatcagcagaagtttggcaacggtatattgattgtgagcaatgaagccacaccgcgcaacaatggaggagttgacagctctactgcaacacagtttcagcttcagaaagcaccaccacttcagaaactaccacagctccagaaatcacatcagctagtaaagccacagcaactagtgagtcagcaacagttgcagcctcaagctcccaggcaaatagatttcagtgctgggaccagttccaaacctggtgttttgactaaaaaaccagctggtattgatggggatggtgcagaggtggatggcttgtgtaaagacgaaggtccgccacctgcattagaagaccggcggcctagaaagaggggaagaaagcctgcaaacgggagggaagagccactaaatcatgttgaggccgagcgccagaggagggagaagctcaaccagcgattctatgcactgagagccgttgtacccaatatatcaaaaatggacaaggcatccctccttggtgacgccataacatacatcactgacctacagaagaagctcaaagagatggaggtagagcgagaaaggcttatcgagtctggaatgatcgatccgagggatcggacgcctcgacctgaggtggacattcaggtggttcaggatgaggttctagtccgagtgatgagccccatggaaagccaccctgtcagggccatcttccaagctttcgaagaggcagaagtccatgcaggggagtcgaagatcacaagcaacaacggcacggccgtgcattctttcatcatcaagtgccctggcgccgaacagcaaacgagggagaaggtgattgccgccatgtctcgcgtgatgaa

SEQ ID NO: 85052 - DNA, 3529 bp, Oryza sativa
tggatagtctggtgttatgaatccatgagtcttggttgtcaacactgttttgaagtttgttaaactgtctaaaaaaaaaacaaacttaatatttcattagcctgtatacccatctccctctgaagcacggagttctactcattttgtttcagaaagataaaatcaagtgtttgctcttctgcctggcgttttctaataaaagaatatttttcatgcaggcaaagccattaatcctctttgtaaaggtatcttttcatgcaacttgttcctccttatttgttttagtaattctcatgcttcatgttgctgaacctgttttttaaagaataaaatcaatgaaaatttagggtcctcccctcccgttccccaaaagggggatatttgttactttaacagaactacacattatctaaatgttcatcactctgtttttctgccagtagttagtactgatgccaagtacacctctttatttttgcagttaagcgagcttccatatcccattctgtatctctgtctttaagattgatgtgctttttttttataacatcgtggtttgaaattagttactctactgactttcagttgccgctccacaccccactgcaaatgtcagtacaaacaacagccttttggatcccttttcaagtgggaatggtactgtgctattagtgcaaaaacatgagcctgaatgttcaagtgttgtatcatcaatacaaggacagaatatggatctgaaagtgatggctacaatttgtttaaccaatttgatgttgtgcaagatttttctgatcattactatgcaaagaattcaccagggaaggtaagctgtgccgctttatgaactctatttctatcactagatccaactgtgaattaatttcctgtctttacttgtgaccactgaccagacctccaaagattgggtgaagacaatccaaaatgaatggaagcttctacagaaagatctacctggtcagtacatgcttttatatggcaaatcaatgtatgcatttttatcaaaccgccagtgcctagatggtgaatacatataatggtcctttcttataatagacctgctgttttatgccaattgtatctgatcacatgccaacagaatacgtttgagatatttctagacttaaagatagttggatgccctgtatgggctataccaatttgcttgtgtggtttgtagtcttggcatgactggtgctgagtcccaaactagctaatgacattgtctaggctttgatgtataaaatactatatttggtgccctatctattagtgtctggtgtgtgccacatatcttatacctataggccctcatttgtcaccctcttccatgtaatcttgtcgatagcagcatataacatgtatcccaaaatcatcctttcttaagtttggggaatgggacaaatcgaaattaactcctacatctatcaaatcatgttaccgaaaaggtatcacacgtatcattacatacactatcacttttgtgccttaaatctttcgtttagaggagctgtgcctgaaattatatgatgtcttcagtactagcaacttgcatctcagcatggtttcaatcatgcagaatctatctatgttagagcttatgaggataggattgatctgctgagggctgctattgttgggccagctggaactccctatcatgatggtctgttcttctttgatgttcgctttccttctgaatacccacaatctccaccggtatgtaaccacttcacagttcacacacgctttgcaccattattttcatgttactaccatcattaatataatctctttaaaatcatatccaacatgtacagaaagttcattaccattcgggtgggcttcggctaaatccaaacttgtatgagagtgggaaagtttgccttagcctgctgaacacctggtggggtactggatgcgagaagtggggcaagtcaaaatcaaccatactgcaggtgctggtttccatccagggtcttgtgttgaatgataaaccatactttaatgagccaggcaacaaaaattcggctaatacagctcctggagaaaagtactcgttggcttataatcagactgccttcctactatcctgcaggacaatgatgtattcacttcggaagcctccaaaggtaactacagaacccccatctctcgtcaagtttaaagtggtaatttcacaagtctctgtgctggaaaagatagtaatagaagaatttcagctgtcagggttatatcagtgcttctacagtcatccagataaagtgaactgctctctgtgcctatatgcttttaaatactgatatacagttaggaactactataacattagtcatgctgtaccaaccgtacttgtcactccgtgaaactctttagcaggcattcagttgccaggagagcgattttccggcttgagaattgtgttgtgttgcgtcatgaaattgccaacttaaaaatttatctgtgggcacatttaactaacaaagacacgcattgtgataatgtgttttggagttttgacagtatgttattgcaaataaacagctgaataagtgagcgcatcagcgcaagaacatttgattttgaaacatcatcagttcatcaccatatgtacctatgaagtcctataaacacaattcagttccatatacctcttgcagatcgattcgctctcacacacacctttcattcactgcagcattttgagtcccttgttgcacgccacttccatgagcgtgagcgcgtcatcctggatgcgtgcgacgcatacatatctggcgcagtcgttggatcatcctctgcgaagggcaccaagcatccccgcgacaacaacagatcgtttgcagatttcaagaagtcactggagaagtactctgaactgctcaggaaggacttggccgcgaaccgcacacacttcctgaaactgacaagagactcgccggctgccgcagatgagatcgttgagtgtaccagcagctagaatcgtcagagcatttgaccattgcagttcacctgcctaactcaaaagtgaaaatggtgtatagatcatagcactcgttacacatactgtgtaggttttttgtttggaggcaagatcgttcggattaattatgcaagaattcgggttgagttcagtgctagccattttgtttagtagctgtttctggtgatacaccaattggatgatcgaaacgtggtccaattctgccagcttaggctttgaacctgctgcattttaaatttttaatagaacctgttgcactagtttatatatgcctatatttacgtggtaacagacagagcagagcgtgttctatctttggttttgaagacgtccattttgatgacgtctttcaactccagacattatttatgctcgaaattgtaaagtaccgcaaatttggtttatgcggaggtttagccagggttccaaatatgaaatgtaatattcacagtagacatatcgatgctggtctggtttgtgagacctcttgaacaacaaatcgagcta

SEQ ID NO: 85053 - DNA, 1000 bp, Oryza sativa
ttcatattgatgttaatgaatctagacatatatatctatatagattcattaacattaatatgaatgtggaaaatgctagaatgacttacattgtgaaacggaggaagtagttttttttcttttgtgtctcttttagatttaattgaacatgttgcttaaccccacgatcattcggcccactgaactcaaccgatcccatcccatgatcatgcttgctaagcgatagctgaggcggagcgttgtttctttttcttttcctttttttttaatcctctttcttctactactatctctctctttttaccttcaggaaggctcttcatttgaacggatggctacgatttgtcatttctgttttgtcgttttctgtatcggatggtcaccgttttgttcattacatggctcatccaagttgctgttttgttcattacatggttcatccaagttgctttgagagatttactttttcagttaggtagatttgatgatttattttactacaaaatattacgtaattatcgtttattttatggtgacttgatctatcatgaaatgatctttaagcatgacttctttttatatatatttgtacaaaaattttgaatgagacaaatgattaaacgttcataaaaaaaatcaacgacatcaatatattaaaaaacgaaggtagtatcaaatttggcacagtggagttgatttgtgagggtgtgacgctgccgagagagagtagagagtgtgtgctcagaattggctcactcacctgcttgtacttcttcatgcggcacccatcggcggtctcgatgatgaactccgtggagaacaggttggcgagcttgacaccgtagccaccgccgccgtcgttcgtcgccttgttctgatcatcctcttcgtcgtcgtcatggaggtggccgaagaacatctccggcgcgtagacgccgcgctcctcgtcgacgagctcgacggggacgacgccgcggccgttatagaagacggagacgct

SEQ ID NO: 85054 - DNA, 3103 bp, Oryza sativa
tacacgccatcttgggtttttaatagaggaagctgttaacttttcgaaagatgtttgagcattcattttatttaaaaattttgtgtaaatgtgtgaaaatgtaaagtaactttaataataaaccaagttatagaaaataataatgatacaatgttttaaataagataaatgatcaaacatgtgataaaaagttatataatttattaaaacccggggatatatttacattgcatcccgtagggtagattgtacattgtaacatgaatgctatttttccaatcattagaagtgaattacttgtaattatccatttataaatagctttattttgaaacgaaggatggactttcctacttcatccatcccaaaatataaggtgtgcacatgtatcaagaaagtatgtaaaaatgattgagagatattacgatgttaaggaaaaaaaattaagtgaagaaattaaatgaataataattatgattagttgaggaaaggggtaaataaaaaaaataaatttatttcaagacaaaggtactaaaaatagctttagaccctgtttagatgagactaaaacttttaattttctatcacatcggatgtttgaacactaattataaatattaaacgtagactattaataaaacacatccataatcttggactaattcacgagacaaatctattaagcctaattaatccatgattagcatatgtgatgctacagtaaatattctctaactatggattaattaggcttaaaaatttgtctcgcaaattagctttcatttatgtaattagttttgtaagtagtctatatttaatactctaaattagtgtctaaatacagaggttaaagttaagtctctgaatccaaacaccaccttattttttaggacggaggtaatataagattgctagtttgactactctctggttaaaaagcccaatctagaataaggtgtaacattataatctcattctaggttgttttttttatattaggttgtttttttttaaggaagaagaaacacgtctgacggtgtgaggcagcagccgatgttctcacagaaaaaaaagcgattttgctatatctcactcgaaagattttttcttatctctcactcgattttctcactcaaatttacagtgcattttcttgtaagttacagtgtaatttatgaaacttacactgtaacttttgtaagttacactgtaatttttgaatcttcacatgtaaattttaaattttgtattggatttggtctttttcttgaggatatggtaatttaatgttcattatggtgtttcttaattgctttttgctttttattatatctatcggattttaatacaaagattaaaaatctgtgtgatacgattataaaaatctttcgaaagatgtataggtactcccaaaaaaaaagagaagaaccagcggaggcccaatcggtagccttataagtctcgcagcacaaaatgggccgctacttactataagaatgtacgggccgaaaagcccagttcgtccctcgtgccgcctctctccgggccgaaaaagcccagctcgtccctcgtgggcccactccgccgctctcctctccgtcaagacggttggcgtttgttcggcagccggcggttgtcacggtgggacccacttgcaagtcgaacgggaaatgggaaaaaaaaaatctctcatatccgactgactccgagaagtccggtgacgagagagatcgagagaacactcgccttagctcttcttcttctcccttctctacggggagttgcggctccggcgggcgcgcgacgagaggatcgccgaagaggttggtcgcgccccccccccggcgcaaaatcgctccgatcgattccatttcaccccgatttctgcttcggattccagtctgttggttcccccgcttgaactcgcaggaatggtgggattgggggtttcgagggggcgcggggattagtagtcccagggtttagtggagatgcggtgctgagggtcggaggatgctgtggcgggggcggttgaatcgcgttgcggcggaatcaacagcttggtgcggcgtggtagcattgttctgtgttggctggggataggtgcagggtggttttcagtggaatcacgtattcaaggctttttttatatataaaaaaacgtggtcatggaatcaatattatcagcactttgtagagtctatgccgaatcttttgttgcttttggaagaatatatgatgtcagttgttagtgattttgcactgaggtgactggttgaattaggaaaggtctaagctgcctgctatgaggtaggcaagaaggctgcatgaatgatgaatcagtcaatatcagatcactcttgctggctatttggtcccaacttttactagttagataatgtcttaacgaatgcttccatgtgtaatctatttgccatagtaacagggcactaaccaatcactttagctgcaactttagggtttattatgtttccatggcttgatggtaacattgtcaaactgatccttcgtgttgtgcaatataagctgaactgttgctacacctctcggtttatactatattaaaaccttcagtccttcgcaattaactgctctgttatacattggggaaagtggagaagaactttgattaggaatttattgctttcagttactcgtggtgcctttcagaatcatggcaaacaatattctgcatttgacaggcataaatgcccatcatatgttgttctatgctcacatattgctaatatgtttattttgcttttggaatcttttcagtgcccagaactgagattttgagtttctaatatcgattttcattccaagggagaattgatatacatatgaaactctgagaaggatgggttatggcatgagtaggatggaggaggaatacagcgagcatgaagatcagaataatggtggatctaattcacaagtgaataatgagttcttaaacacacataatgatattttccatatgactcaaataagatcaggacctagtgaaagtcttcgcaagtctattggtacaagcaaagatgtgatatcgacaaccaggttattgtctggaagggaaatt

SEQ ID NO: 85055 - DNA, 633 bp, Oryza sativa
ccaacggtgaggatgtagacatccaacaacggcggcataacaggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcagcataataggccagccgtgtagacggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtagacggaggcaccactcggcggcgacggaggcaagccggcggtga

SEQ ID NO: 85056 - DNA, 1141 bp, Oryza sativa
tcaaataacctttagcacaaaacaactaagagaattttttttaaccttttctttttcttgagcctttttgctcatatttttctattttattctgggtacgtctttgtcgtcaagactgtttcaaggaattcggcacccattattttgctcacatcgaatacgtccttgtcgtcaagaatgtttccaaggattcggtattcattttttcatattttttattctcttttcacaatgagcaaataaagctatttgaggaataacaagtcaataaagcatatatatatagagcatttatagatcaaaccatatgctagcatcaacattgcatatttgcttaattcaagtatagaatttaagtgtcatacatcatctcccttaaaagcaaaatctaaatctcatgaaaagattagaatacatacaagctatgctagagacaaataaaccttcaaagtattgctagcatgtacaagaaaataccatatgtataaacaaagctctcttttctcaatttttctcattgtcatattattgctcaataaaaccatgaggtacaaactccccctcaaaccatgccaaaaggatgaattatacccaattcaccacgaagaaaagcaaagcgattagaatccaaaagtttagtgaaaatatcagcaatttgcaactttgtgtccaaaaactgcaattcaaaatctcccttctcaacatgatccctaaaaaagtgaaaacgaatatcaatgtgctttgtgcgtgagtgttgaacaggattcttagcaatattgatagcaccagtattatcacaaaagagaggtactttctcaaaagtaagaccataatctttcaaagtagataaaagccaaagaatctgtgaacaacaactagcagcagcaacatattcagattcagcagttgactgagcaacactagattattttcctagaagaccatgcaatcaatgatgtaccaagaaaatgacatgttccactactacttttcctatcaattctacaacctccaaaatcggcatcagaatatccacttaagcatatagaagatgaaatagaataccaaattccaaactgaaatgtatgattcaaatacctcattattcgcttgaccgcttgacgatgtgaagcaagaggag

SEQ ID NO: 85057 - DNA, 712 bp, Oryza sativa
ggtcggtgaagacgtagatgcccaacaacggcggcataaaggccagccgtgcaggcgaggacatcggtcggcggcggacgaggcggccggtcggtgaagacgtagacgcccaacaacggcggcataaaggccagccgtgcaggcggaaacaccagtcggcagcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcgaggacatcggtcggcggcggacgaggcggccggtcggtgaagacgtagacgccaacaacggcggcataaaggccagccgtgcaggcggaaacaccagtcggcagcggcgaaggcaagccggtcggtgaagacatagacgcccaacaacggcggcataaaggccagccgtgcaggcggaaacaccagtcggcagcggcgaaggcaagccggtcggtgaagacgtagacgcccaacaacggcggcataaaggccagccgtgcaggcggaaacaccagtcggcggcggcggaggcaagccggtcggtgaagacgtagacgcccaacaacggcggcataataggccagccgtgcaggcggaaacaccagtcggcggcggcgaaggccagccgg

SEQ ID NO: 85058 - DNA, 774 bp, Oryza sativa
gtgaagtcgtagacgcccaacagcggcagcataataggccagccgtgtagacggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtagacggaggcaccactcggcggcgacggaggcaggccggcggtgaagtcgtagacgcccaacagcggcggcataataggccagccgtgtaggcggaggcaccactcggcggcgacggaggcaagccggcggtgaagtcgtagacgcccaacagcggcggcataataggccagccgtgtagacggaggcaccactcggcggcgacggaggcaggccggcggtgaagtcgtagacgcccaacagcggcggcataataggccagccgtgtaggcggaggcaccactcggcggcgacggaggcaggccggcggtgaagacgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcacca

SEQ ID NO: 85059 - DNA, 645 bp, Oryza sativa
aacatgcatagatgtatagtggccttcaaaagaaaaaaaggagatgcagagctgtctgttttgtactttcctttgcctaattttatgacatatgaccatcctgtgtaatgagcaatcactaataccactaaggccatcttatactcacactccaatttaaagatccacagttgatttatacttcatacatcttcctttgggacattcttgatcgattagatttgttgcagtataaacatgtccactatacatttgtattattttcttataaattctttgttctttcattttctgcaggacatccacgatggactagatttttcacagcatgaagatgttcgatatacatttggaatattttctgttaaattctcttctgatggccgagagcttgttgctggcagtaacgatgattcaatatatgtttatgaccttgtggcaaacaaactaacgttgcgtttgcctgctcatcatgtatgataatttggttgttttcatggcttgtatctttatttaatcttcttaatctatttcttaagttggttatgggctctttccatatttgatctctaatgtgttcccccctacttttccagtctgatgtcaacacagtagcatttgctgacgaaactggccatctcatat

SEQ ID NO: 85060 - DNA, 1893 bp, Oryza sativa
cttctgcctatcttaaaattaatttttaaccttaaatttagagttagattttatagttttttccatcgaagtttatttttttttgcctttgcatttagatcgccaaaaacacgtatataaaagttttattcacaaattacttctcgtttgtaaatatacagtttggcttattccgcgaataagtgaaacgatggctccgatagtttgtcatctctattggttgcctacgcttgatatatactctccgtcctaaaataaaccaacattataatagaatatagcacatcctaatacaatgaatttgatcataccatatattcaaatttgttgtattaagatgcgtttacgagaatgacttattttgggacggaacgagtacttcctatatatcccataaaaacaaatatagtacagcacatcctactactataaaatctaattaggaataaaaagcaaacatgtatgtatgtgatataagataaaatagtagtatgtgttatatcccatgatggtttttttttaagaatagaggaggtaaaccttcaacgattttataagtgatatataaaaagtaaaataaaataatttgtggaaagaaacttttacatattgtgcaatatgcttagcgacttaaaagctagtattaaaaagaaactatgttgaaaatatattaaaactaactttaaattaaaatttgatagtggtttataagtcattgggtaagtgatgaggttttatctttcctagggcggctgtttagtttaactagtttgatttggtggagtgcattagtaaaatctcacgttccaaacatgcctaactctcaattacgagtgttctcggaactctaaactgatgtccccttggaaaaaaaaatggtgagtaatcccctggtgttattttcccatttgtacgcgttaatagtgttgatcaaaccttagcaaacaaaaaaacgcacatctgtagtactccagtagcagtagtagcattgatttttagcgtacgttggtacagtaccatctttttttcagatattggtacaatatccaatcgctttttcagtgagtgtagtacgttggtagtaccatccgcttagtagcattgattcagtgaatcagtgtacgttggtagtaccctccttcagatgttggtacctggtacaatatccaaacactgaatgcactttgatagtaccatcaaacgttcttcagtcaataccacaggcacgcaaatcgatgggagaagcaagggaaacaattaacatttcttcgtaaacggaaattctttactgaatgtttatacagttatgtcacattaatccttgctagattttctttttccttaatgaaacagaaaagactgtacaaataaacaaggaacattaacaggccttggcaggaagcagtcaacaaatatggctgccaaggaagttggaccgtccaatgttccagagacgtatttcacaaaacaaatggtcttttacagtatgtacaaagcaacggaaaaggggcagtgttgcggcaggcagcagcaacttctcgacaacaccaagctccccttaacgtggatccgtggattagttaatggcccggaaggaaggatcttgatctcaattcctgagtaaaacttctcacaaatggatatcgagcacaagcttcacctttctaatatgtaccaaatagtagattatcatctcagcaccaatttattccacgaaagcctaatggaaatccaccattttctaggtaatatcacgggcactgttttccattctctatgtaaaagcagagtatattattaggttcaacctgccaccagaaagaagagagataggtcagcacaacgcaaaaatatgcaacgccctcatagaacttgcatcacagacagtacctt

SEQ ID NO: 85061 - DNA, 5180 bp, Oryza sativa
attcctgcagcccttggaaatactgggtaaactccactgagttgtgagaatcagatgcttcattctgtccagaattgatgctcgtgagacacccatttgagatgtcagtcattgtaccattgcttactgaagaattgttggttatctgaggcctgaatgatacattacttgcaggtgatggtaatccatcatcaagagatccatccaagagggagtagctgctcaatggtctgatggttgaaggtaaagtgtccactgttgtgactgatgtggttgctccagttgctgttgaaacatggttcatgctctcattatctacattgtgaagggcagtaaaatttgccactttaggagattgaacagaattgcatttttccattggttgtaaatcattagtgataggttccaacaataactgcccctctaaaccattcatgttctgcattttcctcatatctgcaaaagaaaggcttttcaattaactatgacacataactgggatgaagtattacaaatgacatcatacgctcatatgcttaccactgtaaaatccagatatagggaaccccgccttggatccatgagcaccattatccttgtcgatgtatgtcaatgcattctgaaaccgtcctattgcaagattcctgaatctttgaatattgttaacttcgcatttgaatgaagtcacattaaaaatcataattagacatgcattggttcatttgcactaaaagaaaactatcaaaatattggacagctcaattctaaaataatcaagtataggcactagcatctgctacttcaaaaaaacatgtaataacaccgatgtatatggtaccaaactaccaaaccaaggttaaaaaaggctcaattaattgcaatactactagctagtatcataccaccttctattttacttctacacacaaatgacaattaattggaatcttaaaattatgtgatactgaaattctctcgttttcaaaaattttatacattcacattgcccgcaagaagtctatccatttcctaccagaagtttattacaatatacgcaatccccagatagatccactctcgcattatttcggcaactacttaggatcatgtaaatctgttccctcaaaacaactcacaagaatgacaacttttcaacatgtagcagccaccataatgtggccaaaaagaaatctttgccagaaagtgtggcaaatccagactagatttagccaagtctgcataacaatcatcaaccttagtccatatactttttgaaatttgacatttgcagaattagtccatgcacaccatgcacctgagacaatgatgtacccaaactataaaatacacattagaccatccagattcagaaacctgtctgttactgccagtgttcagttaaaccagtccagaatgggaaatgccatataatttagattttaagctgacttaaccagcttctgttttggggaaaatattatctaaaatgaatggcattgaaagcatatctttactacagataaaagaaacaaaaatttaccagccaaaatttgctgacattacctgtcactgaagttctgttcagaatagtggaactgcttgaatacagggagcaattccctcctccgaagttcaacctcatgcagaggcagcttctcaatctcaatctctcccccactagagctaagagattcccctgattttgcaggtggttgatctatcacatagaagaaaatctacacaaacatgaaaacaatattcaatattcattgcacacaactgagcacaacgttatctcaaaaaagaagaagaaagaagctgagcacaatgttgagacaaggaggcacaacctttgatttctgccaaatgggaatcctccatgaacttatctgtacctctgcatttgagaggtaccaacttgatctttctcgagatctcatcatctctttcccagaaataccatctgatggaacggaatctgaatgctcactatcacagtcagaagcatccattgccatcatactatttcgttgattatggaagactatgtttgcaatgttttcgtccctttctggccagtttgtcctacggcatacatcccaccactgagtcggttcagcagtaacatgcaactcatcatcttggatctgcaaggaaccaggcccaactattggactgctatcagaggattcagaacctgaaggcagtagttcatgttgaataacatggccagatggtgaatacaccaatagatgctccatggcattagcctttgatggaactggcaatgaaccttcatagttggaattgtggaaaacagcagtaacagcgccagatggtacagatagtttcccacttgcagaagcagccacattactaacagtatttagccaaccagaagaactgttttttatcctactgactacagaattagttacagttgaaggagctggatgaagctgatgatccataaggaatgatggctttgaccaccatggccttgattgacatggggcaaggggtagcccatcactgtgagaattctgtggcagcagactcgcatcaccgccaaaaggagacaatgtaaaaatatggcaagtacctcgggatgaaacaatagatatccactggctaaaatggctaaaagagatatcctggatgacctgcaagcagatgcaatataatcagaaataaacccaagataacaagtttaaattgaacttttattttcttttgaacatacagctgctgtcatgccacgatacagtttgtaaaggtggacatgagatgctgtccaatcatagcgtatagagcctgagctgttagctattacggttggcatgatcctgaaaacatttatgttatggccatgaacggaggctgtgaccaacagagttccactagggtcaaaacaaagagcagatatgggacttgtgtgagccctaaactgagatatgatttctttcgagataaaatccttgatgacaacctgcaagagttcaagaggattacactattaggaaacagaaatgtgagcatgtgacaaagtgaaggcttgctcaagcctcaactaaccattccagcattgtcagcttccagcggatgcacgctagagggaagtttgccagatcttctgccaggacttgatgacaagggggagccagaaccatctggcagaaattcttggcagtactttgacagtgtcttgtatcccatatcaccaagattaataataccagcagctatctgcttacttgattccattgcataccgagcaactaaacttccactactaggggaggtagatgggctaactcctggagatggtgtaaggttctgtggacttagacggcctgtgcttgataataaagggctattggaagcataagctaaccaccttgggccaacagccattgggccatacccaatatttatcccaggtgccccttgcaaaggatatgtcaagacactgaacttattctcaagggtcacagcatcaaagcagtatacctggaatgtagttaaaacatataagtacaccgaagtaaattaaaagcatgtactcctctatgtcatttaacaataaataagagcaccaagagaaacttacttgtgctgcaagagctacagctacaatccgggggctgcagcgaactatatatacggcagaccgaaatctcagaacatgtacatatgagtgagacttcaaagagtagaagcgaacaactgttggagtagaaatgcaatttccatttggagtttcactgctattatctctgatcagtgcacttaagcgaccaccttgaaccatacccgacccatttgtctcatcaccggcaacaaccagaagcatgggatgtgatgttctgaatccttcagtaccatcagagtaaactggtgtgggttgcatttgtaaaaatgtaactggaccatcacgttttgagaccaattcgcaaacatttgcagcatcctcaacatcaagcacttggaacccatttgaataaccaacaagcaaaacatgcttgaaagatgatggatgaagctctaatttatcaaatccagcccacaatacctgtttatataatgaagcatcaagactacggttatgttcaaatttgcataatatactagagctacatgtacacattggtttaaagaacagaagtaaatggttagtgaaaattaaattggttgcacaaacaataccactaaccggtcaacagaaaaaagaaaatgctcttctgatgaatacattccaaaatggaagcatagcacacggaaaactaaattggtctatttactaaatggaagcatagcacaatgagaactgaaccaaaataacaaaagcactatttactaattggtctcaaaaacacacatcagaaaagtatgatgtaataaagcagaaagtcagcttccaggctcccaacaaagttgagatatagttacaatagtgaaaccgtggcaaagaaagaaaattttgagttatggaacagaccaattgttttttggttcttgctttacttgaaaaatattgttttgcccaccatgtagataactagaatttcaaccattgttgaattggataagagtacccattcaactcccgcatgttgtagatttaccaattctgtatatccattttagctttatggtagtcaactggcctcctccaaatgtactacttgcgcacagaattttgaatctacaagaacataagatctaccacgcgggactaaatcacaacgtactaccgcaaaatgccgtgattgaagtccacgattgcaaccatattacatcaggactaaacttagctactcccacagctagcttcaatagtgagaaaaccaacatatatttgaatagttgggaggggcggggagggcagtagcgtgtgggaggagcggacctggtccttctcgtcctcggcctggggggcgatggaggcggcgacggaggcgccggccgagcgcaccgtggacgcgacggagccggcgttggacgacaccgtcttgaggcacgacgagatgatcctcagcgagctcggcagcagcccgttcctcccgcccttcccgcgcctcatccctcctcctcctcctccccactcctcccccagcacgagcaccgccgccccctccccaaactctataaccgcccctccttctccttcacctacaacc

SEQ ID NO: 85062 - DNA, 1931 bp, Oryza sativa
ggtgcggtgcggtctacaacgcatgaaggctgctggccggggggggggggggagccggtgcagtggtccacgtgtcggcagaggtttaacagtggtggagcatcggatcgtcaaccatagactcgcaggtcgtgagcggcgggtgaaaacctagcctggccttagctgggccggcaacgacggcgctacgagcgtcctcccctcctaagggcgttgtcgagctgtttcaccttctctagtagaactgtcgggtaaaaacctagtcttggctctgtttgagaccttgacggatggcggcggcggcattttgtcgtttctctccctacagacgccatctaggcagtcctggctaaatcctcccagacttttggtgcaagatcgctctctagacacacatcctcttgtgtcagtgccctagcttatgcaagttggccacgtcggagggcctctctctcagtgccaaagaggtggctagagttggggtttggtgtcatttgttagggatagattcgggcgacctcggttgtagttcttttgttggcctagcggtggccggttcggtggtagccttctcctaggtttgtgtttggtgctgtcggtgcgtgggggggggtggaaattctttgtttttttcctggttacaacatcccagggttgtaatgttgtaattttttcctactctatcactatgaacttcgccctgtctggtgcgagtcgttcaaaaaaatattagcccggcttgttacgatgtatttttgttatttttttctagtccattggatactaatccaagggtatagaaaaatctgggtgattttaggtgaaaatccacccgaaaaatgcatagacagttcagccaaaacaaggcctgtttagttggtgaaatgaaaatttttgggtgtcacatcagatgtttgatcggatattagaaggggttttcggacacgaatgaaaaaactaatttcataacttgcctgaaaaccgcgagacgaatcgtttgagcctagtaatccgtcattagcacatatgggttactgtagcacttatgcctaatcatgacctaattagacttaaaagattcgtctcgtgatttacatacaaattatgcaattagtttttctttttatctatatttaatgatatatatatgtgtccaaagatttgatgtgatgtttttggaaactaaacggggcccaacccttcatgctaccatatgatctgatttttggatggctttaccaagatgaagggtgaaaatttctggtacttgaagtttaggaatgtcaattaaactcaacttaaagatgagggatgacaagtagacttaatcccatgggagcacctcgcatctggtcctcgctcgcagttatgtggcctaagggaaacacgttcactttgactcctttaacaagtcaccgaatatgcttcgtatcccagaaccataatatcagatatcttaaccttccaactattaaaatcggtgcaatttaactccctctatggttttggagggtggttttgttgacgtggtggtattgacctgtggcattgatatgtggcgttgatgtagaacgaagactaggtcaataccgctacgtagacgccacatcagtgaaaccactctccaaaaccatcgaggatgtcaaattatactggttttaatagttgaggggtcgatatatccggtattgtagtttagggatataaattatattcggtcactagataaggagtcaaagtgaacctatttcggcctggggcacgtgctgtgtcacggtagtgaactggtgggccaaagggcgacagacgcttgtggccgttgccgtcgtgggtttgggaaccgcgtgacgcggaacgagatggagcacgataattttttttatttatacattttttattaaaatatttgaaaaataatttttcattttgaa

SEQ ID NO: 85063 - DNA, 559 bp, Oryza sativa
catgagaggctgccagagcaagtagtactcgaatcgtgatcaagcgagcaactggtgagtatgtgtcaaaaaagtcctcgccttccttttgggtataacccttggccacaagtcttgccttgtacttttcaattgtaccatcaggcctaagctttttcttgaaaacccatttgcatcctacgggcttgcacccatatggacgctcaacgacttcccaagtaccattagacatcatcgagtccatttcactgtgtactgcttccttccagtagtcagcgtcaggagatgaatatgtctcttctatggttcttggggtgtcatccacgaggtatacaatgtagtcatctccaaaggattttgcaaccctttgtctcttactcttgcgagtatctacaatgttgtcctcctcaggattttcctcaggcgtttgatcattgtgttctatcggtgcaaagtgctcatgggcatgacagtttcttgactagaggtgctaggtgtatgtttcatgggaaattcattctcaaagaatggagcatctttgaactcaaaaattggccca

SEQ ID NO: 85064 - DNA, 1156 bp, Oryza sativa
agaagatccaaagtttgttgttcatacctgctttgctttggtatctgcatcctcatccacacacattgaattcctctcgttctcataccttcatgtcaatggattaagtaagaagaaaaacctagcagagggcagtgatatctttgtaccaactattaatcaataataaaaaaaaattttcagtttcacctttcaatcttctcctcgagatctctatatcttgttatatcctcctgatgattttgtctttcatcatcaagttcagctgtcaaaacttctattttggactgcagcacttttatttcgttttctaattcagctttccttgactcaagtgacttgtaggattcagccatacacttcaactgtgtctcagccaagctgtttgatttctcactggcaaccaacttggatgtcaactcttcaaggctcttctccaactccttaaacctaaattttgtctcttctataacttcattgcactttgataattctgcctccaaattcaacttctcagatttaagttgctcgaattcctctgatgagcatatctgcacagcagtcttgacatcacatccagagtcagtaggaccttcaatctccggatcagaagatgaacgaggaaggcaaggaccagaaatgctgtcctttagtggctcaagctgcactttattttcaagtaaagtcactttatcaacataatccaaattattattgtcagcttctttggtgttctctttcaacatcatgaacttaatctcactggttcctgacaagataagagacagcgtcataacaatgtcatttagaacattctcatttgatagagctttctctactagtgcagagaactgctgtattttgtcacataaaccatcacaatctgaagactgcccttggaacttggacacttcttggtcaagtgacttaacgaagtcttgaatctttaaaatggcattgactagttcttgatccatagcatgcttgctcccgctgcttgaatgcttcattagtgatccattgtcagctacttcaaccatgtcaccatgatgagtcttgctatcatttgatgaatctgcctcatcttcaatatcctttagaatatttctgatactatctagtatatttccagcattgttctgtggtgattcagaat

SEQ ID NO: 85065 - DNA, 1964 bp, Oryza sativa
  unsure (1)..(1964): unsure at all n locations
gtagataataaaagtaagtcaagggagtggatgtgagcaatacaaagagagagcaacgtacagctgatacgggacctaagaagacttggatgaaaacttatggaagggttagcgaggtgtgctaaataacagcgagatgaagaaaattaattggaaaagatataaactaaggcgagtcgcaatagagtaatgcgtaagaaacgtgaatgtcatctcaatggggcattagaatggagcccgtcgcaaatgagtcatctgtagcgggccatcggggaaagccgaatttaaaatagattattctgnatgggacataaantaaggnnnatcaccgatgactcattttccatctttcatttgaagtttttgtatttgtgagtgcaaaatatatagctgctgtgtaataattcattttattagctataatacattttcggatactaaatgatttcaaatggaaatatggtcaacaacaaagttgatcctctcatcaagatctacaacttttcttttgttttggtcatttgtaataaaacaaaattagccatattaatgactacacatatcaagtctttgcaataaaacaataaaataaaatacttctttcattacaatagataagtacaaatgcatcggtcacaaggttatgccttccgtatgatctgaacgagtatatgccacaggctcttggggatcatcgtcaaggtcaatgtgaggtcttacatgaagattatggttgtattcttcttcatcgacgacgttgtcaactcctacaattcggcgctttccatccctcatgatgtgcatcctcttgtttgaagggtcttttatgtagaatatctgctcgacctgtttcgcaagtacaaatggttcatcggcgtatcccacctttgatagatctactaaagtgaaaccttccttgtcggctttgacaccagtgcgtagattcacccaacggcagcggaacaatggaaccttgaacttgacgtagtttagctcccagatctcctcaatgcggccgtagtatgtgtttgacccaacttaatcctggaacgcatctatacggacgccgctgttttgcactgtgcttttgtcatcttgtttgacggtgtaaaatgtgtatccatttatatcgtatccttgccatgtgtctacggtccaagacggttccatccccaacaactgtactgtctcatttgggacatccgtggacattgtcacatgattcttgaaccattcgttgaaccgagaattatgttctctgttaatccatgcatcattttgccccaagttctcatctcggattttcgctaagtgctcctcaaagtatgggccaacttctgccatatgctggagcacagcgtaatgagcctgcgcatacgacacttgatctggcctaattcttttccttccgattgtgccaacacctgacaaccttcccccgtgatgagacgcaggaactccgataggatcggcatcggacatgtaattgacacagaactcaatagcctcctcagtcgtgtaaccttcaatgatgctcccctcaggtttagctctagtacgaacgtatgacttcagaactcccatgtatctttcaaacggccacatttcccttagaaaagttgggccacatagttttgtttgcttcactagatgaacaaggagatgaaccattatatcaaagaaagacagtgggaaaaacatctccaggtgacagagggtattcacaatatcggtctgcaacccatctagatcttctggatctataaccttctgtccaattgcattgaagaaggagcacagacgttggatcgtgtgacgcactttcggtggtagaatgcctctgatagcaactggcaagatttgtgtgattagcacgtggcaatcgtgagacttcattccaacaagttttagatcgtccaatttaacatgggtnccgagntcggttatgcagtcaacaatgacac

SEQ ID NO: 85066 - DNA, 2296 bp, Oryza sativa
ttcaagcatgataacactgcgatcttctcatcattcgacaatgtgtggcaggctggagggaggtacactctacctgtctctgcatctcgtatgggttggagttcactgcgaatattcatgtcctgtagatcaaggcgcgcgttcaacccgtcctttgtcttcctgggaatattcaacatcaggccaaccaaactctcacacacattcttttctacatgcatgagatcaatgcaatgtcagacatcaagatctttccagtaaggtagccgccaaaatatggattttttcttccacatacccttctcctttgtcttgctacgttttcttttcttcccaaactcattgcttatgtccttgaccatattgtggacctcatctccggacaaatctttgggagcaggctgaagttctctcttaccgttaaaaattttcttctttcttctaaatgcgtgacgtagcgggagccacctccgatgacccatgtataccatctttcgtgatttcttcagccaccggcttcatgtatgttccttgcaatcggagcatgccttctttccttttatagtttgtccggaaagattaccgagtgcagggtagtcattaatggtgcagaacaatagaactcttagcttgaagttttcctgaccatatgcatcccatgtttccacaccttctttccaaagaatctccagatcgtcgttaacaggctccaggaatacatcgatatcattgtcgggttgcctcggaccttgcattaacaagcacaacataatatatttccgtttaaagcataaccatggcgggaagttatagttcgcaataagaactggccaagtgctgtgaatactactcatgtcaccgaaaggatttatgccatccgtacacggacatatctcatgtttctagggtcgacagcaaagtctttgtgttttcgatcggtattcctccattcaatcgaatccgctgggtgtctaagcataccgtcattcgttctctccggggcgtgccaacgtactaacttcgcttcattggggttggcaaagattctcttgaaacgatcaatgataggtagataccacacaacctttgccggaccacccctctttgacttctttccttcgtcagcacttttctttcacttgtatcgagaagccttgcagacaggacaagcatccaagtccgcatattgcttgtggtacaatatgcagtcgtttggacaagcgtgaattctacggacctctaaccccagtggacacagaacatgctttgcttcgtatgtcttctcgggcaatgtattctcaacaggaagcatagccttcaaaattcctaaaagatctgtgaaactcttgtctgtccatacactacttgcctttagcttcattaggtccaaggtaactgacaacttagtgtgttttgctttgcatccagcgtatagaggcgtctcggaatcactgaccaacctgatgaacttcattccatctctctcattttgggctaggtcctcaacgtcacgtaacatgtcttgcagcagatcgtgatccacatcaaccatttcaccgcccaatggagaaggtataaacatgtcatgctcatcttcatcttcctgattatgcgcaccacttctgtctgctgctgctccacttcctgattcttgctctccatgcttcacccaacatgtatagccctccatgaatcctcgttgtatcagatgaccgtgtacgtcctctccgctatcaaacatattctcattcttgcaatctgcacatggagaacacatgtaatcactgtttcttcttttccgatcctcctccacggcgttcataaaatttattacgccctttctgtactccgtagaatgacgtttcaaatttttcgcatacatccaacttcaatcaattgctacaaaataaaaaaaacaaattacatgcacatcttataagatcagtattgcaaaagtaagacgttatgaaattgctcaattaatgattaatattactcacttgattgatccattttgatcacttttgggaattttctgttttccttggaaaaaagacaaaaaatcgccccctacagcctcccaccaaaatagtgaacagtgggatacaactacagtaggtggtggggggtatttatactgtgcaacaaatatctgtaacggccctaaaacaatcaactgtgacgggcatacaagtaatctctatcgggccttaataaaagcccctcaaaaagagtgtcatctgggacgggcattaaacttatctcaatcgggtctttagttggagccccgcaccgg

SEQ ID NO: 85067 - DNA, 2894 bp, Oryza sativa
tatggaggagtacattgacttggtcgcagttgccacgattaacaacgttcagggtgagtccccaacacgatgaggaacccgatgtgagattgaattcacggtaagcttggagattcgtgcttgtccgcaagcacaaaaacgacagcggtagatttggcgtttactgtgccagttggggccaccgagaaagggtggttgcgttctgggtttccctggatgatgcgacccgtatccaagtcctcgtgccgtacgccggctaagcatgagtaggccactgtttacgtgggcgtgcagaggcgaactgcatttgctacgactgcctactgctattgctgtgctatcgtgcaccagaacaagtactagctacagtgctactgctaggcgtgttagtttagggggtgtttgggagagaggggctaaactcagaaccgtaagtctctaggagatggacttatattttttagagaggggctaaagtttatctcctctctcccaaacactcttttactgcactactcaaaaatactcagcatgtactatgagcatctaatcctaaatacttaccctaagatgccaggtagactcatatataatgaggtgaaatagagaggaaaagagagagaggatgagccactcccatacaagacgtaacttttacataacctataagagaaaaaggagaaatgtgaagagaagattgggtaaacaaataaatttaaactattatggtcagtgtactagaattatcgtagatgtgatttattgcgcatgttacctttttattgatgaatagtctacatggataaatttaagggtggcatctacgtacctcttctataaaggtggcatcctttagagaaagataatagtggctataagccaactataaatttatgtggaagataaagataaaaaaaattgatgagttatcatgtactaaaagttagttatacgtacatatgtttcaagttaattgcattgaatatatagtgagagaaatagagaggccggaggaaaaaatagagtaaaccttataagtaactattatatatgttagttttaatataaattaattgttaatagttatctacatattaaacttgctcttaaccagccaacctgtcatgctccttgacttggtttcactttcgcactttcgcatgccttttcgccgtgctgtgattgagtacgggacaatcccggatcagcggatcgtcccaatcatttgtgcgatcaatttggctcagctcccttattgatctatgcgtgcactgcgtcgtttggatgtgtatcatcggctaactggtgcaccaaccggtcgaaaattaagagaattggcgtgtgattaaccagtcgatcaacagctccgattcagcaaaaattgatcaatatatagtacgtatattagttgtttactatggtggcaacaaaaacaacaatttcagccgcaaccacagcttcaacaagagcatatgatgagaaaaaaaaaataattatcggcaggaagaaccgcactaatatcagccagaagggcaatatcaatatcaacaaggcgaaggacaatatcaactttaaagaaatcaatatgaacaacagccgatacaacatcaacatatgggtaatagaaacaaagagtgggtcagaaccgcatcagttccccaccacgaaccgattcaggggatgtctttccaagacgatccgcgatcctaaaatgggtggaattcattgtcggcctcttgtgcaaccagcgttcactcctcctccacagcatccagaaatcaggtcaagtataattcctaatctcgtactcctaatttcgtagtattaatgataattatgggtattttcttattaagattagattaagctcctgttctcctaatttcgtaggttatcgatttccctgcatcggccaaatggccacgcgtgcatacgtacggaaacctcccacggtccgtgcgtcggtcaatgcatgggtgtggtgtccggctgtccgctgcagcgtttgtcggacgcagacggaaaactgtttcgttcttcactgggcgaggccgagatcgagtgcatggagttcagttcgccatttcgccgcggccggagaccggtcgatcctcctcctggcgcgtgtgcgtccgcgcatggagacgacggaacgtttgtgcgcactaccgcgctacgtccataaaacacccctgttcgccaacgtccagctcggctttttacgtggtcccctcgacggacgctggccccgtacttacgtctgcaagatggaagaaaaagttggcgttgcttgatctagtgtgtggttggaggagagtactgcacttctctggtccatcgcgatgtctcgatctgaacaaggagaggatataatttggaaaacattttctacacatagatgtatacatgtagtttaaatagttatataaaaatttataaaattcgattagatagattataataatataagatactatattagtctaaattcgatctacacataaagaaacaaaaataataatttttttctacaacactatctgattttatcatttctgtttctatagttatagatcaaatagccttgcatttatgtttgtagaattatatcattccaatcgatattactattttattaaaaaaatctataactatttaggttatatgcaaatgatgagtgacatgataccgggatgtaaaaaatccatgtccgaggactttatcagttaacatagcgtagttttctccatcatcttgctagtgacgagtttatggtccaaagctgtatcagagaccgttgtgatgtagaaatcaaaccatatatcacttggaaagaacgtgcagatgtcccttttttctccagcaagagttggatgaatattaagatttttgtg

SEQ ID NO: 85068 - DNA, 689 bp, Oryza sativa
atcatataaaaggaattgagatattccttcatatgggacaactttaagtcattttaaattctagtgactttgacgatagtaataatattacagaaggaaccggcggtggctgtggacactgacgagcgacgcgtcgtcgatgacgggaccacacagcgtgccgtcggacttcgtggtgtaggccatgctgacgaacactacccgcgtccgtttctccgtggccgtgaactcgagcagcccgcgcttgtagccgcccgtgccctgcgactggtacgtcaccttcacgctcccgcgcgacgcgtacgcctgcacggtcagggacccggagcacccgtcgccggcgtccccgacggagaactccagcctgtacgaccgcccgggcacggtgctcacctcctgcagcatcgccgtctccatgccggacaccagctcaaccgcgcgggcgccgcccggcacagcgtagtgcgccgcgtcgatgtacttgacggacttggtggtcgacaggatcgtccacggggacagcggcgagtagtcgtcctcgtccatgggcggcacaagcacgccccaggacgtgttggggaagatgtacgggccctcctcgaagcccccattcttcagcatgttacctggttcattttgttcgattgtttcatgactgtgagcacatccttgtattcaattttgtagag

SEQ ID NO: 85069 - DNA, 3062 bp, Oryza sativa
tcctgcaccccctttctatatgaaagctgctctaaaatatcatattaatctattttttaagtttgtaataattaaaactcaatcaattatacgttaataccacctcgttttacgtaaaaaacttaatcttcatcttcatttttagaaaaaaaacaccaagcaatgaacagatgatatattaattgttgctgtcggtgagttgtttagtcgtgttcaaagcggagtcgagtacattaacggctcatcctctgttcaaatccagtaccggaactcgccgattgggaaattaggatttgaaccggtccgtttcgatgtagttgtctcgtcgtcaaaaggattagatgttctttcgactcgaaagtgaggcggatcccaacttcctaccatttatacgttacagcgtaacatctatatatagcgaacagtaacgataaaaaaaagatagttagttgccagatatactgtccatatcagcagctagagcaatccgtttctctatcacaaatcgtgacaaattaccctgtttaccaaatcgggtctcatgaaaggtgccctgttcaacgcagagaaccttcaggaaaatattgtaggtgcaaccaatgcagatcgtgtcacttcggacaaaaaaaactgtttgctcctggatctcggtgtttctcggaatgaccggtcattgacgtaccggtcggacgcgtacgacaatttgcatgcagcgaccattaatcgacgtacgcctgcccataggcgcccgatctcgtgcgcgcgccgacaatataggcctatatcgtgtgcacggcgagacaggcagtacgacgtactgtcctctccaacgtacgtcggtcgctgttcacgacgctgctcgtgattacttgtagtactactactagcacagtacaactagtaaatacttcctctattccataaaaaaccaatttagtgctgaatatgatatatcctactactatgaatctggacatacctctgttcagattcattgtactaaaatatatcatatccagttctagattcgttcttttcgggacggagagagtatcatgttagaattgaacgacacctgactaactagtggtgctaatttggatcggtgatgggtagagctagcgtgcgtgcgacagcgatgtggaccgggaggaacaatcatctcgttgacaatggcgtgccgcctctcgttgcgcgtcgcggcgcctgctgccgggtggcgaccccgtgtggcgcgaggagcccgccgctcggcgacagtgcgagcgagcgatcagctagagcggcgtaacggtgagagatattggcgtgtgactgtgacctcacgcgcggaaacgactcctggtttttccgttgaaacgtccatcaccgcctgagcagagagatgcaataactcgtgccaccacggcaatatctccttctcctctgtctgcataccagatatcttaaaggtgctagagtcgccgcaagcctagccgatccacgtcatcaaattttgcacaaaatccctcattattttggtatttctaattgagtccacgtgatcagagccgttctttcccacgcgtggacaaaatctggccatccatttcctatctagatggttccgcccttaccaggtcgtggaatcgacgagcgctcctctccccacgtcgcctccccgtccctgatcccctttctctcccttctccgatcggcgattcggtggccgagagtcggccgtcgttccaatcgggctgcggcgcgtcgatgcatctccaagaccttccgtcgccgtcgttttggtccctcctaatgtcgcatcctgctcgccatccctaatcccctttgaaaggaccttgatgtcgcctagaggggggggggtgaatagacgttcctaaaaattatcacaacttcatagcatattagagtgatgataacttttgattcaaatcgaaacttccggtatgggattggaagttccggtctcaatcgaaaagttcggcggataacggaataaacactatctattaacttgtagctcaaacaaacaaaatgtatatgaatcaaaaggtgacaaataacgtatctaagcaagatataaggtcaccaactaaatcaattaagcatgcaagtagatcgggtaaaaacaagctcaagcacaatatgagagaatgcaagaacgggcaaaccaagaggggagacgcgcgatttgtttcccgaagttcggatccacggatcctacgtctccgttgaggagccacaagggccgggcctatttcaaccctttcctcacgaggttgcacaaatgcactcctcggtttcactcttgatttcttcccttgcggaggcgaaatcgaagccttcacaaactttccgtggcacaccacaaccttgggtgctcaccggcaacgcctagccgtctaggagaccttagtccccatgagtaacaaacacaatcgaagatttgcttgctatgaactcgagtgctcaaagtatggagtgaagctcaatagctctcaacttctcaatcactcaatccaactcttttcccttctcaaatccctctcacaaagaggcaccacaaaggatggagtgaagctcactagctctcaactcctcactctctcaatccaactctctccccttctcaaatccccctcacaaagaggcaccacaaaggtagggaaatgaggatggctatttggctttggatgtgtctaatactccccaagagcagcagccactcaaatgaggggtggaggagtttatatacccgagcccctcaaaaactagccgttggaggccaagactgtaattttcggagtttccgaaaagcattttcagacaagtccgaaaacttacagaagcaaatctcagattcgcagccattttcggaatgtccgaaaagtttcggagttatccaaaaaattttcggactttccgaaatgcacagagtaaaacgactataacttttcgctcgggagtccgtttttgatgaacttggactctatggaaagctcactcagaggactacccaactcaaccaaaaacaaggactaaaaccactcaaaggataggtt

SEQ ID NO: 85070 - DNA, 1098 bp, Oryza sativa
ttctcttctcagtaaatgatttggaaaacaaggaagatgtgcttgcatcatgtgatgaactgatttctattccctattatatttcttgaggttttaatttattgttgtgccctgttaaggaacatggagctcaagtcatatcgacaataccgacagtgccatatatctttgagtatggtgatggaaggtgcaaaattgcaattattatattatatatacttgttctctgttagttttctaatcatggagtgctttatccagcaaagtgcaagtcgagaaccctgcagctttggcttcaaatcctggaaagcgtatagcagcttgttgggaaccaacagtcattgcaactattattattcctagtgagtaagatctgcttcctttctcatacactcttttagttcatgaatttatacatatttatatttataaaccagaagttcttgagactacccaaccgctttttcaggtatgttgggccagtaattatgctttgttcagagaggaggggcgagcagcaagaatatacattcattgatgcgtaatagtttactccagaaatcattttcttaaaataaattttgttcttgccttacagggctattgtttgtttgtttgatgcagccaaagggctttgttgaagtaccgattaccattgagggaaatcattgtggatttctacaatgaactgaaaagcataacatctggatatgctacttttgattatgaagattctgagtaagtttccttttcaactcggtaaccatacatggtcttgtctaatcttttgattttttttaaacattctgagatggaaaggcatgtatctgttttctttcatcaggtggccttattattcttttctgtttttttgctcctttttgtgatgattattttggaggcctgttttatgccccattcctgaaattcgtactacaccttgctcacaattttctactccctccgtttcacaatgtaagtcattctagcatttcccacattcatattgatattaatgaatctagatagatatatgtctagattcattaacatcaatatgatgatgaactacgtgcagtgaacgccatcaaaggggcg

SEQ ID NO: 85071 - DNA, 4742 bp, Oryza sativa
atcctgcaaaacaagtgtcggtgcccatcgaatggtggtaactctccttcagctcataaagctttaacaagttacaatgacacctagttcaagaatagcacgttattctaatcatgacgaccctgtataacttcggttctcggaaaaaaaaatgatgaaaagaaagcaacaatgatatatctttcaaacacttctggtatttccgctatgtatggtatgaatgcaacatatatctcatatttgacttgaaatcttgggcagcatctaaatcacgtcaaaataattttgagtcttattttgcaacatgggaattgaagtgcgtcacaagaacattgttcatgtgatctacgtaaagccagcttgcgtaccttagctatctcttcttcatcagaaacagtagcacaaacatactcggcatgtatgcgccctcgctaatgcaagttccacgctgcatcaaaagatgcttcctgtgtctgcagatgaccaaaaaagttcaaagcatgattaatgcatcactaagcgcaccatacatgtaaagaaaaaaaaataatggcttcaattgccactagtccttgcggtattaacagtaacctagtattcccttctagttgcattattattgtagtagtgcacaggcctgactgagctcaccattttaagaacacatttcatcactgcattaccagtagaataatgagcaggctagatctgattagtgattaccatctctcgtctgtaaacgagacaatgaacaattgagcatctcaatgtgcaaggacaacgactgttgtgtgcttccaattctgaagggacaaggagtatctctcagttgactgctcgtgatgaatctccataatcattcaatgtggaagacttgaactcctttttctcttaaagattctgtcattcctatgtaccttcattttggtacaagaaccagttcagctgcctctaccgaaattattatctttgtatccttcagatctgagcataagctttatgtaattctaggaatcttcttgtgtagattcaacttctcttcttccttagataagacatttgcaccgtggtagggcagctgcctgtattagttttcccagtttgttaatcttggtgaaagcaaaaaaccattggaaccacttacctggtgctaaagttgtcttgccaatccagtttctagaaccagttatttcctaacttctccaagcattagataagtaaccagccttttgttatgcagaagatgctccatcagtagcacgctttgcttagttactgtcaattttggaaatgttcaaagtcaaatcaattgtgacccagagcttgctgatcctcactgactatttgagcattactccagcaacggtatatcaggacttcaaccggctgtttcttctgtactctggagaatctgttggttcctaaaagcccttgtatgattacgctgctagatttgtttccgagaataaacaaaagtaggatattccacgggtcttccagtgagaacgtagtagggtgacctcaactgaaagggaattctgatattcatgtccacagtcttttgggtttagtgtatggtacacagctcttggtggacaagcattcagaatcatggcactatgtctgtcaactgacaaagtaataacaatggacgatgctctgctaacaaggaaaatagggtatccaccagagcctcttccatctttcttatggttgatttgcaagacggcaggtgtatctatatctgagtagaattttgcataacagatggaaaggatatcagggatgtttaattaagttctgacctccaacttctctagatgaatggccacatagaaatagcgcgaaagtatcagttggctctttcatggtttgatttgcacctttgcagttcctcttgataaaataatgagatggcagcagtacatctctaaccatcaccaagatgattttgtttagactatcacattctttctgaggttgtttactcctcagtgctctctctgaaatgttgagaacaaataacaaatacagaatagaaggcccactgttcaaacattgcatgcaaccattttgtagttggatttgccttcttttcagtttcctgagaacgctttcttccacctgaaacaataaatatatgaaaattcaaaattaaggagcacataaagcatgaactctgtggcatgttaaggtgaacaacaatataaaatggctaaaagaggcacttaaccttaattgtttgactcaataagcccaggttaatatgaaataattatttcagattgttcatacaccggggaatatatgctgctgataaagaagcctggaaaagctgaaaattaagactgatgaagtaattttgataaaaatgtgtatgctgaaatgaacatctagcagaatgggagaaggccagaacagctaataccatcaaaaatgtgaatgacagaagaagctgggaaacttctgaaatcagtagcccgaataaagaaaaatccctcttgcaatgtagaaggaaaatacagaaggtcatataaacactaatccgataccgaattacaaacccagttgagttatatgtgtatagagtaggcacctcatcttctctagcagctgtttcttcagctgattgttttgccagatgagccactaccagctcttacaatttcacaatggcaagtacgtagttcgaagttcgtaaatcagaaaatgtgcctttatcaatacacagtacagaactaaaggtactgctgtatggcataatttactgaaaggtatacaaccattcccaaacaaaacagaaaatgagaactgaaattcagcaaggtaagcagacatataacaggtgctagtcagcatacgacaaggatgaacttaagttaaagcatctttcaccaacggtcgaagaccatggtctagtgaacagaaaaaggggaaatcttccttcagaactctgcgccaaaatagcttcagctttgaccggcgatgtaaaaaaggatatgatctgcttctaattggcaacagacaagctctcctagtgttgaggaactttggaacactttgcaaagcagagagttctcatctttgtaggactaaaatctaagatagctgcacaaaataattacagcaattagaacatttctagtaacaattgtacacatgagctaaactcagagagaacaaaatggaaacctcatcatgcacaactcttaatggaatccatttgcgtgcttattgaatcatgcttgtgcaactaaccaccattacaactagtgaaaatatctcatgcagtcagataaaaaaaatattatgtggatctgagaaactctgccatgcatatcttctaacgcgaaacatgtgcttaaggaaaaggataaatgagcatgatcacagaggatatatctgtcccaaacattgtctatgcagtgctagaagcacttgttacttgtttgatcaattaaaatgtaatgccaggagtaagcaaaaaaaaaaaaatcgaagccagggctttgatcttacttggaataacaagaagaaagtttaatcaacatttgaccaaatcaccacttaatcagaacaagatttttctaagcaaattgattggattttgcaacttcagacaatcaagttaaattgcttatgttcaacttgctaatagctgttgatagcgtaattcttcttccatgactttgagtagtacacagtagtttgccttactttatgcattagaatagtgtgcctttgcagtccacattttaaacgacagaataatattgcaaatccatgatatttcaatttgtagagtgcacacctgctgcattcgggggttggatgaatcatgggcaagtaagaaggcacatcaggttattttacatatatgatgtcctcctcatctggctcatctgcatcccagtcaccttcttcttcttctgatagatttgcaccttctccatcttcctcttcttcatttccttcttgttgctccctttcctcctttaatttgtccagtatagcaagaatctatatatatggcaacaattagactatagtttcccaatatatttgagagatatgaaaaaaaaaacgcttagtgcaatactgcaataattcattgtgtgctaatgcaacccctgcaaacattggattgttaagttataggttctgtgatgttaaagcttaaaaaaatgtctgtatttggggctgattgcctcgcaaagaccctacaggaagaagcttacgtctggtgtggtatcaatgaagcgtaacctatgatcttatccaaataaagcatatgggtacttgtagctataattttcaggtaaaccgaattgcaaacagccaaacacaattttaagtttaaacagagatgcaaaatactaacacaacttgtaaggtaacaaaaacaatgaccatgcttcttttgaactatttggatcttgatatttgataactatccgaggagcagtactggacaatcacatagtatagatacgttcaaggatgcatgtactaaatgaagataaaccagtgaaagcagatattcattggaacaggtagatagatgagtttagagtgtgtaccctgcttccccgctccatggactcatcctcgatgaaccgtatctcaggcgtgaggcgcagcttcatccgcttgcctatttggctcctgacgtacttagtcttagccttgagcccagcaatggccaccttcttccccctctcgtccccaaacacggagacata

SEQ ID NO: 85072 - DNA, 8341 bp, Oryza sativa
ttctagttgttggtatccggataatcctggccgtccgttgtacgatcggacggtctcgctggtgtgtgggccccacctcgctagtgctctagttgttggtatccggataatcctggccgtccgttgcacgatcggacggtcaggatcggactcagcgaggagaagaggagaaaaatctcgagatgaaatggacgcgtaacctgactccgattcggatcccccaccggcgagatggcacgcggatccgccgccgcggcgatcgccggagttgtgtgggtgcttctcctcctcgtgggggtggcgtcgggggcgcgtcttccgggcgggagcgggggtaaccgggggcgggagccgcgcgggggagcggcggcggcggcggtggccacggagacggcggtgttcgcgctgggaagcttctggaggtcggaggccgcgttcgggtgcctccccggcgtgatccgcacctccgtcggctacgccggcgggtccaaggcccgccctgagtaccgcaacctcggcgaccacgccgagtgcgtcaaggtgcggtgcggagactcccacgcttttagctgttcttgatcgataccatgaaccaatgatatgttcagttccatggtcgtagcaattcatttccgtagttagcatcgtaatctgattggccattaccatttcgtatgtgtaagttaaaaactgaaagaaaatactcgcgagttttcatttccatcgtaatctgttttctcttggttccaagtttcattttcattgcttaatgaggtatcattacctaaaaaaactagaaggaatgttctatggtcaaacaggaacgattcatcactgccagatctgcttcttgtgtgtatttttttgtgcataaaacaatcggagatgtttgtccgttgagtgcttcattcaattgcatgtgtgtgtgtgttgtaggttttggagtggtatactggtattaatactttgcagggcctccttctaaactaactttgttggtgttttatgagctaagatgattgacatttttgagtcatttaggttgaatatgatccccggttgattcagtacaagaaacttctagaggtcttctgggcaagtcatgatccacgagaggtctttgggcaaggaccagatgttggcaaccaatacaggtgcttgagttttctaaacctaaccccttttgtgcaatagatctttttgttcacagtttaccatagtcagatttatatactaatgatgtgattatcttttataaacatgtttcatgctaaaacttagactggtttccataccagcatttagcatatggtatttgctaagtttcacaacaaagcaattgagaattgaaaggtgtacatttcatttcatcacctttgtctatcctacttcaaacaagtacctttgtgtacaaaatgttgccatcatggcttaggaaataattggtcactgaatggtgtagctgtcattctcactagtttgataggatcctcagacagcactgtaatgcgtcaattttaattcttgcttcacttatgtggtcacagatccatcatcttcacaaatggatccgtggaagctagattggctggtcttagcaaagaaaaagaacaagctaaggatcgccgcagtgtcattaccacacagatccaaccaataggtgcattttatccggctgaaccggaacatcaggtagcaatcccatctgaaaattcgaactcaccatgacattctatgttttatttccttttagttattgcttgtactttggtagaaatttgagctgaagcgcaagccgtttctcctgcaactgattgggaacctgcccgaggaggagctcctgacctcaacactagctgcaaagttgaatgcatacgctgctgagctctgctccccaaatacccagaacagaataaactccaagattgatgagattgctaagaaaggatggcccatcctaagagacatttagctcggtgttcctgggttttacatattaatatatcattatccaattgtgcatgattttgccgcaaatcttgtccagatgactggttgtggtcattccttggtcgcagcaatcactaattagcgttcatgtcctcctctgctcattttgagatctctctaatagaatctgcatgtatatccaaactttcgagttgtgtgatgtgacctgaaatcctgaatttatgattggttcttacagaacaggtgccgaaattgtatattgttactctggctcttttatgtgtaaaaatatatgatgtggattcattacattcttaatcaaaaacacttattcccatggaatgctaagaattgttcattcttttgaaaacaaaaatcacattttgttcttatggattttttttcacagtttgctcttcggaatgagtaatgggctaatggccacagtgaaatggcgccagcaacgctatactagatttttcttgatggtacaattgcatggaacacacaatctacaggtggaacataagaccctttttttgggaaacatttcgctattgttgcaacctcacacagctaagcagagactagttatttacatgctccatagaaggaagagattattttgcaaggctatttctcagaaacattctaaacaacaagtgaagacacaaatgcacaatggtcagaggccactaattaggttgctgcttgactctttttgaagcagttctggccagagcattgcatatctccctctttcttttcgcattttcatcagtcctgccagaagcgacgttggcctgtcgttccaatgcttccctcacaaagaatttcaacctccagagggttgtctcactctgcacccgcataggaagcatggttagaataaacaaaataaccaaaatattacagaggtaagtgtttggacagcacatataaaatcacctgagcatccatatcaagttccagttcgtctcctttagcttcgaagctagggttgtcttgtgcaaccatctccaatgccttagtaagctcttctggagacaggtggcagagacctgcacccagttttcttttctcatatgtagtcattttcctacaacatcaagattttggcaacatgccacgtgcatgagtttgacagcagttgcaacttataaacagcagataattaaatcgataggcaacagatgaacatttgtaagatgtaccggcatttctggaccaccatttgccgaagctcctccaactgcttgttgatttcaatcagctggaataagaaaccaaagagaacacacttaatatctaacagaatatcagaacattagtacaaggaatgaagagcaggagttgcaggcattttgtgtgtcagccttctagaaaaatcacaaaaaggtatatccataggtcaggaactcaggatatacacggctgctcaaattggccacattacatactcaagaattgaatccatagtggcacatctttattgacaaaccaaaaaaaaaaaaacataacaaaacacatttctgtgaggcctgagtgttgcagttcatattctgaatggcagtcaagtcattacattttgctttgtggaatgagtgatcattaaagctgccatcgatgtgccgaaaataacaaataacagtcaatgatgagcatacctcattgtcagtatcttttgctagttttgcaatagcttcttctggagaaatgttcacttttggaacaccgttggattcctcatccttttgtttcctttcctaaaaagaaaagttccaagttattactgtcaaatgctaagtaacccatatctgcagctccaaaaagaactaatatatgcttacaaacattcattcacctcattttcaactttaggaagaagctggagccatttctcttcaaatttctcaagcaatgatttcgccattatatgaacatcatgtcgttcatcattgtacttcattgcattggcaaaaattaatctaacatccgaatatatttctcggacattgttatacttgttgtcatctttcccttccattttcttttgtatggtcgaaaaatccataggtttggtgataatctgtaaataagacaaattgaaaacataaatatcactacaaactcatttcagggaggcataatatagtagtagtagatgtccaaatcaacactgcttgacaagcgcagagcaataaatatcacccaaaagaaaaaagaatgccatttaactgagatgtttatatttatatatagcaattggaggtctcctacaagctcccacgttaatgctattaggggggaagctggaacacattagcccatgaaaaaagggggggggggagggggggagtacaaataaccacattaatctgaaaagggaaggaaaagaaaagatgctaagcgttcatctgagaaacccatggatactctacaatagaacagatctactgtgtaaggaaacatctgattctgctagaaaaagaaaccaccgagtgatgtacactataagcataaaagaatcaatattaacacaccatctttgcatgtctgatttttgcaggattaagcaataaataaacagatagtagaagaggacaaggtagtaaaaaatgcctgacgcgacctgtgaaacatgaaacacaatccaaacacgcatagcacacatgtgcatagctgcgaatgaatccatgtttaaataggaaacaaatcaacaaagcaatcattagacaagagtacagcataccgtgcggtcatacctagttagcaagactctgcatagtcactacattgccaataaattaaacctacatggactcaaacacataggttctaaaaaggatgtactttataagaggtatttgcatctataaaaattaagaacgtgctgtactatcacaatattgcatatagtaggatagaatgcatacatgattattatgtgccatatatgcagatggaataaatcattcaaaacatttgaaataaaacgggcaagaaactttacaatttagaactacaaaagtaaaaatatcaagggatacaagaattctaaaaattatctgaaccatcgaaatatatgaactctaacaagaaagaacaattataagttcaagattaatcaacagaccatctggcaacaaatgttggtgcctgagccaagaagagggtcaaaattcaaaatgcaattatttacaaataagtcagcagaaaccatgatagaattagatttatacaatttactgaagattacaaaatcgagttaacagtaatttattgccgcacatattcaaaccagaagaataaatacagaaaatgaatttactttccactatttgccatattgaaatgtttgaattaaaagcttgtgataagtttattatagcgttaatactaaagctttggtccaaaataaaatcaaaggttgtgtttgactgattagaattcatacatgcatgttcttcaacaataaacggacacatatacacacacaaaccttaaacgtgacacggtagataatttgttatagatgtataattactagctcatgtgggtgcacagattctgactagttcatttaatcggttaccaagaaataaaataagtgtccctaatattgcaggacacatattgccaaatctgaaggatgcatccataaaccattaggattgacaaatcaatgctgcattccaagagtccaacatcattttggtcgtctgtaatcctaattcattatatcagtgtggaacagtgtcacaagtcgaacaagcgaactcagggaagagagaagagggggttcactctgctagcaaatacaagatgaaatgtgctagcagtattaccttgtaatagtcatcaagctgaaggcctaccacatcaaccggcttgagaaatggctcggcccattcatgagatgtgatctggaagaaaaggaaatcaagaaaaatattgagtgcatatcatgcgcatttcatttggaaagctagtagtgtgttttgagtgtcgagttcaactacgatcaatcaatatgaatttgagaggaaacaatggagcaagaccatacaaatttatcagcatatcatcaagctagatatatctgtctattttgaaggatgttttctatacatggttatggagcaaaattagaatcaaaactagcggcagaaatcttaattaaactgcacttatttatcattggaaataacagtagccacacgtgcacaagaccggacaataaatagctttctagattttttttcagttagacctatcaggtacagtagccatgcactatccaaaattagcctgcaaattaaaagcttttgcaccaagcacattctgaagcatgattcaggatacactaaatactttgagttatccatgccagcaagcaagaacaacatagatcaatgcatttgtcggatttttcttttttttttttcctctcgagatgtggttaagaaagatcacctggcgcacaatcgtgccaaactggcgcataagatcaggcatccctttggaaaggctgctatccttgcgaccagccttccggccaccactgccatgtttcttcccgtcgtagaatcccaccacttcattcaccctcctctccagctgcaatccacataaatctccaatcaaacctctacgccccaattatccgaatacaataaatgcaaaacaaagaaaaaaaaactgtaccctactgtttccctaaccaaaatccccaaaaccgcatactacagcgaggcgagaaggaactcgaaaatccttccgctgaagaatctcatctaccaggctaagcagcgagacggactacttccaaggttgggggagttggtatttatttacctggtcggtcttggagacgaggtcctcgacctggcgccggaacgcgtccacctccgtccccggggccctctccccggcggcggcggcagtggcggccgtctccgccgccgccatagccctccctccctccgccccctgtgggactccacctcccggcaccatatctagggctcgccgccacgcgcgtcgccggcggccgtctgcgagcgaaaaaggcgaaaccaccggcgcctcgactcgacggaatctttttttttattttttttcctttttttttgccccgcatctcttcttcccttcaccttccgaccctgtgggccggatgggatgggccatttcctgggccggaagacttcgccctgcaggatgtgggcccaaggtggggcggatggaattgttgggcctagtcagcctcgtgatttgttaacatgggccggagaaaaggctggggcgaacggtacaggggccgtagggcacacgtggaataagttcatatgagttccttaacttgtcaacgaatccgatttttgtccttaaaccccaaaaccagatataacggtccctcaactatcaaaaccggtgcagataaggtcctcgacggtttagatggcgattttttctgacgtggcgcctacgtggctattttgactcggtcttcatctgacgtggcgcttacgtggcaattcgatccggaaaaataataaaaccagtggaccccacatgtcagtttcacacacaaaataattaaaaatggtgggacccacgtgggccccacatgtcatcttcactcccctcctcttcttccttttcactccccatctcccctctcttcatctcgccggtggctgctgggaaagaagcagcgtgtgggcaccggccgtgggctccgcccggagggaggagaggagcggcgcgcgcgggcgtcggccggagagaggagagaagcggcgcgcgcgcgggcggcggccggcgagaaaggagccgcgcgcgggcgacttctccctctgcttcctctcccgccgcccctgaagacgacgacggtgacgggttcaacgaggagaaggacgagcacctcaccatcgctgccccgcccccgtttccaccgtcctccgcgctgcccaccgacctcgatgacgtcctcttcttcctcctctctccagaaacccacgggtcacgggaagttatgcggccgacggcggtggcggcggcaggtcatcagcaagtttttctacagtgtcgcgaacaacaacataggcagccgcgcaaagaaatcccatttgcctcattccaccacctagtgtcttcctaagaattttagcctgaaagtccatatttccatcgttacatcccatctgcagtttaaggtaacaagttaacaagcacaattgaacagaccttttctatgaaggccgtcgaaccaacaataactgatccaacaggagcgcctaagccttcagatatgcacacctgcagtgcaaatttccgtcgacctcctcgcaccgctcttcaccga

SEQ ID NO: 85073 - DNA, 514 bp, Oryza sativa
aaaagaaagatggttcgtggagattttgtgtggattatcgccatttgaatgctatcacagtcaagaacaagtatccattaccaataatagatgagttacttgatgagttagcaggggctcaatggtttaccaagcttgacctacgtgccgggtatcatcaaatcggaatgcatatagaggatgaacataaaactgcctttcaaacccaccatggtcactttgagtttcgagtgattccttttggtttgacaagcgctcctgccacatttcagagtgtgatgaataatattctatctacattgctcaggaagtgtgtgcttgtctttgtggatgacatactcatatacagtcgaactatggaggaacatttgatccatctacagactgtgtttcagatcttacataaacatcagcttaaagtcaaaaagagcaaatgttcttttgctcaacaaaagctggcttacttgggacatattatcagtcctaatggtgtctccacagattctgacaagat

SEQ ID NO: 85074 - DNA, 7900 bp, Oryza sativa
  unsure (1)..(7900): unsure at all n locations
ccttcccccccccccccccccgccccctacccctcttcccccgttacccgcgcttctcgtgcagtcgtgcgctcgatgtggttcctgtttcgcttcactgtgctcgcatagtcgcatcgaagcggacgcctggctgcgcgcgtgcgcgatttggatcaacgcggaaaggtatatcgaatgagagaagctgaaaaagcgagaaatgacctggttattgttactgcagattgcgtctggtttcctgtgaaattttcttcccgcaaaacgtcagggtttaacttggtaaaactgggaatagaggaaagctccctgtgctgactttgaaactatcgtctttaacttgaagcctcttttaagttgaagccgccgtttagattgagactaactatatttatggcgtcacaatttcttttaccaaaaaagagactgcaaatgaacatatatttacattgtgtagtaattttgttgtaacttataaaaattacactgtcaatttcagtactgacattgtaattgtaaattttcgagtacacaccatataagagaaagagggaatatcgattgattacctacctgataaaggagatgtaagagatagaaaacatatttacatataagaaaaaaaaatgtagcaatcacatagggaaaaaaatgactgaaatcgaatcgaaactgtggcgctatttctttttagcaaaaatgctttaacttacatctttttatgcatataaggtagggcgactttaacttacctttgctccagggaaactaaagcttgctctagttggaagctaacttgagctgaattagccaattagccatcagaggaatgatgcaagggataatgcttgcagcgttgcttgttctttgccagttgatcaaaaatgcaggcaagatcactgatgctgcgtgcatctccagtgagagggacgctctgcttgctttcaaagccggtttcgctgatcctgctggaggggcgctgcgtttctggcaaggccaagactgctgcgcatggagcggggtgtcctgcagcaaaaagatcggcagtgttgtcagcctggatatcggccattatgatctcactttcagaggtgaaatcaactcatctctggctgttctgacacatctagtgtaccttaacctgagtggaaatgatttcggtggggtggccatcccagatttcataggctccttcgagaagctgaggtatcttgatctttcgcatgctggttttggagggacagttcctcctcggcttggtaatttgtcaatgctcagccaccttgatttgagctcaccaagtcatacagttactgtcaaaagcttcaactgggtgtctcgcctcacttcactggtctatctagaccttagttggttgtatcttgctgcttcctctgattggttgcaggctacaaatacgcttcctttgcttaaagtcctctgcttgaatcatgcgtttcttcctgccacagacttgaatgctctttctcataccaacttcacagccattagggtacttgatctgaagagtaacaacttcagttcacgaatgccagattggatttcaaagctaagttctcttgcatatttggacttgtctagctgtgagctttcaggctcacttcccaggaaccttgggaacttgacatccctcagtttttttcaattacgagcgaacaaccttgaaggtgaaatacctggatccatgagtaggttgtgcaacctacgccacattgatttatctggaaaccatttctcaggagatattacaagacttgctaataccttgttcccctgcatgaaccagttgaagattcttgaccttgcactcaataatctaaccgggagtctgtctggttgggtcaggcacatagcaagtgtaactactcttgatcttagtgagaactcattatccggacgagtatcagatgatattggcaagttatcaaacttaacctacttagatctttcagccaattcatttcaaggcacactgtccgaactccactttgctaatctgtccaggctggatatgctaattttagagtccatttatgtgaagattgtcactgaagcagactgggtgccaccattccaactccgagtcctagtactttatggatgtcaggtaggaccacacttcccagcatggctgaagtcacaagccaaaattgaaatgatcgagttaagcagagcacagatcaagagcaagttacctgattggctctggaacttctcatcaacaattagtgccttggatgtctcaggaaatatgattaatggaaagttgcccaaaagtttaaagcacatgaaagcgctggagttacttgacatgagttcgaaccaactggagggatgcattcctgatctgccatctagtgtgaaagtattggatctgtcaagtaaccacttatatggaccattgccacaaagactgggtgccaaagaaatatattatctatcactcaaagacaacttcctcagtggaagcatccctacgtacctatgtgagatggtttggatggaacaggttcttctatcactaaacaacttctcaggtgtactcccaaattgctggaggaaaggttcagcgctgagagttatagatttctcaaacaataacattcacggagaaatatcttcaaccatgggtcatctaacttcccttggatcattgttactccacaggaacaagttatctggtccactccccacctcactgaagctatgcaacagattaatctttcttgatctttcagaaaataatttgtccggaaccataccaacctggataggtgacagcctgcagtctctgattctcctcagtttaaggtccaacaacttttctggtaaaattcccgagctactatctcagcttcacgctcttcaaattttagatattgctgataacaatctatcaggccctgtacccaaatccttgggaaatttagcagccatgcagttaggcaggcacatgatacaacagcaatttagcaccatttcggacatccatttcatggtttatggtgcaggtggtgcagtcttgtatcggttgtatgcatacttatacttgaatagtctacttgctggcaagcttcaatataatggaactgccttctatattgatctctctggtaaccaattagcaggggagattcctattgaaattggatttctatctggactaacgggtttaaatttgtcaggaaatcacataagagggagcattccagaggagttgggaaacttaagaagtttagaggtgcttgatctctccaggaatgatctgtcaggcccaattccacagtgcttcctgtcattgtctggtttgagccatctgaatttatcatacaatgacctttcaggagctataccatttggaaatgaacttgcaacttttgcagaaagcacatactttggtaatgcacatacaactgtcaagaagctgtttgtaccacaaaaggaagcatcaactaaactttgacacgggaacatacttaagtgcactgcttgggtttgcatttggattctgtattatgttcgtcatcctgataccctacatggttgcatgaaagactcttatgatagcctatgctttggattggctattatgatatatgaagattttgttttatagttagttgagcattgtaatgattttatccgaacatatttgacaggtgggttaagcggtgtaatgcactaaggcttagctcttttcaaattattactccatccgtttcaaaatgtatggcaccattgacttgtcgcataacgtttgaccatttatcttattatcaaaaatatataaatattatttattttgttgtgacttattttatcatcaaataaaatcgactataattttacatatttatactatatcttttaataagacgaatggtcaaacattgtggaaaagtcaacggcattatactttttgaaaaggaggtagtattatttctcagattatcgaaacagattatttgctctatatttcgaagaataatttaaaaacagattagtttttttcaaggatctgtttaataggggtttcaaatccagtcgataggtttattcagaaaacaagcaattcaagaaccaacttcaaatggaacaggtttaaaaggagtgctcaggacactaaaaagcttctatctttgacttggaagacagctcactaatactaccttgacacatgtgatttttttgacaaatgtttgactatttgttttatttatttttttaaaatataaaatatttccattcaacgataaatcaagtcacaataaaataaatgataattacataaactttttaaataaaataaattgtcaaacatatcctaaaaggaacagcatcgtatattaaaaaccggagggagtaagagttaggcgtcgatagagcattaattcggtcgtttcagggcttctatagccggcccggtgacgacatcctctggatacactcgcaaggcccactagctagcgagcccccttcgttcctctgatcctctccgcttcacgccgtgctcgagccgagcgatcgatcgatccacccgcaccgtgcacccggccggaatggaggtggcggcggcgggaggtggtgnnnnccgccgctcccgccgccgcgcggagcagcccccgccgccgtgcaggccaaccaacgacgacgacgccgcggccagcaagctgtgagtgacctaccgaccgacccacccccttcccttacctctccattccgcgcacggctcctctgttgttgcgcggatgctgcgctctctctctctctctctctctctctctctctctctctctaccactgcggcgtggttggtggtttcgaatcaattcggttcggggcgtgctgtttgttccgcgctgtgttgcggtagagaggcaaaagcgagatgtactttgatattgatgatgtaatggcaaggggcgtgtggttttaaccctaagattttgtgttcaatccgctcacaatttcttcttaaaaatatgtttggagggatgtatttcctccaaatctccttttattattatttttggacctaggcaaaagcaagagaagcctgtaaacctggtgctgaatcgtgatgctaaaaaaatgtcataacaagcaggagagatggtttgaacagtttccattgatgctcccgagttgcacacaccacttaggtgcctctttccggcgagggttcatgcaataaataattgtaatgataaattggtgacaagggagctattcctatttcaccaatttgtattgaaagacgtccttttattgcgcggcatagttggccggccacttacatatatatagttgtatgtgttcttaatttttccctgtttgtttggagcggattgatgctttagatagcggttagccgatattgagtggcattggcaccctcaacttctagtgcttatgtgggctagtagcgttcgtaacttcgtataaagagacgatctaccttgaactcttcagcatgcatttatgagactgtataggccaatatcttgaacaatgaacaaataaatgtatagacagtgcaaaaaacatgcatgcaagatgtgggggtattgcttatacacttatgtcattgtaggttgcatagtagaaatcacccatttccctttgcaggtcatgtgttaataaaggatacatgaaggatgattatgtgcattgttaggcaaataacaaaaggggctccaataataaattgaggtatgtagtacctcattgaatcttttatctgcttctctacaattggaaattctaatttgttttcctttccaaataactctgtgaactatgcacgttgatctgttcttgggaaccttctgcgtcagttcctcagtgctggaaatgtcaggatggtcaaaagaggaaacagaaacttggtgctgctttgatacgacattcttccagttgcagaaaaagacagagcccacgcacgacgtggatatagggacagcttgacttcatgagtagactttgattgcctgagtctttaggttggggttcaaggtctggaagagaattacacatgactttaaccccgtctttggctcttctcttcttatatctactctggccttcatggaaacttgactaatcaataccctagcaacttctgtgataactaatcagaagctaacttgacagtgctagtcacaggctctactggatgtccgtgatgagaggaaggatgcaaggggtgtggcttgcagcattaatctccctcctttgccactctatcgcaaacgcagggaaggaagccgctgctgctgtgtgcatcaccagcgagagggatgctctgcttgccttcaaagcaggcctttgtgctgactccgctggtgagctgccttcctggcaaggccacgactgctgctcatggggtagcgtgtcctgcaacaagaggactggccatgtcatcggccttgacatcggccagtatgctcttagcttcacaggtgaaatcaactcatctttggctgctttgactcatctacggtaccttaacctgagtggaaacgacttcggtggtgtggccatcccagacttcataggctccttcagcaagttgaggcatcttgatctctcccatgctggttttgccgggttggttcctcctcaacttggcaatctgtcaatgctcagccaccttgctttgaactcctctacgatcagaatggataatttccattgggtttctcgcctccgtgccctcaggtacttggacctcggcaggttgtatcttgttgcatgttcagattggttgcaggcaatcagtagtctccctttgcttcaagtgcttcgcttgaatgatgcatttctccctgccaccagtttgaattcagtttcttatgtcaatttcacggccctcacagtgcttgatcttagtaacaatgagctgaattctactttaccaaggtggatctggagcctgcattctctttcttacttggacttgtctagttgtcagctttctggatcggttcctgataacatagggaacttgtcctccctgagttttcttcagttgctggataaccacctggaaggagagataccgcaacacatgagtagattgtgcagcctgaatatcatcgacatgtctagaaataatttatcagggaatattacagcagaaaagaatctgttttcctgcatgaaggagctgcaagttctcaaagttggcttcaataatctaactggaaatctatctggttggcttgagcacttgacaggtttaactactcttgatctcagcaagaactctttcactggacaaataccagaagatattggcaagttatcacaattgatttacctggatctttcatacaatgcatttgggggtagactgtctgaagtccatcttggcaatctatctaggttggatttcctgagtttagcatcaaataaactgaaaatagtaattgaacccaactggatgccaacttttcaactcacaggtctaggactacatggttgccatgtaggaccccacatccctgcctggctgcgatcacaaaccaaaattaagatgattgatctaggaagcacaaaaatcacaggtacattacctgattggctctggaacttctcttcatcaatcactaccttggatatctcaagtaacagcatcactggccacttgccaacaagcttggtgcatatgaaaatgttgagtactttcaatatgagatcaaatgtacttgaaggaggcattcctggtttaccagctagtgttaaagtgctggatctatccaaaaacttcttgtctggatccttaccacaaagcttaggagccaagtacgcttattacatcaagctctcagataatcaactgaatggaactatcccagcatatctttgcgagatggat

SEQ ID NO: 85075 - DNA, 738 bp, Oryza sativa
gcgcattcacctactagtggtacagtagttcatcattcgttgaagaagagaggagagagatcgaggtaggatattggatatttctttcagatcagttggtggcttgtcgcttgagcttgacaatggacgtggccgggggctgcaaagaagtcgaggaggtggaggctgttgacggcggctatcacagacgccgatggagatcggttggcccaccgacgttcgacacgtcgaccacgtcaacttccaccgagtacatggcttgcagggccctcccgtggagctacagcccgaggtctgcggaaacgcccctagcgcaaggtaagcgtcttcttgttctccatctgcggcggccagagctgcggctgacaactgtattattattatggatatggaatattgcacaagacggtgttcggtgtgtcacggagtcgatgcactgctcgtacgacgcgcgggggaacagcgtaccgagcatactcctgctgatgcagcggtggctctacaagcatggcgggctgaaggctgagggcatcttccgcatcggcggcgacgacgcccaagagcaagctgtccggtagcatctcaactacgcttgctcgcgagaggcacgctggacgtgcactgtctggcgcggctcatctaggcctcgatctcggagctcccccgctggatgctggactccctggccgcaggggacgtgacgcagagccaattcgccgacgactgttctgagctgtg

SEQ ID NO: 85076 - DNA, 757 bp, Oryza sativa
  unsure (1)..(757): unsure at all n locations
agtgggcacatatcaagtatctgcttggagcaatgttttcgtatgtgtattccgnatgcccanttcatttcggttagtcattatcnatttcagttggaaaatgcaatcgtatgtttggggtactataagtgatcaaggggtggtaactcatatcacaggggcaaactttgcacagagttcccattacgattaatgggtggctccgagttttcttgtgggcacaagcatcccaagtaatacagtcttatggttcttcattatccgcatatggtctttttatcctaggagctcattttgtctgggccttcagtttcatgttttttatttcagcggcatgcgttgctgactcgctcccatttttggaccattaattgaatggattattacataggcagtccctgctacaatcttgttgatcaacatatggaaattgttatactttcagtagcacattttttagatttttattgaccgatggttgtattttaatacaaagtacactaaggcatcctgttggtaaaagggcatgttccccttcgcaggttgaatctttatgacttggtatgtttcactgatcacccgttaacattatttaattgaaatttagccatagtggaaatataattttttggggcatattcaccttctttgtgtgacctctcttcatgtaaggcctgtcatgttgtagcaaaaagagcatttcgatatagacaacatctggtgatgaactactgtaccatatagaggcgaatccgcg

SEQ ID NO: 85077 - DNA, 741 bp, Oryza sativa
cacaccttagattgcgttctactgcaagtagttcatcatttcccttcccttgcgattggcttgggcgagggggaacatatcaagtatccgcctgggatcatgttttcttatgtactattctggatgtacaactccatttcggtagtcattttccattttagtcgctaaatgcaatcctatgtctggggtactattaactatcaacgggtggtgactcatatgacagggcgaaactttgcacagagatccactacggatcatgggtggctccgagagttcttgtgggcacaagcatccgaagaaattcagcttatggctcttcattatccgcatatggactttttttcttaggtgctcattatgtctgggccttcagcttaatgtttttattcaccggcatgcgttgctggcttgctgccatttttggaccattaattgaatggattattatatcggcagtccctgcttcaattttgtttatcaacatatgggaattgatatactttcagtagcacattttttaaaattttattaaacaatggctgtattataatacacagcagacaaaggcatcctgttggtaaaagggcaagatcaccttcacaggttgaatctttatgattatggatgattcactgaataacctttgcattatttaattgcaattgtaccatagtggaaatataattgtttggggcatatttaccttctttgggtaactatcttgatgcaaggcctgtg

SEQ ID NO: 85078 - DNA, 537 bp, Oryza sativa
  unsure (1)..(537): unsure at all n locations
cacggtttggacactctnnnnnnnnnnnnnnnnnnnnnnnnnnnnnnnnnnnnttgttgcttttgaacatctggtacagatctgttagtaaatttacatgccctaatattatgattattttatcgtaaatcagatggttgaagctaaattcacaacgatgcttaaccactcaaggactcttctgagaaaaagatggctatatggtatttttgatgatttcgtgacgaagcagctacctcacaatgtgacatggtggtccaatgacttgtacagtaggatagttgctactcgtgtgcacattgcacagtaggtggggtgtgtgaagggccacaaaacacctcttgttattgcttcttttgttgcatatatgctactgcaatcagctatgattttgttcagtctgtgatttgttaatagacagttgcccctgtccgaatgggtcctctgaatgtcaaaaatttctgccactgtttcatcgagcttttttatttgtgggatgggatttatatctaggtgatattaactgccacattgaat

SEQ ID NO: 85079 - DNA, 6735 bp, Oryza sativa
  unsure (1)..(6735): unsure at all n locations
tttcaccaaggtctgagcaattcttttagaacgaatgaatatttacttaaccagaatagtagtgtggcaacctcacgtttgcagtttgtttgttaactgttcaacctgttctgttagtctgagaaatcaaagaaggctggacaccctccttcaactactgttgttgttgaattcctgagaactacgtacatgggaagcctagaggtccttctactggaagaagatatgaatttcaatgcccgtgctacatcattcaccgttcgtgttctctttctattctttctgacgttcccactataaagacatgtttgattttgaaaaatccatatcttcacacaagtatcgatgttcctctgcaggaggtcaagggaaaaggctttcttctagtttccactgacatagcaagcagagggtttgacctcccacaaaccagccacatatacaactttgaccttcccaagacggctattgactatctgcatcgtgctggaagaactgggagagaaccattctccaagttagcttgcagcgtgacaaccctcataacagaggatgagcactttgtattacagagatttcagaatgaactcaagttccattgtgaagagctacctgtagaatccatgttcgcatttaacttgtgacgtccctcactggatgtaaatagccatttctcttgatttcatcccccggttggaggtttttcttttttctgtttaatctagatgaagaggtttgaacaagtgtcctggttattttccctctggagagtggagaaagatgttgaacgtatttatattaaagcataaagttgttatgtatccttaatccttattcactggattgtagcttttttaatggaaattcccattagttgcaacagggttatacccctgaactcttcaatatccaaccagcattgactcgaaaataacagtatcaggcgatgaacaaggtaatctgaacatcctgttcaaagatttagaattcaaatgttaggtctgccttcggcgagagcatgattaggtacagagcacactcatgtcacacatcacactcttcattatcaacagaggagagaaatcggtccatcactcaacagagaagagagaaatcgatccatgagtgatgcggatggcagacagaaactatgaacatgatactctagtactcctaccatggaaactgttcagattcatgatacgagccaggaaaacagatgcaagattatatttcaggtgcgccaggtctgcagcatcaagagaagcaggatgggctcttccgcaaattactcttctttagtctccagcaatttggaatcgcaggccacgatcttcaccttgtttattgtctctgtaatctcttcgttcttgaaaattgcatctgttaggatgaaagtccacacattgtcgcagaacctgtaggtgtgcagatggccctgtgcagagaaaagggaaagccatcactggaaatgcaggcggtctgaactatacatgtgaatactttcaaaaggactcatggcaggaaagcacagtcaatgtgctaaacataagaaatctaattaagatatatgtaacacatcgacggtcttgagtgaagctatatattggcatatactcatcacttcgaatgtgtaacctcaatgcacaataaatcatacagaacttgaattatttcccataaagtacaacacaattgcaaaagataatcatgttacttcaaaagctttgcagaagtagccatcttcgacatacatgacacacaataaaagaacaaaattaatcaatattatattccagttatttgtaggtttgtccaaacaggaaccatgattgaaaatgttgtgcaccgctacttgaccttgatatttagaaattaacatcagaacataatcaatcaatattccagttattttcatggaaatttggattgtcccaaaagtgcttaacttattggtcacagtcattctcacagaaagtctatcgaattggtgagtagcctatgaagcaagcaggaattgccttcccacaaaagaatacacggtagatctaaaagaagactcctatgccacaaacttaatgacatgccaacatgacatagtaataatgttatctatagactgcactctcagtactcatttgcattgcataacttggatgtgtgcaaacaccatagaatgaattgatgattaacaagataagtcaacagttagaaagtttactaattcataactaaataacaacaatacggcattctcatcgattcctttttttaaaaaaaaatctacagctattaatgaaacctacagtacaaaaagagaatcaatagaaagagcataccttgacagtaaccttgctcttcacctgatgctccaaagcgctagtcatggactgaaacaacaagaacatccatatatgaaaaacaagtaatccacatccggcagcagtaatgaaggagaggtagggggttaagaaaccttgtcaaactgcacgaggacttggatggcgagctcggggctgagcgccccactggagaccatgtcgtccagcgtgtcggtgaggcacataccgatggtggacctccggtacagctcgaaggtggccatcgatgatcgaatatcgatcccctccctcctgcagataggcagcccagatacataaaaagtttaagatcggcatgcaaaggctgcggaaacgaactaatcaaaatcctccgggtctgtttgccggccagccgccgcaaatcaaaatctagaaaattcatcgatgtgatcgttcgtgcatatacacaagtatcgcatccctccctccctctatttggtttggttgggtgcggtgcggccaatcgaatcgagggcacaaaatttccctaaaaattagatcccgatcccaacaaaaaatcgcatgatcgaatcgaaccaagcaccagccgcatacctgatctgagactgagagcgagagcggagaggaggattgaggggaggagcaaagcgcagccgcagagaggaattcgaaatctggggcttatataccgatggaggccaggggaagggaggaggggatttggggattatataggcaggggaggcagcagcaaggatcgactatgtcggtgccaaatgccgattttgcccctccctctcccgttgacctggtcaatgcatactgctttatttccttttcttttttttttcatttcatttcattattattccttttccttttttcctttgattattattattattattattattattattattattattattattattattattattattattattattattattattccacgtcatcatttaccttttcatcatatattattgttctcgcttggtttagttacatatagtcgcttggtttagttatacatagagaacgtatttggctctcttttgtgttaatagagcgtttcagctttcaacctccagaaatatatgccacgttgtattggtttttcttactaagccaggatgggtgaaggtgatgaagagcacgatgaattaaagctcactagtaattgacccgtgctaacgctacggtaatatttagtaatgcaaattaaactattaaagtttatcattcttaaaaaaaagaatgacagagccaattactatattgttaattacatagcgatgtgagtaaaataacatcgtgacttttctatcttttgatttgaaacaatgcaagcctattgtacaacttcacaatcaggcatagacatagaagtctatagcatctaatatttgatatatatgtggttttcaatagattttcagtctccaaacttttccctttataaagtgatcacctggcctaagagaattgagagtccaagagaccttgcatcttctttccctcagtagaacatacatacagagcaaagacataagttgagtctgcaggtggctttgttgctcacccagtcaccaaggtcttcccaccgatcagaaagtactataaacttattggatctgggaaacaaatttacatgtgcatttcagccaattaaatgatccaagtacttaagtagaccaaaaatgcaacatgcttcagcttggtgtcatctacctcaaaagctaatggcggtgaaagtttacaaaataaatttccagttcacatatagtaccaaatgatctggaacgaattcacttttntggggcaggcaccgggggcccaacgccccttcaaaatttggatttcccaaaatgatattaccgctgatgttcggaatttcagattttcagactttcaaaccaaagttaagactttcataattaacttttatcaatgaatattccaaagtttagactttcagaatcttaaccatggtaacttataacttaaactgtcttatcatgtgcttccatgtatgcctatttacattctgaaattttaacatagctatatacatattctgaaatataccatgtgttgaatgcctgaatctgaaacaacaacattagttttctgcaagtattcattaaaaaaatatgcagcaatcttgtataatgtaccaaactacccaagcaagacaagcaagatgatgttgattttaggttctgaattaaggtaatgtaataagaaaaagaatatatttctaaaatttaatgattttcctcatcaatttgactatatcacaaatatactccatacattaattttcaaagcataggcataaagcttcaaaatgcaagccatagataaacacttaaagtgcccaaagcacaaatttattccatcacatgtcaaaatagagatcattatattttctctaaatagaaaatatggggtaaataaatgaataaagttcagaagtgaaacaacccttgccaaagcccgccaaacaactatgcattccaacattgtgtacattattgagctcagaactaacatatgaatttcagtcgatataacacatgaatctgtcatgtactgcaaactgaaatgctaattttgtaactccaatccaatatgaagaatcgatgtttgttggtgacaagaacgaagtggtatttaggcgcaaatataaacaacttaaccgggagataagcaacaacccaagcgtagaacctatcaggaatatccttaacctttagctacatctaccttccagcacatctgaaaaagttgctcccatgttgtacgctggtggatagcagagggcttcgtgcaagggagaggtggaaacaaaatgcaggaattgagaaacactgtatgaagacagtgacctgatgttggcaagccagcacacttgatgactgatagcttactttatggagtaaaatggacaatttccttaaaaagaagaactgatgaagaaccactacttttactgcatcagttgttaaccaatagtattaaatttaaaagtagcaaattatcatgagttgctcatataatgctgaatgttacctgaccaatatcggcacagtagaagtaggaaggcctcgcggaatcaaagctgcatctccacgggtttctaagacccaatgcccaaacttctagttctaagtcactgtcatcagtgtatgggttgtcttttggaatggagtagttaccccacaagttggttagcaatttcactctgtcctgtaaagggaaaaaagggaacaaattatcaaatagagtacatgttgatgctccatatattgctaattgtttgtcttatgtgagaggagatttatcacaaataaatatgtgaagtcatttgcaaaaatttcagttcgtatgtttgaagttcatcagaaacatatttatctacccaccccggtatctacttacacaaatataagtagtgaatccagataactgggttgttgctatatgggaaaaaattgcagcagtagcagtacctatctcatgacggtggaaaaaagacactcaaatcaatttgattacctgtatcaccatcctgttttgcaactcgtagcaaaatggagtacagtaataaaatcctattaccagttgcaatagtacaatggaacttagttgattcccataatttgtagtatacacatgatgacataaagggatggatggggtctagttgtacaagaagggctctgcaacactattttatctccattaccaaattctctgtaacactattctacgtgcattaccaaaatcagaactcaaaaaaagcaggaattcattcagttcgtaacctggtcaaattcttgtgagcaaaaatttaccttgggcacagaggagatcggcaaaggtggccgtcggtgacgatgcggacgggagagatcgacgctagcggagcagatcggtgagcggccgtcggtggcaatgcggacgggagagatcggcttgggcggaggcgcggaggagatcgacgacgttggtgacgccggccgacggaggagggatggccgttgttggcgtggcggcgtcgcgatggcggatggcgctggatagggcgatggcggcggcgtgagagtgcggcgtcggcggcgtgcgagagagaggaggatgcgtgtgaggagcgtgattgggaggatgcgcgtgaggaaaggggagaggaggacgcgcgtgcggaggggagggtccgcgacgattttgaggcgttggatcaaatgattctggaccgtcagatttgatgaacggggtttgtaggagtgtagttggtgaattatagggtagatgcaaccacacaattagtgataataataataatcataaccatcccagatcgcaaaacggt

SEQ ID NO: 85080 - DNA, 741 bp, Oryza sativa
cggtgaagacgtaggcgcccaacatcggcggcataataggccagccgtgcaggcgaggacaccagtcggcggcagcaaaggcaagccggtcggtgaagacgtaggcgcccaacaacggcggcataataggccagccgtgcaggcgaggacaccagtcggcggcggcgaaggcgagccggtcggtgaagacgtaggcgcccaacaacggcggcataataggccagccgtgcaggcgaggacaccagtcggcggcgacgaaggcgagccggtcggtgaagacgtaggcgcccaacaacggcggcataataggccagccgtgcaggcgaggacaccagtcggcggcggcgaaggcgagccggtcggtgaagacgtaggcgcccaacaacggcggcataataggccagccgtgcaggcgaggacaccagtcggcggcgacgaaggcgagccggtcggtgaagacgtagacgcccaacaacggcggcataataagtcagccgtgcaggcggaaataccagtcggcggcggtcgaggcggccggtcggtgaagatgtagacgcccaacaatggcggcataataagtcagccgtgcaggcggaaacaccagtcggcggcggcgaaggcaagccggtcggtgaagacgtagacgcccaacaacggcggcataaaggctagccgtgcaggcggaaacaccagtcggcggcggcgaaggcaagccagtcggtgaagacgtagggctgcagg

SEQ ID NO: 85081 - DNA, 739 bp, Oryza sativa
agtcagccgtgcaggcggaaacaccagtcggcggcggcgaaggcaagccggtcggtgaagacgtagacgcccaacaacggcggcataaaggctagccgtgcaggcggaaacaccagtcggcggcggcgaaggcaagccagtcggtgaagacgtagacgcccaacaacggcggcataaatgccagccgtgcaggcggaaacaccagtcggcggcagacgaggcggccggtcggtgaagacgtagatgcccaacaacggcggcataaaggccagccgtgcaggcggaaacaccagtcggcggcggcgaaggcaagccggtcggtgaagacgtagacgcccaacaacggcggcataataggccagccgtgcaggcgaggacaccagtcggcggcgacgaaggcaagccggtcggtgaagacgtaggcgcccaacaacggcggcataataggccagctgtgcaggcggaagcaccaatcggcagcggcgaaggcaagccggtcggtgaagacgtagacgcccaacaacggcggcataaaggccagccgtgcaggcgaggacaccagtcggcggcgacgaaggcgagccggtcggtgatgttctgactgatccattcctggagcgtaagagataagcttaaagccatgaatcccttttatgcatatctggatctggatcctgcagaacaaacatataggatgagtagtatctgatatataaatataatactcgagggggggcag

SEQ ID NO: 85082 - DNA, 746 bp, Oryza sativa
ccagcggatatatttcgttctactgcaagtagttcatcacattcacctcagtagctagctgcatgaccagagatgctagtttcggatgttcatcaggatccatacttccaaaagcaagtgccttgaagtagtaccaaaactcttcttcggatggcctcttcaccctgatgggttgggttgtcccaaacttagcaatgtcctctgttgtacctatcactacaaccttaattccaataccgggcatattctgcaaatatgattggaattttgtccaagctgcctcatccacatcccaaatgaactcaataacaaacaaatatttcccttgagaagccttggagttaagcgagagctctccggtcttcagatcgtcttctttaaagaaaaatatatgggagaagcagttgcgcaccctctcatccaggcaagcatgttgcacaagagttttctttccaatccttggtgggccaataataggaagaatgctaacatacggatcatgaggatcattgcaaagcaagaaattgatgacttgctccttctcaatacggctgccaaacatacaattctctatgtatagatatgtactgtaaggctgacgtggtagacgagggtggctaccaaggagaatgacaaattccctcatatctgcaatcttagtttctaaaccatcaacaacatcttttgatgaactactgtaccatctgattaggcgcatggtcataagctgtttctgtgtgaaaatg

SEQ ID NO: 85083 - DNA, 4707 bp, Oryza sativa
aaatgggtggtgagggggggcatggaattttgcaggcggcccccttgctgccctccgttagggcgattttgcactgtgcggggggccgcctgcaaatgggcggcgagggggcatggaattttgcaggcggcccccttgccgccctgggggagggcgattttgtactgtgctctatattttttttgtatataaatatcaatagttatcaaatctttttatattgaaaactatacaagattaaaatctccaagactggtaaaatacaattttattattttttagggcatatttggaatgttaccgtacaaatattttgttaatgccaaaatataagcaagttttggcactaccaaatatttggtaaggtaaaattgcatttgatcatatttggtttgctgccaaaatgtaaaattgtagtgaagaatgttgtacataatctcaattctagattacgtattaccaattaataggcttccattttcgtgtgtggtgtggtagttggaaagaagatatgaagaggttgccttcagattgtcaattatatagcgtcgttttcagtgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatatggcactaccgtgaagcgccgaaagtgtgttgttgtgagcataagttgttcaagcaccatatgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagactagtacgtcctggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtacaggtatttaacagtattaataaaaagtaaagtaccgtgtgggtgagggatcgacgctccgtgggacgaagagctggcgaacgcgcccgaagaggtggcgaacgcccctgcggagctcgcggaagcgccggtcgtgcctacgaacgcgctcgaatgcagacgaggtcctgcgatgaggaaacgtgcagttaaaacatggtgacacattcgtgcaaaagctgaaacaaaaatgaactaatatctgggctgaactgtaccgtgcgaaaccggtgctgtaggtcgcactgctccgaagctaggggcgctcgaagacaaacgaggtcctgctccgacggtaggcgcgcgaggccgtgggtgtaccggaccagctggaggtacgacgtccacggcgctgcgacaggagaagacgcgcatgaccgcacgcatcttctcctgcatccggtcgaaggtcgccctctgctcaacgtcagtcaagtgcaaacctctgttcaacctcacctggactgcggtgatatcggcactgatatcccgtgccgcatcagcctatgcaagatggaaataaaaaattcagtagttgtcctatattatgcaagataaatgacataattgttggaagtaatacaaattggacgtaccgccacgaagtagtctcggtcacggtgcgtgggatacgcgtccgtgacagcggcaacgtgcggctctggggcgtctggagtgaaggtcacacgcgaacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattgtatggctcgatgatgtaattaccataaaaatttagaaatgaacaatccgaactcacgagtggtcggcaggggggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgataggaattagacatgttatgtgaaggaaaaaaaagaagaggactgataaacttataacgcagcgaagttgcactaaccccacgtcgacaccagtaagtccccatcgtgggaccgtcctctggccactgcgcgctgcgaccaaccccgtagggtgcgctgtccaccactggtcgccctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacctacccgaacaaccacaacaggtacgcctcaagggagcgtcggaccgagtaatcatcagcgtcagggtgcagaaggtccgcctacagttaagaatgaaatgttagtacaaaacactcatccggtcgcaaataagcatgtatgataataacaacttatttactacaagtgaactggagcaaccaagccttgctaagcccgactgtagagtacggaggaagggtggtggtcggtcctaggtgtggaaggcgcatcacctgctcgaagcgcgcagtgatatcctccttccacccaaaaacaccgtcgacgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtgcaaaacaaagcaaagttgagttcaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattatgatacaacaccgaatagttcgcaatactactagtacaacaatagtcggaggtactcattacaacaagattgaattgaaattacacgatagaagtatttagtccgaacactcattacatcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactacaggtacatccaccatccgccttcaagatacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtaggcttgg

SEQ ID NO: 85084 - DNA, 504 bp, Oryza sativa
aacaggaggtgagtgctgaacaatatcattaacatcattaccaacaatttcagtttcctgatcatccacgtgctccacctgcacgctaacatattgctgctcctcatcagaaccacctggtatgacatctgtgggcaagctgtcattaaacataacagattcattgaaaacaacactcctgctcatgaatgtcttattagtttcaggattccataacttatatccttttactcctgaaccataaccaagaaacagacacttaatagctctaggctctaattttccattatcaacatgagcataagcagtgcatccaaaaactctcaactgtgaataattagcgggcataccagaccataccccaataggagttttcttattaagtgggatagaaggcgacatgttgatcaagtagcaggcggtgttagcagcctctgcccaaaaacgcttgttcatgtgaacgttggacagcatacaacgagccttggagatgattgttctgtt

SEQ ID NO: 85085 - DNA, 2933 bp, Oryza sativa
agatatgattctctacatcaaccttgtgcacatccaaatccaaaagagaataacggggtgcatatccaaatccaaaagagaatatattggtgtaatttcgattggcgacatcttagtgatgaactctcgtcgagatcgaccacaactctcgcgaatctcgccgtggaactcaataaagcatcgctaatgttagtggagacgatgcgatattgtggatgcaagacgagggtttccttgttggaataagttcatctaaggtcccttaacttgtcaataaatccaattttcgtccctcaaccagaaaaccagacacaacgggtccctcaactaccaaaaccagattaggtccctcggcggttttgagggcagttttggctgacgtggcacctacgtggctaatttaactcggtcttcatctgatgtgtcattgacatggcgcttacgtggcaattttgtcgcgaccgagaaaatttgcattttcccgaacgctagtgtattaatccccgtcccaggaaaagccggggtacaccacacaaacatgatataaaagacacatctttattatatcgataatatttacattattacaaaggcacttcaggcctgacaaacaaaaataaacagcagcggactagcgggcctatggctccatcttcacaggcgctcaactggggtataagctaggactccacctaagacttcttctccaaagcttctcttactgaaggggggaaagatagagcaagaatgagtacaaccacagtactcagcaagtcacaccgggagatgcatgattaatgcaagggggtacaaggggataataatatgggttaagttttgcagtaaacagcatttaaaagtcacttagttgcccaaagccattttaaaaagacgatcctagagctacacagtattattaatcaaggccgtgaacccgcacgaacctgccttaacccaaggcctatgatgattcagaccgaactggcaacctgaccctaggtcccagctcgtcccaagccaacccaggccaaccattccacattttagttgttaagcaggttttaagaattaaaacactaacttgggtacattgctaggcttgcccataaccgagggcgcggctattcgaatagattatactctgatcagaggtgtacatctttacccacaagacacgtcttcctcacgtgtaaccacgtgccacataccaccacggcatacggacggaagacgtgacatagtttccaacccatcctagccatagacaagagtgccgacccaaccccacctacggccggaacctccgggacaggtaggcaggactgagcccctagcagcaggacaccagccctgtgccatgacatctcgactaccgggccgcagctcgtgtagccttcatttgtcctagagatgtccatcgacccccgacttcatccatctccatccgtgtacttttgtttataaccagactgagccacaaactaagccttacccactagacatgtggaagtacggtagtgctttgcaacagaggcccgaagaccggtccttatgtggccgaggtgctactatcaaatccatgcaccccgagcctagcctaaaaccattttgagggttttgaatagagggggaggtgtgaatccaattccacaataatccaaccattccacaatgtccaagtgaaatggatattcccaaagtctagagttataaaaccacctaatgttgcctaattaaacagcgaagcatctacctaaattcatactagtggtactatgaatagagtacccactagttggggttttgtttattctagggtgaacaaggtaataataacaataacaataataataaggtcatagcaaaggtaaataggcatggctaaataaaacagtgataacgcgggaatttaaataaagctataatgcattaattcaaataaaaataattttataaactgggattcaatatattcaaggatgatgtgacttgccttgctcgctttcccaaacgtcggcttcaacctgcacgtagagcggatcttccgaagctgcagcgtctacacgaccaacggaaaggaaaaaggcttttactctaataaactccatataacaagtaggaacaaagcacaaaaatgggttcttgacttcttgaggaaaaattagagacttgaacggtccaattccgagttcaaatggccaagttatggccatttgaagtttatatgctctttaagtgaatatttgcgaatttctttatttaaattttaatttaaaaaggatttattgcgtcagccgaggagagggggcgcgcggaccgggtccacgggagtggggcccacgcggcagcctcatggtccacggtggaccgggcgcacccgggctcacaccagccggcgccgtgggccccacgcgtcagccgtacccgagggcgcgggcggctgacggctaggccccacgcggcggccacacagtgcgcccggaggcggccacgacggtgcagccggcgggaggcggcgcccgcgcccctatggtcaccggcggcggccataggcacggcggagcggcggccgagagaggggaagggaagggaagggggaaaagaggcggcggtccacggcttaccccgggtcgacggcgacgacaaaggaggcggccggagcggaggaaggcggcggcgcggctcgggtggactgggacgatggcgctccggcggtcggcgagctcggcgaggtggtggacggggtcagcggcgatgcgacgaagccggagaaggcgacgccgaggcgggagacggtcccggcgagcggagagggccggccggaggtcgtcggcgacagaggagagagaggacgacggcgcgagctcgattctggcagggagacggtgcggcaagtggcggaaacgggcgagagaggcgcggggagggtttaa

SEQ ID NO: 85086 - DNA, 683 bp, Oryza sativa
ttcctgcagcccatgtgttaaaaagtcaacggtgtcaaacgttgtgaaacgaagggagtattaatttctggagcgatggacttggcttccgctccaatcgaccatttgaccctgggaatcttggacgaccgcatgatcctctccccggactacttctcgaggatcttcctgatcccttcgctgggggtgtcatcgtaccataacggctgaactgagagaatcgatatcacgtagcgctagcgccttaccctacctaaagaacccgctcccgatgctggacatcgctgaggatcgcttggctcccgcaccgcagcgatgtgctatgactgctggaaccaaaccacgaaagactgtggccaccaacatcgccgtacgtgttgcaaaagccaccgtttctgctgctccatccatgtcaagagcacctaggtgccgaccgctcgccgccgtgagcaccatctgctcactggatcatacccgttttactctgcaaacgtctctaccacaggcaccggttcctcctctgcctccaataagccttggcgattcacctcccgaacgaccacgtcgcacaccttcacctacgatgccaccacgctcgcagttgtgacaccagcttcatccatcaagtagaacgccattgataccagcgcatgtgcattaatacatacgcgcaaattggcatg

SEQ ID NO: 85087 - DNA, 568 bp, Oryza sativa
ttcgcacgaactagacaagttcgtgtcctgaaacgagtattttacaagtctttgtgctaaattgcatccatttagcaagtgtacgtaccaccaatgcaatatactcctcctttaattttatactatggaagcaatgttttagccttagcatgtcagtgttacatactgatcctcagttgtcatttcataaaggcaatccccaggacaattaggttagatggtgatggcaagtgattgctgcaatggccaatcgaagaggtcgaatcgcttcgaagaaacgaagtcagccatcaaggcttagaactcaagaagggtgatctgtttgagatcaaaggaactgatactttacaggctagttccaatttacctcaacaaaagtattatgttttttttttgcagacactgtagttaatatggcacaccattttcttgaagcaggcagatgtggagatagattttgagctgacatccatagatgctgctgatccttttgacccttcctggcttttggacaccgagaagcattgccgagaagcagatgcatcagttcatggcggcttggggccat

SEQ ID NO: 85088 - DNA, 602 bp, Oryza sativa
caaggaataaaggggactgattcagcacatttatatcgttgttagaaccagcgacaccaaagaaagcatgccaaatccaaaggtcatatgacgcaaccgcttcaaggataattgttaggactttatagtcaccacgggtgaattgtcccctccaagctctcggacaactctcccacctccagtgcatgcaatcaatacttcctaacatacccggaaagccacgagattcattaacttgtagtatatgatctatatcctcacttgtgggccgtcgcaagtattgcccaccaaagacctcaactacccctcgtgcaaaagtgtccaagcactctaaggaagtgcttttgccaattagcaagtattcatctaaagcatcagcaggagtgccatatgctaacatacggatcgctgctgtgcacttctgaagtggagaaaggccagtgcgaccagaacaatcttctctttgagtaaagtatggagaccattgacctaaggcttgcacgatacgtaaaaagagatgctttcgcatacgaaatcttgtgcgaaacattctctcagggtagagtggctgatttgcaaagtaatcagccactagacgtcgg

SEQ ID NO: 85089 - DNA, 700 bp, Oryza sativa
acaaagttacaagcccattggcccaatacaggagacgcagcaccttgcttttgtgattgcggccaaacgagatagatttccgagatgaggctggatccgttggaaggaggacttcgagagctttccatcaagtactcacgggcccaaaacggagcacgtatgtagatttggcggccgtttgaagtcagcaatgtaacacgtggccgggcccaaaacggagcacgtatgtagatttggcggccgtttgaagtcagcaatgtaacacgtggccgaatcagattgcagcacatggaggacttgatcttgatgtcttcttgttgattcatgatgtgagcaatggtcgtacccatagtagccatggtcacatcatcctccccttcttcacagaaaaccgtcctcggtttttccatatggtgctcttcgcgcagtccactgaaaacaacctgtttcttgcaatcaaaacaagacaaactcgagacaatatgattagcagtaacatgtctctctagcttgcatattttatccggaactacaagatgttctaaatctgaacaaatgtaaactctatgcaccaaaaatattcctctatcattatattcgccaaagatatgaaaaatagcattagttggacatggcaaatcatatataacaaataatttctccttcaaattatcgagctcacaaaaatcatcaaactgaa

SEQ ID NO: 85090 - DNA, 908 bp, Oryza sativa
aatgtcacctcccttgtaacttcaacaatactagaggttttgttgaagacacggtaggcatgtgcatttgactcatagccaagtaagaatcctcgtccaccttaggtgagaacttagatgaacaaggcctcttactcaaaataaagcatctactcccaaagacacgaaaataggaaacatttggtttcttaccactcaagagctcatatgaagttttctttagaattttgtggaggtataggcgattgatggcatggcatgcggtgctcacggcctccgcccaaaagatatccgaagtcttgtactcatcaagcattgctcttgtggcttcaataagagttcggttcttcctctcaacaatgccattttgaggaggatcatagggggcgaagaactcgtgcttgattcccacttcatcaaggaatacctccacttgtgtgttcttgaattctcctccattgtcatacccccctcaattttccggggttaaacttcgtaccctcttgatggtgagatcatagaggttttgggcttgcttggcgaagcgcttgaagacatcttgagcctcactcttgtcatagagaaaatacacccaagtgaagcgggaaaaatcatcaacaatgacaaaaccatacttgttacctccaatacttatgtaagccacgggcccaaataaatccatatgtagaagctcaagagggcgtgttgtagtcatgatgttcttgataggatgtggattcccaacttgttttccggcttggcaagcactacacacacgatctttctcaaatgtgacattagtgagcccgaggatgtgttccccctttagaagagttgccaaattccgcattccaacttgggctaatctacgatgccatagccaacccatggaggatttagcaatcaaa

SEQ ID NO: 85091 - DNA, 596 bp, Oryza sativa
  unsure (1)..(596): unsure at all n locations
tagcaaatgagtcagaaatttaccaacatgcagattagaggtggactaattaaccactagattcgagaatcttgtatcgttgtctctctctctctctctctctctctctctctcttttgtgacatgaggtcgtcaagatgcatggatgcatgcatgaatacacagggcgcagcagcacgtatgctcctccgatccctccatttggcatttgccatgttcttcgatgaaaccgacgtatcaccaactaatggcactgcaagttattgtgatcctcatcaccgatcgatcagctctattgttccgnnnnnnnnnnnnnnnnnnnnnnnnnnnnnntttatagccccttttttaagggaagtcgagatgcatgacgacaaattaaagcacgcaagagcatctgctgctgtctaaatttagcccgtgtgaggtggcgccgtcctatcatatcggatgaatttagagaattaaatatatactactaattacataaataaaactaattcgcgtgataaattttttaagcctaattaatctataattaacacatgtttactgtaacatcacataggctaatcatggattaattagactcaata

SEQ ID NO: 85092 - DNA, 818 bp, Oryza sativa
gtgcaggcgaggacaccagtcggcggcgacgaaggcaagccggtcggtgaagacgtagacgcccaactacggcggcataaaggccagccgtgcaagcggaaacaccagtcggcggcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcatagaggccagccgtgcaggcggaaacaccagtcggcggcggcgaaggcaagccggtcggtgaagacgtagacgcccaacaacggcggcataaaggccagccgtgcaggcgaggacatcggtcggcggcgacgaaggcaagccggtcggtaaagacgtagacgcccaacaacggcggcataataggccagccgtgcaggcggaaacaccagtcggcggcagtcgaggcggccggtcggtgaagacgtagacgcccaacaacggcggcataataagtcagccgtgcaggcggaagcaccagccggcggcagacgaggcagccggtcggtgaagacgtagacgcccaacaacggcggcataaaggccagccgtgcaggcggaaacaccagtcggcggcggtcgaggcggccggtcggtgaagacgtagacgcccaacaacggcggcataaaggccagccgtgcaggcggaaacaccagtcggcagcggcgaaggcaagccggtcggtgaagacgtagacgcccaacaacggcggcataataggccagccgtgcaggcggaaacacc

SEQ ID NO: 85093 - DNA, 1731 bp, Oryza sativa
ttttttttatattatccaaactttacaaacagggtcatacaagcaaccaaacaagatataacagggccaaataagcaagggcaaaatggcctatttaccccaaaattaacaccgtcaccttacacaaacggaatagggtcagaccggagcttcgtactcgaaaatgagggtcaaataagcaaagttcaaaaaatagggtcaaatcggcaattacaattcaaaacgaggtcaaataagcaattgcccctagaataaatgatctctaaattcccctcgatctcctgcggaagggattaacctaactaaggtcttattagtagtaacttgtgttccattgggttaaaaaggcccggcctatgaagtgaacttcccggcccatcaacatttttcggttttggatactgggcctccttttgtgatgggccgagcccacttcttcggaccttgggaccaatggccttcacggcccatgcgtagcgtcccccacaaccaaacagcaccaccacccggaagccgtgtagatgccgaagcgcccggcgagcggccgccatggccgtgaccggccacagttcagtcgcaggtgtaaacgccgatttcgcggccttagccacgaagggagtcgccgaacaaaggatagtccccaccctgtccggctcggtgatgacggcagttagatcggcggatggggaattgcggcagcggtgagccggtgactgtggggaattacggcagcggcagcagcgccggcaggggaggctgctactgttgttcatacacgagtagccccggcacgttgggcagaagcttatcgaggtcggagagaggtgcccgcttcatctccagaggagacagtaagtaacctacccctttggcctttgctcgagtgctagattctctcacaaattgctgtgatttcgctagtttggacactcgtagatctaattgggtcaatctagcatatgttaatttatccattgaattgtttgcaatatgtcaatttctgaaggaaataatgggaatacttcagaagcgattggaccccggggcttgaatttccggatagatccatagaaaattaaataagttgagattgaagttcttcgtttcaaacatactttgatggaatttggagcatattttcttattccttttggagtcttagtatgtaagagtaagactgactgcaatttaagatattcataaccttgtctttctaaaataataaggaaaccagagtagcttcagccttcttgtttagctgccttcaacaacaagactacagctgagagatgttaagccaaaacgccaaatttcgatggttttgtattaattctgaatactgaaggtcatctttttcacagagttggtagtcattgtaggaattctgaattcacaaggctaatctcttcaacattcagtatttcactaacagcatatgctttgtcagtagcagagcttgtgctttccgcatttaacttgtgaaccggatgttctctgcaaaaagaaatggcatcggtgaatttcatggagaatgcttgtaccaatcagcacaaaaaagtgggaagataatgaggtgtcttacagtgattcacagaagctttgctttgaaggcatgtccagttcgtctaaagctttctcaaacatatctaaaacctgggttattgttggatgatgcataggtaatacttgtacacaccacaagccaattaaagtcatctttttggcgatttc

SEQ ID NO: 85094 - DNA, 665 bp, Oryza sativa
aaggattcgatgatatctcggaccctgaagatatcaacgcatggattagccacgctgtgcagaagcaggcacgggttctggatattgttgtgctgtgtgacaaattgtatctcgaccactccgagtttgcttcccgctatctcacaagaattgagttcaccagtgttgtttgatggaaggattcttcaagcaactcgagatgggctgtccagcatgggaaagtctcttcttagatgaatgcgccgttaatgatgttgagatctcctcccaaacactgaaggttttgaccatcaagaacactctgttctccagtgacaagactactatttcgaccccgagtgttacttatctgaagttgtggaggcctgtggatagcatgtgtgtttaatgacatgccattactagtgacttcattactggtactttatcatgtgcaagactctggtgatttcttccaaaatctcaggagcctttctgctgctaaaagtttggagttcaattatattgggaaagaggtatgcttattggtcttacgcatcccactttccttattatatccatgcatcttaatgtacgtattgatacgaaaaaagaaaacaaactcaagcatgttgcttcttattgacacttcagaattgcactggcaaattaagacgaattcttat

SEQ ID NO: 85095 - DNA, 730 bp, Oryza sativa
cacataatagcacattttaattcttgcacatgatagcaattttaagtctagtaagttctctgcctcaaacatatgggcagtctaaagtcttacatataataggtaaataagccaaccaacaacacataacaccaaaagaactatccaactcatccaagaagcctatgttgatccagggaacttttcactaatgaacatagcaaaccaatgcatcttgttttcaaatggaagtccatcgaatgctctagcaatatgagggttggcaaccaaatgagcatagtaaaatgatctatggacctcctcaaaaccaggaagggttttcaatgtgtcaaataaaccttctggaagcttattgtccggctcggcgacctttagtatagcagaggcaagcttgtcaccaacactagtgaatgcaccaatcagcccgtcatcttcattctcttgtgtttttgctttctttggcttacttgcagatgatgcctccgcacgatcatcagtagtggcaggaccatcattttcttcatcattgtcatcttggacatcctctgttcctaggactgaacttgagtcctttgcatactttcctgtagccatggtgctaccaaatattgtaagcatctcaccatagtgtgcaagaggtttgttaaaataattcgcatcagccttgtgatccttcatgaaacaaaagttaatgtataagcaaatgcaataaaaagttataaaaataaag

SEQ ID NO: 85096 - DNA, 764 bp, Oryza sativa
cattgtcgtcggccggtgacgcgctgaggacatcgatccaaccatggttgtcggagtcccagtccggcaccgacgacggcgagcacgccattgctctcaccctcttggccggagactctgaagcttcgtaatcttctgctgctgctgtttttttttttgctatgttaatggagacggtgccgagtacttcgatccagccatggtcgtcggagtcccagtccggcaatgtctggccgccggaggatgccattgctatgatccggccggtggggctgttcgacatgtcgtcagcttcctcatcgtctgtcgatgacgacgtctcggactcccacaacgccgccgctgcgtcgagcgcgctcgtcggagacacccatgtcgccttcacgacttctttcttgagaccgcatgactttgagacgaacgggtgctgtagcagctgcgccgccgtgggccggtcgccggcgcgccgttgcatgcaccggcgcaagaagtccttcgcctccggtgacagccatggcggcaggtccggcacggcgtccgtgtacccgatcatccggagagcggcgagcacgtcgtccatgtcgctccacggggcgcggccggtggccatctcgatgacggtgcagcccagcgcccacacgtcggcagccgggccttgctcctcgccgcgcgccacctcgggcgccatgaacgccggcgtgccgccgagcaccggctgcttcgaaccaccgggcatcaccaccctcgcgcacccgaagtcggcg

SEQ ID NO: 85097 - DNA, 895 bp, Oryza sativa
tttagtagtttgaaaagcgtgcgcacgaaaaaagagagggaagtgttgagaacttgatcttgcagacacacccgttggcaaccacaacagattagctacaggtgaaatcgatggaggaggccaatgacagctggctgtagctagctcatgcacgagcaatccccatcaagagagggatccgcaaaataacaatgaatcacaggggcttagaatgctcacaacaatgaaaccatgatcacagaaactaaattcaaacatgatcgatagaaatggtgaagtagtgagactttgatcttatcgacaagaacaatggttcgatccagtagataatgttaggattttagaaagaagaaaaaatgggatttttttaccatgctattcttctactgcaagtcatccgttatcctccttcagctgtgcaaccaagtttgtactcctagcctgcaatcaatgacattgtgcaataattgtatatagaatctcctcttgttccagttccaaattcctcaacactgcacagaccaattgacaactaaaaaaataaaatttaaacaggaaaagtaaggaggtgttgaatgcatcctgcaggaatttcattgtggtcaggcttgttgttagactgctggtaggaagtcagagagtcagatacaaaactgtagtgcataaaatataatctaaatgacccagtgcataccttgaaactgaatttgttatccagacaagcatggaagtcagattccttttccttcaaacgaacatgatcatgaggcctgaattcactatggttcttggtttggcatatattatgaagtgcaactagttggtgctgaaacaaatagtgtgcactacacatctaaccaaaaagaactttaatagtgacaggttaccaatctca

SEQ ID NO: 85098 - DNA, 1760 bp, Oryza sativa
tgggtgttcgatgataagccgtcgccgttgccggaggagatcactgtccctcgtcatcgtcgccgccgtcggaggtggagagcgatgccaagggacgccggccatggccttgcggcgcggggacatggcggcgacaagaagccgcggcatggcgccggcgcggttcactcgccgtcttcccggttccgatggaagcaccggtgatcgccggcgatcgacgtgctttggtttcgctgttgcagagcctttttggcttagttgtttatggatttcttttcgtttgctttgtaaatgtgctgagaatgagatcatcgtctgaaactgaaaatggttaagcctaatcacaaatgtgaatgccttgttgctactttggatctttgatccactggtgttagaacttagaactctcctgaccaagtattaagtatgaggttagtaattaaattagagaccttatccttatttccttagtaatctttttcaatagtgggtatctggtctttgcttcaattgaaactacacgcataataatttacagcttataaaactgctaatatgaaaaagcaaagaaccacacacactccacccaccgtgtacaatgacttctagattcatgtagctagtgatttctttgtagcagtaaactatgctaagtggaatccaattaagatttttcttctgttacaaatgctgacacttacgaatgctcatttaacacacagtcaaaaggaaaaattcagcaacaaatctctagactcattaaaaaatccccagaaagcttacccagtactatgtatttatgggcacaatcatttaaagtctatgagtgacattatatactcacgactctttattttaaaccaagcacccacgacgtactccataatcacactagctaactatacattttcaattttatattttcaccatatcgaaacaaaagtataaactcaattaatggtaaaactagcttctttcgatgttagcatagatttacagtttctggatcaaacaaaaccaatggctctaactaaaaaggtatattcaccacaaaagttgcttaatatatgttcttgacaaaatgaatgttagattactgtttcttcttcctagctaaccggtggtgttccttgtcatgctgactatggctgagaacattggccatatatcatatcaaaggcataaaacagtcagatatgtccaaccatgcatggaaaggcttatatcggcaaacgatatgattatgctgcaaggcgcaatatggttcctttttaaaaagaacaatctggttttgttgttaatttctctacttttgttttgtttatggaaatttctctacgtttttttttacgaaatatttactccagctggagaaacaattttagaggatataactacaccctagaaaatgtccaatagaattatttacctcatattttggagcgaatcagggcatgtacaacatatgaacatgcccacaaattaaacctcagatatgaggtaataaataattctactggaaccatattattatgaggtaaataattctactggaacatattcttctccacagagtaaaatctattggaaccatattctactccacggagtaaatgttccaggtatgaggtaaataattatactgtaacgattgaacatgcaactaattcgtggagaaatgtcaccaactaataaatcaaaccccaggttttttttatgcaacatcacattcttacacttttttgttattaaaacaaact

SEQ ID NO: 85099 - DNA, 764 bp, Oryza sativa
atcatttacatgtgagcaccttacgcgtgttgaagtcgtatgctcggaggatgatcccctggtcgaagacgtggtgaacttctttgtaaatagtggactgacctctgctcaggttcatatcatacgccgggtgtagatcaagtacatgtgagcaccttacgtgtgttgaagtcttatgctcggaggatgatcccctggtcaaagacgtggtgaacttctttgtaaatagtggactgacctctgctcaggttcatatcatacgccgggtgtagatcaagtacatgtgagcaccttacgtgtgttgaagtcttatgctcggaggatgatcccctggtcaaagacgtggtgaacttctttgttaatagtggactgacctctgctcaggttcatatcataacatttgttgctccagttgagtccgaaagcacatataaacatgtatactgctcttgtttggtgctatgatatgagtagaaacaatcatgtcttagtagtactatgtaagtgaaaggtctgtcaccttgttctgttgatgttctattgtcctataaccaagacgtactgcaagttgatgcttgagtactctattattttgcctttatattttcccgacgtgatgttatacaccatgactggaattgagatcacctttgcttgtatgactgtaactttagcagtcatataaccatctttggatcaaataacaaggactcagatcgcaccaatgctgacaaacagtattgctcctaaatccaggccgttga

SEQ ID NO: 85100 - DNA, 720 bp, Oryza sativa
acgatgactccctcgccacggttactagcttcgagctcttctacgacgacggcgtgggctccggcctccgcccgctcccggagaccatgtcggacttcctcatgggctccgccttcgagcgtctcctcgaccagctcacccagatcgaagccggcggcctctcccgcgcaagggagaacccgccggcctccaaggcctccatctccatgccgcggggccgcccactcgcccagttcaatcgccggagaggagacagaaaaagtgacgggagtggcatggttttaattttagaaatttcgagtgacatgtagctgatatgatgaatattagtgataattttttaatttggcaaagttgcagtggcatggatcgaattaaccctttaaacaacatcaaatcaaatctaaaattaagtttgaaaatttaaaatgtagcttataagcatacaaacataagtgaaacaaatagggttatatatatgtctccctttaccacctactcctacaacagtggtacgacagcttcacccaaaatctgataagccgatgccactgcatcgaattcttcaggtgcaactgcaccgccattacacgagtctctgaatcgacgatgttggtgccccatgtttgtgaaattttcgatcaaagaatacaatgtgtgacacagattccataaccatgtgtgtgacagtggtgtttcataacaaatatatagttgtat

SEQ ID NO: 85101 - DNA, 1690 bp, Oryza sativa
ggatagacaggagcagccttcaccaccctcaagacagccatcacgaccgcaccggtgctcgttatgccccacttcgccaagccattcgttgtcgagtgtgatgcttccacctatggcttcggtgctgtcctcctccaggaccaccaccccacggcattctttagccacaccgtcaccctgcgacatcaatccttggcggcatacgaacaggaattgatcggcctcatcctcgtcatccgctaatggagaccgtacctatggggtcaccggttcctcgtaagaactgaccacttcagtcttaagtttttgctcgatcaacgtttggccaccatccaacagcatcattgggttggcaagcttctcggctttgatttcacagtggagtacaaggccggtgtcaacaatacaatggccgacgccctgtcacgacacgacaccgacgagaccatgctgctggccatctctgggccgcggttcgacttcatcgaccgtctgtgccaagcccaagacatcgatccgacgctgttggcactcagggaggagttcatggtgcaccagcacgccgccccatgggcgttgaccgacggcatggtgacatacgacggccacctctacatcccgccggcctcacctcttctccaagagctccttgccgcggtacacggcgacggccatgagggggtgcagcggactcttcattgactccgctgcgacttccactcacccaacctgcgcacggtggtccaggaccatgtccgcgcatgcatcacttgtcagcgctacaagtcggaacatcttcactcggctaggaaactctttccactcctagtgccgatgtccatttgggcagacatcaggctcgacttcatcgaggcgctaccccacgtgggcggcaagtcagtcatcctcacggtggtcgaccgcttcagcaagtattgccacttcatacccttggcgcacccatattcggcggagtccgtggcccaagcattcttcggcgagatcgtccgcctccacggagtgccgcagtctatggtctcggatagggaccccgtgttcacctccctattctggattgagcttatgcgtctcatcggcgccaagctccacatgacgtcggcatttcatccccactccgacggacagaccgaagccgtgaacaaggtcatcgccatgtatctccgctgcctcaccagagatcgtccctgccagtggctacgctggcttccatgggtagagtacatctacgagacggcttttcagtcctcgctcaagcagcggcaaggaatgcaacaatgcactactcggtagataggggaatacaacagcacatgcacctgcatgggtatgcatgcctgtaggctctacaggcgcacggctgtgtggtgttgagtattcgatatttgtgaaattatcagatgtccaacatgtggcatcctcctaattatacgcataatatcgcacatcttgaattgttgtttcttccgtaaataactccaataaatcccttaccccatattattgggcttagctattagcccaatatttttaagagtaaatttcacaaaactacacgttttatggtccaagttgcagaaaaccacacatattttgacacttggcacttaagtacatatattttggtagtgtttcacaaaaccacactatcaatgaatggatccacccgtga

SEQ ID NO: 85102 - DNA, 1324 bp, Oryza sativa
ctttcactaggattttaattattctagacataatttaaaggatatattttagggtcgttttgggacgtgacaaacctaccccctcttaaacggaatctcgaccccgagatttggaagaacatgcaaagaggttgggatgggctgccttcagctcgtcttcgcgctcccaagtagcttcttcctcggcgtggttgctccactggaccttgcataaacggataacccaattcctggtcctacgctccattgtgtccagaatcttcaccggcttctccacgtaggtcaagtcttcgcgaacctcaatctgctctgaatcggcttgctcggatagcactcgaagacatttcttgagctgcgacacgtggaacacatcgtgcacattgcccaaggatgcgggcagctccaactggtaagcaacttctccgcgtcgagtgatgatgcagaaaggccccacatacctaggtgcgagcttcccttttgtctgaaatctgtgcactccccataatggcgtgacccgaagatacacaaaatcgtccactgcgaattccagatcgcggcgtcggttatctgcataacttttctgctgagactgtgccacctttaggttatcctaaatggttctgactttagcttcaacatctctcagaatatcaatcccgaacacttggctttccccaacttggtcccacaacagtggagtccggcatttgcgtccatacaacgcttcatagggtgccagttgtatgctggtttggtagctgttattgtaggagaactcggcataagggagactcttatcccaggtcttcccaaaatctagaacacaggcacggagcatgacttccaggacctgattcagacgctcggtctgtccatctgtctgcgggtgataagcagtgctgaaattcaatcgggtggccagctcttcttggagcttcttccagaagtgagaggtgaattggcttcccctatcggatacaattttcttaggattgccatggagactcacgatcctagcgaagtaaagttcagctaatttgttccctccataggtggtcttcacagctaatttgttccctccataggtggtcttcacaggaatgaaccgagccaccttggttagtcgatccacgactacccatatagaatcatatccgccttgggtttttggaagtctggtgatgaaatccatcccaatttcatcccatttccattctggtacctgtaaaggttggaggagtccggccggtcgttggtgctctgctttgacacgctgacacacatcacaaagggccacgaactcggcgatttcccgcttcatact

SEQ ID NO: 85103 - DNA, 3022 bp, Oryza sativa
ccgccacctcacttgtcacgaccggaattaacccaacgatcattccatacgtgcgtgtattattccttgtcccaggaggcaaggtacaccaaaagttgatacaattcagagtttaacaagcggaagcgtaaatagttaatttattacatgggcgacgaaggcccagcacacacgaagataaacggaaaacagcggaagactagggcaacgaccacaggcacttgacggcaggcacgagctagacaccaaagtcttcatcctccaggaactcctcttttgggttagggaaaaattgagcaagattgagtacaaccaccgtactcagtaagacacacccacaaatgcagaataaatgcaaaggagtacaagggagttataataaaggggttagggtttgcagtaaacaacatttacaagacttttagttgcttagggccattttgtaaagacgatcctagagctacacagtgttattaatcaaggccgtgaacccgcacgaacctgccttaacccaaggcctacgatgattcagaccgaactggcaacctgacctgggtcccagctcgtcccaagccaacctaggccaaccattccatattttagttgttaagcaagttttaagaagtaaaccactaacttgggtacattgttaggcttgcccataaccgagggcgcggctattcgaatagattatactctgatcagaggtgtacatctttacccacaagacacatctttctcacgtgtaaccacgtagcacataccaccacggcatacggacgaaagatgtgacatagttcccaacctatcctagccataaacaagagtaccgacccaaccctggctacgaccgggattcccgagacaggtaaccaaggttgagcccctagcagtaggacaccggccctgtgccatgacatctcgactaccgggcgacagctcgtgtggccttcatttgccctagagatatccatcgagccccgactttgtccatctccatccgtgtacttttgcccatgaccagactgagccacaaactacgccttacccactagacatgtggaagtacagtagtactttgcaacagaggcctgaagaccggtccttatagtggccgaggtgctactatcaaaaccatgcacctcgagcctagcctaaaaccattttgagggttttgaatagagagggaggtgtgtgtccatttccacataatcaaaccattccataacgtccaaatgatatgagcattcccaaagtctaaggttataaaacgacctaatgttgtctaattaatcagcgaagcagctagctaaattcatactagtggaaccatgaatagggtacccactagttggggttttgtttatcctagggtgaacaaggtaataataacaatagcaatattaataaggtcataacaaaggtaaataggcatggctaaataaaatagtgataacgcgggaatttaaataaagcgataatgcagtaatttaaaccaaaataattttataaactgggattcaatatgttcaaggatgatgtgacttgccttgctcgctttcccaaacgtcggcttcaacctccacatagaaaaaggctttgttcaaggatgatgtgatcttccaaagctgctgcatctacacgaccaacggaaagaaaaaggcttttactctaataaactcgatataacaagcagaaacaaagcacaaaaatatgttcttgatttcttaaggaaaaattacagacttgaacggtccaattctgagttcaaacggccaagatatgaccatttgaagtttatatgctcttaatgtgaatatttacgaatttcttcatttaaattttaattaaaaatagggtttattgcgtcagccgagaagagggggcgtgcggaccgggtccacgggagtggtgggccctacgcggcagcccctcggtcgacggtggaccgggtgcacccgtggctcaccagccggcgccgtgggccccacgcgtcagccgcacccgagggcacgggcggctgacggccgagccccacgtggtggccacacggcgcgcccggaggcggccacgtcgttgcggctggcgttaggcggcgcccgcgcccctatggtcgccggcgccggccataggcgcggcggagcggcggccgagagaggggaagggaagggggaaagaggcggcggtccacggctcaccccagggcgacgacggcgacggaggaggcggccggagcagagggaggcggtggtgcggctcgggtcgacggggtcggcggagttccggcggtcagggaccgaaacggaggggtggacgaggtcggtggcagtgcggcgaagccggaggagacgacgccgaggtgggaagcggtccggggcgacgacggcggcggacccgagctcggcggtgacgccggagagagagagcgatggcgcgagctcgattccggcgggaagaaagtgcggcgagtggcagaaacggacgagggaggtgcggggagggtttatatagggttgggagtgagagagggcggccggcggggaaggaaaccggcgcgggggtcccggtcggcatcaatggcgccggtgagatttgcgggagcaaatccggccgtttgaacgcgggagagaggggaaaatgggggaaaagggagagggaatcacggggaacatttccccccacttaatggcacgcgggaacggtcgggggcagcgggatttgcggcggcggcggcgctagacgcgggcggagggagcggcgggagcggcgggaggagggggatgacgggtgggccccacccgtcaacgagggcggcgggcgggcccgcctgtcagcggcgcgcacgcggggagggagggaaagccgagtgggacgcggggagaggagaaagagggagatggagttgggccgaattcggcccaagagagaggggagagggttttagggttttctttttataaaaccttttcaactttgtttatttcttgataattattatatgtgctctgaaaattccactaaa

SEQ ID NO: 85104 - DNA, 702 bp, Oryza sativa
ttttggtttaggtggggtctatgtggggtgtgttttagttaggtggagtatgattaagtcttttatgtgttgtaatctgattgggttatgtgttatattgctgattttaaatggttgttaaatttatatatgtggtctgttttgggtttgtgagtacttgatggaaagcttttgaagtcttctttttaatggattcagctttattttggaaatctattttgtttggctgcaatcataaaagcaaggtgttgtgtctcctgtattgggtcaatgggtttgtaattttgtttgggaccttggtccatgtggggcccatgtggggtgtgccccaatctggtggagcatgacccttggacccttttggtcatcctcccacctctataaatagttaggtaccccttcagggtttcttgggtttttgatagattaaagtttagccattgctacttgcttgcagcgcgcgtgtcggctagaccatccgtctgcttgttctttggaaccccaacttatcatttgtattaaattcctatttgcaatatcagattgcttttatcttgttcttgcttgtttcttcgatttgcttgcaggaatagggtttatctgcaccggcaagatcagcaacccacggagaggtgtatcgatcgctaaggcgcaacacaacgtctcgtacggttgtagtcggatcgtcaacgtttctcccaa

SEQ ID NO: 85105 - DNA, 674 bp, Oryza sativa
attcctgcacccctgactacataatctatcaccctattctatttgttgacgcatgccgagacgtaaagcactctatcgacaccctggatggagccctcggattacagcttgacagacatatcctggtaacgatgaaagcaccgaccggaagaaagctaaccgagcgggcactgaggaccttgatattcttccggacacgctgctctttacccccaacctcgacgcgctgacttcacccatccacggaccataccattcaccattcaagactatcaactgatcagaactaccataatcgtgcacctatgaaatataataccccatgccgaaacggacatgtgctgcttgggtataaaatgctgacacctattagctgtgacagtcacgacgccatccaacaacaacatatcatcactcgtcatactaacaagtttaccgcgcatgcggtgacacccctccgctcaggtgaagcggccggtcagtgaagcggccggtcggtgaagacgtagacgcccaacaacggtggcataataggccagccgtgcaggcggaaacaccagtcggcggcggacgaggcggccggtcggtgaagatgtagacgcccaacaacggcggcataataggccaaccgtgcaagcggaaacaccagtcggtggcggacgaagcggccggtc

SEQ ID NO: 85106 - DNA, 530 bp, Oryza sativa
gtgataaaaacccttgctccaaaaggataaggaatatgatatgttacattggccatcggcgtttccttgctagggaccatccatggaggagaagcaaggtgtttgatggtaatgttgaaaaccgtgagaagccagagaaatttaccacggatgagctgatggagcaactggagagggtcaaggatgttagaccaggaaagcatcctgaaagcaaaaaaagaaagtgggacgaagagggccaatgttggaagcgaaggtcatgtttgtgggatttgccgtattggtcgagtttgaagctgcggcataatcttgatgtgatgcacattgagaaaaatatatgtgagtacatccttggtacatttctaggcatggctgggaagtcaaagtacagtacaaattctaggcttgatttggaagatatgggtattaggaagcatttacacttgatccgtgatggagattcatatagttctcctcatgccccttacacaatgactaaaacacagaaggctgattttatgattttttga

SEQ ID NO: 85107 - DNA, 602 bp, Oryza sativa
atatttgaccgcaacacgcccggatattatgttattatgtttcggcaagtttattatcaagatatatgtttagcccaagtcagttaatttttactactgcaaaaagagttttgcggtatatcaaagggaccccaggttatgttatatggtacaagccagttaagaattaaaattaattggctacacggatagtgattgggctggatgtcttaatgatataaaaagcacatccggatatgccttctcacttagctcaggtatatgctcctggtcaacaaagaaccaaaatattgttgctttatcttcagccgaagcagaatatgtagcaacatcaaaagccgtgtcacaagctgtttggttaagaagaattatggaagacatagacgagaggcttacacaaatttattgtgacggtcaatttgcaattgttatcggtgaaaatccagtcaatcatgacaggacaaaacacattgtatccgggaaacagttgatcgctaggaagttaaattgctatcggtgaaaatccagtcagtcatgagcagttggcagatatatttgccaattctttatccaaagaaaaattcatccacgattgagaaatg

SEQ ID NO: 85108 - DNA, 682 bp, Oryza sativa
tcgccattcccgccgccagcttcttggccagaacctccaccctgatcatcatcatcggcatctgctggtgctggaacggtaggcgaccttgccgacggtggtggcacgggggacgacggtggcgtcgaggaggatggtgttgacggcggccgaggtgacgggaaagtgctctccatagaagtgggcagcgccggcgcggggaggaaagaaaccgccgtctccgagcacgaagaaagggaggaggcgggagcctgaacggccccgatgtgagagcccggcgtcccgatgtgaggactccatcgatcgctcggcgaggaccacaacggcggcagatgcacctcgcttgccgtgcagggggtcagtgatggtccaccgaggtagactggcagtcggagggaagggggaaagggcggtggaggcaggagacaagcctccattgttgggatcggccgcaagtatggaggcagcaggagtgatactgggaagggaggcgggggtcggagtgctgccaagggtagcagaaggaggtgagcgccggtgagcatcggtggcggctgcgcgacatgcgacacgagtatgactggcgagccctccatgcgggcggccggcggcggcggcgacggcgggagggaagttggggcggcggcgatgggaaggaaatgggtttagggtttgggtggag

SEQ ID NO: 85109 - DNA, 551 bp, Oryza sativa
gaattttgggtgctacataaccaatttttgcctaacagaaaaggacaaggctcaagcagattctttacaaagtagtacatgaaaaagatataccccccccccccccaaaaaaaaaaaggaaaggaaaaaaaaagagcaaccaacacacacaaattagcacgatccaacacctttcgctgtgccatctacttccattttctggtggaagggtcaaacatacctttcctcaatttcttttagtgttcgacgccatatatcctggttcttcgtgagtttttcattcatctgcaggaaaggcaaagtaccaagtcatgtcaaagaaccacagcaactatgcttgataataactgaaaggtgcatgatttgagatgctcacatctgcaagtttctttttctccaacattgcattctcaatcttttgttggatttctttactcttatcatttacagctttatccactgcatcagaaatgtgttgttccttttctttcttagcttctgacagccgagcctcataatactatgaatataaggaaacataggcagataaa

SEQ ID NO: 85110 - DNA, 593 bp, Oryza sativa
gggaaaaaagagatgcgtatacagataagtaatataagagggattgtacaacggataatacgagcgacacgttgcgtgggacggctctctggcttggagcacaacaccacaattactcgtgagcaagttactacttgtacctgttgtcgcgatccattgagactagtaaggccttgtttagtttttaaattttttttcaaaaacatcatatcgaatcatcgggcatcgttatcgatctatcagctgcgcctccttccccgccgccggctgcgtgttatctcgatcaccccagcggcgacggcgacgacacgagagaagggaagcggcagcggctgcgacgcttgagaagggaggcagtggcggcgcgtgcgaccttggggtcggactgtcggagaggcccgggaggcgttggtagtggccgcacgggtgagctcgaggtcgaagatcccggtagcggcgaggtgagcgacctcgacagcatcgcgcccgccgtcgacacccccgcctccctatcgacgcccgtgccgtttccgccttgctgccgccttcccaggcccatctttggcagccgccggccaccatcgtgatgccgt

SEQ ID NO: 85111 - DNA, 3364 bp, Oryza sativa
agcaatctccacaaaatcctcctcgccgccggcgccgatcggtaaatcttcaccaaaccaaagccaagctattccctgcagatagctcgacagcaatgggggcaatttttctttctttttttcgttccctcctgagctttagtgcaaacctagatggggagattgagatccatcacaagtgtgtggctttgatgctaactctgagagagctttggcattagtacagcgctgactttagatagctagctacctgacctgttactggtcagagaagagaggaaatagagagataaaagagggagccagaggtagaagaactaggaccaagatgaatcatttggtaaatataactggtccaatatgaaaatgttgctttaccctggtgcaggctgcaacaatggtaataaaaggaggtctcatatgcaatttatttttattttttttttgcaatgaagcataattgaatttttacatcctttttatcagcttcagaggcaatgatgtcaagtctatacccttaaatttaaagatgtattttttttattaaagtatcttatatctagaataaatttcataaaactacatttacttttatcaatctatcataaaactgtatatttaaaaaacatgtatcataaaactaccgatttaacaccatatcttccataaaactaaagatttgaggtatcatatcagaaacatctgttttatcacaaaactacgacttttataaccccaatatgctatagataagaacttaaaaatctagttctttgataacttcactgctaaatctgtagtttcatgatataatattttaaatatatagttctataataaatttgatgctaaatttgtagttttgtaatacgcatctttaaatgtgtagttttgcgatagtttggtaaaagtatttgtagtttttgtgaaatttactcttatatatattagtagtttagggttgatcttccatgttattagagttatgtttggttagggtttgcttattgcatgtctttgttggtgatcatttcgtttgtgggatccttgattttcggttagcagtaccgtctttagagtcagctggtcaggttcgttgatttgttgggtgatatcggtttattgatttgtaagaggaacaaagatggtggctggtacttattcattaccttttgtgcattttttttaataatgaaaataattatatctccggcttctgtccatgggcacacaaccaaccttttgtgcataatagagttgatcataattatggatgtgcttgtttgctcatgtcttgcagcattttaagatgtagagaattttttttctttgtcgatagatcttttgttgtaatggttatcatatggttgtaaattattgtcttgtttaataacgttatcagtcttgtcttgcaaagaaaatcatggctagtgaattaaataaaaatacaatgcatttcttattacacgcgtgtgagaggttaagcaagttcctcttatttcttgatcaaggactcaagttgtatttgatttgtcacgtctctaatatgatatcctgcgcatagagttctcttccagatatgtatgaatttatttgattttttagttcaaatggattccgtagtgaaaaccggataaatcatagcattcctagttgaactgaaagtgatccatttctcataccacacattgttgtagtagccttttgctgttgctactgcttttgttgattacacgatgtcgaaatcaaggcatgcaacacgtggtgtccccttgaactaaaatcaggagagggcagctcgatgagaaaatttcaggtcccatcaccagcaactgtaccacaattgacactgccactcacaccccccaatttccttggccacatcccaaagagatatttttggcaaagctaatcttcaattctggcagcaaagcgctccaatgctaacacgcaaatatccagctcaaaaatccttttgccccaccagtccattagtgcagctcaagaatcctcttgcactatcacatatgcttgcactggatgaattccaaagaaatttcatcaaaagttttaggctccacttgcatcaaagaaaattctgcttctgatgtttcctatttcactctgcattttcgccattcagagtttcagacgtttccaaacacaccaggctgcaccaacttctatttttcagcctgccatgccatgttggatcagtagtagtagacgacatggatgggctggaagtctggaatgacaccgaacactgataatcagtgttgcttcaaaatgttgatatcttgatcacaccttaattagtgagacaatgcagaacacgcaccaatcaccatcaaggtttgttgtaaaccacacaaagtttaaaaatgcaataagtccattcaccagtcgttatgcctctactgatcattgcactttatacccagaatgctggacaaaagaaagaaatgctaagcatgaccacaatcagaatgtcacatatagtagtagtaagttgtaacagtttaacaacagtaccagcatcacatataatagcttagcaatgaaaagtatccaagataacacagacgtttacatgccagttcctactcgggcattctcacgaacacaaggtggacaccaccaacatcactaagatttccaactaacaaacgaaagtaaattagcagtatcgcgaaccccctttaagagatgtaaaggggctagggtttcgcacatttcaaccccgggtcgccgccatcgccgcgtggagggggcagtcacttgggcagcatctgcgccgctgcagccgcggctgcctcctgctgctgctggaagttgagcgggcggcggaacagcatgatgtgcggctccggccggtggatcgcgtagtgcacccacccgcggctctgctgcactccgatcgcgcgccactcgttctgcaaataaaccccatcggaaaaacccccattccccaatcagacaatcaacgaatcgatccaaccaggaacgcgattctacacgaatgtatttggagatcttgaaggttacctcggagagaaggcgattcttggggaggagcttggcgacctccggcggaaggacgacgtgcctgcgccgcgccggccaaaaggatcagaaactagggttttgcaacggagataacgagaagattcaagaagaggggattctcatctacctgtactcgtaggtgtcgtcgaagtacttctcggagtactggatctggcccatctcaaccccaactcctcgatcaacttctctacaggaaaaatccccagaatcactcaaaaaagccccaaccaaacaaccaaaatcccaaatcacgcagcaatccggaagaaacggg

SEQ ID NO: 85112 - DNA, 1807 bp, Oryza sativa
cgggcaacatcatgcggctgttccagaaggccaccttctgcctgcagccgccgggggactcctacacgcggcggtcggtgttcgactcgatggtcgccgggtgcatcccggtgttcttccacaacgcgacggcgtacctgcagtatgcgtggcacctcccccgggagcacgccaagtactcggtgttcatctccgagcacgacgtgcgcgccggcaacgtgagcatcgaggcgacgctccgggcgatccccgccgccaccgtggagcggatgcgggaggaggtgatccggctcatcccgtcggtgatctacgccgacccgaggtcgaagctggagacggtgagggacgccttcgacgtcgccgtcgaggggatcatcgacagaatcgccatgaccaggggaggctacgcgagatggtggctccggcctaaacaatctaggcaagcactagacgctcgacgacgcagactaagttaatgaattaaatgtaggatactcgatcaatttacagcatgtagaacgagttgatatcaatcatcagtttcgctagttgatactatcatatagatctttgtatacttctgtttgttccaaaattcgtttacatcaagatttgcacctgtacgccccacggccacagttgttgcagtttgcagattctgatccacggctgtacatgtacggaccgaatacgatcggttggaaaacacgtgccttagcacaataaatctcactttgtaacatacaacatatatactcgcacttcaatctgtaattccgttgagaatttcactgccagaaaagtggatcttcctctttcttagaagttgattgtaaaaaaccatccaaattaagtgttatcgtctcaataaatacttgtagcatctccaacaaaattgctatttttggctctccaaatatccatttaaccatcttgccaaaaataaatagagagatgaatttgtatttcattacaacggtctctccatatattacactctgtaaattgacaatgagtcccattttgttaggctctatgtgcttcttctccctccttccctctagatctttcctctccccacccatagtgacatggagaagcaacagcagcagccaacaggaggggcagaatggccttctctaccacctcaccggagctaggagggctagggctgtaagtgggtcagccgcgaaaccacctataggtcaaaataagcgggtttacggctaattttagcctataagtgggttttacgggttagccacttacaccctaaggagggccacctcttctgccatcgcatgatagcggggggagaaaggagggcggccatggaggtgaggtgaccggcaccggagaagaaaaggcggtcgacggacggtattggagaagggaaggtgacgacgatcctcttatggtagacggcggcgacaaaggcgaggtggccagataacaggcattgccactgccacgttgatgatccctagagattgagatagagtactaccagggaccaacttttatcttacactttgtgtacaagcacttgtactcagaaaaaaagtatatccatccctcaaaggaatgcctcttcgttttttcatgttcatacttttctttaaaaaatagtgagttaaatcaatatgtcactccacaaaagttcaaattcaacttatgcaaatagaaacaaaaataacaaatttaattataaatagaatatgcactcacatttaaatttgacatttttgtaattatatatgtcgaatttaaacttgtatgtttgtgaaatgatacatagcatgttgat

SEQ ID NO: 85113 - DNA, 898 bp, Oryza sativa
gccgacatggcgcctacgtggctgccacgtgggccggcgggaggttgaagaaggcgacggccggaacggacagcggacggcggctgcaaatggcgggacgaaccacgacgatacaggcaaaagcgagcacaccgggtggttgcacgagacgaggggagacgagccaatggctcggattcgccggagggagttcgacggcggcggattgcggcggcggcaaccggcggcgagaaaagagggaaacggcaacgacgcgactagggttcgattcctccggactagagcatctacgcggccaccgtagtccgtttctagcatcggattagacggagacactacaagagaggccggcgacgtgcgggcgctacggagcacgggcggtgatggcggcgagtacacagcgagcggcggtagcggtcggggcggcgccagctatctacggggaggctatacgagcttctaccgaaaactaaggggaagaggacgaacgaggagggagaacggggaggaggcactaccgtgcggggtgaaggggcgcaatgacgatggccgacggtgcggggcgtgatcgctccggcctcgggccggggaagaggaaggagagggtgcgcccggagtccacgtcacgcgtcctcgctcgtgccggctcctccgacacgtgcgacgacggcgaacagggcagggcgcggcaatggcgagggcgaaaacggggaagattggtttggggaggggctcgggtttatagggcggcaatgtcggtttgggagggaggaaccgacattgggcggtcaagccagcgagctggctctccgactagcggccaaaacgacgacagggaggatgacgctggcggggggaaaaagaagaaaagaaagagggaaaggagacttgactcttg

SEQ ID NO: 85114 - DNA, 1904 bp, Oryza sativa
ggccagatcgggcagcttggaggcggctgcagcccggacgcgccggcggcgggaggaccgccggcccggatggcgtggggacagccggccggacttcgcctccgccggatccgacggcggcgggggcaggaggggcggcggcccggatggggcagaggcgggagaggcagccgcccggacggcgtgggggcgacggcggcccagcgtccctgcatcgacggcggcgacggcggcaccctccccttccggcgttggcgtttttgtgcttgtgatgttcctgtgttgttgttgttgatgaaatatgatcttgtgatggtcttcttgtagtagtgttttctcttggaatttgtgatgatttccgatctgtatttggattgagattgagattttgtttttgggtttgattggatgcgggatttggagaggaggagcgcgtgaggttagagaggagagggacgaaaaactggtgtgacgaccagaaaaatacaaatatttatactagttatagatctaacgattcaaaattacgtgaaacttacatacaagttacactatagttacatgcaagttacagtgtaattacactacaattgtaatataattacatccgtcaaatttttagaagaaaattcgtcgacaaatgtatagatggtcccattgatttcctttacatcctaaaattgtaaaaaagtataaacattgtttacatcaattcgtagcccctgaacaggaccaaatgtaaatcagaactatgtaaaaaggtagcagcagattacaagaactataggtacaaaaacaaacacgtccgctaatgccaagtattcgcgtctgtcacgtcagatcctccggtgaaaaaccaacttttctactataggtaaccggagtcgggcgacgtcgtgaacaccggcttgtccttgtccacgacggtggcggccaccgtggcgctgctgctcttccgccggggcttcgcctccccgagcatggtcaccacgtcgcgcatggtgggccggtccttgggtgacttggccgtgcacagcaccgccacccgcagcaccagcagcatctcctcccgtacgtggtcgacgcggccgccgacgctggcgtcgagaagctcctccaccccggtgttgctgcgcagccgctccctgatccacccgacgatgtcctggctctcgccgtactccggctcgatcggccgccgtccggtgaggagctccatgaggacgacaccgaagctgtagatgtcactcttctgatccaccttcagcgtgtacccgtactccggcgcgatgtagccgtacgagccggcgacgacggagacggtctcgtgggcgcgcgccatgacgcgggcgaggccgaagtcggcgatcttggcgtccatgttgtcgtcgaggaggacgttgctcgacttgacgtcgcggtggatgaccggcggccggcagtcgtggtgcaggtaggcgagcccggcggcgacgcccgccgccacgttgtaccgcgacacccagtccatcagcatcttgcccttccgctggccgtgcagcgcatcccacaggctgccattgaccatgtactcgtagatcaccatcgtgtccaggttgttgctcacgtagcccagcatgcgcacgacgttccggtgccggagccgcccgaggagcttcacctcggccgcgaactcgcctcccgcctcgacgtccgtccgcccgtccaccgtggtggcctcctcggggcacccggcggcgcgccacagcttcttgacggcgaccacggcgtggtggcgtggcatgtcggcgcggtacaccacccccgtgccgcccatgccgacaatgttagcctccttgatgcacgcgagcacctcggcgctggtgaaactcaaccgctggaacgccgtgaggcgccatggccac

SEQ ID NO: 85115 - DNA, 1068 bp, Oryza sativa
gtcattgttggattcatgccaattgttgtgtgcctctaccttgcatcaatgtttaatccaatgggacggcgatgatgatgaaattgttcaagcggatacatcggccgaggttgcaatggccgatgctacttttgagtggcgtcatgggaatatccaatgcttatcggggagggatctttctagctatgattttattagtatatccgatggcaaatttgtacctatttctataaagccggctagtgtagcatggctaagccatatatatttgtataatgagtaaagaggctaatttagagtggttacaaaaagggtgcaagagtatcggtctacaaagaacgatattggtgaaaccgttgaagattttgatgaagtggacaagcttggacaagggtttacatcggccgatccattggaagaagttgacataggtgatggaactaaaccaaggccgacttttgtaaataaaaacatgagagccgattataaggttaagataatcgagctacttaaagagtatgttgattgctttgcatgggagtaccatgagatgccgggacttagccatgagctcgttgagcatcggcttccaattaaaccgggttttaggccttataagcaaccacctcgtcattttaatcctttgctatatgaccgagtcaaggaggagattgatcggttgttgaaagcggggtttattaggccatgtcgttatgcggagtgggtttctagcatagtcccggtggagaagaaggggagtggtaagattagagtttgcatagattttagagatttaaataaagccactcccaaagatgagtatcctatgcctatagccgacatgatgattaatgatgcctcgggtcataaggtgattagctttctagatggtaatgccggctacaatcaaatctttatggcggaagaggatatgtacaagacggcttttaggtgcccagggtttgttggtttatttgagtgggttgtcatgacctttgggttgaagaatgccggtgcaacatatcaaagggcaatgaatttgatcttccatgatttgctaggtattat

SEQ ID NO: 85116 - DNA, 5126 bp, Oryza sativa
  unsure (1)..(5126): unsure at all n locations
atccgttcggccggccagaatagaagaagatagaggtgggttttgtttggggatttttagtgaagttgtagattatttatatttttgttgcactttgttccattaagttgtttcgttctgttttgattcattgttgcattcatcgatttttggtgttgcaatccgaatgttcaactattgattttggttgaaataattttgcttaagaactgaaacattttttctctcctagtgaaactttttgactctgaatacatcgattttttgtgttgcaataagtatgttctactattgatttgggtaaaacaattttggtcaagcactgaaacattttttctttggtagtgaaacatttttggaacattttttattgaaaattttttttaacagaagatgaaacatataaaacatctctcaataacacggtgcaacaccgtccaacaatcttcacaggatcggacgtaagatcagtagcagcctccgtaaaatgctccattgaatcgctataacgcaaaagtagaaaataaatgactttgcaaacaatccgtgtaaacaagcagactcggttgacagtaacctacactagaattgagaagcgatttaatcgatatacgattaattaggtgatgcaaccattgcagtgacttgtttagtaatgaaaaccatggaaatcgtgttagcaaaaaaaattcctaaataacaaattcgggaaagaggttaaaaaaatatgtagaaaattagtttcgtacttcttgacaaccatagctgaggactgtggtggcctacaggtaggggagacagggttatctcaagggccccgttacgatgctctctacctatagttgaaaaaaatatgaattattgatcttatttatttagagggttcagatatatttatactatcgcattaagagcaaggtcaatagtgcagcccactactagcttcaaatcatctataatcaatataatagccaattcatacaagttgcttactatactattaatatatggacccgcctgtcatacacatattacatcttggagtccgtgctgcagctggctacagatctgtagcccgctgtatttctctctcttcttttatctctttaaaatatgtttataactagcttatagcctgccatatgtacatggtacctgcaaagcatgtatagccattacacgtgatgaaagaactgattatatatgtatagaagcccacaagccttttaaaattagtagctaggagatacccaaaaatactgtcagtacttgcgccacaatcagaaagcatcagcacctttgaaaccgcgtgatttctctcgaaggcctatgctgtcctaagcaattggtgtctctaggatgctattaattaattaatcaagttattttatgttatgaaaatagatgcacaacggagacacgaattttacgtggaaaacccttacgggaaaaaaaacacgggcgccaatcggcaatgatcactatagaggagttgattattaacgtaggggaatcacaatgggaacgtcaccccttcccgtacggcttacaagagtatatatagggaataaaagaaagatacctaataggatagatatgaagtcctactaggaaactaatccaaatatattgtggccccaaaattcagatcacatatttaacaatctccaccttgagacgaatttcctcttgtaacatgaaaaacttcaaacaccaaaaatacctcatgtaggtaaaatcaccgcgcgccaaatggtctctaggactatactgtaacaccaaccaagcttgagcaaagctcaaacttagtagcagtaactggctttgtcatcatatcagctgggttatcatacgtacttctcttgcataccttgacatcaccttcagcaatcacacctcgaataaagtgatatctcacatcaatatgctttgttctctcatgaaacatctgatcctttgtaaggcatattgcactttgactattacaaaatatatcaacacaagacgtaactccacaaagctcagtgtacaaacctctaagccaaatagcttctttacaagcttcagaaatagccatatactctgcttcagtagtagataaggcaacagtggcttgcaaacttgccttccaactaacggcacatcctccaatagtgaaaatataacctgtaagcgatcttctcctatccaaatctccagcaaaatctgaatccacataaccaacaagtccatctgtagatatcccaaactgcaaacaagcactagatgtaccacgtaggtatctgaaaatccattgaacaactttccaatgctctttgccaggattagccatgtatctactgacaacactcaatgcatgtgataattcaggacgagaatataccatggcatacataagtgaaccaactgcacttgaatatggaactctagacatgtactcaatatcataatctgactgtggacataaatctgaaaataatctgaaatgtgcagctaaaggagtactcactggttttgcatcatgcatattgaaatgatgaagaacttttttcaatataacctttctaactaagatataacttgccagaatgtctttctctagtaatttccataccgagaattttcttcgctgcacccaaatccttcatctcaaattcactactcaattgtgccttcaactttgctatctctgatttgtcttttgcagcaatcaacatatcatcgacataacgaagcaaatatatagctgaaccatcaacaactttgagataaacacagctattataattggatcttctaaacttctgagaaagcatgaaagagtcaaatctcttataccattgtctaggtgactgctttaacctataaagagatttcttcaacctacagactaggttctcttttctaggaacaacaaaaccttcaggttgctccataaaaatgtcctcttctaactccctatgtaaaaatgcagttttaacatccatttactctagttcataatcatgcattgcaacaatactgagtaaagtgcgaattgaactatgcttcacaacaggggaaaagacatcattaaaatcaatacctggaatctggctataacctttagcaactaaccttgctttgtaccttgcctcatcacttggagatataccttcctttcttttgaagatccacttgcaacggataggtttcttctcctttggtaacttcatcaattcccaagtatgattcatttcaagtgactccatctcatcatgcatagtagttatccatctattgcaatcatcagaaacaatagcctcagaatatgtagaaggttcggtattaccttcaatttcttccgccacactcaaagcataagcaactatattcgcttcttcaatatatctttgaggaggtttagtatttcttttgggctaatcttttgcaatagaacgttttgaagactactgaacagtagaagaatctgaatcttcaaaaacaggtgcatcttggttaatagcaccatcttctttttctggtgcatgccctgaactaatcaagtgctccacctgcacacntgctttctcctgactctcaacaggaacattagtagaaggtttgtcatgtaacataactgattcatggaagacaacatttcttctaatcacaacctttttagtttcaagacaccataacttatagcctttcacaccagatggataaccaagaaaaatgcacttaatagctctaggctccaatttaccattattaacatgagcataagcagtacaaccaaatactcttaggtctgaataatttgcgggggaaccagaccatacctcaattggagtcttcttatcaatggcataactgggtgatcgattgataagataacaagcagtggaaacggcttccgcccaaaactgtttaggcaaacctgcattagacaacatacaacgggcctttgatataattatcctgttcatacggttcagctacgctggttttgtagagtgtgtgaggaacggtgtagtgacgcacaatgccttcagacttgcaatatgatttaaatatcttagaacataactccatcccattgtcagtacgaaggattttcaccttcctttcagtttgtcttccaaccattgttttccactctttaaacacatcaaaagcttgatatttgtgcttcaagaaataaggccaaacttttcgctaataatcatcaacgagatagtcatcatgtaacgagcacctccgaaagatgtcttacgagcatgcccccataaattagaatgcacataatcaagaataccttcagcagtatgtgtagatgtgttgaacttcacccttttatgcttgccaaagatgcaaagctcacaaaatttgagcttcccgatgctttgtccatctagcaatcctcgcttgctcaattctgccaaaccattttcgctcatatgcccaaaacgcatatgccaaagattagtagcatcggaattagataatgaatcagaaactgctgcaacattacctaatatagttgtaccccgcagatagtacaggttggcagatttaatatcagctttcatcacaacaagagagcctttagttaccttcaaaattccgtctccaccggaatatttgtaccctttgcgatcaagagtacataaagatatgagacttctcttcaaatttggaatatgccgcacatctgacaatgttctgatacagccatcaaacatcttgatctgaactgttccaatacctgctaccttgcatggtgtattatcacccatcaaaacagtaccaccttggatagcttcataggtggcaaaccaatccctattcgggcacatgtgataggtgcatgtagtatcaagaatccactggtcactagtttgtgcacaaccagcataagcaacaagcaattctacatcagacttctcatcagtaacaactgcggctttaccttttggtatatactttccgggtcttttgtctttgtcctgtaacttccaacactcagagatatcatgtccatctctcttgcaggatttgcatgacttatacctggctctggactttgatctcccatggtagctacttgagcttttatctcttgattgggtctctctgttctt

SEQ ID NO: 85117 - DNA, 1668 bp, Oryza sativa
aaaggggaaatggggagctagggttttcagcctaaaaccagtcaacattttgatccaaatcaacatgactaaatcactgatttaaatatttgcgtatatagagcaggtacttttttatgatgagtttactagttaattatttcattcccattggatacaataattttctttggtatcttgcctctatcttaatcaatagtctatattgttcatctctcgctacctccacgtaccatataagcaccgtaaaatgttaaatatatgatccgaattttgggcccataatatattcggattagtttcctagtacgacttcttttctatcctattaggtgtctttcttttatctcctatatatactcttgtaagcagtacgggaaagagtgacgttcccattgtgattcccctacgtttgttgtcaactcctctatagtgatcattgctggtcggcgcccgtgtttttttcccgcaaggattttccatgtaaaattcatgtcttcgttgtgtatctattttcataacaagtggtaccagagcattggagatcaatctactaatcacgtagccaccggtgtgattttttcggatcaaagaaatcgatcttggcgacccctatcgtctcgtcgatcacgcgagaatcagcagcccgcgctcgtcgagagaaatcgcaggagcagcaggacgtacaggcgtcttctaccagcgcacgcgccgaggaaaagcagcagcgtccaatccatccatccggcagcacacgtcccgaggagaaagaaaattagtgcaagtgctatggtagatgtgactaccacatccaaatttatccatatcattcatttataaactaagaggcaactcatacaatatatcacatctagtacacaaatacaaatgtctctaatactctcacatctttcttgaaatttgtatggaggttgcctcttaatttagggttggctcatcatgtctctcctcacttctctccttcacctcatcatttaatctaatgtggcacatttatgggcagcatatggagcattatagtacttgcctgcaggcagccagcccttctgttcacgtgatttttattcatgtggaaattgctacggccaccaaagcttgtgtaccaggaagattacagatctacgctacgtgcacacagaaagtacacctaggttttgcgtttttgcttggtttaccctaatttcttactagcaaattcatgattaattcccatggcaagtttgaagtatgatctaccgcttctggaccgagacacaagattctcactttggcaagtgaagatgcgagctgttcttgcacaacaagaccttgatgatgcgctttctagatttgacaagaggacacaggattggtccgtcaatgagaagaaaagggatcgtaaggctatgtcatatattcatcttcaactatctaacaatgttttgcaggagatgcttaaggaggagacagccgttgggctgtggttgaagctggaacagatatgcatgaccaaggatctgaccagtgagatgcacctgaagcaaaagttatttttgcacaacttgcaagatgatgagtccgtgatggatcatctctccactttcaaggaaagtgttgctgaccttgagtctatggaggtaaagtatgatgaagaggatttaggcctta

SEQ ID NO: 85118 - DNA, 827 bp, Oryza sativa
taatatttttaaagtttatacggataaagtttatacacctaaaatttatatagtatgttataaactcaacccgaatttggattaaattcagataaaaaatgttccaatgtatttatttacatgtataatgtttacgcacacagatatttttatattttttttctttcaaaccttttttttttgaatttgttatcaaaaccaatcaaaatgcatacatgcgtaggaagaagagaagaaaaccgcagtgtcctggtgggtgaggccaagttgactgtgtgcggtgacgcggtcactcatgcataagagcatctccgagagaatggctaagtgactctccaagccaaattttagccatagcagagaaaaaatagcctccaacagcatctccatcccactggctaagctatatggttagccaaatactccccccaactggctaaatctagccagccacaaccacatccctaaggctggccaaatgctctccccgctacctcctctgatgcaatggcgaggagtagcagcgttgccatccgtcgcagcaccgcggtccctttgagtagcctctctctctccagcactgccctccgccgcctcgaacaggtcgtgcccggcgcccgccgcggtggacgaagtcgacagcggcggcgttgacggcgtcaccatgggcgtggacgacgccagctgctgctgctgcatcggcacgccgtgcgagtggtggaagtgctgggacggcaatgaggaggagaagtgttcatccgccccccttcggccgcctcatcgctcgccgcagccgccggcatcagctcggcgcagcgcgccgcctc

SEQ ID NO: 85119 - DNA, 6545 bp, Oryza sativa
ctgtgatgtatttctttaagaatttgagttgtagttttttgagaatttgtgatgtgaatgattcattgatttgaggatgatactttgattttgggatatttgggatatttggggagatttgggaaggagcaactatttggaaagaaacaatgaaaataaaaaaaagaaaaaaatggtgaccaaccgggactgtgctgctatctttagtcccggttattatttcaaccgggactaaagatagtgatctttagtcccggattcatagtcccggttgaaaatccgggactacaaaggggttgccaaccgggactacacggagcttgctgcaacttatggtaaataaaccacggttaatcagcaaatagttaaaaatgtgcctgtgtcaaccaagaatagttagtagttgagttgttcgcggtgatgttgcctaacatgaggtgcttcaatcttcattagcacactcgtttcttgtacaacgtcctattcattctgttccgtcacgctagggttcaatgacaacagttgatgatcgattaggcagcctttaattgctgtgatcaatggagatgcacgtgtcctaaaaacgaacatagatagagatgcccatgtgtgctgtgacgtcgcataaaagtacgcatggacgctagccgttaacataccctcacgtcccaagaacaaatgattctaagataaaatagaacatttcatagtaaaataaatctgaacataccaaaacaaattcgttgtaatagaaaatgttatattctatattaggttagtttattttaggacgaaatgagtatactgattgaatgcctttgatacttaacagatagcggttgtgtcaactaaagataacaattttagtgaaaagagatggaaaggtagcattaaccattgttttttattctaatgagacaacacaacatatatttttcgattgccaaattgccagaggtatttggaaggccgtatgcatagcttttggctcgaaccgcctactattgccgctaacttttttggtaattggctaaatatcaattctttgtgagaattgcggcattgtgttgagctatttagacctctagaaataattggtgttcaatggcttcaagattaagttatttttgcaggttatcttcaaaaggacctattgggcgaggcaatggtcttaatcgaagatgatagcaaccagtgaaagagggttgcaaacttttgaagttaagagtaagtttagtggtatttgtatcatgttgggctaatggttgtttggaccttgtgtaaggtgtttggagactatgcgctcgtgtattggccatgtacatcctgttaaatttagaggctgggtttatcgcgttttataagaaaaaacagatggaatgactactatttcacatcacgtaaagctccaggtgagatacatcggtgcttgcaacttactagccatgaaagacaggtgtaaaatttaaatactagttagtgtatttttagtattttagtccacttctattgcacatatgaatctctatattaagttacattgtactgacttgttcacccgaagcaaataagaataattatctcttttttttcatgtgtgtataaagatgtcagatttgttaaggagaatatcacaaagctactaagaaataagcaaatatttttttttttgcatatgtgtatccagaagtcagatttgttaaggagaaaaatataaaaactactaaagaaaataaggacctcatgagatcaagatagcctaaaaaagggaggaagttcacagggcttgagggcaagttttatagtggaggtggatgtcacatctaatttagatcatgtcatcttctcattacttaagaggcaacacataaaacatatcacatctaatacacaaaccccaatattaatctactctcacatcatcttgtacttttcttggatattgtgtagaggttgccccttgcatgaggagtggctcattctctctctcctaactcctctcctccacctcatcatctaatcttatatggtaaatttagaagcaatgtgtagagactcgtagtacttgccctcaggggttgccttctagacctttttaccttgtctgaaaaaagggcctctagggagtcagctatgaaggaaagcatgcgatgttcatagccaaattaatgctaggatgttgattttcatatgctttctccgaaaaagaaaaaaagggacagcaataggtggtactaaggttgttttcaccttggaatgaatggacatggtgatgaccagattcgattctcttttccggagatacacatacaccactagtagaagagactgtcatagcaccttgccttcctagaaattgataccagagagggaccatcttatatgtcgtgatcagtaaggatccatcaccaaacagttgggatttctcccaaagatgaatgagacgtccatcaaagtatatactacccagtactacttactactcagtagtttgttcattaaggtaataaggccttatttagttccaaacttccaacttttccatcacatccaaattttcctacatatataaacttctaatttttccatcacattgttccaatttcaaccaaacttccaatactaagacgttaagacgttaagttgtctgaactctgaattccactgaagataaagtacaggaactatagcagtggagtaaccaaaccttctgcagcttacccttcagaaataaaaatggtttctgcagccgttcttcagcccaagattctaaaatggagaaaaatcagtatgtggttatgtgcagtgtaaacaattagacaaaataaacaatagtaatggtggggcagtaggggcatgggccatttgttggtatgtggcaagtctccctcaagctctgctagctcccgtgatgatccagaagccgctgcttgtcccctgcaggatgatgtcgccgtctctgaaggtgcaagtaattccagtttggctgcttgtttacggtggacgaacggccaaaacatggccattctgaaatcattttctgggctgcgtcgctctgaacatttcaatctcttggaccatccgcacattgctgttgactaactgcattctccgaatcaaaattttgatgtctgtttgctgctgcaatcatggcttttcgaaccttagaggcatctgaatccgaataatcggttcctggaaatgcatgatgctttctgctttctcccgggctgtaggttgatccatttgtcctgtgattaatcagggccaaagcgaatggtacactgattgcacaattagtaggtccaacctacatcgaaacagtgattgtaagtagatgaaagctctgtccatcgcatgtttgcttgtcgccagaattattaatgagtataaagtacgtgtcgagcaattaggtcgcacttaactacacgctttaattaattatttgcactgttttatagacttcgacaagacagagaaaacagggtcctaaaatctttaccctacatgttgcaggctcgacaaatactgattcgtacctttcaaagcttctgaaactgatacgccatatgcccatatatattcctggtctggccccacataccatgctgtgcaagtgcacgtctacgagccacatgcacccacgtggcaaggttgggcccacctctcagtccttggttgagctgattctgataccgtgggcccttttcctactgcagctcgacacctgtacccttcttgagtggcaagttgagactgaccctgagcagttcaccatcacacctcatgtcatcaggcagaaaacaaatagttaggcgagctaagcatctcaacaagttagcttaagcagttttgacaaaatcagagggaaattcggattgataacatgatcagagtcactgatgttgtagtatctcttgatctgcaactcatttatttccccagatagtgtgtgttctccatttgttcagacaaaacaatggacagaaaaccagcacaacctggacaggtgacctctagtgcctggatccagtgttcctgagctaaggtccagtttttcagtttttctcagaaacttctgcatattggtgatgcttgggcaaacttattccctgccataggattatgaaattgacaaattgtagagaacaagtcattttcagcaacttagactaatcgactgacctaacaagacattggcgacaataggaatcaaattggggcctaatcatgttcgcgaacattagactttcttattcaaatgtttcctgtctgaatcaatcggcaaattacaattgcacaacgaaatatcttccctatttcatattccaggcactggtagtattacgtcattcagcctaaataagacaggcactaagctttcaccatggtataaattagttctcagaaatgatgtcacagttcagaaaataaacacagttgagttgttattgacttctaaaaacaagcgatgtacagataatcatgccagaaaactaaattattctgttatttaaagttgtacattatcgttgtattaagaacatttcgatagatacaacgtgatgtcatatatgaaaatgtagcatatatacttaagttctctcaaatgatgtcatagttcagaaactaaacacagttgagttgttattgacttccaaaaacaaacaatgtacatataatcatgccaggaaactatattattctactccctccgttccaaaataagtgcacttctcttcaaatttgaactagaggagtacacttattttgggatggaggaaatattatttaacgttgtacatcatcattgtactaagaacatttctatagatacaacacgatgtcatatatgaaaatgtagcatatatacttaagtgatagtatagtttataagtcaaggtaaataagaatgtgaaatttgacttggaaacaagaacaacaatacaaattataaggattaattgtaccttaacttgttcatatccagaaccaccagacaaattaaaccagtcccttcgtggtgctttcacctgaagcaagcaactaggcctagaataaacaaacataaaggatccataaatatatctgaagttatgagaagctcgggaattgataccatcatgattgatcaaaaaacaagagggaaaataaattagtcttgtaccaaaacaaccattttatactcgctcgttagatagagaatatgatggagcattacacaactctccatattgcgctactaactccataattgttgtttttcaatgctccctttgtcgcaagagctcttgtgctctcaagcagctagtaactggagcaggcttctactagtctattcggctattccatcaccgcatgttcagttcagctgcataatgcaatgcaaagacaacgagaagttgtcttgtacttcgactcagcaccaatctgccatttgatgggaaattctttcatcctaacaacttctaatcatgcactgttcaagggtgcctaacttaattgtcatagttgtattaaagtacatacaggattcttcagaacatcgagcacttggaaagccctgggactcttcttttaaacaatgtaagagtaaaaacaagtcagaaagaagtaaaacatatgttgtggacaaaattcttaaggttccatgtttcgcaatttgttgcatctgtaaccctttgtttggagtgaactacaaaataaatgatacatatactaaagttagagaggtgtgcacttgtacaatcaaaatactcacctcctatcgtgccaaaatttctaatctcaatgcaatcaaacaagcagctgtactgctattcttgttctgaacaaaagttgttctcactcaaaaattactgtcaggttaactccagcaagggattcaatcagaatatcgctgatcttaaaattagaacataatgctacggcacatgagcagttacggaaacaaggaacgattctcatcgaaggaccaaggggatagagattagtaaccttatcgaggcggaattcaaagcagaacgaaccccggaagcctcgcctgcatcgtttctactagggcatatatgctctggcgctcatagaacacagaattcagatccagatggagaggacggctcgattagatgaaaatcgcaacgtatttttttctcattttcgctactccctctaccccgccagcgatctagactggaatttctcacgaggatgcgccaatatccgcgcccctcctcgaattttctcagatttttttggtggcgtttgatcgagaaagaaatcggacgagacgatgcgtgaagtcccaccagtcggcctgcctcgtaggacgaatagctttgctggaccggagcttgtacccggcccgctattaagacctggaccctttttctttcggaataagtccacttacataccttattttccgtcgagtttaattcgcgtccctaaaacgtataataccagaaatcttgccatctactaacttgcaaaaccagattaaattagatccggacgaggtcgctggcgtgtgagcttggcctggg

SEQ ID NO: 85120 - DNA, 519 bp, Oryza sativa
  unsure (1)..(519): unsure at all n locations
tcaatactactcggatacgtacggcaagacacaaagtccaggatacaaattaaatatacctggtcaaatctgtggtcaaggaaattaatccatacacaaatcagctattacatgcacaaagtggtctccaaactaatccgtgcatgtgctaccgacgattacatgtctacacggctgcatgacatggctgcatgctacggttcatccattgacaggcctcgaatcaaagttggatcacaaaccaggtttatcgttctaaattttcttatataaattagaattaattcacagatcactaattattatttgatctattattttatacatgtaccgccggccgccttcgtcgctgccgattggtttcatcgcctccacggttggtgtgcgccgctgccgttgcnnnnnnnnnnnnnnnnnnnnnnnccggcctgcctccgtcgccgccgactggtgtcctcgcctatacggtcggttggtcacaccaccgttgatgggcatcgtcatctacaccgccggcct

SEQ ID NO: 85121 - DNA, 611 bp, Oryza sativa
tcctgcacccccctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaacccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcact

SEQ ID NO: 85122 - DNA, 562 bp, Oryza sativa
atcttggaaggagggtatcaatggtgatggctgatgattgttctacagatgatacggttacggggctcttaaagcaaaggctggataccgaacaacttttgttaggtgggtctttgctgaacatgagatgctgcgcctatgtgctaagtagaattgccaatagttgcctgggtgtgatgggaggtgctgttgataggatccgcgccagtgttgatttctggacagcaacaactgaaagagatgtagtgtttgctgatgttgctcgtggtttgaatgttaatctcgacaagaagttgactcttgattgtaataatagatggtactctaccttatccatgttaaatgttgccataagctacaagcaagtctttgatcacttaaggcaaatagaggaacagtatatttgtgctcctgatgatgatgactggaaattagcaaaagaggtctgcagtaagttgaaactgttttctgacattgcagaactaatttcagagcataagtatgttactgctaatatgtacttccccaagatttgtggaattcgatggccatgaggagatgg

SEQ ID NO: 85123 - DNA, 594 bp, Oryza sativa
cgtcctggtgcacctcgatccctaggtagaaggagagaggccctaggtcactcatctggaaggtggccttgatctcttccttgaacaacgccacctacgcatccttggtgccggtgatcaccacgtcgtcgacatagacacccaccagcagggcatttccaccattgccccatcggtagatggccgcctcgtgcgggctttgctcgaagcccatccccttgagcatggaatccagcttggcattccacaccctcggtgcctgccgcaagccatagagggccttgtgcaggcgtagcaccttgccctccttgctggggatcgcaaatcccagcggctggtgcacgtagacctcctccttcaaatcgccatttagaaacgccgacttgacgtccatgtgatgaacacaccggccttcctgagcagccagcgcaaggaggagtcacacggattccatccgtgccacaagggcgaaggcattgtcgaagtcgatcccctcccgctacacgaaaccgcgtgccaccaagtgagccttgtgcttgacaatggctccggcttcatccctcttcagcttgaacacccaattaagggtgatcg

SEQ ID NO: 85124 - DNA, 761 bp, Oryza sativa
ggagtcaaacttggtgaagaactcttgtaggccagtcatgtgatgggtggcgccggtgtcgaggtaccacccatcagtcttgtcgttgctagagccatctccgaggaaggcatgtgccttcggctcatcaaggtggaggagagccgctgcggccgatgccgctggaggtagctcgatgcttgcgtgtgccaagagtagagccggctcttcctcttccacctgtgcaacgtgggcctggccgcgtcggctgtcgacagtatttggcccaatggccaagcttgccacagttgcggcaggcgtcgtctcgtgccagcttgtggttgccagcggcgccgccctgggcgcctctgcaagcgccaccctcgacgcgtgttcgcgcccactgcagctggacacctccgtgcgccttgcgctgcttacggccgcctgtcgaggaagaggactcccccttcctctcgtcatcctgacaggcctcccactgctcctgagtgagatggagcttcccgccaatggtggtatgccccgagaaaggttgtggctcatcgctgtcgacgaacttgaggcgacctatcgcctcctcgatcgacatcgtggagaggtccagcaaagactcgatcgagcgagcgatctacttgtacttctctaggacgcaacggaaaatattctcgactactctctcctcgtcgtagttgtcgccgtcgtactgcaccatcttctgcagcagagtattgagcggagggaaaagtcaccgggctgcagga

SEQ ID NO: 85125 - DNA, 610 bp, Oryza sativa
tcctttgtcgcttactccttcgaggagcttcactgacatcctcctcagagacaagttcatgtgtatgttcagtttgttttggtggtgtgattgaactgggaattatttcaaagggttggttcgaaccactatgtgtatccttcattgggaaaaagctctcaaagaagatagaatcacgagactccataattgtaccaacatgcatgtctggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcggtgtccaacatggcattcaccaagtcagtcagcgtgcgattcttcctttcagcaatcccattagactcgggagaatagggaggcgtcctctcatgtatgatgccatgttcctcacaaaataa

SEQ ID NO: 85126 - DNA, 657 bp, Oryza sativa
ggctgttttcaattttctttctccattcttatgtatgtcttcatttctttttcctcttttacgtaccttattctctcgtactctctccggacttataacttgtcgttttacataaatgtgaggtcaaactttaaaatctttgattataaatcatttctaaaatatttgtcttttaaaatggtgactatatgaatagattagtcttaaaaagtactttaataaaatcatatatttgttaacacttttatacataatataataaaaaataatggtaaaagttgttttttaaaagaccgtacccttatgtaaaacgacaagtattatcaaaccggagggagtaattcatcatggtcataagaatcgttttttctttttcttccactcaaattttttgtttcctttttttattactcttttttaacgaaaacttttttatatgaactatttccatccaaattttctacatatagacttttgtgtaccctagactttttaatataaaaagtatatataaactttttaaaatctttctagactttatatatataaactttatacagaaattatatttgcaatttataagtttagtggatattttcctaaaaattagagtccaatccaaacaaacttgaaaacaggaaaaaaaagataaagcat

SEQ ID NO: 85127 - DNA, 582 bp, Oryza sativa
cggccactgcctcgtcgccggcctcgccaagtacccgaagaaggtgatccgcaaggactcggcgaagaagacggcgaagaagtcgagggtcaagtgcttcctcaagctcgtcaacttcacccacatcatgcccacccgctacaccctcgacgtcgacttcaaggacgtggcctccgggggacccgacgccctcgccacccgcgacaagaaggtggccgcctgcaaggccgccaaggctcgcctcgaggagaggttcaagaccggcaagaacaggtggttcttcaccaagctccgcttctaagcgcgccttcttgttcttgctatcatccggtaatctatatctgctttttttggtatctgtgtccatgaaagactggttgttagtattgagtttaaaattaagacatgatgatgctcatgtgttatgaagtcatgccaaggatagatctggttgaaagttttgtttgggaattacactgcttcagatgcgatttgtttccatgttcctccatttccagcgggattcattgcgatgtgccaacaatgttttgcggacatgatttgcaacttaataagtctact

SEQ ID NO: 85128 - DNA, 592 bp, Oryza sativa
ggctccacacaaatttctcttctttcttcaacaactgtgtcatgggtcgagcgattttggagaagttctcgatgaacctccggtagtatcctgccaaacccaaaaaactgcgaatttgagtgactgtcttgggttgcttccaatcagtgacggcggtcgctgtttcggggtccacagcaactcctttagcagatatcacgtgtcctaagaatttgacttcggacaaccaaaactcacacttgctaagtttggcatacaattgatgttcccgcaactttcccaacaccagacggagatggtgctgatggtcttcctctaattgtgagtacaccagaatgtcgtcaatgaaaaccacaacaaacttatccaagtattccatgaacactttgttcattaagttcatgaagaaggcaggagcattggttaaaccaaacgacatcactgtgaattcatacagtccgtatcgcgtggtgaatgcggtcttcgggatgtcttcttcacggatgcgcaactggtgatatccggaacgaagatcaatcttggagaataccgtggcacctttaagctgatcgaacagatcatcgatccgggg

SEQ ID NO: 85129 - DNA, 1441 bp, Oryza sativa
ttgattgactagggagaggacacacacacatatatattttatcaacgcttagaccattcgtgttattcaaaatttttgtgtaaatataaaaatatttaaatcatgcttaaataatatttgatgataaattaagtcacaataaaataaataataattacataattttgttgaataagacgaatgcaaacgtataaaaaaaatcaacggtcatacattgaaaacggagggagtagcgaaagagcttgtagcctagtggttagagcctcagtagcaccttaggtcctgggtttgactccccataggagtgaattttctaggatttaatggctttgtgctttcagtggtagatgacgtacccgtcaacagcgaagcgtctgtgttaacttcgtcaatttccataatttgccggcccagtcttcgaagatgctcataggggtgagtgtgcgtgcattgtgagtgtctgtgttgtactgtgtaatttttttttttaaaaaaacggagggagtatataccaatcacctattcaaccacgatctagctagatcaccatctaaatataacaactcataattttactcttttattacttaagcaattccacttgtgaatattttttttactcaagccgtttggcagttggcaccaatgtactcacaattttactctttttacaatatctatttacatattaacactaatgtaaatcatactcaagttgttattgtgcataaaataaaaccacatataaaaccgcacatgagttatttaaactggtttcagtacttcatgggtagaatatgcagtttcatacttggggtagcagaccaacctcaatcggtagtactacatttataaaaaaagtatatgtttcttatattatatcgcagctagcgcactgtataccttatagaatgttatgatgtgcgggaatgaaattttacgtgctatgtatttgtgtactttgtatataaatgtgagtaaaaagttttactcacaacatgtggtttagcccaagcggtttttatattatgcgactttagatgatagtttgtttgaataaatttaggcagttgaaaaagagcaaaaccttgaagttctgtaatcttgtttgataaaactgcttttagaccttgtgagatgcttttctttttcatttatgttgccactaaaccatgatattgttccatcctgaaaacataaaacaattggagaagaattgacaaccacacatatattggagaaagccgaaagacgagtctttattacaagaaacataaaaagcaaaaggctaggaacacacaccaccgttgggacgacgaccggccaggcttaaacccaccaccactcaaattaagacgcaaaatatagttaagctggtcaccattatttataactcctcaataatacaaaagattaatgatttctcgaacttaatcgaaat

SEQ ID NO: 85130 - DNA, 1629 bp, Oryza sativa
cacttgatcatctccacaccgggtcattacttgttactcttggaggttgccgcctcctagacagcttgtggaggagttgcccggtgacctctccgagaagattgtggaggaggcccggcgccggtttgtgagtggtttagcttcaccaccttcggagtgaaggaagaactaccccgagtgatcgaggcttgggtagtcctctccgtgggccggctcccgccttgcccaccccttgacgaagggggcgtgcggtggcttcgtagttgagcggtggagttgggctcgcctcaacggggagtaggaaaccggcgagtttccgaacctcggtgaaaaatctcttgtctcatttgattgtcgcatttacatttgtgcaatttacttttctagagacacacttgagatcatatcaccctaggattgcaaaacatcgacataggagcgtgatttactttcctagagatatatttgagccactatcaccctaggtttgcaaaacataacttagttgcttagttagagttctccctcaccaagcctagcaacttaggttaaatttgattaggtattatttagttttaaatcgcctattcaccccccctctagtcgacatctcgatcctacagaatggcaaaagtttagtatgcatctaaactccaactagtagttttgcaataccaaaacttttgccaccaaaacttttgccatttgccatttgccattccaaatgcatctaaacaggccctaagttttgtatgtaattattgcttgtggatgatgaggtgacatgtttgcatgttaagctttaagatttgtggattataactttatagtaagataggtagccacatcttttatttcttctacacggaacacaaagatagatacgcacataatacacttatgtatgcatgcccataatcccctttaacatatgcaatatatatagagagaggctataaaatatataaatccataaaggcgtaaatctaactaaatttctagtcaccaaagatacgcttcctcatctcgcgtctacagccatgcattatggtggtgtttggatctagggactaaactttagtccctgtcatatctgatgaatttggagtattaaacatagactacttataaaactaatcacataaatgagagctaattcgcgtgataaattttttaagcctagttaatccataattagcacatgtttactgtagcatcacatagggtaatcatggattaattaggctcaatagattcgtctcgcgaattagtccatggttatagaatgggttttattaatagtctatatttaatatttataattagtatccaaacatccaatatgatagggactaaaaactagtcacatctaaacagggtctatattatcgatcgactaccacaatttatgcatgggaaactatgcatcagtcaacatatatatatatatatatatatatatatatatatatatagtgaccatagatactggtggtgacctgagacagatggaccgcaggtgaccatatgtagtagagcctccctcttcattctatctctcatgtactgtggaggctgtggagatcacacgaaactactgtgaaaatggatagctatcaaaggtgtcta

SEQ ID NO: 85131 - DNA, 5506 bp, Oryza sativa
tgtagtgcttgtcaagccggcaagcaagttgcatgttctcatcctactaagagtatcatgtccacatctagaccattggagctcttgcatatggatttgtttggcccaacaacctataagagcattggtcgtaatagtcattgtcttgtgattgttgatgattattctcgctatacttgggtgttctttttgcatgataagtctattgttgccgagattttcaaaaagtttgcaaaaagggcccaaaatgaatttagttgcactcttgtgaaaattagaagtgacaatggttccgaatttaagaataccaatatcgaggactattgtgatgatcttggtatcaaacacgaactttccgctacctactcacctcaacaaaatggtgtagtggaaaggaaaaatcgtacattgattgagatggtaaggactatgctagatgaatatggtgtttccgattccttttgggcggaagccataaacaccgcttgccatgcaaccaataggctttatttgcatcgtctcttgaaaaagacttcctatgagctaattgctgggaggaagccaaatgtcgcctattttcgagtttttggttgcaagtgttatatttaccgaaagggtgttagactaaccaaatttgaaagtcggtgtgatgaagggtttcttctaggttatgcctcaaatagcaaggcataccgggtctacaacaagaacaaaggtattgtggaagaaaccgccgatgttcaatttgatgagactaatggctcccaagaggggcacgagaatttggatgatgtaggtgatgaaggcttgatgagagctatgaagaacatgtctattggagatgtcaagcctattgaagtggaagacaagccatccacctccactcaagaagagccatctacttccgcctcgtcaagtcaagctcaagttgaagtggaggaggagaaggcacaagatccacctatgcctccaagaatacacaccgctctttccaaggatcacccaattgaccaagtgttgggtgacattagtaagggtgttcaaactcgatctcgtgtcgcttcgatttgtgaacattactcgtttgtttcttgtcttgaaccaaaacatgtagatgaagctctttgtgatccggattggatgaatgctatgcatgaagagctcaacaactttgcaagaaacaagttgtggactttggttgaaagacctagagaccataatgtcatagggacaaaatggatctttaggaacaaacaagatgagaatggattgatggtgagaaacaaggcaaggttggtggcgcaaggtttcacacaagttgaaggtttggactttggtgaaacttttgcccccgtggcaagacttgaggctattcgcatccttcttgcatttgcatcatgctttgatataaaactatttcaaatggatgtgaaaagtgcttttctaaatggtgaaattgccgaacttgtctttgttgaacaacctcccggttttgaagatcctaaaaatcctaaccatgtttacaaactctcaaaagctctttatggtttaaaacaagctcctagggcttggtatgaaagattgagagattttcttttgtcaaaggatttcaaaattagaaaagttgacaccactcttttcacaaaaatcattggtgatgatttctttgtgtgtcaaatttatgttgatgacatcatattcggttctactaatgaggtattttgcaaggaatttggtgatatgatgtctagggaatttgagatgtccatgattggagagttgagcttcttccttggacttcaaatcaagcaactcaaggatgggacgttcgtgagccaaaccaagtacatcaaggatctactcaagaggtttggcttggaggatgcgaagcccatcaagacacctatggcaaccaacggacatcttgaccttgatgagggaggtaaaccggtagatttaaagctttatcgttccatgattggtagcttgctttaccttaccgcatctaggccggatatcatgtttagtgtttgcatgtgtgcacggtttcaagccgctcctaaggagtgtcacttagtggccgtgaaaatgattctaagatatttaaagcattcctctactattggcttgtggtacccaaaaggtgctaaatttaagcttgttggctattccgattcggattatgccggttgcaaagtggatagaaagagcacatccggtagttgccaaatgcttggtagatcccttgtgtcatggtcattcaagaaacaaaactccgtagccatctctaccgccgaggcggaatatgtttcggcgggtagttgttgtgcccaattgctttggatgaaacaaaccttgttggactatggtatatccttcaccaaaaccccactcctatgtgacaatgatagtgccataaaaatagccaataacccggtccaacattctagaaccaagcatattgacattcgccatcacttcctaagagaccatgttaccaagtgtgacatagtcattagccacataagaaccgaggatcaactagccgatatttttaccaagcctcttgatgaaacccgcttttgcaagttgaggaatgagttaaatgtcatagacttctctaatgtggcatgagatggtgcaccatggttgcttcttttgcaattgtatatttgctcctatttgctcttatgctttggacttattgccatttggttcttcattgcgaaaatggagcatgtcacattaagggggagttttggactcttgcatgtgctctacttccttttatatgtgagcaaatcaactaaaagtgctagtagtgttttcaaaatgcccaagtcaacataagtcaaaagttttgcaaaatcaatgaaatttgaaaactatctcttggaaaatgtttcaaaagggtccctatatgttttccaagcctcacattgctagaaaaatgatttttgaatgaaaaatgctattttggctctcttttgaagaatctagattcttgtttttggccaaaatgagattaaaccccaaaatgagtttgagaaggaatctgagaaaagtttcaaaacaaagttggtagagaggaggatttgaaatgtttttggtattcaaatcatattcaaaatccaaatatttcaaaagttgtttgaaaatcaaattcgcccaaaaacccctatagaccataaatggtcacctcctagcactcaagtaagttttgttgcaaatcttcataaatttcaaatattatgaatggttggcaatatttcaactcacacatttcaaaattgctccaaaattcaaatttttgttgaattttattgtatgggggtagccgaactgtgcaagggctatgcacagtcggctggggggccaggcggtctgaccggcgctatatgcgcggtctgaccggcctggtggtggcggtctgaccggcctctaggaaccggtctgaccggctgcatcctggcggtctgaccggccacgtatagccggtctgaccggccagggatggtgggcccaggactttgtcctttcttcctcctcctccttctacccgacccctcctcatcccatctcatctcttctcttctccaactcaaaaaaactcctcctctctcctctcccaaaccctagccacctccctccaccaaatccatccggttcaactgtcaaaatcactccggttacaccataagtaaatctcctcctcttcctctctctattccatggattgatttgagttcttattgagtttgtgatccatggcatggaaccctaggtgaaggaagaggtgttcatcgatttgcaccaatagagggtagtttcttggtgtgattcaactccttcaaccggtaaatccctctccctcttgtgcattgctctcaaatcggtctatttcaatctttagggttaagggtagttttcccattgcttcaatagacctacaccttgatgttctagttccaatcttgtgcaacactgttctagcaatttttagaatcatttgtgtggattgtggaaggatttgggtgtgctcgtgtcagtggcggtctgaccggacgcggtctgaccggccgagggccggcggtctgaccggccttgaaccgttggtctgaccggccgtggctctcggtctgaccgcccctgacaggcagcactcgcccttcctcccacttcactatgtggtttctaaaattgttgctcatccatcctttgctccttgtttttcagctatgcctccccgcactcggcatggtcgtcgtgctcccacgcccgatcccgttagtgagaatgaggaatcaagcggagatgagtatgttcaaagtgatgaggacaatatggaaaatgttgagggtgatgagatggaagtaagtgatgatggtgatgacaatgagagtgcaaatggtgaagatgatgaggcaagtgatgatgggagtcctctcgattcctcgatccaatttgtgcttaatttgaggaatgctcaacaatacactatcctccgtcatcatgatcaattccggaggcctaacgattgtaatgatccaagatttcatacacggttccaaaagtccgtgtatgtacaagtgtatgccaacaaagccttcgccgaacacaaatggatctcttggaggcacattggtgagacaccggagtttgagaatttgcaagagatgttccggaccattgggattgatagaattgtcaccatgaagcaaccttttgatgaagatctcatccggcaattctatgccaccgtatgggtgtccggcgattgtgatgcaatgaagtggatgtcggggaccctccgatgctctatcaaccgccgtgaattcaaggagctcttgcacattcgcttcaacaacggggatgaccttcatgatgagcacacccacaatctctttcccattgatcacttttctcagttttatgaagaagggggaaggcacacatatggaaaggtggcgggtttaagggctctcccaagtgtgatcaaccgcatagtaagggccaccatcctcccaagatacggcaacaatgatgacatacgcggagttgcttggcatgttattgatgccattatggatggtcgtcggtttgatgttatcaaccttatgatgaaggagattgccatctcaaaggggactattggacaaggaatctattatgctccctacataatgaggttgattcaaagcaagttgggacaaattggtcaaaatttaaaagaacataaggagtacaagcctcgtctccaactctcctcccctagagctcctcgtgtgcgccaaccaacttttgatcaaggtgcaagctaaagtgcagcccccctcctcctcaagggtatgatccaagtactttattccatccacaatatgcctactttggaatgcaaccaaatgacttctttaacccggtccttggggctattaataccctcagtgaaagcattcaacgcttatccaccgggcatgaaccattgcgtgaggatgttcgtggcttg

SEQ ID NO: 85132 - DNA, 784 bp, Oryza sativa
tttatctctctctgtgtatcgcacacacatatttgttagtccttacaaaggcacaagggcgttatatatttttttgtctgtgtgtctccagagagtgagtgtgtctaaaaaaatatatatatatgtgtcaatatttgtttttagtgtatacacagtgtctgcgtctctaagtatatacatacatattacatggtattctatatccccctctttatgtatatataaaaagacgcatatatatatatatatatatatatatatatatatatatatatatatatatatatatatatatatatatatatatatatatatatatatatatgtgcaacctctttaaaccaccatgtatagagcaaaactgaaatttactaggggtcattgtacaaaagcactaacaggtgtcattgtggaacaaataataataacatgaaagaacattgcaagaggattcaccattattatgatatttccttcctcacagggaatatgggaggccatatcatcataaagggcatgattgaaaacaagatttcatccttttctgtcacctcgtaaaccttgtgaagttgcctactcttaacatccaagtagagtgcacattcatctgttttcaagaacaaaaactcagcatcgtcccctacataatccatgtaaacaacacgactatccccgcccacacaatttatgtgcaaattagcgcacatcgaccgcaaacaaatggtatcaaccagagtccatccagtgctgccatgcttaagtagccaaatacgaagctgaggct

SEQ ID NO: 85133 - DNA, 652 bp, Oryza sativa
tgtagcggaccctttggttagccccctgttggttgcggaaattcgccaagcgacgcttgtgcgactccagttccttgtgcttggcttccaagcggatgctcttgtccaccagacgttggaaatccggatagtccccggagacaagacgcacggacagctcagggtccattcctgccaagaacttctcttgcttctcctcatcttcacgaatattcctccagggcgtaccgtacccccccgggccaggttgttaaactcatgcaaatactccatcatggagcggttgccttgcttcaactctcggaattcccttttcttaagggccatgactccggcgggcacatgggttctccggaaagcggcggtgaagcgggcccaagtaagtaggattgccctttggctgcgtagcctggaaatggtcccaacatagagatgcgggcccctgcagttggtgggcggcgaagatgactttctcctcatcactgcactgcacggggtctaactttttccccacggcatgcaaccaatccaacgcatccacggggttattggagctagagaaggtaggtggacggatgcggaagaactccgcgagtttagagtgttgtgggggtggtggtggagcattatgttgtggcggattttggatgtg

SEQ ID NO: 85134 - DNA, 518 bp, Oryza sativa
gcagcccctcaaaactctagaacactcggacgtccacttgaacttttcttctttcttaagcaactgagtcataggtctggcaatcctagagaaattttcaatgaaccgacggtaataacccgcaagtccaaggaaactccgaatctgtgacattgccttaggcggggtccacttggtaactgactccacattcgacggatcgactgccacgccctgagctgtaatgacgtgacccaagaatttgacctccgataaccaaaagtcgcatttactgaacttggcatataactggtgctccttcaacttctcgagtaccagacgaagatgttgctcatgttcttcttcagactttgaatagatgagtatgtcatcaatttataccacaacaaacttatccagaaattccatgaacaccttgttcatcaggttcatgaagaatgcaggtgcattggtaagtccaaaagacatgacagtgcactcatacaacccataccgagtggtgaaggctgtcttggaaa

SEQ ID NO: 85135 - DNA, 694 bp, Oryza sativa
  unsure (1)..(694): unsure at all n locations
tacattggaacccgaggcatgccggttgacaatttctcatgccgttctctgcaggtgcttcattgtacttttggttttcttgtattcacatttttcctgcacaacacaaacttttatttcctttctgttgtttcctgtattgctttgcctgaatatgtacataagtggataagttatggtgtgcagcaacaacaaaaacttactgttctgtttcacaatgtttgtccattaagaaaaccaagaatgtggttattacaatgttttcactcattaaatgctttgaaatgggtaaaatggttgcattttgctatgcatgtttttttctcgttaaatttttcttagattttgtacttccttggtttgagcgcatggggtgctgtggaaaaacattgttagacggagggagtatcttttagatgtttgacatgaatgcgtattttatttttgacaaactgtgcaatggaatgttgacccttctttgcttactctaaagtaataaatattgcagtgaaatgggtgcccatttttccccttggggaccaattcttgtaacatgtggtgcctgtttgctgcctcaaactgaaangccaccgttgtagccaattgcctgtgcaggatgaattcttgaggggcccgaacattaccaactcgtacccttttcctttttaccgagtatttatgaactccagttact

SEQ ID NO: 85136 - DNA, 530 bp, Oryza sativa
tatagggcgaattcgagctcggtaccccttaagccagaagtcgcacttgctgaacttggcatatagctggtgcttttttaacttttcaagtaccagccggagatgctgctcatgttcttcctcggacttggagtagataagtatgtcatcgatgaaaaccatgacaaacttgtctagaaattccataaacaccttgttcatcaaattcatgaagaaggcaggtgcattagtgagtccgaaagacataactgtgcattcgaacaacccgtaccgagtggtgaatgttgtctgtggaatatcctcttcgcggatcctcaactagtgatagcctgatcgcaggtctatcttagagaacacagtagctcctttcaactgatcaaacagatcatcaatctggcaaaggatacttgttcttgatggtgacctcattgagtgcgcggtagtcaacgcactcttgatggtgacctcattgagtgcgcggtagtcaacgcacatcctcttggttttgtctttcttctccacaaagataa

SEQ ID NO: 85137 - DNA, 592 bp, Oryza sativa
cgaattcgagctcggtacccctaaagggtttgtggctaatctggaagtcaaacccacattggaagatcaaatcaaagaagctcaaaaagatgatgctaatgtcaaagaaatcaagctcaacatgaagaaaggaaaagccataggattcactgaggatgagaatggtgttatatggttacatgagaagttggttgtaccagatcagccagaactcaagaagctcatattgtcagaggcacatgaatctcgttattctattcatccgggaactacaaagatgtaccaggatctcaggaacagactatggtggcctagtatgaggcgtgagatcgcagaatatgtggtactttgtgatgtttgccagcgagtcaaggcagagcaccaacaacttgccggacttctacaaccattgaaggtaccagaatggaagtggtatgagattggtatggatttcatcaccggtttgcccaagactcagttagggtatgattccatttgggttatagttgatcatctcaccaaggtagctcactttattccagtcaagataacttattcaggtgacaagcttgagtattctatagtgtcacct

SEQ ID NO: 85138 - DNA, 1712 bp, Oryza sativa
tcttatcctgttagaatccaaaagccttgatgtcatcctagggatggactggttagccagatataaaggtgtgatagactgtgctacagaaaagtaactcttaccagtaatgatggtcgagttgtaactgttcatgcattgtcttctgagtctttaaggtcaagactgaaccaaataacgttggaagagattcctatagtccgggagtatcctgatgtgttcccagacgatttacctggtatgccgcctaaaagggatatagagttcagaatagatttggtaccaggaacaactccaatccacaagagaccttatagaatggcaaccaatgagtttgcagaagtcaagaggcaagtagacgatttgcttcagaaaggatacatcagaccgagttcatctccatggggagctccggttatttttgtggaaaagaaagatcatacccagaggatgtgtgtggactatcgtgctctaaatgatgtgactatcaagaataagtatccgctacccagaattgatgatttgtttgatcagcttaaaggtgccaccattttctccaagatagatcttcgatcagggtatcaccagttgagaatcaaagaggaagatatacctaagacagcttttaccactagatacggattgttcgaatgtactgttatgtcttttggacttaccaatgcccccactttcttcatgaacttgatgaataaggtgtttatggaatacctagacaagttcgtggtagtctttattgatgacattcttatctactcccgaaccaaagaagagcatgaagaacatcttcgccttgcactggagaagctgcgagaacatcagctgtatgctaagtttagcaagtgtgaattttggttgtcggaagtgaagttccttggtcacgtcatctcagcaggaggagttgccgtcgatcctagtaatgtggaatccgtaaccaactggaaacaaccaaagacagtttcagagattcgcagtttcctaggcctcgcaggatattatcggaggtttatagagaatttttccaagattgctaagcccatgacacgactgcttcagaaagatgtgaagtacaagtggtcagaagaatgtgagcagagttttcaagagttgaaggatcgcttaatatcagctcctattttgattttgcctgatccaaagaagggttttcaagtgtattgtgatgcatccaagcttgggttaggttgtgttttgatgcaagatgggaaggtggttgcctatgcatctcgtcagttacgtccgcatgaggagaactaccctactcatgatcttaagttagccgcagtggttcatgcgttgaaaatttagcgtcattatcttttcggtactcgtacagaggtgtataccgatcacaagagtttaaagtatatctttactcagccggatctgaacatgagacaacggagatggttggaattaattaaggattatgatatgggaattcattatcacccgggaaaggctaatgttgtagcagacgctcttagcaggaaaggctattgcaatgctacgaaaggacgacagttgccattggaattatgcaaggaatttgaaagatttaatttgggaattgccagtagaggtttcgttgcagccttagaagcaaagcccattctaattgatcaagttagagaagcccaaattaatgatcctgatattctagaaatcaaaaagaa

SEQ ID NO: 85139 - DNA, 1215 bp, Oryza sativa
tcaaaggctctgaaaattccactaaaaatcttgttaatgcactggagcatggggaactcaagaaaaaattccaccacgctaattccgattattaattgcatttattaactagggatttagctctaggttaattaagataatttcttcgggcaatttatttaaccaatttttaaagcaagaaaagggggggggggaaacttcagggtgtgacaaacctaccccccttaaacggaatctcgacctcgagattcggaatggctggcgaagaggtgcgggtgggtggccttcaactcatcttctctttcccaagtggccacttcttctgagtgatgactccactgaaccttgcagaatctgattactttgtttctggtccttctctcgctggtttcgaggatacgagtcggcttctccacatacgtcagatcttcctgaatttcgatgtgatctggacttgcctgttcctcaggaactctcaaacatttcttcaacttagagacgtggaacacgttgtggatgccaagcatgttggagggaagctcaagctggtaagcagcttcacctctacgttccaagatcctgtatggtcccacaaagcgtggtgccaactttcctttggtttggaagtgatgtactcccctgagcggagtgacacggagatacacataatcccctgtttcgaaagcgagctcccttcggcggttgtctgcatagcttttctgccgagattgcgcgattctcaatctttccctgacagctctgactttctcttctgcctcatttaaaacttctgtaccaaacaactggcgttcccctgtctgatcccagaagagcggagtacgacaccttcgtctatacagtgcttcaaacggtgccatctgcagactagcttagtaactgttgttgtaagagaactcagcatacggcaagcttttgtcccatgctccaccaaagtcaagcgcacaggctctcaacatatcctctagtatttgattgactcgctcggtctggccatctgtttgtggatggtaagcagtgctgaaattcaaccgggttcccaattcttcttgtaatttctgccagaactttgaagtgaattggcttcctcaatcagacacgatcttcttaggtacatcatgtaaacacataattcttgccatatagagttctgctaatttcttccctgagtaggtagtgtgcaccggaatgaagtga

SEQ ID NO: 85140 - DNA, 2772 bp, Oryza sativa
tgaaatccattccgatttcttcccacttccattctggaatctgaagtggctgtagcaaacctgctggcctttggtgttctgcccttactcgttgacagacgtcacagagtgctacgaattcagctatctcccttctcatgttgacccaccagaacttttctttgaggtcttggtacatcttagtactaccgggatgaatggaatactgagtttgatgagcctcggttagtatcaagtcttttaattccttgttttcgggtacatacaatctttctcccatccagattgttccttattcatcctcaacaaaacctcgggcttttccaactctcatgttctttttgagctctgctatttcaggatcacttgcttgagctatgcgaacctgctccaccagtgtgggctgtgcctctagggcaaccacgaatccgtgctcaactataccaaggttcagatgttccaaatcgcgttgaacctcacaacatagttgctctacccatacaacattgcagtagctcttcctgctcaaggcatctgcaaccacattagccttgccgggatgataatgtattcccatatcataatccttgatcagctccaaccatcttcgctatctgagattcaaatcaggttgagtgaagatgtactttagacttttgtgatctgtatatacctcacaacggttaccgatcagatagtgccgccaaatctttaaagcatgaacaactgcggccaattccagatcatgcgtcgggtagttgccttcatgaggacgcaactgccgtgaagcataagaaaccactttgccatcctgcatcaacacacatcctagcccctggcgagatgcatcacaatagactggaaatctttcgtctgatcaggcaggattaagactggtgcagacaccaaccgtcgtttgagttcttcaaaactcctattgcattcagcagaccagataaacttttcttccttcttcaatagttgtgtcattggcttagcaattttagagaagttctcaatgaaccggcggtaatagccctcaagtcctaagaaactccaaacctgagtgactgtccttggtggggtccatttggtaactgactccacatttgctggatccacagctactccttgagcattcacgatgtgaccgagaaactgaacttccttaagccagaagtcgcacttgctgaacttggcatatagctggtgcttttttaacttttcaagtaccagccggagatgctgctcatgttcttcctcggacttggagtagataagtatgtcatcgatgaaaaccatgacaaacttgtctagaaattccataaacaccttgttcatcaaattcatgaagaaggcaggtgcattagtgagtccgaaagacataactgtgcattcgaacaacccgtaccgagtggtgaatgttgtctgtggaatatcctcttcgcggatcctcaactagtgatagcctgatcgcaggtctatcttagagaacacagtagctcctttcaactgatcaaacagatcatcaatccttggcaaaggatacttgttcttgatggtgacctcattgagtgcgcggtagtcaacgcacatcctcttggttttgtctttcttctccacaaagataaccggagcaccccaaggcgacgtgctcgggcggatgtatcccttctgtaactgttcatcgacttgcttcttgacttccgccaactcgttggctcccattctgtaaggcctcttgtggattggagcagttccaggtaccaagtcaatccggaactcgatatccctttttggtggcattgttgtcagatcgtccggaaaaacctctggatactctctgactatgggaatatcctccagcttcttagtggttttctccactgctacctcttgttcttcaccagcagcctggtttaaactaatccctggcttctgcggcactggagactggaaggttaccacctcttcttttgcattggtcaacttgatggtgcggctggcgcaatcaatcactcctctgtgccttgtcaaccaatccattccaagtatgacatctaggtccttggattcgagaagaatgaggttggctggaaaaatcaacccttgaatttcaactgtcacagatgggcagtagtgagttgtggtcatgccacctccaggagtatgaactcgcattggtatcttaagcttcactaaagataacccatgtgcaccagcaaaacgcttggaaatgaaggaatgggttgcaccagaatcaaacaatattactgccggtgtcgagttgacggggaatgtgcccaatataacctctgttgctgactgcgcctcctctgcagatgcatgattgacacgggcctgaacgaacttgggtccagcacgtcttggcttcgggcactttccaaccgtgtgtccgggtttgttacaattgaagcagagttcgggtttttctcccaacctcttgggctgttctggcagagctggctgaactgattgagctggaatctttagtgaactcggagtagggttgaggctgtgctgctcactgttgttgtgactgccactatggtggttcttgttgaagcttcccgggtggtagggacggtgctgccggataatcatggtggaaggtccaccgtgacgtcccatcgtgaaacgaggcttctgactcttcccctggggagtcctgaactgagctgccttcctcttacggtttattttgttacagtgctcctcctgacggatagccttatccaccagcttctcaaa

SEQ ID NO: 85141 - DNA, 806 bp, Oryza sativa
aaagttacatctccagtgacacttttggcagcagccatctcacattatgaattggtaaggcaacatgaagaaataggcaaaccttactaggggggtgggaggggagagggccaaaagatggggtattcagaccaatcaaacaacggagaagggaatcggtctcctctgatgacttcttcaaactttcaatctcttgcaacttcagctcccttgcttcttctgaatcagctacctttttctttaaggaatccaactcctcctgctgaccatcaagcgtacctctaagatttgatgcgtcttacatctctacctcaagttcagcttcaagctcttgaacccgtgcaacgacaacacctttgccgcttctctttggtgcggttgactcaaggtcaacattctgaagaaactttgattttggcattacttgggaaatgtcacactcagaaaattctcgaaccagaatttctaagctgaatgtgcattaaatccctgtccagaaccagccagggtagacaaatgacaattgttgacatacagacccacgtcttacaaaaatataaaagattacaaatgcagcaggaaagattaaagcgagctaaaccgggaagcttgacttcagcagcgggcgagtccactccacaggcaaaccttgacggcagcaacgaaaccaatctctctgagacggctccactgagaagaacttcaactctggtgtgggggaaaagagagcaagactgagtactacccactgtactcagcaagtcataccggaagaggaagtatgatgcaagatataaccaaaggaa

SEQ ID NO: 85142 - DNA, 957 bp, Oryza sativa
tgttgtatgggtagagcaactatgttgtgaggttcaacgcgatttggaacatctgaaccttggtatagttgagcacggattcgtggttgccctagaggcacagcccacactggtggagcaggttcgcatagctcaagcaagtgatcctgaaatagcagagctcaaaaagaacatgagagttggaaaagcccgaggttttgttgaggatgaataaggaacaatctggatgggagaaagattgtatgtacccgaaaacaaggaattaaaagacttgatactaaccgaggctcatcaaactcagtattccattcatcccggtagtactaagatgtaccaagacctcaaagaaaagttctggtgggtcaacatgagaagggagatagctgaattcgtagcactctgtgacgtctgtcaacgagtaagggcagaacaccaaaggccagcaggtttgctacagccacttcagattccagaatggaagtgggaagaaatcggaatggatttcatcaccggtttgcccaggacgtcatcagggcatgattctatttgggtagtcgttgaccgactcaccaaagtggctcacttcattccggtgcacactacctactcagggaagaaattagcagaactctatatggcaagaattatgtgtttacatgatgtacctaagaagatcgtgtctgattgaggaagccaattcacttcaaagttctggcagaaattacaagaagaattgggaacccggttgaatttcagcactgcttaccatccacaaacagatggccagaccgagcgagtcaatcaaatactagaggatatgttgagagcctgtgcgcttgactttggtggagcatgggacaaaagcttgccgtatgctgagttctcttacaacaacagttactaagctagtctgcagatggcaccgtttgaagcactgtatagacgaaggtgtcgtac

SEQ ID NO: 85143 - DNA, 632 bp, Oryza sativa
tacggtttagttgtctgaccaaaatattttcaagtatatggacaatatataaaaatatagtattaaatatagactaataataaaataaattacaaattccgtctgtaaattgtgagacaaatttattaagtctaattattccatcattaacaaatgtttactgtagcatcatattgttaaatcatagcgtaatttagcttaaaagatttgtctcataattagttattttgggtgtgtttagttccaaagtttttttttctagacttccaactttccattccatcaaacctttcatacacacaacttttcagtcacatcgtctccaatttcaaccaaattttaaactttggatcaatctaaatacaacatttatctatatttaatgttccataaaatttttagaagtttgaaaggacaataacagaacaggagagctcctcggaatccgaccacctctctgcactagtactgcatgcgtcaccgcgccggccaccgttaagaacaggtacaattgcgtaagctataagcctggcttataaacatatttaagtagataataaggagagagaagagtagcgggctacagatttgtagccagctatagcatggactccaagatggggctgcaggaa

SEQ ID NO: 85144 - DNA, 1175 bp, Oryza sativa
aggaccagccagggtatacaaacgataattgttgacatacagatccacgtcttacaaaaatataaaagattacaaatgcagcggaaaagataaaacgagctaaacttggaagcttgacttctgcaacgggcgactccactccacaggcaacccttgacggcagcgacgaaaccaaccctaacaagacagctccaactaggaagatcttcagctctggtgtgggagaaaagagagcaagactgagtactacccactgtactcagcaagtcataccggaagaggaggtatgatgcaggatataaccaaaggaggctaagggttcatttgcataaagcaggcatttaaaatcagtagttgaaagcagtaaaaacaattgtagtaattaatcagtattaaccaatcactgtccaacactataccacgttgcaacaggcccaaccaacaatctgaactacaccagttcattaagctaaactaggggtgagactaatcacggtgaatctgattgatcgcccataaccgcgggcacggctattcgaatagttttactctggccagaggtgtacaactgtacccacaagacacgtcgccatgccccgaagtatcaccatgatactacaaagggggaaatcgtgaaaagacccttcgcataaccctccctaaccatccacactacgctaaggtttcacccccacccctcaaaaggcagtggtgaatccggagttgggcagtcccctcgtgcgccgcggtgaatccggcagctggacaaccggataccccgtccaacccaactccatcacgcccaccctcaccaccggtgcctaggaaagggtcgagctatacttcagatcaagcagttacccactcccgcttgtggtaagcacggtaagtctcccagggtttccagcaaaccggtccttaattgccatgggtgcgactagcaaaaccatgcacccacagcccaccattcagtgtattttaattaactaacaccattgcggtggcaccaatacaaagctatgctaatagtcaaagtctatgtaataatgtgattcccatttgtgtactacttgagctaagcatgactaagcatttcctaaaccaacatctagtcattttgacacccaaattatcaatggcataaggtaaacaatatatggctgagtaataggact

SEQ ID NO: 85145 - DNA, 660 bp, Oryza sativa
ttgatgaaacaggttattttgaatggactgtgtgaagagcaccatatggaaaaaccgaggacggttttcagtgaagaaggggagaatgatgtgaacatggctactatggatacaaccattgctcacatcatggatcaacaagaagacatcaagatcaagtcctccataagctggaattcgattcggccacctgctacattgctgacttcaaacggccgccaaattttcatacgagctccgttttgggtctatgagtacttgatggaaagctctccaagtcctcttttcaacggatccagtcttgttcccagattccatctcagtcgacggcaatcgcagaaacaaggtgctgcgtcacctgtaatgggcctataggcttgtaacttcgcctgggaccccggcccaagtggggcccatgtggggtgcgccccaacctggtggagaacgaccctacggcaccattggtcatcctcccacatccttaaatagctaggtaccccttcagggtttctcgggttttgatgatagagatagctacttgctaccggctcgcagcgcgcgtgttggctaaaccgcccgtctgcctgtaatcggaaccccaccatattgtgttttgatagtgaaactttcatctttatctagcaatttcagtgcttgttc

SEQ ID NO: 85146 - DNA, 615 bp, Oryza sativa
  unsure (1)..(615): unsure at all n locations
agcttgtcgagctcttatcgtatggcctgtttccaatctggtgcaaatccccgaagttttagcacatactggcttggctttggccgcaccatgattttgcgctcaatcacttccctggggacccccggcatgttggacggttgtcaaaaaaatacgtccgcattgtcgcgaagnaaggtgatgagcgcgagttcctatttctcgttcagtgatgcnccgatcttacttgtcttgtcggggttggcactgaagagtggaacaattttgattgcgccatctggtttcggcgtcttagttgttttgctcactttcttgggtggctcggctgtggccggtgggctgggcgtgtgctcgaccatgtcaaggttccgcttgtcgcattggaccgccagctttgtgttcccttgaatagtgattgttcccttcggcccgggcatcttgagtacctgatacgcgtagtgagatgcggccatgaacttcgcgagtgcggttcttccgatgatggcattgtatgctgtgtcaaactcagcaacatcaaatgttatctgctctgttcggaagttgctcgcttggctgaaagtcacaggaagcgtgatcttgcccaatggtttggac

SEQ ID NO: 85147 - DNA, 1206 bp, Oryza sativa
  unsure (1)..(1206): unsure at all n locations
gccgttgtcttcctcccgtgccctgcctcccgcaactccagctccagctcccgacgacgacggcgcttggtcctggcgagccgccgccgtcgcgctgtccctgcgtcttgtcgctccagctcccagcggtggcggcgcttgcaagtctccggcagcagctgctccgaccacgcccggtcctcggccagccacgcaaccgccacattcgagcccgccctcannnnnnnnnnnnnnnnnnnnnnnnntttgccaccggtggggagaccggaggcacacggtggcgaagacgggctgaggctgggggagactggaggccgccatcaccgtcgtgtcccgttgtcacgccctgaagtttcccccttttttcttgctttaaaaattggttaaataaatcgtccgaaaaaattgttttaattaacctagagctaaatccctaattaataaatgcattcaataattggaaagggcattatgggatttttttttcttgggttccacatgtcacaattgattaacaggatttttagtggaattttcatagccctataaataattttaaccaattaaaattcattaaccgcgatattttaaatcccaggaattcatttccctttttcctctttctccttttccttctttttctttcttgggccgtcggcccggtccatcttgcccggccacgctcaccctccttctttttgggccggcccgtgcccctcccttcctccctagggttgccgacaggtggggcccacctgtcggtcgtcctaacctccagccgcccgcgcctaggccagcaaccgccgccgcctgctccagccgcccacgtcgcccgcttcctccaccccactccgcgcctccccacgtcgccgcccacctcctacacctctcccgtacgcgtgcaagctcgcatagaggcgcgattcatttttgaatcccctctctctctcttcctccccactcccccacatcgccggcgaaatagggaggtttcccggccacgtccgccccctcccgcacctataaatcgctcccccgagccccctcaacctttttccgctctcgccacgctcgcccgtgcactccgccgctcttcccacgccacacccgagcttcgccgtcaccgcccatctccggccgcgcgccaccgccttttagagccgccgtagcgctcaccgagtccgcccgcaccttggccaccacttg

SEQ ID NO: 85148 - DNA, 1345 bp, Oryza sativa
aatgcaaggcaagggtgatagtgcaactcgataagggagaatggagttcacagcagtttgccatgagccctatcatccgttatgcccaagccctttgcttgcaagattcatagtagaccacaaacaaatgtcaactggagagaagtcatttttaagagttttgcaacaaaatagggtacctcctaagaaaattatgaagattttcaggaaactaagagtttgtttcggagacataccatttgaaaataaagatgagcacaacatagcacagacagaacatagaaaagcaaactcagatgttgaaagcgcattgaagcacttcacagaattgcagattcaaaacccagaatttctgtacgtaatgcaaaaagatgaggacaacacagttacaagcatcttctggactgatgcaagattgaggatcgagtatgatattttcggagatctcattatgtttgatgctgcctatagcactgatatgtataacatgccttttgtgcctattattggaataaatagccacgcgacacccttcctgttaggatgtgctttgttaaaagatgagaaagtagaaaccttcgaatggatgttgcgtacatttttgcaagtgatgggaggaaaaatgccaagagcggtcataacaaaccaggacacatcaatggagaaggcatttgcagaactcatgccgcatgtaaggcttaggttttgcaagcggcatgttatgagcaaagctcaggaaaagcttggagacttcatgacagcaagaggtaacataaatacagatctacataacttagtaggcaactcgctggtagaaacagaatttgaagaaggatgggttgagcttattgagagatacaatgcaagtgaaaaccaacacctgcaactcatgtggcaaacaagaaaaagttgggcacctgtctattttagagaagatctctacccatttattgactcagttggttccaacgagggaataaactcattatttaaaggtaatatgcttccaaaggacacaatagataagttcattgggcaatttaaggagatacaagagaatatagcaaaagttcatgaagaagatagatttcagtcaggagctgaccttaaatacatctcaatgcaaccaatagaacaacatgcagcacatatttacacaagggaaatatttctgaaagtacaggaagaactactacattctactgcattcaacgtgcaggagatacaaatagggacagtgtacagacttgaaaaggtcttcaactatgagaacccagagttcgatagaaattatttttgaagtgcttgctgaacctggcatcaatgcattcaagtgccaatgtgc

SEQ ID NO: 85149 - DNA, 642 bp, Oryza sativa
tgacagcattcacttttttttgagacagcattcactttgtggcactttaatttgactccaatttgacagcattcacttcatgccactttaaagcacaatagagcaaaatctgcattctgtgaactacaatcatgatttgatactttctaagcatccagcaatggcagatcatttcaattgtcaaaataaaataatatttagtctaacaacttggaatgaccacatagttgcaatttagacatcgattttttttatcatttgaattcaaagcattatatcaacatctagcttacgcatttttcaactctctttttcaagcaggccatgctagactgctagacagtagagatacaatggagtttatccatacctctttaccgacaaaaggtgaagtgttgatggaaaaagacattctgactgtcggttcctctattttgatggtgggcaagggtgttccagaaactttatctgctatggattccccaatctgcagagttcaaagaataacagattttataattatccccctcttaagataaatgtaaaccacgaaagcttgaataaattgtaaaaacaccaaccatgatatcattgattccacatactgcacaaatgtcaccagcactacattatcaactggaa

SEQ ID NO: 85150 - DNA, 756 bp, Oryza sativa
attccgccggagctgggaaaggcagggaaactgatagtgttgttcatgtttggaaatagattatcaggcagcatacccgcagcattagggagtttgacaagcttggaggatcttgatttgtcagataatgatctgacaggaggtattccacctgagttgggtcatctcagccatttgacattcctgaagctgagccataactccatttcaggaccgattccgggaaatatgggaaacaatttcaagatgcagggagttgatcattcgtcagggaattcctctaacagcagatctggttcggatttctgtcaactgctctccctaaagatcctgtacctgtcaaacaacaagctcactggtaagctgcccgactgctggtggaacctgcaaaatctgcagttcatcgacttgtccaacaatgcattctcaggtgaaatccctacagtccagacgaactacaactgttctcttgaatcggttcatcttgccgacaacggcttcaccggtgtttttccatcatcgttagagatgtgtaaggcgctgatcaccctagatattgggaacaacagattctttggaggtattcctccttggattgggaaaggccttctgtcgttgaagtttcttagcctgaaatcaaacaacttcacaggtgaaatcccttcagagttgtcgaatctctctcaacttcaactgttagacataagcaacaacggtttgacaggattgattcccaaatcttttggcaacctaact

SEQ ID NO: 85151 - DNA, 683 bp, Oryza sativa
cgcggcgggggcgaacctggaggcggcgttcaatgagtgctccaaggggaagcccttcttcgcggcgacgccgtcggtacgtggacgtcacgctcggcgccgtgatcgggtttgtgcgcgtcggtgaagccgtgcacgggatgaggctgttcatgcgagccggagcccgctccttgacgcgtggctggaccgcttcgccgcgctggacgctgccaaggcggtgttgccggacaccggtaggctggccgagtacgccaagatgaagcaggcagagtgggcagcagctgccaccaactgagccagcatggccacgtctggtactctcgtggggagatgaagttggtgttggtgtgccacccgtaccgtacgtagctagtcctgtcacacgatgtgacgactgtgtgaactttgctactatacgcaataaaattgtgaagtcgttaagttttcgtaagtacacaccggcgacgtgtaatggaattatatgtactggtcgtcatccttaattagtccttcactcctaccactacttaaaaaatgcatttttcaaatgaggggttttttttttcacaggcgaacattaaccattgaaaccaaatggccgcatacaaaaatataaaccgggctgaagcttattgtcttgcaggcggaccattccgcctgcaaataccctttattttcac

SEQ ID NO: 85152 - DNA, 628 bp, Oryza sativa
tagtcatggtcacatcatcctccccttcttcaaggagaaccgtcctcggtttttccatatggtgttcttcacatagtccattcaaaataacctgtttcatccaatcaaaactagagaaactcgaagtagtgtgattagcaataacatgtttctctaaatccgaacaaatgaaaactctatgcaccaaatatattcctctatcattatatttgccaaagatatgaaaaatagcattagttggacgtggcaaatcagacttagcaaataatttctccttcaaattatcgagctcacaaaaatcatcaaactgaacatagcccaaagtatttaaagaagatagcaatttacgttcctcaacttcattagcaatgtgaacagcatgcttaaaatcagcacacaaagaaacactaggaatagcatgctcattcactagttgtggcatggatataagtgaagcattatcacacaactcttctttatcacaaggaacagcgagtaaatcaacttgtgacaaaggaattccagcatttggttccactaacggttgctctacttttgcatgaaaagtgaacaaatttacttcgttaataatgcactcaccttgattaatttcagtaccatttacttt

SEQ ID NO: 85153 - DNA, 714 bp, Oryza sativa
ccaacgatgacgtctggagttgtcagcacatcctcggcagtcacgtggttcacacgaccccgaatgacatccttaccaccattgttggggcggggaggcgcttggccttgctggcgcctcggctttgggcatttatccgcaaagtgcccgggctcgaagcagttgaagcacagacgctgctgaccttgaacttctctgcggccttgaccaggctgcacaacgggcgcaggaggacggggcacacgggtcccttgctgactctgctgttgctgcggctgtgaggaggatccccctggatatggattggtgtagcggaccctttggttagccccctgttgattgcggagattcgccaagcgacgcttctgcgactccagttccttgtgcttggcttccaagcggatgctcttgtccaccagacgttggaaatccggatagtccccggagaccagacgcacggacagctcagggtccattcttgccaagaacttctcttgcttctcctcatcttcacgaacatcctccggggcgtaccgggccaggttgttaaacccatgcaaatactccatcacagagcggttgccttgcttcaactctcggaattcccttttcttaagggccatgactccggcgggcacatgggtcctccggaaagcggcggtgaagcgggcccaagtaataggctgcccctctggctgcgtagcctggaagtgg

SEQ ID NO: 85154 - DNA, 1217 bp, Oryza sativa
aatcccaaaatatccaaactcatgttttgtttccttccttgactccttgaacccttgtgtacaaagtatcaaatttagattcaaaacccaaactccaaatctctccaaatcaaaatctttcagcaaaaatctattttgcctcccttgtcgatgggctgatgtcacgccccgaactagtaccgaccggaactagcccgtgacgctccaaattaacctgttaatcgataccagtcccaggaaacagtgctggtatcacaggaagacagaatatcacagcaacagaggtctctttattatagagtaggagtacaatcaagtcgggctgcggacagatcccgagttcacaactgcattacaaaagggaagcggaagccaggacttggaccaaacaacataggcgcgacttgggaactaggccgaaaccctaaaactcatcgtagccggcttgctcctggaagaactcctcgtcagcgggatccgcttcatcttcttcagcaactgggggggagattatttatgtacagcaagggtgagtacaggagtactcagcaagccatgggaaataagtgtttaatgcaggcttcaagggaaaggctgttgtttttgcaattgattttatttaaactctttttcgaagcagctaagtgagtgcttctcaaacgacacggatgagacagtgcgtctcgtctggtcggagtatgtgcaatatatcagtctttgaattgattcaaggttggcacccggccaacagctttcaaacggccacccgggcctggctgatcccatcagccgcagattttccaaacatcgatcccattccacaacagcaatttcacaaagcagtagtcaaacaaaactacgctaggaatcacctcacatccgcccatgaccgtgggtacggctgttcgaacagtttaataacctctgcagagggggtacactttacccacacgacattactaacccggataacccagcccgtgcagaacggccacgtctggagaccttgaggctttcatgacaaggcatttcgaaagccaacacaggtttaccatatgccaacaagaggggtcccagaccaacaacaggttaggtcccagaccatactgtgccaggaagcccgagggttctccccgacaccaccccgttgaatccacatgtctcttggcatcatggctcccccgattagctaattactcagccaggggcgtcccatt

SEQ ID NO: 85155 - DNA, 556 bp, Oryza sativa
tttcatagcactaaaaaatatcaaagctatttggattgacgataaggttttaactggctttccttgcgttaaaatgtaaaaggcatacaggctatctatgacgaaagacgtggcaactgtactgtggactactcagacaggacggctacaactcatacctctgaatcccttggtttgccacaaggaccatgggttcaagagggtggaccacaacgcgctgtgcatggtgcatacatatggcctcatcgactcaggaatcgatccaactcatcccatcttcgcatactactcgatactgaccgtgattctgtgactgctcattactacggcgtgtgccacgctacaaatgattctccatctggaacctgcatcatacaactcgtgtgaactacgcatttctcgtcctacagccataaccagcggagtgttcaatgcctctcaagatcatgcttcatcttctgatccagatggccatgggacgtaagtactatatgctgatccaacctttatacttatcggcaggagcaagaataccacgcccttaccattctactac

SEQ ID NO: 85156 - DNA, 532 bp, Oryza sativa
tccgtgcccccacccgacatgaacctgcagctcggcgagctgctggagaccgagaagggcgccgacgtggtgttcgaggtcgccggcgagaggttcgccgcgcaccggtgcgtgctcgcggcgcggtcgccggtcttcggcgcggagctctacggcctgatgaaggagggcaacgccgccgtggtcgtgcgcgtcgaggacatggaagcgcgggtgttcaagctgctgctccgcttcatgtacaccgactcgttgccggagatgaagaataaggacgcaggcgtcatgtgccagcatctgctcgtcgcggcggatcggtacaacctggagaggctgaagctgatatgcgaggagaagctgtgcaagcacattagcatgggcacggtgtcgaacatgttggtgctcgctgatcagcaccactgcgccgggctgaagaaaacgtgctgcaattttctcggctcatcggcgaacctgagtcctatcagcaggggctgcctctctgttataagagcttgtgttaggatgctggtgc

SEQ ID NO: 85157 - DNA, 655 bp, Oryza sativa
aaataattttataagatcataaggcggtttggatggtggttttgcctaacgtggcgcctacgtggcgttgatgtggcacaaaaattcaaaaaaaacccaggagtatccgattaaaaataaaaaaatacaatgggaacaggggcggggttaggtttttcaacttgggtattcgaaattgtaggagagaaaattttccaacccaagatctaatagttgtataatatgcaacggtataagcatgatttcataaagtcataaatggatagaattgaccataaattgaatgcgttaaacatattagagtacattactaaactattaattgaaaaaacatatcaaatttatagaccatacaaaatggcaaaatgataagaactcttacaatatagagaagaactttccgtttcttgatattttgaaaatgattgatgatgtcttcattcttaacttgcaagaagaaatatctttcaatgaatataaccaagcaatcattcaaatattcttgccccatcttgcttcttaacttgtttttgatatagttcattgaagagaaaaccctctcaacactagcagttgcaacagggagaactaacacaaatttcagaagtttgtaaacaaggtcatagcgagaaaccttgtttgttttcacaagcat

SEQ ID NO: 85158 - DNA, 1513 bp, Oryza sativa
tcagtgacagtcaatttgatttacacattttttttgccttagtgtaggaaaaagtgaaggataattattagttgattatcctgtaaatttcttacccttcatgcttaattccatatcaatctattctagagttcttttgctctcactgcatttccatgtgataaacacaaatctgtagtatcgtgctgtaccacttgatataactatctgtattgagaagtaaaatggaaatattatgttgccacgcttcctaaatccaattaacaagtgtcttatgagcttccattgatactgatttgaaaatatcctccgaaacattttttttaaaactcattgaatgctgatggattgtgcttgaacaggtccattgcaattagtactccagatgtgaacctttcagcggagaatgttattgccacaatgtcttcttttgactggtagatttgtatgatcaaatatagttgtaccatcaccatggacacattattccgatcattatgtaaaactttattttcattttttatatgcattggtgcttcatctttagattgtaatgtgtaagagttttgttctcagcagaatctgtacaacgatgtatgcaaaattactcatcaacagcatcccctgcaaatgtattcgtgggttttctccttacataatcattgattcagccagaaaacaaatgattagtctacagtaatcaaccaatctatgtgtaggcggcgcgccattggcgcgccccagcatctagttaagtttaataccaggtaacaagtgacaatccatagagatttaatagtgaagctgtagggatagtaaaaaaaactgagacgatttctaacttctgcttaggatagatggtaaaaggcctaaacacggggaattcacccgcatatcagtgtgctaaaagaagataagcaaattaaactacctgatgacaaaggttcaaactcagcaacaaaaactaccactggccattgcaagaacacatgaacagtaagtcactaagcatgactccctggaagtgccagcgtgacaaccagctcttccataagagaggggcaactcctgcaaagatgcttgaagccatcactggcgacgacagcactcaggtttgccagtgagccgaggaaatcgaagcacgctttcttcagcccgtcacagtggtgctgatcagccagcggcaggatgttccataccgtgccgacgctaatgtgcctgcacaacttctcctcgcagatcagcttgagcctctcgaggttgtaccggtccgccgcgacgagcagatgctggcacatgacgtcttcctcctccatctccgggagcgagtcggtgtacatgaagcggagcaacagcttgaacacccgcgcctccatgtcttcaatgtgcacgactccatcagtgtcgccctccttcatcgagccgtagagcgccgccctgaacaccggcgaccgcgccgcgagcacgcaccggtgcgcggcgaacgtctggccgccgacctcaaacaccacat

SEQ ID NO: 85159 - DNA, 1240 bp, Oryza sativa
catgactcgatggagggattggaggcgccagcatggcaaccagctcattcacaagagaggggcagctcctgctcagctgctcgaagccgtcgccggcgaggacagcactcaggttcgctggtgagccgagaaaatgtaagcacgccttcttcagcccgtcgcagtggtgctgaccagccagcgtgaggatgttcaccaccgtgccaacgccgacgtgcttgcacaatctgtcctcgcagatcagcttgagcctctccaggttgtaccgatccgccgcgacgagcagatgctggcacatggtgtcttcctcctcctccatctccggcaatgagtcggtgtacatgaagcggagcaacgccttgaacacctgcgcctccatgtcgtcgatgcggacaacgcctgccctgtcgctatccttcatcggaccaaagagctccgcgctgaacaccggcgactgcgcagcgagcacgcaccggtgcgcggcgaacgtctcgcctccgaccccgaaaaccacatccgcacccttctcggtgtccagaagtttgccgagcttctggttcaggtcagacgcggaggcacggtgacgaaggtttcggtggcgatctccgtcgtcctctcggtgcggatctcgccgacgacggctatgtcgcaccgaatggtgaaagaatcgtccctgagatcgtcggacttctcaaattcgtcccttttgatcaacttcacatgaccccaagtcaagcactcgtcaccaaaagttcttactggtctagatgacagcactcgtcaccaaaagttcttactcgtcaccaaaactattttaacagctcgagtggacgtccacctgagtattagaatctctctccgtacctgatcggcgaaacaaatctgaaactgggctttaaccttcacacccttcgtgctggtggcattttcatctagcatgaggtgaaatgatatgtaatcggcgaacatggcgatgtccccgttggggtagtatctgatgcgccaacggtggccgccgacgacgaactggtcggacgtgagggctgcaccgttgggagtgcccttggttcgcgagtagccgtcgatcttgaggaggtggtacccggtcaccgcgtcggccacaatggaggaggcggtgccgcggctgacggcagtagccatggcaggcaggcaggcaaggttaaccgcctgctcgagacgaacgagatgaaagacacaggatttggttgggaatatgctg

SEQ ID NO: 85160 - DNA, 2015 bp, Oryza sativa
tgttcaaccgtcaggcagatccaactttgttgacgggttgaatagcagtgaagaagagacatcaagaaaggcaaggttgggatgtagcgaggcctaggaggtcagatctggtggccacgggcactgcgagcgatggatccggtggcagcaggcctcgagagctccagtagcagttgatgccgtgacgacggtgggcttgggtgcatagatcttcccttttttccaccacgattgtatatgtgagtttgcgatctgattttatatacgtatgaaccaaaaattgttgaactagatccaaattattgaattgaatttgtgtaacgggatccaaactgttgtgtgtttgaattgaattaaagttgttgaattatattttttagcaattggtaattgcgatggaactattttcttgctaaaatcatttccagaataagccacccatccctcaaaagtaatttgtgcagacggacggctttaggccggaccgcacataaaaattgatttttccctaacggttccttaggtggacggcatgtaaaaattggacttttacagctgaactgcctttgaaaatcaacattcccacattgtttacgtatagtggtaaaaccgcattcacaaatcatagaaagctcttttgtagtatgaaaaggaactagagttaccgatcaacgtgagaggagttgtttaacaaaaaaaaagaaaaaacccggaaagctgagaggagttttttaataaacaaaagggggaaacctgagagttgtgatacgatgcgtggacacactggacagtggatatcgaaaaacttttgctgtcgtgaatccgtcgtctcgtctctctcgttgcgtctccttccaccttaatttgcaacattagttccttcttatctccagcgcttaaccatatacgcgaatccagcagctatagcgtcaagcagcaaagcaagcaatagacgacgagcccaccttgccgtccatgggtcaatgcgccatgtctcacacgcgctctaccaccgccggcgccgccggcggtaagccgccgatcgcgccgccgccgacgtcctccgcctccgccattgtcgccgacacggccagcgggtaccacctcttcaagatcaacgactactcgcgtaccagggacatcttccccaccggcagtgccctcaagtcccgcgcgttcaccattggcggccaccaatggcgcatccattactaccccaacggcaacacggaggagtgcggcgagtacatctccctgtttcttcatctcgacgagattgtcaccgacaagaacgtgtacgcgcagcacgggttccgtttattcgacgagtttgccggtgataatgatgacgatgatgaactgcagccttcctccatcgctgacctcgggcaggtcagtacctttggtggcaacaacattgggttgggacgactgaggtttatcaaaagggaagagttggagaaatcgaagtatctgaagaacgactccttcaccgtcagatgcgatgtcgtcgtcaccaagcggatccgctcggaggagacgccattggtggtgaggacctctccaaagccaaaggtggcgaggctcgtcaccgtgccgccgtccgatctgcaccggcatcttcaggacctcctctgcgccgagaagggcgccgacgtggtgttcgaggccggtggcgagacttttaccgctcaccggtgcgtgctcgcggcccggtcaccggtcttcagcgcggagctgtttggatcaatgaaggagagcgacaccacggtggtcatccgcatcgacgacatggaggcacaagtgtttagggccttgctccgcttcgcgtacaccgactcgttgccggagatgaaggagaaagacgaaggcgccatgtgccagcacctgctcgtcgcggcggacaggtacgccatggagaggctcaagctggtgtgcgaggagaagctatgcgagcgcatcgatgtgagctcggtggcgaccgtcctggcgctagctgagcagcaccattgtga

SEQ ID NO: 85161 - DNA, 832 bp, Oryza sativa
accccaagttcatcaggagagaagatttggagaaatcggagtatctcagggacgattcgttcaccatccggtgcgacatcatcgtggtcgacaattaccgtgccgaggacgccagcagcggcgctgccggcttcgtctccgtgcccccgtccaacctccatagccacctcggcgacctcctcaagaacgagaagggcaccgacgtagtgttcgaggtcgccggccagaggttcacagcgcaccggtgcgtgctcgcggcacggtcaccggtcttcaacgcggagctctttggcatgatgatggagagcgacaccaccaccaacgatgccatccaaatcggtgacatggcggcgccggtgttcaaggcgttgctccacttcgtgtacaccgactcgttgccggagacgatggaggagagggaggacaccatgtgcgagcatctgctcgtcgcggcggatcggtacaacctggagaggctgaagctgatctgcgaggaaagattgtgcaagtacattggcataggcacggtgatggacatcctcgcgctggctgatcaacaccactgcaaggggctgaagaaggcgtgcttcgattttctcaggtcgccggcgaacctgagtgccgtcaccggcagcgaaagcttcgagcatctgagcaggagcttcccctctcttatgaaggagcttgttgacattctaggaacttcacataattatgcttggtgagttgtggcaatatatcctagcttatttaggaagaaactccaaatcgggtgcctgattgtttcttaaaaaatcggatggtcaaatattttagttgaccactagtgaaa

SEQ ID NO: 85162 - DNA, 875 bp, Oryza sativa
tcttggggtcacagaaagttcatcaaacgggaagatttcgagaagtccaatgatctcagggacgactccttcaccatccggtgcgacgtagcggttatcggagagatccgaactgagaagacgaccgagatcccatcagccacaacattcgtcactgtacccccgtctgacctgaaccagcagctcgtcgacctgctggagaccgagaagggcgccgacgtggtgtttgaggtcagcggtgagacgttcgcggcgcacagatgcttgctagcagcccggtcgccggtattcagcgcggagctctacggcttgatgaaggagggcgacaccgccggagtcgtgcgtatcgaagacatggaggcgcaggtgttcaagctgttgctccgcttcatgtacaccgactcgttaccaaagatggaggaggaagacgtcatgtggcaacatctgcttgtcgcggcagatcggcatgatctacagaggctcaagctgatctgcgaggacaggttgtgcaactacattggcgtcagcacggtgttgaacatcctggtgcttgctgatcagcatcactgcgacgggctgaagaaggcgtgttttagttttcttggctcactggagaacctgagtgctgttgtcaccggcgatggcttggagcatctgagcaggagctacccctctcttatgaaagaactatttgttgtgatggcacttccaccgaatcatggttaatattcttgtgctctagcaatgatagttgttggtttctcaatctgaagttctgaacctttctcatcaggtagatatgttatcttcttttagcacgcaggcatggtgctgtactccctgtgtatctatgcttttgttatcaggtacactat

SEQ ID NO: 85163 - DNA, 754 bp, Oryza sativa
gcgtcgccggccggcggaccggccctggcataccctatataaaccatacctattttctgatttcaacacacttcttcttcttctttcaacacatctccccaccgtatctatttttcatagaaaatatgcggaggtccaaaaagcgtcaacacgagtcgacaaccggtccataccagaggtcggtcgatgcccggcagctatccccgggcatggacgactacgggatggatgatcgccacatggatggtctggagggcgatgacggtgatcagccatctcctggcgaggccaacttctccgtcgacgtcgacgccacgacgttgcccacaccaaattccgataaccagccatctgccagaagagcggagtgttggcgacacttcgaattattcaccgagatggttgacggtaaaagtatacctcgtgctcaatgcaaatattgcgaaaaaattttgtctgcagctacttcttcagggacaggccatctcaaccggcattacttggcgcatctcaagaacaaggcgccggcaggagcaagacagacacatttgtccttcggccctgacggttcagtaagtacatggacctatgattcaaaaatagctagagaagagattgctaagtttattgttgctgaggatctaccaattagaatgggggaaagcaaacattttgagagaatgatccaaaaagctttttgcccacagtacaaaaaagtttctaggaaaaccaccaagaacgatattacatctat

SEQ ID NO: 85164 - DNA, 551 bp, Oryza sativa
tccaccacccaaggagatcgacatcgtcgccatcaagcgtcggatcatgctcagtatgatcggtgacgaggtagtggttaagctctgaatccgggttccatgttgatttgttctgtgaggatggagaggcttggtccttgcctgtatgctgcttccacaaatttagtgcacttgacttgcttgctttcttttgtgaggtctgctcaggaactcggggagtaccaccaagcttggttcggtacagacggaaaaccctatagagctcattattgacatgttgaaaagcttcagaataatcaagccccactgcatcacctattgagttcatggcaaccttggcaatttccaactttttgcgaggatcaagtatcaaagcaaagcaataaaggtgaggtatagcggtgaagtatttgagaaatttttcttccatgggtttaacaatggaagacagaatacgatcagaccggttttcatccaaaacaagtgccagcttccaaatccactcaagcaccaaacaagatgtaggatagtaaattcctgataattgaact

SEQ ID NO: 85165 - DNA, 5507 bp, Oryza sativa
gaaaagtagtgagggctctgaagaacctcatcatcacagggaatcactttttgaagtgtttatgcagtttatggaaccattgattttagagtgtaagtcatattcggagaagaacttttctaatttaggggtcacaaagctagtagaagttcattgtatgttgaagtccatcaacaaggtattgacaacagttattgaagagaaaatctatgtacctacagaggacacatcggaaggatcttactttgagttcttgcaagatatttacagggtcttagtctcaatggccgaaaaaatgtatgaattctgggtgtcagctgtgcatttggaagatgcaaacgttaagaagatgctacctttaatgtttgctgagattgtcgatgcagttggtcatttgttagatattgaatacaaggtcatggggcgggaccttgtaaaattatggttaatgatatttgctttgtcagctactaatgcatcttccaaggacattaaaccctgcttcctgctagcctcaaagatttctggcctttcatcccaagtgatttgcacattcagtgagcttcgtcaggttggttatacaacttttcagaagttctttatgttcttatactctgctttgtggtccttaattgcctatagacctcaattctatatttgaattatctaaatatctttgcagactgccatgttcattaggttggtttgttgattttcagtatgatgctctctctccgttgaccttattaattattatgtaggtttccttctccatttttacattgtgcggtgctgtgagaacattcagagctgctgttggtactggtgttgcagcgagttcattttctgtgtcttcgttatcctcagataaatgtttggaatcactagcagcattgttaagttcccagacattgagggatgctattcgtacttcaataaactcaatgccagaaggacagtctagtcgttgcattgaggagctaacattagaccttacaggtacattgaagtggatgagaacttgtggccttttggatgttaaattggaagtgcagggggaatcatccttggttacaagggattcagtgtttggtcagagagctgaacttctaggaaggcatttatcggaaatatacacaaatgtgctcgagtcaataactgtgaccacatcaaatagtacactcgttgcaaaatctgttgaaaggttggttgatgcaatcagaccaaatttatgtcatttggtgagaaatgaatcaaatagttcaagtgagtttgtttactcagttataggaaagcatatctctaacaaacaaggtgccaactggcagaagatcccaagtttatcttggctttatgtcttcttttttcgcatatatatgtcatgtagaagtttgtatctgcaatctattggcctcatgcctcctgattcagcgatagaagcaacagaactagtggggaattcattcgttgtatgctgcgggaaggaatggaccaattcagccaatattctcgcagaaggctactttgcttggattgtccaaaattcattccctctttttgatgctatcgagattttaacacaatctctttcgagaaattgttctgggtttactctgcttgttttcatccttcatgtgatggctctgcagagactaaatgaccttaacaggcagattaatgcttttgattttttgcttgaagatgatacagatcaatttgacaaggagaatagtgaaggcactgagttattaaagaagtctagctgtctcgaggccacacaactcaccagttttatgatgagctatgtgagactattatcatcaggagaaaccggctctttttggtgttatgagattagttcttcctgggattcaagtctatgctctttagatgaattttcatttcctatagcaacttggcaactgctgtgtgaaaacattgatatttggagcccccatgcatctaaaaaggatttgaagaacttcttttctaatctgataaagtttgcttttgttgaaaagaggtcatgcaaagatgtggagaatagtggcagccaatcttctcaccgagaaattactctttgtaatgtttcagtgcagctcctttgtgatactattatttatgaccgaaaggtatgtcctctcttaatccttccatccaaagataatatagtaccatttatctatgatttattgagtatgatgacaatattgatgtgctgtaataatgatcaatgttagtctttagttctatgttttggtgatttctttcttgtgccctctccaaattgcttggtctaatgcaaacttacaacttcttaggttctgttgaagaatttggtgtcaggtttttgccatgctctgaagaaatcggtattgtcttttgttactgatgctaatgaagataatgacttgttggactcgccacctgatttggtggatatattaactaaactggaaaatgagaagttttttagtacaaattctgatgttacacacacaaatggcatagataaactatggatttgtgagaatttacttaatttttttagtacagttcctggatttcatgcaaactccaagtcattgttgcaacttatagcttacattctccatctggaaaggtaagttcgcattttatatttttgttcatgtgtactaactacaatggctattccttgtataatcatagtacaaatgtatgcacgccctttgtttataagtactaggcacttttgactgagagtagttcacaaatagttatcacttgttaatttccccaatgcataatttttcatgctatgctctatatcattgccgttaattatttgtctcatggcagtaattggagggcacaaatgtgaaacacttgagacttgagagaaagtgtccaatgtttatttgttcttatgaagatcttggtggtctttttagttgaacttcttgtttattacaacttaatttctttctttgtaaataattgtttctctgggttatttctagtggattttgtgttgtctttattgatattggggttctctagtctttttcagtatttcctttttgttaataaggcctatgatcagtttttgatgcaacgaattgtgatggtgaactgcgtgcatcctagttagtcaaaatgtcctgggaatctgtattgacaacaattttgggaaagtgcatggtgatatgcacattgcacatttcttagctgcaactgaaatcttttggttatctccttgctgagaatgacattttttcaattttcttgcagactgctgctattggcaatggtatgccatcgttatgaatcttgtaattccatggggctacttcgtctgtttgtatgctgtcgaagagcaatgaaaaatcttatcttcaattttggtaaagaatttccagagttgaagcaatactcagcattttccaaaatttttggtggctcctgtctgatttggcttttgaggtctgttcaggaacttgtcagtttgtcacacaaaatatttgaagagcacactgatgagatgaaaaatacaattttctccctggtagataagacatcagaaatattttcaacactaactaacatgaattctgtattttacttgttgggtgcaaagaaacaaatcatatcttccagcggagaaagcagtactccaaaacatgatgatcaggcattcagcatactagaaaattcagctttggagcatgtcaaaattatggctgaactgttagagaagtctacaactggcattcctgtaactgttaagggtagtcagtgtgttatcaaattagagaactgttatgacactgtatgctgggatagattattatgcaccatgtcttgcataagaggattcttgtggggtcttatttcagcactagaaggcacatgcaaagattatctatcaagcccagaggaaaggaacgtgatgtttcagtatgcctccagattcagtgggtgtgttgctaagtttgaggcctttgtagatatttgcatgcatgtcttgtttatggagaccaaggattgcgagttggctgatttaatctctgttcatcttccacaagagctggactgcgagaacaactctctgaatattactgcaatcatggatgaatggactaggcaccaacctgaggagatcggatttcactcagatggtgtactaaatatttcaactgagactcgtggttttgatctgcccaaagtacaatttgtgaaaggatttcttttagaaaaccttttaagtggtgagggtccatccatagcatttactttaagggagctctacaatgcatctgctgctattgttaagctgaagggaatcctatcatttccaagtgaggtatgtagacagatatgcagtcctttccaaaagcttccattgggtccaatggttgcgacagcttacatcgctctacacaaattagcagacatgtctaactggcctgacatgttttctcttttatggattgacggaatattaagttatcttgaagctgtaggaaacattttggcattacctgagatcaacatgtcaaaagaattgtacactcaagtagttaatgctcacttgagagctattggaaaatgcattttgcttcaaggaaagaatgcaactctgcctacccatgagattggatcaagtacaaagacactatatttgcagaatagatctggtcatgttgttgctaaaggtatcatcaataggcagaacagattaaattcactgaaatcaagacttagactatcactgggaaaatatgtcaatgtttcatcaaacatgcatctaaatacagctgtgcaagtcattgaaagagcattggttggagtgaatcgtttcagtcattcaatatatgaaataaacacaggaaattgtgatggtgggacagtttcttctgatgttgcggctgggatttattgcctctatctggttcttgaaactgtgccaggttagtagacaattttctgtctggtacttccagattcactatgtttgtaatgcaatgtggttccatgcactgcttcaaagaagtcaataatctactaaatattttcaaacatgatctcatgtgcaatagaattgtctgccaacactgagtgtgtttgacaataccacaaattatcatgactaatctgtcttttcaaatatatgctcaaacaccaactagttaatatcaggtaataagcatggtcctcataaaatatatgtaggtcttcaataattaggaatttttcacagaaatgcttgacacactccttttcatattcatggcacctcttttggtagcatattaatatgctgtcggttcttgtcagtctaaatagactatcgcgttacatggacattgtccagaatgcatgaattattctcaactgagtggagtagttgagcaattcaggatggacctacttctaccagttcacctccacctgctgaccctccaaaatttaactgtgtttgcctcgatcttgttttgctcatatgtatgcgtatgaggatttgg

SEQ ID NO: 85166 - DNA, 515 bp, Oryza sativa
acaagtttgtttttctgaaataggcttaggacctcctcccttgcacggtgctgccattctgggggcatgcttagcacaccatggtccatgtgaggagtatcgctgtcgtctccatccctgcaaaatagaacactttgcactcttccatcacttcttcgatggtcatccccgggcctgaatgtccattctcgtctgcatgcctcgtgcttgactctagtaatatcccgagcaaatcatctttggttctctcgccatctttcatagcatgcatccttttctggaccagatctcgtataattgattcaacctcgttcttaatttgatacatccttcggttgtttttggtaggcaaggacctgaaagggcacaccgcttcagattttcagtacagagaggaactacgagtactgaataacaaacatttaatttcgatagaaattatgtataactgtaaggtctggttagtgttacaatagaggcgtggagcataaaccactaaatcagtgttgatgaac

SEQ ID NO: 85167 - DNA, 2064 bp, Oryza sativa
aacgtgtttttaagagaaccgtcccaggcctaattggtgctttattcaatattgtcttacatcttgaaagtccttttattttctacacagagaggatgcctgttcattacccttatttgcacccagatgctggagccattgtcctaatgtgtattgaggttataacagcatttgtggggagacattcttttcaaattgattcatgccatgtctctcagtgcttgcatgttcccatgacactttttaagggcttcaaacatcttctttcatgtcggaatatgccccattcttgcaaccagagtgaagagcaactggcagctagtaatgaatatatacttgatagacaattttcagttgacatgtatgcttcatgttgcaaattgttatgcactactattcgacaccaacagcggtaaaatattttgcctctcgtattttcattctgtagttatatattattattttcattccatattgttatatttcctccttttatgtctagtgaggttgcacgatgcgtggctgtcctggaagattcagtaaacatacttctaagttgtttggagtctccaaatcccaaaatggttagtagggccggttatttttcttggaacatggaggaatcaatgaaatgtgcttccttttttagaaggatttatgaagaggtcagtgatgcttatatttctgttatttgagatatatgtatcaatgtatactccctttgatcacgtttagtatgcgatgcacctactccaccattagccgcaacgtaggatgttagtatccaaaaaagagtatataaacatgaaccccgtagaagaaatggccctgtggacaatgtataccatatatatttaaggttggtaagccaacaaatcatatgcacactaattatccttttttgtggacaatgtagatgcgccagcaaagagaactcctaggaaagcactcgatgtactttcttgcaggttacatttctatgtattctggacagggtccatttcagacaggcataacacggtatgcccttcctaatgaagctctttcatttatgctttggatcagcaattttacttttcttacatcgcagagaaattgatgaggccttgagacctggggtttattcgcttatcgatatctgcgaggaaagtgatcttcaactgctccacacatatctgggtggtcagtaactcctgcttaaccttttcttaaaatgcttaatctatttacgaataaacaaatgtaactactataaatacaaactgatccccaagataattccttttttcattctttggctttgcagagggtccatgccgaacaacttttgcaaatctggtgcaggactacaaattacacttccagtatcagggcaaaatctagtcaaacttgctaaaggctttttggagcatttgatgttgatccgtcttattctgcataagatatccaatgcatcatctgcatgatcttgggtttgtgctgtactattaattgctgactgcttatgcactgaattttcacccttcagaacggaaagggaatatggctgttgctgaaggtttttcaatctacccttttaacttaggagccaaacaaacaggatggttctgaattctttcctttattttgcagatttaaagctcatcaaattaatctgctggatttggaacaagatgaaaaggagcaaacaagaaaatgagcttagtaatcaagatgagaaggacttggtgatctgcagcctttggctcttgttccataaatcacaacttggtaatctctagcacgtagtgttcatattctggggtaatatttaacacacttgccccccaaactaaactaattcttttggaaggtagttcaatcagactgatcctatccaggccatactccatattactaaaattgaatttgttttcaccaaaggtgctaacaatgataaagatgatacggttctaaatgaggttataatttctccgaagggtatgtttagatgggtcacaaaatgttggtggagatgtactccaacatcgtatgtattctggagaaacttattaaagataagtc

SEQ ID NO: 85168 - DNA, 833 bp, Oryza sativa
ggggcctcgggccaccgttcggctcgggggcctcttctccctgctctctcccgggtcgagtcgacacagggtggggatgcgcggagtgagggctgtcctcgtcgcgctccacgaccaatgccgcgctgaccacctgcggggttgccgccaggtagagtagcaacggctcatctggctccggggcgactaggaccgggggagaactgaggtacgccttcaactgagtgagggcccgctcagcctcctccgtccaggtaaacggcccgaagcgtttgaggagcttaaataggggtagcgccttctctcccagcctcgatatgaaccgacttagggcggccatgcagccggtgacgcattgcacatccctaagcttgctggggggcgcatccgctctatagctcgtatcttctcggggttggcctcgatgcctcgggcagagaccaagaacccgagaagcttgcccgcaggcacgccgaacacgcacttgtcggggttcagctttatgcgagcggagcggagactttcgaaagtttccgctagatccgagagtaaggtctcttggttgcgcgtcttcacaaccaagtcatcaacataggcctcaacattacgtcctatttggctacccaaagaaattcgagtagtacgttgaaaagtaggacctgcattctttaacccgaaaggcattgtcgtataacaataagttcctatgggggtaataaatgcagttttttcctcatcctccctagccatgcgaatctgatgataaccagagtatgcatctagaaaacacaaaaggtcgcaccccgcggtggagtcgacaatgtgatctatgc

SEQ ID NO: 85169 - DNA, 888 bp, Oryza sativa
ccaagttgttcttttctttaacaaaaaatttattcagtcatttgctaaaaaaaagctatatctaattattatggttgattaatgaacggctataagttacaaaaccacagggtatttagctatttgtcattattagagttgacgtttaactatttgtaattcatgtgttggatcaggtgtggtaaatagttaattgtcacatataaggatggtaaatttagagatggttgtctttcttagagctaaactagaatctctgagatgagcggctgattattgttttgattaaactagtatggtggcccgcgcagattgcacggctagtatcattatatcttctctcatataatagcatatatgttttctcaacgtattattcaaatatattaaaatgacaacataattttaaattttgtactaactttacgaaactactaatgtgtaatattcatattggattttatatacgtgttagttattaattatttttaatatcaaactttagtaatttataaattatattcctatatggactctagactcgtctttcaatatatttttttaattccgaattttcgttacctgtaaattatatttctatatagactctatgctctttttttaatattatttatttttaattctgaatttttattatttctaattgtatttctatgtagactctaaactcatctttcaatattctttaatttttaatttcgaatttcagttgcttctaaattatattccaatatttgtattcctatattgactttaaattcttcttccaatgtttttttttaaattttgaattttagttatttgtaaattgtatttttatacagactctaaactctacttttaattttattatgtttattccaaatt

SEQ ID NO: 85170 - DNA, 1030 bp, Oryza sativa
agggggtacactttacccacacgacattactaacccggatcacctagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccctgacaccaccccggcgaatccacatgtctctcggcatcaaggctcccctgataagctagttactcagccaggggtgttccattccacccatgtggtcgtacttgtcttatgtttggatgaaattccaaggaaacggtccttaagtgcaagagcgggaaaccgtacacccgatacgttccccggtccgctgttttggaaattcatttagttcgcaagcaccgacccaggtgtcgggttttccaagtctttcgtaaaacccaagttttacccaagaagttttttagattttaagtttgaaggcgtccgtcgatactcgcacagggtgcacgaatatcaagacgcaactagatggttacaaggggacacgatataacaattatcaaaggaaggatcaaatgcaacaaattaggtaggtccgccaatctgccttgcaggcgagacaacagattaagtgcgatcctatcaatgcataatatttttaaaaaaacataattaatttcaaatataggctcaagatgttcaaaggtggcttgccttgctcgagatctggagcttgatcctcgaaatcctcgcactgcgggtcttcgggctccgaaactacacgcgaaacgggagaactcaacaaacggcgaaaataaagccctattaatgacctctaagcatgccattagatagatctcgagatttgaggaattttggaagttgaacggagtcaaacggatttacggttgggaagatattgaatttctaagattattgaatttttggtctaaaggaaaaggatttcattaaatcctttttgaaaaagaaaagaaaagaaaagagg

SEQ ID NO: 85171 - DNA, 544 bp, Oryza sativa
ggactctagtctcctcttctaatattccttattttttaattccgaatttcagctatatttaaattgtatttctatatggactctgtcttttctttttctccgattaatgtgagaatttctaggccatgagagcgaacttggaggttcctttttctattcctttaattatatatttaattccaaatttctttctaaattgtatttctatatggactctagtctcctcttctaatatttcttatttttaattccgaatttcagctatttttaaattgtatttctatatggactctgtattttctttttctccgattaatgtgagaatttctaggccatgagagcgaacgtggaggctcctttttctattccttaaattatatatttaattctgaatttctattttttcctaattgtatttctatatggactatatagtctacttctaatattccttatttttaattccgaatttcagttatttcctaattgtatttctatatggagtctatactctacttctaatatttcttatttttaattccga

SEQ ID NO: 85172 - DNA, 661 bp, Oryza sativa
ccgttttcgtccctgtcaactacgacggggctacattttctcttgccctgtttcccacgtggtgaatttatccccgcggttaccccatccggtggtagttagcactcagtagccgtcaggggaatcggtggcgtcgaacggcgcgagggagggcgctaacggtggacggtggacggacggcgcgacgatggcggcaggcaccaggcggcgcgacgacggctacaggctccgcacccgcgttgacggctggggcgggacagcgtctgcatgagaggaggcggcagcacgcgtgcctgatggctggtgcgatgtaggcgtgcagcggtgagactaagtttagatatgaaagatgtggaggttgattggttgactagggttaggtgttatatatacatgttaattgggtttcaatattatgagccaaaacatctaacaaagtctagaattagtcctctctacagtgaaggcgagtcaccgcggggggcgaggacggtgaatggtttcacccagggttcacaaagctgacgaaagctggtcggtttttgcggcttttcgacgtttcgacatagctccgaattaattttcgattggaatttcgaagttcaaaagtaaatcttgtcgagattcagtcggaatttaacgaaaattggtcgatttattg

SEQ ID NO: 85173 - DNA, 700 bp, Oryza sativa
aagattatggttggtaggagatggatgagttcctgatcatcttcttgctctaaaatggaaggtttccaatggattccagcttctgaatcttgcagctagctaggtaggtaggtagctggtagcttagctaggcagtcaggcagatggtgtgttgttgcttctgctgtgatcgctcgcatacgtagataaggttagaggttgatcgctcggtagatggtactgatggccgggatgcttcccggagtggagtgcgcgcggcggcgacgtctccggcagggcggcggggaggcgccgtgcgggacgcggcggccgtcattgtgcctgtacgccggcggccacgaccacgccctccttggctcctccgcttgtaaggtagagatttcgagatcatgaactaatgttacatcttttttaaacacaaatacaggacaatcatagatcagatattgaatttgaaatcgcggtatttggaattggaattatgttgcagcagcagaggagcgcgtgcgaggagcagcagcccgggtggtggacgctggacagcaacgtgcgggaggcgaaggagaggctggaccagaagctgcggagccagagggaatccgccgtcgtcgtcgtcaagaggtgctcctctaatactccctccgtttttaaatgtttgacaccgttaactttttagcacatatttaaccgttcgtcttat

SEQ ID NO: 85174 - DNA, 1095 bp, Oryza sativa
  unsure (1)..(1095): unsure at all n locations
tcctgcagccccctctggttaccttggcaagaaggcgacgacggcgatcccaaatcctcatgagtccgtcctcgaccaacacgcgtgagccgttctcatccagctgtcccacgctgatgatagaattcctcaacgcggggatgtagtagactccggtgagcagcctgtgctcaccggacttggcggtgaaggtgacggagccaacacccttgatctccacgccggaggcgtccccgaacttgacggtgcctcggacgctggagtcgaactcggtgaagaactcccgtcggccggtcatgtgatgggtggcgccggtgtcgaggtaccacccatcagccttgtcgttgctggagccgtcgcagagggagacgagtaccttcggctcatcaaggtggaggaaagccgctgcggccggtgccgctggaggtagctcgatgcttgcgtgagctaggagcagagccggctcttcctcctccacccgtgcgacgtgggcctggccgcgtcgtggctgtcgacagtctttggcccaatggccaagcttgccacagttgcggcaggtgtcatctcgtgccggcttgtggttgccggtggcaacgccctgggcgcctctgcgggcgccaccctcggcacgtcttcacgcccaccgtagctggacacctccccgcgccttgcgcggcttatggccgcctgtcggggaagatgactcccccttcctcccgtcaccntgagaggcctcccactgctcccgagtgagatggagcttcccgccgatggtgatgggccccgagagaggccgtggctcatcaccatcgacgaccttgaggcgacctaacgcctcctcgatcgacatcgtggagaggtccagcagagattcaatcgagcgagcgatctcctgtacttctcagggacgcagcggaagagcttctcgacagctctctcctcgtcgtaggtgtcgtcgccgtactgcaccattttctgcaagagagtgttgagacggagagcaaagtcatcaacatcctcacctggcttgaaggccaggttctcccactccttgcggagtgcctgcagtgtggacttgcgggcgcggtcgctgcc

SEQ ID NO: 85175 - DNA, 578 bp, Oryza sativa
tgaagagaatgatatagtgcatggatcacttgtagttgatggacgagaaaacgagaatcagactcaacccgagaatagtgatgggcatgccgatatgaagagagcttatttgttggatcctctccctccatgtaatatgaccgccagtactagtgctgcaaaatcacctgagggctcagaagttcagcaccacaattcaatgttacattcaatcagaactcccgagtggcctaagaacgatagcgataaagttatgacgcaatacagtttgaattctgataattcaaagtgcaaaatagatgattcttgtactggagaaacctcgaggtcactccaaaatgaccttttgatggatgaactggttcctgacactgctgtacaaaaagaaaatatgatccagagaactacggacttatccacatctgagataaactatacgaaactgaacgataatgttggtatatatagtgtgtcagctagtaatctagaaaaggaattatctcttctgagacaggaacaagaatatctcggaaatgaaaggcggaagcttgaaagccacgcagagtctgtcagcagtg

SEQ ID NO: 85176 - DNA, 626 bp, Oryza sativa
aatttttggtctcatgatacatgcatggaccatggaataacagtactgcatcatgatgatatttgtttgtagatcattcttcagaagtgctgataatttatctcctctcgcttttgtctgacagaagcaacaccgaagcgaattcttcagttgatgggcgtgaagggagttagcatctctcatatcaagagccatcttcaggtaattttgtagacccaggacttaccttttcagatttgtatgctaataatatacatgcatatgtatatatgcagcatatgctctttagatttgtatgctaatattagctagagatttgatccgtggctcaacctcttttttctctctcttaaataatggtcagatgtacagatcaggctctagcaacagcaatcatcctgtcagcctccagaagttgacatcagctactgttaacaacattagcaaacgtgagtttgtgaatagtgaagatcgctgcatttacgcgtcaggggatagaaacactgcatcttcagacaagaatacttacaccatactccgctgcggccgctcatcaatgtgagtgtgagagagagttaattagtcatttttcaattaatgttaattccaagtacatatgtgtgtta

SEQ ID NO: 85177 - DNA, 538 bp, Oryza sativa
agcctgactgccgcggcgaaaccgccctgctgaatgtgctcgacggtagtggcccaaccccccagctgcctgctccggtcaagaccaccctccccaccgtgaatatcgccccggcagtgggctggcccaaggacgccaagcccgaggcagcaccaggcactcaggtgaaagcgttcgccagcgggctcgaccaccctcgctggctatacctgttgcccaacggcgacgtcctggtggccgaaaccaatgccccgcccaagcccgaagatggcaagggcctgcgcggctgggtcatgaagaaggtgatgaagcgggcaggcgcaggcgtacctagcgcaaaccgcattaccctgctgcgtgatgccgaccacgacggcgtggctgaaatccgtacgaccttcatcgaagagctcaactcaccgttcggcatggcgctggtcggcaaggacctgtatatcgccaacaccgacaggttgctgcgctttcactatgagcccggtgccatgcaaattcgtaatgaaggccagccagtggtcga

SEQ ID NO: 85178 - DNA, 689 bp, Oryza sativa
gacagcctctcccgcgcccacggcatcggggaggcgctgctcatcgtcagccacgacggctacttcccggagatggacaagatcgtgcagaccatcaccttctgccaggtcaagcagatcttcgcgccctactcgccgcacctcttcccggaggccttccccggcgtctcctccggtgactgccagggcaaggacaaggcggccgagaagcactgccagggcgacccggaccagtacggcaaccatcgctccccgagaatcgtctcgctcaagcaccactggtggtggatgatgaacaccgtgtgggatgggctggatgagaccagggacttcgatggccacatcctcttcatcgaggaggatcattacatcttccccaatgcgtaccgcaatgcgcagctgcttgtcgacttgaagcctagcaagtgtccccagtgctatgctataaacttggcgccatcggatgtcaaggcgaaaggggaaggttgggagagcttggttgccgagaagatgggtaacattggctatgccttcaacaggacagtttggaggaagattcatgccaaagctaagcagttctgcacattcgacgagtacaattgggatataacgatgtgggcaaccgtgtatccgtcgttcggatctcctgtttacagcctgaggggacctaggaggagcgctgcacattt

SEQ ID NO: 85179 - DNA, 1783 bp, Oryza sativa
tgtcagatgcaaaacatgaagactattaattattactccatacaaaataaggagagtttcttatatgaaccaaggtaggagttggagttctggtgcaaagaaaaataagtataatcactatattgtgtagcaactgcatcaaaccatcacaattctgataagtcaaaaaattgatctaacattttaggaaaatgataccaaacacgattgcaacagacagcagtactaagcttacatcttaacagctaaatggcagcagaaagagcaactaaaatgactcaaaatgtgaataaaccaattcattctattacatcgtgcaagctgctagcacatctctccataaaacccattgataaatcctagtaaagcttacaatagttattcagtctttgtataccaaaagatgacatgagctaagattttgtgactacaaactttttgatgtccactattctcacctctcatttgagtaatacactctgcatcgggatgagcttaatctgctttcacggatgagaaaagatagtggacgaagcagaatgatgaaatgaatcccactgttccagtagccagcataatagcaataaccatgaagagtgagtagccgagatagagggtcgccgacacaggtccactcaagctctttaggtcaaaaacaagatagttgatcgagtacaagaaaatgtagatcgccacagatccagatgagaagaatgatttccaccaccatttccaatcctcgacacagagatgcatgtaggtcagaacaagggaaacctcagcgcagacaataacaaggagcaacaggacgatgaagaggaatccaaagacatagtacacacgccccatccatatgctagacatgatgaagaagagctcgatgaacagggtaccaaagggcagtgtgccagcgccgagaaccagcaaccaggatgggtacttctgaggtgggatttcacgagggatctggttagtgcgcacggggtactcaatgtgcggtgccttggcaccgaggagtccacctacaagtgtaagcggcacagagatacagaaccagagcagaatcaatatgacaaacaacgagaaggggatggctcctgtgctttggcttccccacaacaggaagttcagagtggtaaggatcaggaatgcaatgccggggaagaagcaagctaccctccatgaaacagccatccaccctgtatgatcaccgcacttgattgtcttccacacacgaacacccacatatcctgccaaaattccaagaaccagatagaagaacagcatgcccgtgatcagagtaccgcgggaagctggtgacatgaacccaagcgccgcaaacagaatggtcaccactgccatcccaaggatctgaacaccatccccgaccataacgcagagcaacattgggttgcttggcgcgcggaaaacatcactgacaacaagcttccacccagacagctcctcgttcatctgcgcctcgcttcactgtcaagctcctcatacctcgtcagatcacgcctcacggtcctcagtaatatgacaaacacgataccagcaaggaaagcaatcaccatgagcgagttgaggatcgagaaccagtgcaccttggcaccctccatcttgaagtatgcctcccacctcgagggccacttgatatcgctctcgacgaacgacacctcgtaggtgtacacgaagggctcgttctccttgatgctcatggacacggtggtcgggtcgcacttgatgctctccgggtacttgccatacatcttgagcgact

SEQ ID NO: 85180 - DNA, 530 bp, Oryza sativa
aaagtctgtgttgagcaagtcaaaaaatgcgaaagctgtcagcccaatggcggagctaacctgcgccccaataagagctgcagcctatcgcaccaatttggcctttcgccagatgggggctggacatcattgggccgttcccggtggcgcgaaacgggtacaagttcgcaattgtggctattgaatacttctcctgatggatcgaggccgaaccacttggcgcgatcacttcggcagcagtttagaagttcgtatggaaaaacattgtttgccgtttcggagtgccaaaagagttcatcactgacaacggcaagcaattcgacattgacaagttcagagagatgcgtgaggggctaaacatggaaatcatgttcacgtcgatcgcacacccgtagtcaaacggggcggccgaacgcacaaatggtaagatcttagaagcactaaagaaaaggcttgagggggcagcgaagggtaaatggcgagatgaaatgctatctgttctctgggcccttcggacgacccccacaagg

SEQ ID NO: 85181 - DNA, 519 bp, Oryza sativa
atgtagagctaagaacgccctttgcagcacactctttttaggatgttcaattgaggggaatttcttcacttcgtaagagctcccagggtttctttcctcgataacaccaagcaggcgtggcaaattgtcatacgaggcttcgtaagttccaaatctcatctctattattttctgtttggccctccaggccttgccatagctaatagtatacttgtatgtctcttcgatgtgtcggattattgaccttggttcatatgtgagattatcgatgacatgcgcatacatctcagatgcaacaaatgcacaagtaatgttcctgtggtatttctgaacaccaggtagaaaacatgtatgcttggtaacgactgacactgtccaataatccttccatttccccttatacgcgtgcactctccagggacaaccaatttttccttaacacaccgaacttcatattgcgaccggttcgacttggcaacccaaaactctctagggtaccgagctcgaattggccctata

SEQ ID NO: 85182 - DNA, 555 bp, Oryza sativa
ggccacgtcggcgcggccggcgggaggcggcgcgcccgcgctcctatggtcaccggcggcggccatgggcacatcggagcggcggccgagagaggggtgggaaagggggaaacgaggcggcggtccacggctcaccctaggtcgacggcgacgacgaaaaggcagccggagcggaggaaggcggcggcgcggctcgggtcgacggggacggcggcgctccggcggtcgacgagcgaaacggaggggtggacgaggtcggcgaggatgcggcgaagccgaaggaggcggcgccgaggtgggaggtggtctggggcgacgacggcggcggacgggagctcggcggcgacggcggagagagagcgatggcgcgagctcgattccggcgaggaggaagggcggtgagaggcggaaacggacggaggaggtgcggggagggtttaaatagggttggaagggggagagagcggctggcggggaaggaataggcgcgggaggtccggccgccatcaatggcgccggcgagatttgtgggggcaaatccgctcgtttgaacgc

SEQ ID NO: 85183 - DNA, 1198 bp, Oryza sativa
gtatgaatgtctccgagattttcttatgaaaaatggtttaaaaattgggtaggtggacagtactctcttcactaaaaagtttgaaaatgatttattcatttgccaaatttatgtcgatgacataatatttggttctactaatgcctctctttgtgatgaatttagtagtatcatgactaaaaggttcgagatgtctatgatgggtgagctaaccttctttctcgggctacaagtcaagcaatgtcacgcccagatattcccgaatagaattccaagtagaatgtgcattaaaatccccgtccaggaccggccggggtacacaaacgacaatgttgacattcagatccacgtcttacaaacatcataaaagtcttacataaatgcagcgaaaagaaagaaagacaacaggagctaagccttgactagaactgcagtgggaacaccactccacaggcatcctcgacggcacggacgaagcctactcctcggagaaacctccatctgacacatactcgtactctggggttgggaaaaaatagagcaagactgagtactacccactgtactcagcaaatcataccggaataggggcatgatgtagggaattatcaaagaagagctagagtggttcgtttacataatgcgagcatttaaaaacagaagttgaaagatttaaacagttgtaataattaattaatattaactatccaccgtccaacgctattccacgttgcaacaggcccaaccatctacctaaactatccaaaatcaaaagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacataccacaaagaggtcgtgacaggacccttcgcctaaccccctgtaaccaagcgcaccacacataaggttttcccccactcctgcaaggcagcgggcagtcccctatcgtgcctaggtgtatccggaagcgacataggccgtcgcagggcccgccccgttccatcacgcccacccttgcctggatgcgttgactagagaaaagctacactacaagcccagccgttgcccacgctggcttgtggtaagtacgataagggctgcagg

SEQ ID NO: 85184 - DNA, 676 bp, Oryza sativa
aatatatatatatatatatatatatatatatatatatatatatatatatatatatatatatatatatatatatatatatatatagtgaaatcatatagtactttgcaacttaactaaatttatagttggttagggaaatcaatactttgcaaattaacttattatgtcaaaaccttcttaaaagcttacctagactaatagaccatatacaaaagttcttaacaggatcaaaagttgcgcaagcgcgactacgtggctagtgttgttctttagaaatcccaagtaacctttcgagttatttttgcgaggtgaattgacatatcaaattgcacatatcttgaggaaatgctccaatggccctttaatccaggattaaagaaagtactttttaatgcttgagtagaaaccttaattaattgcagtatgaataattcaggttcttcattatcctactccctccgtttcaggttataagacgttcaactgcttcaagtttgaccaagtttgtagaaaacaataataatatttcactcaaccacatttattatgaaatatattctattattgatttaatgaaactaatttggtattataaatattactatatttgtgcataaacttagtcagatttaaagtagtttaactttgaccaaaatcaaaacgtcttataacgtaa

SEQ ID NO: 85185 - DNA, 1002 bp, Oryza sativa
catgttcaagtgacaagcatgacttgccttgctctgctgctggaggaacctcggcgactatttcgaagtacaccggagcgtcggaggaaccggaatctagcgacatacaaggcaaacattgcaaacaggctataagactactaaaacagggaacaaaactatttttgatggattctacacatttttcttgatttactgagacttgaatgggcttaaacggagctcggatgaattagttatgaattttagaagattcactgtgtttattactataaaagaaaaaccttaaatcatttattgcgcaataaattccagggctgacgtcagcacggggggggggggggggggaacgcggcgcccacatgcggggcccaccggtcagcggctcgggggggcggttcaccgtggaccgggaccacgcgggtggtccaccgccggtccacgggaccgatggcccagatcgccctcggggccgattagacgggtggtggcgacccggctcggctcaagaccggccaagcggccacggcgacggcgacggcgcgcgcacacgcgttgccggcgacggcaaccggcggcgcaaaggcggcgccgacgggcggtggtgctaaagcgaccactaacgggcggcggccctaaagcggcggctacgagggagagggaggggaatagaagggagagggcgcctcaccgagggtggccggcgcggaggaagacgacggcgaacggcgacggcgagccacgggaggacgacggccaccagcggacgggattcggggtgccctaaggaaggagaagagagagattacagggagggagatgaaccacggcgaccggcatttatggcccaaggcggcggtagaggttgaactcaccggagcgcgaggggatgcgaattccggcgatgaatcccgacggggaaggggcggacaagatggagttcggcctcgtgaacccgacggcgactgcggcgcggcgcggcggcgaccctatcggtggcta

SEQ ID NO: 85186 - DNA, 563 bp, Oryza sativa
cttccccgccggcctgatcgcttgtccttccccggagttcccccatgagccaggttgtccgcatccacgaatatggcaacgccgatgtactgcgcatcgacgacatcgacgttcccgcccccgccgccgacgaaatccagatccgggtaaaggcgatcggcctgaaccgcgccgaggtgatgttccgcaacggcgcctacctgcaggaagcgcagttccccagccggctgggctatgaagcagccggtgtggtcgaagcgctcggcaatgacgtgaacgggttcgccattggcgatgccgtcagtgtggtgccgccgctggacatcgcgcgctggggcacctatggcgaactggccaatgtaccggcgcggctggtggtgaagcatccacaggcactggacttcgaaacggccgccgcggtgtggatgcagtacgtgactgcctggggcgcactgctggagcaggcgcatctggcagcaggcgatttcgtcatcatcaccgccgccagcagcagtgtcgggctggctgcgatccagatcgccaatgccgtgggtgccaccccg

SEQ ID NO: 85187 - DNA, 596 bp, Oryza sativa
tgatgaactcttttggtaccccgaatcggcaaacaatgttcttccagacaaacttttgaaccgcagctgtggttattgtgcctagtggttcggcttcaaccgagcgagagaagtactcgatggctactatggcgaacttgtagccgtttcgcgccactgggaatgggccgatgatgtctaagccccaccttgcgaatggccagattggcgcgattggctgtagttcgtattgtggtgccgtttggcttcagccatgtctctggcagctttcgcactttttgacatgttcaacgcatactttaagtatggttggccaatatatgccttggcgaaatacttttgacgcgacggtccttgctgccaggtgtgctccgcacatcccttggtatatttcctttaccatctcctcacctttggagaaagatacacagcgaagcatgggctgtagtattccagttcggtacaattgcccagagattatcttgtacttcgcggttctgatctgcagctgttttgcctttggttcgtcatctggcagccatccctctttgaggtgcttgacgaagggcgttcgccagtcatctgggtcttcgccc

SEQ ID NO: 85188 - DNA, 605 bp, Oryza sativa
ctcgatccccctctcatgaacaagaaatcccaaaaattggccagccgatacaccaaaagcacactttgtcgggttcatcttcaagccatacttcctgggtctctcaaaaaccttcctcagatcggctatgtgatcgtctatctctttggacttgacaaccacatcatcgatgtaaacttccactaaccagccgatcaggtcatgatagatataattcatggctctttgatatgtagctccagcacttttcaagccaaaagtcatcacaacccagtcaaacaagccgattgcaccaggacacctaaaagatgttttatggatatcttcttcagccataaagatttggttgcatcctgtattaccccccataaaacttaaaatcttatgtcctgaggcagcatcaactaactgatcggctactggcagcagaaactcttcttttggggtggctttattcaaatccctgaaatcaatgcataccctgatcttaccagacttgttgataaccggaactatactagaaacccactcagcatatcggcacggacgaataaaaccagcatcatatagatgtttgatctcagccttcacaggttctagcatat

SEQ ID NO: 85189 - DNA, 695 bp, Oryza sativa
gttgttgggcgtctacgttttcactgaccggcttgccttcgcagctgcagactggtgtttccgcctgcacggctggcctttatgccgccgttgtcgggcgcctacgtcttcaccgaccggcttgcattcgccgccgccgactggtgtttccgcctgcacggctggcatttatgccgccgttgttgggcgtctacgtcttcaccgaccggcttgccttcgccgccgccgactggtgtttccgcctgcacggctggcctttatgccgccgttgttgggcgtctacgtcttcaccgactggcttgccttcgccgctgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacgg

SEQ ID NO: 85190 - DNA, 1233 bp, Oryza sativa
tgtcatccactttaagagttctcgatttgtgtttcacgaagtttcggtggtcaaccggcgacataccgacggttagacaagtgccatcgcgccggtcgaattgcggaaggacgcgggtcagatcggcgcgggcgacaggcgcggcaggcgacatcgatgttcagaccgggtgatctataccggtcagaccgacggcatccacttggtcagaccggtagatcaatctcggtcagaccgatctccatcgaattcgagggtaacttttattttcgctaaaagttttcggtttttgggtataccaaccattcactcccctcttgttggcttagttcttgctatttgatcctacaagtggtatcagagccaggctaggttaacatctctggcccgatggacacgtgtgaaggcctgatggaccttgggtgcctgcggggcccgcatacctgatggaccgtgggccggtggggcccggatacggtgaaggggcggtgaagggctaagggacactaatgtgtgaagcggagattgttgaatagtcccacattggttgtggaagggcaaagaacctaagatataagtgggggagcccctcacctcaatggctagcttttggggtgggaaaggccctttacgatcctacaattggtatcagagccatgttttcttctttggatttttatcgatctagagtttttgccatggctactcccgctcgtttttcaactaagcctcatgttttcgatggaacggatttttctcattggtgtagtaggatgcaatcttacatcatggctgaagattatgatatttggagaaaagtttctcatgcttatgtgattcctgaagctattaatactgctgctgaaaaaactgcttttgaacaaaattgcaaagctcacaacattcttttgagtggtatttctcgttcggattatgatcgtgttgctcatcttcaaactgctaatgagatttgggttgctttaagtaattttcatcaaggaacaaataacattaaagagcttcgtcgagatgtttttaaaaaggagtacattaaatttgagatgaaacctggagaagctttggatgactatctttctaggtttaacaaaattttgagtgatcttagatctgttgattcttcttatgatgctaattatccacaatctgagatttctcgtcactttttgaatggtctcgatatgtctatttgggagatgaaagttacatctattc

SEQ ID NO: 85191 - DNA, 770 bp, Oryza sativa
gcacagtcccgcaagaaaaattatgcagaataccggtcgccgtgacttggaattcccagtgggtgattttgtaaacctcggggtccccccattgcagggtgtacacaggtttcagacgaaaggaaagcttgcacctcggtatgtgggtcctttccgtatccttgctcggcgcggagaggtcacttaccagctggagctgcccgcctccttgggcaacgtgcatgatgtgttccatgtgtcgcaacttaagaaatgtcttcgagtgccatccgagcaggccgactcagagcaaattgaagttcgcgaagatttgacctacgtggagaggccagtgaaaatcctggacaccatggagcgctggaccaggaaccgggtaatccgtttttgcaaggtccagtggagcaaccacgctgaagaagaagctacctgggagcgtgaagacgagctgaaggcagcccatcccgatctcttcgccagttcttccgaatctcggggtcgagattccgtttaaggggggtaggtttgtcgcgtcccaaaacgactctaaaattcatcctcgaaattgtgcaaagaataattaaaattcatgtgaaagcctccaacaattaaaatgtgcaaagataaaagtcaaatgaggcttggaggatttttgtatatttcctaaaagcctaaaatgtgtaaataaattttagtggaattttcagagcacaaataataattgaaaagaaataaacaaagttgaaatggttttataaaaagaaaaatcccaa

SEQ ID NO: 85192 - DNA, 676 bp, Oryza sativa
ttcaatgcacttgaccacaatgtctcttattccctgccttagcaagcggtcaaacgacttttgtgaccagtccatgaatataaaagatctgcttaatcttctctttataagcaatgggtgggaagttcttcacatatatagttatcacctgtaacagaaaaggccattcaaacaaatgttcctagggaacaacaaaacaaagctaaatgatatgaaatgtccaagctaattatctctatgaatataaaaaatatcaacaagcgaagggtgccttgtacgaataggacaatacatccataacagaaacaaccttgcacaggttgagccagtggacagtggtattgaatcattagactaacttccacacagcagagtgtagtgtgggatacattccctaacgtgccatgtagaaactaaaataatgatgcagctgcatctttgaaatacatcaataaaatgatggttatttcggttcaacaatggtaatcagtagttctggataataaaaactttaatgtgaatgagacatgattaataaaaaatgcatgatgtttcatgtttctcagatcatttgccagttccattagcaaattatggcccgaaagaaatactctttctgtcccataatataagagattgtagggtgatgtgacacattctaatataatgaatctga

SEQ ID NO: 85193 - DNA, 813 bp, Oryza sativa
ccttctggaacgctgccaactatttggccagctccggattcaaggccatgtaagtcgtgtcaatatgcccagctgccacctgagaatcggtgttaacgacaagccggggagcaccatagcccttgccttgcggagcacctgtaggatagctttgtgttcagtcgtgttattagtggccgagaactccaagcgcgccgcaaatgacgttgtgcggccggtgggcgaagtgattatcgcggctgcaccagtcctagacgcgttgcaggctctgtcagtgcgcgctgtccagatctcctccgtgggggcttcgactgctcggtgcaatgcctagtccattctacaataaaatccgctaggactagcgaatttatggtggaccgcgcgacaaagcagatggtgaaggaggctatctccacggcccacttgctgatacgccctgtggcttcccaattctagaacatgtcccctaacgggtacgacgtaggcacggtgatatcgtgagccaaaaagtaatgcctcagtttgcggtaagccattacaagggcataagctatcttctcgagttccgtaaactgcgtctttggccctgcgagggcctccgacacgtagtacaatgacttcgagctggagttgtcctccaacaccatcactgctgacactgccgctggtgaggcggacagaaaaaagagcagccccttacccagagcggtgttgctagggccgtcagcttggacagatgctctttgaggctctcgaaggcctggtggcactcctccgtccatcacaagggagacgccccccgaagcatagcga

SEQ ID NO: 85194 - DNA, 1071 bp, Oryza sativa
tgcacaggttcatcatgcctttgtctaattgctcttagatcggacaatttcatctcatgaaccccactacagaggtgactatgaaattgttctccaaatcggcccaactgttaattgaattgtatggcaaagaagaaaacctagtaaaagccattccggataaagacaaagaaaacaacctgaccctcaaagcgtcaacagtcgatgcctcaccacactgagctaagaatcggctgacacgttcataggttgaaacactgtcttgccttgagaattttgaaaaatctggaactttgtatcggttaggcaattgaaccgtctcgaaccactcagggtacggatgccgatacaagtttcgagtatcctttggcttaagcccaaactgctctctcatcacatctgcaaacatatcggcccaaggtctctggtgaggcaccccttgtgcttgttgaggtataggctcaaattgattgtactgaggagcaaactgaggctgagctgatcctccttgctgatactgaacctgttgcgacgaaggctgatattggtaattcaaattgcccccctgataattctgaaagtttggctgtatgttgcgcaccaaatgctaaggaataacttggggtatcaccgattgatctggctgcacattatgaaccaaatgctcagggagaacttgagtcgtgacatgctgccggcgcaacgcttgacgacgctttcgggttgagttgcatcggtttcgatcttcaacaagaggtaaaacatgagtttgacaagtttatgaaggatccatgttaagattgcaagtgctgtgagttgtgtacgttttgttgttgattaaggagacctagagtctcatttccgtgagctcctactctattatgaatcaaataacctagttgtagatagaaaagaaaatcaactgatcaaccaaagagacatttgtttggactaagagtttcagacgtgtcttcttcggatcaaaggcaacaatcgtcagtctagcttttgacaaactacttcaaagtttctctgaaagacagcatgcccaaggacctcattgccccagaa

SEQ ID NO: 85195 - DNA, 620 bp, Oryza sativa
catgttattcacattgctagcgagaataaagagcttaaattgctatcttctttaaatacttggggctatattcaatttgatgatgtttgtccactcaactgcttacagaagaaattatttgctagatttgaattgccatgcccttctgatgtgatttttcatgttattggcaattatgatagtaaaggagaatataatgtgcatgaagtatatgtttgttcgaatttgactatacctccttttcatgatgaaatgtattgtctagaggaccgcatgcgtataagtaattctctatctagttcctctagttgtttaaatgagctacaggttggtttgcaagaagaggagtgttgtggtttttcgactacaaagattttaggatccaaccaaatggccatcaagaaatgttcctcaccagatgttgtgatagataaagataagttcaatacgctccatgacaaggcgaaatcgaggacgatgaggatgatgaggacacaactagcttagatataaccatgaataccttatgtattaatcaaccaaaggtacatatgttctatgttgcaggtacgtcataagggccttcggccgacctgccgaaaccatccaaaatagcaaac

SEQ ID NO: 85196 - DNA, 596 bp, Oryza sativa
cttacttcggctgcggcttgatcaacatcttcttcaatctcttcttcacgcaaagcttgctcaatggatggtgtcgacgggggatacccgtagaccggatatagagagtattggggtacgccggtataaggatctacgtagtacgacatcgagcaatcaaaagacaagaattatactggttcaggccccttgacaggtaatagccctaatccagttgatatgggattatatggtggaaaacacagattacaaaggaaaagacttaactcgggagattcgacgagatcgtagtcgagatgatccgactagctctcgtcgacttggctctttgtaggctctgacttcgtaggctgtgttggttgtctaggctttgagattcgatgagctatggcctccgcggggggtcccttttataccgtaggttgggcgatatctgagtaggactcggatgtaccaaacctgatacgatacgtaggtaacccaattcttgttcgagaaggtttctccttgtttgttgtctttacgaagaatttccttaagtgctagaggatttatccatatacacgtggatataccttgtcgatacgtgacgtata

SEQ ID NO: 85197 - DNA, 2136 bp, Oryza sativa
gaatcacagggcaagtgctggaagtatccatggccaagccattgggagacaagaagcctgatcactcgttcaagcctggaggagctccaaattttcctcttcctccttatggtggctacatgggagatccatatggtgcttatggtggtggtggtcctggattcaaccaggtaaaccaaactaaaccaagtggtgcttatggtagggttggtcctagtatacctaaataccaaacacattctgcgagaaaatccacatataaataggtataatacatatgtataatcttgttgggtcaaatgcttcgttctctggctctttttgtccatccactaaaccctcagtccacaaaatgacccattcttgagcatcgccacttcagctacagtctgcctataaggcccagtggcccacaatgcccaacaccaaaccctagttaaccaatatccagcatctctatttctcaattccccatttccagctacccagctggcagcatgggtgcacggtcacccaggcatggcatggttactgcggtcccaagtgccaaagctgacaggtgcccagggtggcagaacgtcgcatttgccaggaggagcagctgagcaagtagtgtgcctgttgcgcactagttgatctctggatcctgtacaaggacatgcaggtagatggaggagctagcatgtgcgtcttgattctaaatcctaatcttctctgtaatatgtgcatcttgattcgaaattcgaagtttctttgttgatacgtaaatgtgaaatcaaagtatggtacattgtttttttatggaaaactgtggactgtagacaccaaaacaaaaatagaaagatctgtaaccacatcagggcatgttgtaagaacactaacattgacctgtgacggtgtatcaaagcaatccaatagactgttcacttcacatgctcccttgatttgtatgtagatgatgaagttcttagtgttgtctaatgatgataaagcatcatattctgaagttgtgaaaaatgccttgagtctgttgaagattagtcaacatatattgatagtctgttaatgttcttttatacatggatcatgatttttttgcatgaactttccatttagttattagatactacctccgtcccaaaatatatctatttatagcatagtatcttgtcccaaaatgaagctatttctccacctacctcctctcaactaattaatatcattctccttcacccactttcttttttcaatctatcacaaccttcctccaatcattcccatctactttttattacttgtgccaacctaaaaaagcgcacatatgagctgtttgttaattgtggggctaaattatactccctccatcccaaattatagggcgccgctgccccctttttaaggaaaatcaaacttggttgcttttgactaataatcatactaaccatatctatactaagtattatgcatgttatatcactagatttatattttgaagtacttctatgtgatgctaatttcatatttgttgggatcatagaatggaataaaatactagtcaaagtatattattgaagaccgtgtaaaaaaaatataggccttataatttgggacagacggagtagttttctttaatgattttgtaacacctttaaattaaattgcattgtcatctattgtacattgattttggtagttcatatactgtccttttccatgaaatatgctttaagtaactctgaatacccatgctagaaatcctgcatccaccactgcatattgacaatttagtcattgtctctatcaacatttttgttacagcctatgatatatggtagaggaccagcaccagctggaatgaggatggtaccaatggtgctccctgacggtcgtctgggatatgttctgtaagataatgctgtcctagagtcacaactcacaaacaagtcttaccatacatcttcatttcctaacagttctgtttgtaatgtcttgacaggcaacaaccaggtggaatccctcctccgcccccaccgcgtcggggtgaccggagggatggtggcagcagaggtggcgaagggagtcatggccggcgatatcgcccttactagctttttcgttcccttggtcctgccgcca

SEQ ID NO: 85198 - DNA, 538 bp, Oryza sativa
tacgcattttaggcttttaggaaatatacaaaaatcctccaagccttattcgacttttaactttgcacattttaattgttggaggctttcacacggattttaattattctaggcataatttcgaggatgtattttagagtcgttttgggacgcgacaggaggcggcgttcccgcgcccctatggtcgccggcgacggccataggcacggtggagcggcggccaagagaggggaatggaagggggaaaagaggcggcggtccacggctcaccccgggtcgacggcaacggcaaaggaggcggccggagtggagggagacggtggcgcggctcgggtggacgggaacggcggcgttccggcggtcggcgaggtcggcgagatggtggacggggtcggcggcggtgcggcaaagccggaggagacgacgccgaggcgggagatggtcctggcgagtggagagggccggctggaggtcgacggcgacggcggaaagagaagatgacggcgcgagctcgattccggcggggagaaagggcggc

SEQ ID NO: 85199 - DNA, 781 bp, Oryza sativa
tgacggaatttgatcttcggtatgatctaccgaaggcgatcaaggggcagactatagtcgattttattgttgatcatcgtgatgattcaatcggctcggttgagattgtgccttggactttgtttttcgatggatctgtgtgcactcatggttgtggtatcggcttggttacaatttcccctcgggggcaagttttgagttttcttacactattaaaccctatgcgaccaacaatcaggctgagtatgaagcggttctcaaagggttgcaattactcaaggaagttgaagccgatgctgttgagattatgggtgattccttgctggtgattagccaattggcgggagaatacgagtgcaaaaatgatacattaatggtttacaatgagaagtgccgagagttgatgaacgaatttcggctggtgactttgaagcatgtatctcgagaacagaatgttgaagctaatgatttggcccaaggggcatcgggatataagccgatgatgaaggatgtcaaagtagaagttgccacattaacagccgatgattggaggtatgatgtgcatcattatttgcataatccatctcgatcagcttctcggaaattgcgttataaggctttgaagtgtaccttgttggatgattagctttattatcgacgattgatggggtgcttaaatgtttgagtaacgaacaagccaaggttgcaatcggcgagctgcatgaaggaatttgtggaactcatcaaaaggctcataagatgaagtggttgcttcggcgtg

SEQ ID NO: 85200 - DNA, 1050 bp, Oryza sativa
caagccgatgttgatgaagttgaggaagcttcagctaggttggttttgtcaccagagcaaacagtttttgtgaagccgaaagggacagagaatcggcatcttaagccattgtacattaacggttatgtcaatgggaagccgatgtccaagatgatggttgatggtggggctgctgtgaatttgatgccatatgctacattttggaagctaggcagaaatgctgaagatctcatcaagatgaacatggttctcaaggattttggtagcaatccattagaaataaaaggagttttgaatgtggaactgacagtcagcagcaaaaccgtccctacaacattttttgtcatcgatgggaagggttcctacagcttgctgcttggaagggattggattcatgctaattgttgtattccttcgaccatgcatcaatgcttgattcaatggcaaggcaaaaagattgagattgtgccatccgacaggtcagttaacgttgccagtgccgatttagctctttgggagatggacgatattgattgcttatctggaaaagtttgggatggagatattctaagagtgtccgattgtgatatacagccaattgaagatggagagcccaagttattattttgagggcgtcgtggagggttcaaacgtttacaccaaggacacagtagatgatctcgataacaagcaaggacaggatttcatgtcggccgatgatttggaagaaattgatattggaccaggtgatagaccaaggccgacattcatcagtaagaacttatctccagaatttagaaccaagttgatagagctcttaaaagaatacaaagattgctttgcttgggagtattacgagatgctaggactcagccgatcaattgttgaacatcggctacttatcaaaccgggtgttagactgtaccagcagccaccgagaagatgcaaagccgatatgctcgaacctgttaaggctgagattaaacgattgtatgatgctggttttattcgtccttgtcgatatgtcgagtggggggtaccgagctcgaa

SEQ ID NO: 85201 - DNA, 740 bp, Oryza sativa
tctttacccacaagacacgcctttactctgcattccatggcaattggaacccatcataaaaaacgtgacataaccctttacccatcctagccgtgaccaaaagtaccgatccaaccctgcctacggccggtatcccgggacaggcaggccaggattgagcccctagcaataggatctagaccgggtgcgccacacgcataggggtgagaccacccgtgtactagtccagtgccatggcatctcgactagcgggcaccgacccgtgtagccttcatttgcctagacatctcgattaccgagccacagctcgcgtagccttcatttgcctcagagatatccatcgtcgcaacgacttcatccatctctatccgtgtccttttgttcaggactagactgagcaccgagttaagccttacccattagacatacggttagtacggtagtgctttgcaacagaggcccgagcttaatccttatattggccggggtgctacttcccacaactggcatgcacccaaaccccaccggaaaacaggttttaggggttttgaaagaggaagagacgggtatgtccaattccaccataagccaaccatttcatagtatccaagtgatatgagaattcccaaagtctaaagttataaaaccacctaatattgcctaattaatcagcgaagcatctacctaaattcatactagtggaactataaatagagtacccactagttgggttttatttg

SEQ ID NO: 85202 - DNA, 3981 bp, Oryza sativa
atgccgccgttgttgggcgtctacctcttcaccgaccggccgcctcgtccgccgccgactggtgtttccgcctgcacggctggcctattatgccgccgttgttgggcgtctacctcttcaccgaccggcttgcctccgccgccgccgactggtgttttcgcctatacggttgccggactccgccgctgttaatgggcctcatcatcgacaccaccggcttggttccactggcgccaactggtgtttttgtcaccattgatggactacttcgatcccacatcggctacttctgccatcaccaagggaatactaaaaagctaactcatcattttttcttatatgatattttccttttcctctgcctcactacattaactggttcaccgttgactagtgagtcgggggctacagatgttatatcatattttcaacaattttcataatatttatcttgattgcttgcgatataatctgagtacaaatgtgcctatcgagttatggagttttatcttcctatgttctccgtttggtttgtcgatggatagttgcctttgggccgattcctagcacccgggggctcgttggatggaccgagtaacgcaaggtgctaagtattattcggaataaatcaaaagcataaagataagataaatttattttctgctctttacaattgcaaaagtacccgagtagtaaactccgatccgtgaaactttgttccattaatgacgaactcatgtcactcatatgcatgtctgggaagtgctttggccgactcccgatgcttggggactatgactagtcgggcagagtatttaaacgtaaggagtcatccgctcggggaaatcaaaattgacaagaggagaaatacatatttgtaaatattttaaatacttgaatttttctcgagtattatatttatatcagatactactcatccgatatgtttgttctgtaggatccagatccagatatgcatagaagggattcatggctttaagcttatctcctacgcttcaggaatggattagttagaacatcaccaccggcttgccgtcgtcgccaccgactggtgtcctcgcctatacggttaagtggtcacaccaccgttgttgggcgtctacatcttcaccgaccggcttgccttcgccgccgccgactggtattcctgcctgcatggccggcctattatgccgccgtttgttgggcgtctacgtcttcaccgaccggattgccttcgccgccgccgactggtgtctctgcctgcacggctggcctattatgccgccgtttgttgggcgtctacgctttcaccgaccggcttgccttcgctgccgccgactggtgtctccgcctgcagggctggtttattatgccgccgttgtaggacatctacatcttcttcgaccggccacctcgtatgacgccaactggtgctatcgtcttcacgactggccacgtctccgccactgcaaataggcgtcatcaccttcaacgcaagctgtctacgtctgctgccgactgctggtttatactgctaccactactgatggacgtcatcgttttcattgctggccgccttgtctgacgccgactggctcgttcacctccacggctgcgcgacttcgtcatcattgactggcatcatcgtcatcgctgtttgcttctgttgctgctgactcgtgttcacttcatcacggctatccaactttgtcatcatggtggagcaacttcatctttattatcttcggcaccggcaaactctattgctgctacttcgcaagttttgctacttcaccaaccacgacgtctttgtgaacctcgacatctcggcatgcgatgccgtgttattttactacaacaagtggctctccaatattcaggatttctacttggacatcttcaacacatatcttcaatcagcgctgctatacgtacgaattatttcgtacgatggttgtacgatcaaacggatccctcaggccttagttgatcccatatccaagcccaagctcctgacgtcctggcctgctatctggttggcttgcttggacagccaatgagccaaccaaagcaatttttatttcaatcatatcttaagcaatcctcttcctaatatcttactgtatatagtaattgtacttagcacccaacattgaatttatcatgtggcatggttaagcaaattacgcatacaaatatgttcctcgaaccttggacagtgataacattaaccctagtttcagattaaattaaaaataatggcatatgttttgcaaaggaaaattttagattaaatccataataataaagaaagcatttcatggccatgaacattgcctaggaaaaaaaagaaagagagaataatgtaaaaaaaaaaagatgattgtgaagctaaagaaaatcaagtaaataagatgccatacctttgtcttcgatgcgtatgctattggattagtttcacacttgcaggttagatcagaacatgaaagtcagatttagggtttggtgtagtgaacgtaaagtcaggtttagaggtaaattgggctttagggcccataagtacgcttagactgccgcgcgcgccgtgcgtgctgttttgccgttgccgtccgtgccgttgcgtcttatcgtaacaagatcgtactaaaaagatcgtatgtgtagcattttccatcttcaatcaagcaatgactattcgacgacaagaagctaaagttctcgactctatgttcagttgtttcccaactaatcaaagagtcgggggctacacaaatacatggctcaaaattcgacaagctttatgtcaagatgaattaatcaattaatcagccaacgagtcaactctgggagtcatcaattttgtcttcgctttagagcagtaggtcaagattaaatttacatgtctgggagtttggagtcatcaaccaatcaacttagtttcgacaagttggacaacatcatctactttccttcaagtgaagcatctccaacagctacaacattaaattttattgccatcttcataaatcaagaagcgttgcatcagtcttctttatgcatacacgctcgcatcaaggaaactactcgagctttatatcttctcaacagtttgatggattattatcactgacttcatcatcagcacctctacttcatcggccctgacatctctgccgttgctaatggatgactacgtcttcgcctccagttgcttccgtcattgccggcttgttatttcgccttcacggttgacctattataaaaacgctgatgagcgtcttcgtcattatcattggttgctacattgctattgactggatcaccgacatcgtcatcttcatcaatatcctgtcaagcctcttcaacatagcctattctactgctgtttgatgggcaacttcgtcattatatttgatcacctctattgctaccaatcgtcattactgtcggttacgtttgtcgtcgtcaactattttcttcatcttcatgattggtggatttcgtcatcgcctttgatctgcctcgtctgtcaccaactgattattttgctgccatggctacacaactttatcgctgggcgccttcatcttcattgttagttgatctgtctgctgccgactggtttcttcgcctccatggctatgcgacttcattacttttgattggtatcactatcttcactaccaccaatatttttgccacctctagtggacaatattatctctatattggtcatcttgtctatatgccaactgtgtcagctaccatcaatgaacaattgtgactatgacagaaggacaagctatatgctcaggagcttactagatcaaacacaagtatcataccttcaatttggacttgttccggatacatgcaacatgaattcatgatcatggttctattttctatgctcaaagactagactatttattattccccgtaaaggttatcaaccgaatacttgcgtcagtcaggatt

SEQ ID NO: 85203 - DNA, 3835 bp, Oryza sativa
  unsure (1)..(3835): unsure at all n locations
ctcactatcnggcgaattcgagctcggtacccgtttgcctaaacttaagaaagatcgtgatttggtttgtacaccgtgtcgtcatgctaagatggtttctacttcacatgctcctattgtttctgtgatgacggatgcaccgggacagcttttacatatggacactgttggtccagctagagtgcaatctgttcgaggaaagtggtatgtgttggttattgttgacgatttttctcgatattcttgggttttctttatggcaactaaggacgaagcttttcaacactttcgtggtttgtttcttcgattggagcttgaattttctggttctttgaaaagaattcgaagtgataatggtggagagtttaaaaatgcttcatttgaacaattttgcagcgaaagaggtcttgaacatgaattttcttctcctcgtgttcctcaacaaaatggtgttgttgaaaggaaaaatcgtgttttggttgagatggctagaacgatgttggatgaatacaaaactcctagaaaattttggcatgaggcgattaacactgcatgttatatttcaaatcgagttttcttgcaatctaaacttggaaaaacttcttatgaactactatggagattatgggtaccccatacccacacggcatggttatccgactagtcataggggatagcttatatctatggaatatgtaacagattatgacttgggtattacgtttccttttatattatggagcggcctaaagtcctgatttgataatattgtaaaatagatttaggaaaccgatatcgtattggttaaggtttctatcttataatcctgcccccccatcctatataaggtgggcaggaggccctctagggggcatgagacaactagatcatcagatctataatacatccggcggattcaaatccctaaacaggagtagggtattacctctcatcgagagggcctgaacctgtctaaatcctctgtctctgcatccatccacttttaggtcttgtgcgctaccccgtttgccgaattcatgtttcgacacttcgatttggtcatcaacccgaagtttcacatttgcgtgtttttggttgcaaatgttttgtcttaaaatctggaaagttggataagtttgaggaacgctctaccgacggattgtttcttggttaccccgcacatactcgtggctatcgtgtacttattttggggactaacaaaatcgtggagacttgcgaagtttcttttgatgaggctagtccaggtactagacccgatattgcaggtacactgtcacaggttcagggggaggatggtcgtatttttgaagacgagagcgactatgacgacaacgacgaggtcggctcggccggtcagacagggcgccaggccagtcagaccgctggcacacctccggtcagaccgacgcatgacgtgtggtcagaccggcctgggtcgtcggctgagggttctgttgatgctgctcgagatggtcctccagaaattactacttcgaccaatactgatacagaacgtggatcaacttcagaagttactgctcctttgcacattcaacgacgacatccgccggaacaaattattggtaatataggtgagcggactacaaggtctaaggtaacgactcatgatgtttgtgcaaattctgcatttgttgcttcttttgaacccaaagatgtgatgcattaactgatgaatcgtggattaacgccatgcatgaagaacttgaaaattttgagagaaacaaagtttggactttagttgaaccaccttctggacataatattattagaaccaagtgggttttcaaaaataaacaaaatgaagatggtttgattgtgagaaacaaagctagacttgttgctcaaggttttactaaagttgagggtttggattttgatgaaagttttgctcctgttgctagaattgaggcaactagacttttgttggcttttgctgcttcaaaaggttttaaattgtatcaaatggatgtgaaaagtgcttttctaaatggttttatacaggaggaagtttatgtcaaacaaccaccgggttttgaaaatcctgattttcccaaccatgtttttaaattgtctaaagctttgtatggtttgaaacaagctcctagggcatggtatgataggcttaataactttttgcttgcaaaaggttttacaatgggaaaggttgacaaaacgctttttgttcttaagcatggtgataatcaactttttgtttagatttatgtggatgatatcatctttggttgttcgactcacgctttggttgtagattttgctaagattatgcgcagggaatttgagatgagcatgattggtgagttatcgtactttttgggattgcaaattaagcaaacacctcaaggtacttttgtgcatcaaacgaagtatacgaaggatcttttgagactgttcaagatggagaattgcaagccaatttgaacaccaattggttctacagctgtgttggatcctgatgaagatggtgaagctgttgatcaaaaggaatatagaagtatgattggatctttgttgtatctaactgcttctaggccagacatacaatttgctgtgtgtttgtgtgcacgctttcaagcttctcctcgtgcttcacatcgtcaagcggtcaagcgaataatgaggtatttgaatcatacatgtcacgtccagataaattcatcccgaaataaaaatcattttctaaaaggaataatagaattaattaaaattcgaaaagaaattggcaaacactaaaatacgtacaagaaaagaaaaatttgaatgtggcccggagaatttttgttaaattctccttggtctaaaatgagccctcaaattttacttgaattttcagagcaccggaaatattattaagcaacaaaaacagttaacaaagtttattaaaaagaaaaagctaaaaataatccccctcctcactttgggccaagtctggcccaaagtcctccctctctatctctcggcccgaggccaaagtcctctcttcctccccctctttctctacctctcgacctctccctcggtacctgggcctccccttccccctcggcccagctccctcctctccccctcccacctgggccgtgtcccggcccagccgagcctccccaggccgcgccgcacgcgcccgtcacgcgcgctgaccgcgcgaccgcgtgggtcccaacacccggtcatctccttcctcccgcacgggctcttctctctcccgtgcaaaacctagcgccgttcctcctgcaaatccaccccattcgagccggctctttccaaattgattagggggaattaatcccctttccttcctgttcaattccccccaatttcccccttgattcgtgcccccaatcgtcgggaacgcccgcgccaaccccggtcacctttcatggccgccgaccacgaattccgccgccggtccccgtctctcccgtgggcggctccctcttctcccctataaaatggaacccctcgatccgttctccagttatagcccccctcccgcggtctaccgtgggctcaccacctattcccggcgtgcttctttttgttccgcgccgccggccaacttcaggcggctatgccngctcgcccgtgcggcggctgatgtcgccaccgcattccccggcactacgacgccatccttcttctcagcctcaccgtatcctcgccggaaacccaccggaggtgcgcccccgccggcaatcagtggcatcgccgcactgtaccgcctcccgtcggccgttcgccacacctaaagcgttggccgatgctgctgtcccct

SEQ ID NO: 85204 - DNA, 755 bp, Oryza sativa
accagccgctcctgccattccagtaagtcttgtctatgaaaatcttgaatcggctgaataactcattttgataatcacctgtcttcaaatttcttcttgcaggccttaagccgatctgtcttctttcgatatcaaagactatcttgatgaacaaacagaagaagacacccccagcaggccaaccattccacattttagttgttaagaaaattttaagaattaaaacactaacttgggtacattgctaggcttgcccataaccgagggcgtggctattcgaatagattatactctgatcagaggtgtacatctttacccacaagacacgtcttcctcacgtgtaaccacgtcccaacataccaccacggcatacggacgtaagacatgacatagtgtcacgcccggaaattcactagtaatttccgaacttatttgtgcataaaatcctcgtccaggaatcagccgaggtacacaaactgacaattttaatatacaaatccatcttaataataacgttacatacttaaaaagaaaagaaaacagcagcggaattaacggtctagcaatggcttcagctccactcccacaggcagctcaactggggtataagccaaacgtcttctccttctggatcctttatcttcaactgaggtttgatgattattgcaagaatgagcatatgacatactcaacaagccacacagcaaatatgcaagtgcacaaggattccaaaggatggcataatatagtctcat

SEQ ID NO: 85205 - DNA, 1465 bp, Oryza sativa
gattttagcccaattcaatttaaaaatcaattctaaattttgtaggttgtttgtatgatagaaattggatgagattagaatttggaaggaatttgaatagggaattttgaaaggaaattatatttggatataatttccaaaagagatattttctagtttgagtgcaatattttgagagataaaatataaggaaatttatttgatgcactccaatgagagggagagaaaataaatggaggaagatagataggatttttagcctcaaaatatatggcatgggtttcaaaaaatggttgaggctaataggagatttggatgacaaggatataatctattatcttagcacaagaacaattattcacaatgtttgtagtaatattattcttgtgccgagaaggaaatcaagccacaggaattagatcagcagctagatcaaaaggaagaatttggatcaagaatcaaaggatatgtttaagatcaaaggatgggctaacaaataatcccactaaaattggaattactttggtttaggttcaatggcaaaattgggaaggtttcttggaccataatccataaaaatagaaaggggtttttcaaactaaatttgaataaaagagttttagtcgaaagaaggttttaaattaaaaccaaatcaagaaatacctcaatttaaccaaatatatttttaaatgaaaaatacaaaagaaataaaataccagagaaggattttatgcaagttagttttagaaggtccctctaattatattttcctaggtttaggatgctattaaaaatataagactcggcatgatgcacaattagaaaacggttaattttcggtatgttacataatacctctcctgttgctgcttatcatacttcctctgatacttattaataattctagccgaattcatctgaaaacctcgagtttttcctccatcggctgttcggccagctgtatgtaccatattgacaggaaaaggattgccattgaccttcatcggcttcttggaatcatcaaacttgatttttcctccctcaatagctgcctgaatctgctatctgaatattttgcaatcattagtagaatgagacccagagttatgccacttgcaataccttctcttgcccaattcctcagccgatgggattgtgtgaccagcaagaagttgaatctgcttctcccgaagtaacagatcgaaaatcttatcagccttggtgatgtcaaaagtcatacctctcctcttttccagaactatttacccattggcatggtataaccttcttgcttctgacccactcggctgttgctacctcggaatcatcatcatcatcatcggatccatacatgtaaggatagacatgattgatctttttgaagttcttcttggcttctgcaaacctttattcatgtagggttaccttctatgcaagatgtgatagactatcaaactcctgagac

SEQ ID NO: 85206 - DNA, 562 bp, Oryza sativa
aacacatatttttccctaacttctgcaaatcaattgtaacaattgtacctggagacctcttctcaatctctgccttccagtcgaacaacagctgaaaactatcttcataagtgccatgaatctggttctcagcaagcctccttcctgcccaagcctttgaatacttcagcttgatctcatatcgctcttcaagtttctcttttgctgccttagctcccttgttagggtttttctttaaccaatccttcagtctatctgcaatccagtcttgagtggccatcttcccttccatgagcttggttgtgggacactcatgtgcaaatggtagcttctttatctgcacacacattttaaatagtgctataagtcacaactttcaagcaaaatggatacaaatgtgcaaattgacatagaaacctgaatagttttgccattagacaaccttgatgcatgaatgccgccatttacacccctcatgcttgcagtgggcaatgaatcttgttggatctgtttgcaaattagagagttcaaatcctgtaacaaccgcaaagtgcctaatagc

SEQ ID NO: 85207 - DNA, 509 bp, Oryza sativa
agtgacaaattttctaaagcagagcaagatgaaccaatagcttctaaagcttcatcgccgacaccaagccataccatctttaaggatttcaaatattggcatccttttgcaacagagatcattcctttgttttcattaacatgcttggactccacggataggacttccaagttatggcagtaggtaccaattgcatacagggatctgtatgttatgcaaccattgcagaaagaaatatcaagagagaccaatgatttactacgtatctttacaaattcaaccagtccttcgtccgtcaactcttgaacaccacacagctttaattcactaagattgcatccctctgccagagtaatcaacccatggttttgaacatagccaccctgtaagaaatgttgtcaataaaaaatgaaactcaggggaatacaacactaaatatcagcatgaaatgaaacctcaatgcgaagcttacaacgcgaactgctgacttggacatgataacctcaaaa

SEQ ID NO: 85208 - DNA, 502 bp, Oryza sativa
atgcaagcttatagcactgcagattacaagagattaatgtttggtgagtgctatacatgattaaagtattcaataattatacattacatgttgataaggtgtcactaggaggcggcaatgagagtgatattaaccacataatactaagtactaacctcatcactgtttacttgaatatatcgtgcaactgctccaaacgcgaagttatcaactgatacaaaattgggcccagcaaaatccaaaattacaccatcttctctgcagatgccaatgtgaccgataaaggggatcaaccatgagattaacggtaatggtgtccatactatacaacaaggaaagcgagctcttcttgggtcaattggagcaggctggcttctgtcggtttccatcaggacagtataagcacaagctgttggaaaagagaaacgggttaacattaaataaaagtgtcacaagcatgttgataggggtgccggcaaatacacatcaaagcatgctagga

SEQ ID NO: 85209 - DNA, 686 bp, Oryza sativa
tgcagttggtccgaagattacaaggtcaagatggtgatgtaataggggaggaagttcctgcaacgcctaagaaaatatttcagatcttgcatcaggtccccacccccttcccctggctaatttctttttagatgtgttttggagtttcacttaaaaactctgataaaatatcacaattttttacacactatcaactttgaaactgttggaaaaagatataatattgttaataattgtatgctggatacataagtgtgaactgttttatccaacttcctctagcacagaaactctccctggcttgatttacttgcttgcataaggatgagggctataaatctgttgatggggatattgttctccctcatcaatgttctcatcatttttttcatccgcagaccattgaagctctctcatgtgttccttctcctgaactggctctcagattatatctgcagtgtgcagaggtattgctgtaacaattgatttatgctttccataactctgcatatcatgtaactacctttcatattacaggcggccaatgattgtgatctggaaccggttgcttatgagttctttactcaagcattcatcttatatgaagaagaaattgcggtataagccctgcgttgcccttccttgtgcacatccattttgtcacattacttcagggctgcaggaat

SEQ ID NO: 85210 - DNA, 835 bp, Oryza sativa
tgttggtagaaacacacatgatcgatatatctctctcacttgacaaaaacttgaagatgaacagtaagctaaagagcaatgaacacagaaagttttgtggtgcttaaatcttgccgcaccgttttcacgttttcttcttccttttattgaagggaaaatgcacactacggcctaacaaattgaccggattactcgctctaccatccggattacgagcgctatcccactcgtcagatcgtgcagcgagagactcgcatactaccgcctcgacgtgaactcgcacgcctcaggtctacagacgcgctcaactctgactagagcgagcccagaaaaacagggaataaaaaacaaacacataacgtgcatgaaaggaaactatcctaactgaataaaacagcttttgcaggcacaagtttaacgtaatatgcaacaaatctccccctaaaccttgtgctcgcgacttacttccaaaaccccgatccgcgagcgtagctcctcaaaccgcactcgaccaagggacttcgtcagtatatcagtgacttgatatgcagtcccagtgaattccaactgaactcgaccttcttccacacactcccggatataatgataccgagtagctatgtgttttctgcggtcgtgaaacaccggatttttgctcaatgcaatcgccgacttgttgtcaaccatcagcttgaaaacatctggttgagcttgattaatttctcccagcaactgtgccatctagacaccctgacatgctaccgtcgtcgccgcaatatactctgcctcgcaagacgaaagagcgacaaccttttgcttctgggattgccaactc

SEQ ID NO: 85211 - DNA, 789 bp, Oryza sativa
tgctcccttgatgaagagctggtgggctgctttacaaggacatcaacattctgtaccaactgtgagcccgatcccccacttgggccacttagcatgttttgaactggagtagcattgcctgatatgtgcccatgttccaaacagagcatagtataagccaggcatgaaatatcagaagtcaaaagtagcattcctgttttgtcgacatttcactacaggacaaatcatgataacaacagctatttaagtactactcaattctaaagctaagtgcccatctttgcaagatcctaaggattcaaggtgcattaatcaaaatatgttttcttgtgagcactcagaacaggaagttctccattcatggtcaaggcaacaacaaatgctcctgccagctggcagtcagcaatgaaatgatttaagggaactccaaacaaacataaccctatccacttaagcataacaattctaacgttcaaagaatcactaacaaatgcggaacttatttattcatagcttcagaactatttgatgacgtgacagcaatacaactctacttctatttcaaagaaactaaaatttaatcccatgcaattgtgcaggatatttgggtagtttcataacaatctgaaaatgtaaccagataagataagtacctccgatggaattaggagcgcctatgtgtgaaacatctgcattcagcaaggatgaaccagctccaggacgctcaggtggaactgtgccagaggcctgaagatgaaaatgacatgagctagcatgataaaatgaaca

SEQ ID NO: 85212 - DNA, 756 bp, Oryza sativa
aacatcaatacacactgcagttccactttcaaatcctgcatttgccaagtagcgagcaaccaacttccttgtcataagcattgcttgttcttggcttagagattttccttctactctggatccatctttccctcgatatttgttccctttcttataatactcaggcatcattccaaatctttcaagcattgcagtgttgcgactaacaggcgccggtaaattatcaagaaccccatgaacttctattttgtagatcctagacgtctcacttgttctaggaattgcgctttccgggacacagtcagctggaaacctaatttctggaatgaaagtatcatctgttaaattactatagtccccagcattctttgaggaagggccattttccgacattgggactgagatgttgtgaccctgatcatccataaacacagccctcttccttttatgcacactgcaaaccttcaggtaattggacattccctctgatgttctttttggtatatctttgtcacctgaacggaacttgccatgccatgtcctgaatttttcagcatattgtttgtaccatgtgtcaggtaactcttcgtatcgattatgtctttgagataacatagtgttctccctgcttggactaaatgaggttctagattgcatctgcagcagcaaggacaaatataaccatcagcatagcatatgaatcacatcaacattagttagtatgcaccaactgcagctgaatgctatacataatta

SEQ ID NO: 85213 - DNA, 578 bp, Oryza sativa
tcgttttgacagttaacgtactgttcttgtttttttatgactctggtcagcatcagtaaatcacacagagattaaaaggaatcaaacagctgggaggaaattaaaatgaccaaacttccaagtttctctttcttcagctctcagatttcttcagtgacacaacagaagctagaaaaaaaaaagctttaaaaaaaaggcatgtgtacacaaatctgcagaactagcagttgccatttccaacaaccaaaatctcagctagattattctgtacataggagtactgcagctctgctcgatcgatcatatcctcctcctcaccaactccgatccaactgaatcctgaacttttttagaattcagatccttggatatctcatctacacatctacgtagaacaaaaacaagatgcatccacgtgtaagtgtccttcttggccagccgtccgatcgccatgcatgacgatgtccacggatagatctcatctttttcatgcatgaagccttttttctgggagatgtctacttcatgcatgcatcggcgaaaaatttttctttagctcgacgcctttcgatttcgat

SEQ ID NO: 85214 - DNA, 604 bp, Oryza sativa
atttcaagaaaggttcttgaaaatttgatcaagtcatctgagaggggtgaaccatctggcaatgagggttctgatattgatacagacacagaaccagaacaagatacatcagaaaagaaacagaagcagacccatttacctacatctgtacctgcagctgacaagttagaaaattctaaacgtgtggcacaggaggaaaacacccttcctgccacaaaattcaagaaacaagacgctgggctggataggacattattcataagcaaccttccttttgatctaagtaatgaggaggtacagagcgcttctcagcatttgggaaggttgaatctttcttcccagttcttcacaaactcacaaagtatgtttcaccatctgttagaacatcatatttcctttatttcctgctgttgtatcaaccagaggtcgtttgcatgtacactcattaatgcatgtttttgtgctatctacacaggagacctagaggaactggttttgagaagttctacacaccagaggcagatgatgcagcagtttctgctgccaatgctgctcgtggattgggaatttttataaagagcagggctcttaagataatgaaagc

SEQ ID NO: 85215 - DNA, 946 bp, Oryza sativa
ctttttcttccgatgtctcattttgcgacgtggttatgagcatcagaatttgaactcaggttgctgttatgatctcaaggctgatttgctgctctcctatttttgaaagtgccaccacttgtgctatttgaagtattgcttaagctggataacacgtgtttcacccctggtctagttctatttggtgctaatgaacgaggtggtggcataagaactcgagcatctctctgacgctgaaaagcaaaacagacgggattaaatgtagggaagcataccaaagcaacctactggaaatttgaagaagtttgtaaattgaaataccagtatagagagaacaacctgattcttttcatcgcttgacatgccagacgctgccttacctgaagcactggaagctggttctctgcattaaactaacaaaatcaggaaagatgccttttctgcagaatgtctatgcagttttagactaagtacaacattaacataagagactgaaaaggacaaactacaagcctatgatccaggcgcacaaaacagctatgatctcaaaaggtgctatctttaacaaataatcgagtatttcatggattacttccagattttgtattatccagagataatttttagataaccctacagtaactaaacatagacaagcttaggaaaattactgtaaacagtgagtagtcaccaattctaaagctatattgctatctgagcagcaaagcataaatttattggttatatacatttatctgagcaaatggaataattgcaatatagtagcttaacacatgatatatcagatggaacgtaacaaggaagatgcaacaaacatgagggagcatcatacttggcacttttgtcagtccattcatcatcagcctcttcatcacttgaactccccgacatgaagaagtcgtcatcactcacatccacagtatca

SEQ ID NO: 85216 - DNA, 2282 bp, Oryza sativa
ctaagtcccttagaagaagagggtactaagaggtgtcccttacaaagaatgcacaatgacgacgacgacgaccaacaatcatcaacctcacagcattagcaatgtctacgcctgtccaatcatcatttcctgctcgcagtgtctttcagaaccgaagcagctctgggtttcggtctcaggacgtcgacccagacgaagccggcccaccgcacatcctcttctggagatgctccaggctcgccacccgctgcagcgaggctgtccggccaatcttgccggcagccagagcgccattgacgaagtcctcgtcctcctgagccgaagaaggtatgtcgggcatgtagttgttgttacctccgatgtcgttgttagtagcgaagtaattgttcgggtcatcttggatgggaacagcagcgtctgacgttgcttcagatggggagctgttgaatggcatgctgagggatgacatatcagaagcggcgggaaacaacgcgttcatgcctgtcacccgcttcaccgagtcctctgccatcttcacctgcgaatttttgatacatttcaatgttcagattgacctgatttaataatcatgtttggactgtccaaatggtgatttatagagtataatggtagcgtggattattcttctaataacagggtacacaagtcagttgaaagtttgaaacaagccaaagtagccaatccatgggatgcatattgcaaaaggcatatatagcatacctttgctctcaaggtctcaacatctgcttttagcactctattgtcaacagcagcatcattgtacttctggttaacatcagcaagacgccttaacagcgaggagttctcgactcttaattgcgatacctgtaacaagtaaatccataactgaagtcagtagccagtaatttaggattttatgtcttatcgaaaataactatgtgaactatcagacctgtgcctccagctcattcaagtgagctgcctttctgcttcttgagcgcctggctgactcccgattggattgcttcctggaacaggtcaacaaaactagcattatatcgagaagtgcttgctcaacatcttcatacaaaatcacccaaaagaacagcctatattattgtctagcacaagtaacataataaacaatacaaggtataatgcaatccaccatatcatcacgtgacgtttgaatattttgattttagtgagcaaatgtggggtgtacacactgtccatatcataactcaccataccttgtatgctgcacatacatgtaccctaccgtgacattattttacagccaactgagactaataccaaacttaaattgagaaaatagctgccaaatgaattctggtaatcatagtcgatagctatcaaatccgtggtttattggggtaattgctttatgaaaggtaaagctctctagggagtataactttgatttgcaaatccaagatgggggtgcatcaaccagatactagatacaatcggtttcagaaacttgtgacataaggaatatgatgtgaactcagatttaattcatcccaaattgcttatgtcaataaacaagtagagagcaaagtgctacgtgtaatggccatacaaattcctctcttgctcgagacactaagcactgagtatggcacacagagaactaatatggtaggtaaaagatcatatatgcgatgcaataggaaactgaaaggctaccggatgaaagtggaaatccaactgaaagggctaaggtgaaaataggacacatgcatgcatgacgaggtaggttaattatgtacagaatctatattacaagcaagcaatgaatgatcaccttcgttgtaatctttgatcagcaggtcttgcagttccagtggtctcagcttctccctccatgtcatcatcatctgactgctcccttgatgaagagctggtgggctgctttacaaggacatcaacattctgtaccaactgtgagcccgatcccccacttgggccacttagcatgttttgaactggagtagcattgcctgatatgtgcccatgttccaaacagagcatagtataagccaggcatgaaatatcagaagtcaaaagtagcattcctgttttgtcgacatttcactacaggacaaatcatgataacaacagctatttaagtactactcaattctaaagctaagtgcccatctttgcaagatcctaaggattcaaggtgcattaatcaaaatatgttttcttgtgagcactcagaacaggaagttctccattcatggtcaagg

SEQ ID NO: 85217 - DNA, 599 bp, Oryza sativa
ctttgaaggagactcagatggggaggtataagctttacttaaagcaaaaaccggtattagtttttttccttataagaaatatgggttttaaattattttttcaaggggattttgtcttactttcttcaaaagaggaggtggatgttgataatgaatgaaacaagtggtggttgtaaaaatttctttttttgtgggtaaggggacaagaatctttttgtgtttttccgggcttcaagggttgcctggaaaaggttgtaacaacattcatgagttttgttcttatagtgggagaagtttatggatttttttgggagcaacctcaattgatcctttaaaagttaggtatcacctgtggaatggttttagagggctatagttagcgatgggtctacccatgcaacactttgtgaggttgggatgaacagattagaatattaatttttgatagtttacttatggagtatgttggtcttgggtacctatcaaaagatataatcatatgtgatacattatcaagggccgtaggtatttgtgagtatggacaaaaagttttgattgacatcatatcaggggatctctagagaggacctgcaggcagg

SEQ ID NO: 85218 - DNA, 797 bp, Oryza sativa
tagagagtgtaaagagagatggaaatttaaaggagataccttacaagacaaaatcatgtagaatggtgttttgttgtaaaacaataattagctggaaatagctacagacaacattcaaatatataaaagctttatactgatgagctattacaaaatataatcttcggtaattcatgcacaaaatcaacttacctgattggctacttctgaaggtaatgcagcattcgacagccctaaaagtatatcaacatagtcagatgtcttgggaacctttggtacaccacatgcctcagtaaagaattcgcaaaggctgggataggctgaagatagcatctttcttgggaacatactaatcttattcttcattgaaatgactttctctgttattatttcagaacagcctgttgggtcatgccaatacagatcttttggggacaagaattttccaggaacaaaatcattagatcgagcacggtttaatggtgtaaatatagaggagcaagacaaaactcccgtttaatgtcaatcgttgcagtggcaaaaccttctgacacaaaggtgtagaatttgcacatctggtccatactgaaaaaagaaggtcaaagcattaccaagtttagaacaaagatatcccattcttaaactgcagtacatacatgatatagatggggactgggaatatttagattagtactccttacatgactgatacgctctaaaattgcagatcacaaaatgctatgattaaaatacagacattgaaatcaagtaccttgcactaaaagaagtctgtgaag

SEQ ID NO: 85219 - DNA, 3937 bp, Oryza sativa
cctactgatgcggcttacagaaacagtcatactgtggctatcagaggaccagagcttttgggaagagattgaagaggggccaagggctctgggtccccttggacttcagcaggtgagttctttttttcttgttttgatcttatgacaccaactattattcttattttcaccttccttttcagttctacctggatatgcaatttgtcatcctttccgggcgaggccgtttcttatctcggcacgtacatcaagtgatactgaaaatcattgatagagcaatggcagcattttctgctacagggatgaaccctgataggtatgttactatctatctgacttgcatctatccttttgcggttaataaatctatttcagtccgactgtatttagtaggaggtgctaatattaatatctatgcatgttatgctgtaatggcaatcggatgcatgcatgtattttgctccatgttacaattgtaatagattcctcacataccagaaactggctggaataggctagtgattatgcaattcctggtttattcattttttagataataattcctggtttattcatagctggaataggctagtgattatgcaattcctggtttattcataaaggttggtaactgaagatgatatacccgtttattctctgcagtgtccttccaagcgacgattggttcatcgacgttgctaatgacactatcagtaggatcagtggcaaccctcgaactgccaatggggatagggaggtgaacagcccgacagcctccgtttcagcgcaatctatatcgtcggtcagatcccatggcagctcctagtgtacatagtagccttagtaaccaggtcttgtataggagtgagtgtgaaatagtttctccatttccctgttgtattctctccttaggtcttgtataggagtgagtatctcctagctttgttccccatctggtgtacatgccagtatatagacctcgtttggatgggcctcaatcccagtccatccatgtgtataggccaggattctgaactaaaatcctggcccaaactcatggatggaatgggattctgcatattccaaaggcggccttaggaaaatatttgaattgaatcggttgttcagagatgtgtctttgtaaatttggtgagaaatgtatgacccagtgtagtttgtcttcttggaaacatactgtaccatcttgatacgcgtagactgactttgtgctgattgttcatctgaaaagagtattgtcttccaaaggctgatgatgaactctgaaaaactgaagattcatctgtaccatagtagcctagcaacaagccaacatgcactgaacacgcgcttgctacctgccaaccaatttgacttgtgcttacctttcttcctacagtgtggtcgctttcgcctttattttttttagtggtgggttcgcccaagtgcacggaattgaggacttcgcttaccattggagaatttggtcttcattgtttttaaaacttaattttgaatttgattattttttatttttcatcatagtttattttgagtttgctaatgatatgcatataaaagttttagtcacaaatgatcttttatttagtactctctccgttttatataaaaaatatcagcatctaaaatatcaaattagttttattaaatatattttaataatatatttgttttgtgtttaatatactactacatttttctatagatttaaaaagaagtttgactagtaaaaaaacaaaatgatttgtatatgaaacggagggagtaataagtgattcgaattaacataagaataagtaaaacaatatgctcatctcgcactccgtgaccaggtctattctaccagaccacatcctgtccacgtcactcgttagtccgtcaacgatgaggacgatttaccaatctccacttatcatgcagccgtctaatcgcgatccgacggccaggatcatccgacgcgctgccccttgacaaatcggacatggttgaaaaagcttctctcacaatctagttttgatcacattttaccaaccacaacttaaatacttaacaactcttgcataaagtaatgatcaaagcttgatgatgattatgcatggaaatcgcccgagggcctgtcaatttctcactctcgctatagttagcattttttcttggataatctttgatatgctactttgattaataatatctataaaaattttaaataaaaagtaactacatgttacgatagtttgtttaatgataaatttagtaacatcaattttatacgattgatctttctacttttcttgttattaatagtaaaaattaaaaatgtttgacttaatagtgtttctattttaggacggaaagagtacttattgatgatcacaatactaacagagccttttatgtatttagtgatttaatgtttgatcccttcaaagctttcacaaagttgtcctttccacacgtcctcctatatgcacttatatagcattgcattggcaccaaaactatcgacctcatgtcctcatcatcatcaatggagtgcaccggaaacatgtcggcggcgccattgctcgtcttgacggtggcggtgctcgccgtgctagcctccacctgcgccgccgacccagagccgatacaagacttctgcgtggccgtgccccgtgccggcggcgaggcgtcgccggcatacccgggcttcccgtgcaagccggcgtccgcggtcgtctccgacgacttcttcttcgccgggctcgccgccgccggcagcacggacaacccgttcggggccagcctgaagccgggcaacgtggaggcgttcccggcgctgaacacgctcggcgtcgccatcaaccgcgtcgacctcgcccccggcggcgtcaacccgttgcacagccacccgcgcgccgccgagctggtgcacgtcatcaccggccggatgctcgtcgggttcgtgagcacggcggggaagtactactccaaggtggtcggcgagggggagacgttcgccatcccgcgcgggctgatgcacttccagtacaaccctgggaacgcctccgcccgcgccatgacggtgttcaacagccagctccccggcgtcgtgcccgccgcgacggcgctgttcggcgccgacccggagatccccgacgccgtcctcgccaagagcttccaggtggacgccgagatcatcaaactgctcaagtccaagttcaagaagtgacactgacgtctcatccgccatggctacagcatatctgttttgctttagctgtcctagatacagtaaatagagttgtttcacgtttgatattttggtccgatatttgcccatttggcacatcaataaagtaaatttgaattgtcctatacatgcagcaaatatcggaaaaaatcacttaaagacatcaaattctcaacaatttagagaagaatttaccaaatgaatttgacgacagcacggcagccacggctaattttgcacccaacccttcacgcatcttcccatcttcctccaccatgacgcggccgcggcggcgccatgcttggttctccgccggtgatcggaatccttcccctgccgcgggcggcggcgagaatcataaactgccttagagtcgcaaacttgcacggcggagagattcgaggaggcggcgaggaatcataaactgccttagagtcgcaaacttgcacggcggagagattcgaggaggaggaaacggaggcgtatcccggcggggatgaggaggccgcccatcagcgcgcggcgaagcagccatcgacgccggcggaaggagaagcatatgacagtaacaaatcgggctgggcctacttttgccagaaagttcaatagtacgctgttcccctaaatgggccgcaacgaaaattccgaaattggtgtgcaagtcagaatatagcctgcgcccatttg

SEQ ID NO: 85220 - DNA, 751 bp, Oryza sativa
ttagtctagcactcgagattgttgagaaatgagaatgaaatcgtgtgccaattcattgctggtatcctgaatcctgatgtttgcaattgacagcgttctacaaaatgtataaagacgggtgggctatttatgtcagactaccactccattgtcttcatcttgtcgttcagctgcatccttcttggccttggcctcgtgcaacgcgttcaccagcctcgcgaggcaggcgccggcgtcgtcccgggggttcttggccgtgaggtgctcgccgacgtcggccggcaccaggtccacctccggcagcagcctctcgacggcggcgaacatctcgtggtcgtcgacgtcgaggtggatcttggccatggacttgaacgtctcgaagtcgcagtaggacatctcgatcttcttgtccatcctccccgtcctgatcagcgccgggtccaggtcctcgacgtggttcgtcgtcagcacgatcagccgctcctccccgaacgccgaccacagcccgtcgatgaagtttagcagcccggacagcgtcaccttgctgtcgccgccgacgccgccgccgccgccgccgcgatcgatcagttgctggagcagtcgacgtcctcgatgacgatgatggacttgctggtggtctggatgagcagcttgcggaggtcggtgttggtgtgcaccgacgtgagctccatgtcgtagacgtcgtagccgaggtagttggccatgggtaccgagctcgaattcgccctat

SEQ ID NO: 85221 - DNA, 684 bp, Oryza sativa
ccgagcgcgggcgcggcagcgcgccggcccggccgttgaagcgtccccaccgggagacgctctcggcggcggggaggtcgtcgaggcggctgcccgggatcgtctccgggctcgacctccgccgcctcaacgcgacccgctccggctcgctccgcaaggtcgccgcggaggccgctgcggccggggctcgcgtcttctccgagctgcaaaccctcgcgggcaccgtgactgagctggatgcgaccggggaggaggagaggagcaagtgccctcactcgatcgtcctcaccggcgacgagttccgggtgaaggggcggaccgtggagctgccgtgcgggctgacgctcgggtcgtacatcacggtggccgccacgccgcgcgcggggcatgccgaccgagatcctaaaatcacgctggtgcgggagggggacgagccgatcatggtgtcgcagttcatgatggagttgcaggggctcaagacggtggacggtgaggacccgccaagaatccttcacttcaatcctccgctccgcggcgactggagtggcaagcctgtgatcgagcagaacacatgttaccggatgcagtggggaactttctccgctgcgagggcctgagggtccgtgctgatgaggagacccgtatgcaccacccttgccctcagatgaaacacgatgaacctat

SEQ ID NO: 85222 - DNA, 2944 bp, Oryza sativa
ctatcttcagcctatcccagcctttgcgaattctttactgaggcatgtggtgtaccaaaggttcccaagacatctgactatgttgatatacttttagggctgtcgaatgctgcattaccttcagaagtagccaatcaggtaagttgattttgtgcatgaattaccgaagattatattttgtaatagctcatcagtataaagcttttatatatttgaatgttgtctgtagctatttccagctaattattgtttttacaacaaaacaccattctacatgattttgtcttgtaaggtatctcctttaaatttccatctctctttacactctctatgtaggtctttcatgtgtttgcgaggtgggctaatgatctccattctgcaaatgacaatatgaatgatatattgttcttggaaggatctcttcaaaagttggagacaacaatactgccaaccttgggtgataaatgggtctctctccatccttcttttggccttgtttgctgggtagatgataatgagttgatgcaacactttgaggactacaatggtgttaacttcatacaatttggagaactttcttatgaagacaagcaactgctgtatggaagaattgctgcattgctaaaaagcctaggcatccctgcactttctaaggtaattaaaatcctgttttgggaacggtcattgaccttttttatctacttttacctggaagaccattcatttttgtcactgagagaaattttaataatttcagtgttctttatttatgaaaaatattctccaaattaatctctattaagagaacaaattttatcattgagagaaaatttaataacttctgagtgttctttacttatggaaaacatgttccaaattaatctctattaatagaacaaaaaaagggcacaaaatagaatgattactgaactggctgtggcaccagtgtgtttttcatgcacttctcagatacctattttctacgatccaccactgctcatcctgagtgggtagtagcaaatcggagaaacttcaaggtggatgaatcttgattattttattttatgtatttatttattttgcaaaatatgtttggatgatgctgactttacacagcttttcttttgcggggaactttagccagctgtcaaaattgactgcctttgatgagacgctcagttcagttgatagcagctgaaaatatgcgttctgtctgaatgctgcacatgctttgatatttaattcttacacatcttttactgattatgtaaataaataaatgcatatttaacaattgcatatatacatcaaattgctcaagcatacgagtaggaacttacatattgaatattcttagcagcaactattgtccattttctgtatgtttctcatccaggattgttgcccttctcataggttatttatcgtgaagcaatattttacggtacagtggataacagagaaaaggttacagtaatttcttggctattaccatatatgcaacgctacatctataagatgcatagagatacatatgtaaactttcaacaaaatgaaatcacgaagcttagcaatctccaagttattgttgttgagaagttattccacaagtataagctgaaagaacgtgagagttcttgtaagagaagattcaaatgcaattgcctattgcaggttagtatctacctttctattaactacctgctcttcatttgtttcttattcttataagaaagagaacttctggagaagccctttttgctagaattccacccacaaacaattgtatttcaagttctgattattttgatttatttttttccacatgtggaggcctgtagggtagcattatttatcgacctccttaccttctaagcttcatgccttttgaactttatgctatgcaaatgcatgcataatgtactcattactcaacagtaaaattttactctgataaagtcagctctgatttcccaaatccatttgttatgttccttatttccagggaaataatctatatgctacgcaagaagctgattcacattcactgtttctggaactgtctagacttttctttgatggatcccctgatctgcactttgcgaactttctgcacatggtcaaaaccatggcagattctggcaccacagctgaacaaatagagtcttttatcgttaataatcagaatgtgcctgatttgcctgagcatgaagctgtttggtccttttcttccttgatcatagcagaccaagatgttgattgccaaagaactgaattccaatctatatgtgacagtcagaaaactgaaatccgatctacatgtgaactcaatatttccaagcatcagagaacgtctggagttgcttcaagttggccaccaaacgactggaaaacagccccagatttcataacatctcacaatagccagtttacacccaatcaagagacaaacttgaacaatgttgtaccttcgttagacttaaccaagactcagtgtgaaaactcagaagatattgtgggtcctgttgatcttgaaggggattggattacagaagatgattttggatcagaaaatacagtacttgcagaacgtataggggcaactggcgatgagcctcatatggtgatgtcgattaactctgccaatttgccggcttatttggatttagaaaccggaagctcagcaaactcagtggtggatattgagctaacagaattcaatgataaactggcaaatgtttcggagaagagggataggctctgcataaaggctccagacagagacaaattattgagaattggcaagcaaggggaagctgcagcccaccaacattttgttgatcattttggatccaataatgtcaggtgggtgaatcaagaaaatgaaacggggttgccttatgacattgttgtcacacacaaatcgggtttcacagaatatgtg

SEQ ID NO: 85223 - DNA, 1140 bp, Oryza sativa
tacgcaccccaagtggatgttccacattcatcaaagataagtgcaatattgatagtgttgtattgctgtgtaagtgggcaatcatgtttagcttttgtctttggttgttgtgatggcagggatttgtgcttgaagatgccactggcttatcattgaatggggatcttgatgtgcaatcggtgtttgcagggactttgcccactgcacaccctagcttttcacctcagaaacacctagagatgttgcctatttggcaggcccctccccttccagacgaaccaattgagattttcattggcatcctgtcagcaggcaaccattttgctgaacgtatggctgtgaggaagacatggatgtctgctgcccagaagtcctcgaatgtcgtggcccgtttttttgttgccctggtaaaatcttgaagatcaaatttgatggcctgtatgtccaagttgcatgcttatgtttgtggacttgagctgatgaattatcttttctgcagaacagcagaaaagaagtcaatgcagaattgaagaaagaggcagagttttttggggacattgttattgtgccattcatggacagctatgacttagttgttctaaagactgtggcaatatgtgaatatggggtatgtctaagattggtacatattttcgaacttgctactttcaagctgctctattaacatctaatgaactgtttgtcaggtgcgtgttgtttccgctcgatatataatgaagtgtgatgacgataattttgttagacttgaatcagtgaaggatgaacttaagaaaataccaagaggtaaaagtctctatgtgggaaacatgaattatcaccacaagccattgcgcactgggaagtgggctgtcacttatgaggtaagcatgtttttattttacaatgaccttatatgtcttatcattgattgaagtgctgtagagaacatttcaataaaagttatttggcctgcctgacgcggtttttgctgattcattgaaatcttaacagaagaatatagtattcatggcaatatggcatgctaatgtacttaactcaatctttcacccttttgaggcatctaacaaataatcacttactgtaaccatacagcgaaacttagcataacaatggtataga

SEQ ID NO: 85224 - DNA, 1111 bp, Oryza sativa
gaattcaatgataaactggcaaatgtttcggagaagagggataggctctgcataaaggctccagacagagacaaattattgagaattggcaagcaaggggaagctgcagcccaccaacattttgttgatcattttggatccaataatgtcaggtgggtgaatcaagaaaatgaaacggggttgccttatgacattgttgtcacacacaaatcgggtttcacagaatatgtggaggtgaaggcaacaacaaattcatacaaaaattggttctacattacattgagggaatggcagtttgcattagaaaaaggcaatgcctttaccattgctcgtgttgttctgaaggattcaaagaaagcaaatgacaaatcaaatgttctcattttgaagaatccatacaaactttgcctgaacaaatcagtgtatcttgccctcataataccacagcaatatcaaacaaaacgccgttactttgaaggtaactcggatttgcaaagtgaggtaaaccattgagatctgcaactttggctaagcctttactcaataggaagggaggttgtggggattttgccactgcacctttacttcaataggtacaatctgacatacgctatatcagttttgtttggctccatatttaccaacatagggttttccatagtaagctcattctatgctttctggatatactacttgtcgcgatggttctcggccatgtcataggacatcacctcgtctaacttgtaattttagctgttgtaactattcatccaactttgtggcctcggttttcagttcgaggttcttgatacatgaacgtgcctgatcataatgaaaagtcccattgcaattgtacaaatatctcaattttaattaccatgtgttatttactttccagtaatacgttaccagaatcctccaatttcacatatacaaagaggtgtgtgccaattccatactggagtactcctatatttttaagtcacatactaagggtgtgtttagattccaaaataaattttggtcaaaaatgtcgcatcaaatatttggacatatgcatggagcattaaacatgggaaaaaaaatcaattgcacagtttgcatgtaaatt

SEQ ID NO: 85225 - DNA, 817 bp, Oryza sativa
gggccacgacatcgagaacttctggcaacaagacatccatgtcttcctcacagccatacgttcagcaaaatggttgcctgctgacaggatgccaataaaaatctcaattggttcgtctggaaggggaggggcctgccaaataggcaacatctctaggtgtttctgaggtgaaaagctagggtgtgcagtgggcaaagtccctgcaaacaccgattgcacatcaagatccccattcaatgataagccagtggcatcttcaagcacaaatccctgccatcacaacaaccaaagacaaaagctaaacatgattgcccacttacacagcaatacaacactatcaatattgcacttatctctgatgaatgtggaacatccacttacagtgcggtacggaaatgatgtgacgtgtcgtccatcaacgttcacgtggtaaccctccaacccggcggtaagagtaagaacgaacatgcagtcctccacaaacgggtatggccaatcaacagagaccttctttgttcggccaatgaggcggttgagccaccatgacgtctttgattgttctgacctctcctcgtcatctcgaatccatttctcacacttcaccatcccatccactgtacaacattgtaaacaaaatcattaatcttcaggcattgcaaactaaatctaatgtttggacaaaacattgtataagttcatcgtgtttcatctgatggcaaggtggtgcataccggtctcctcatcagcacgggacctccagccctcgcagcggagagaagttccccactgcattcggtaacatgtgttctgctcgatc

SEQ ID NO: 85226 - DNA, 1399 bp, Oryza sativa
gcatggcaagttccgttcaggtgacaaagatataccaaaaagaacatcagagggaatgtccaattacctgaaggtttgcagtgtgcataaaaggaagagggctgtgtttatggatgatcagggtcacaacatctcagtcccaatgtcggaaaatggcccttcctcaaagaatgctggggactatagtaatttaacagatgatactttcattccagaaattaggtttccagctgactgtgtcccggaaagcgcaattcctagaacaagtgagacgtctaggatctacaaaatagaagttcatggggttcttgataatttaccggcgcctgttagtcgcaacactgcaatgcttgaaagatttggaatgatgcctgagtattataagaaagggaacaaatatcgagggaaagatggatccagagtagaaggaaaatctctaagccaagaacaagcaatgcttatgacaaggaagttggttgctcgctacttggcaaatgcaggatttgaaagtggaactgcagtgtgtattgatgttctttcagaaataataattaagcacatctctaagctggggcgtaacttgaagcttctaactgacagctacaggaagcaattttcatccattgaactccttaagatgttcctacagactgttggctacaggtactttaacctattttatatacgcgcctctttacttttttcccttttgttttccctgtgttctttttggtattaggtgcagggagatgccttctgtgttactatatatactaacacatcagttcttgcctaaaggagctagtaataaaattgagtcatgttgatggcagagcatgtgtatttaatgcatttttttttctataaaattacatgccaaagttctgatagtgattttctgctgtaacatttagtaacattggccccttgatggaaatcactaaaacgacaaatagaggggccaactaccctatgcagcaagatgcacaagtgcaaaatcaaaatgctcttcttcatgcacaacaggtaggaaactgctgctggctcaccatacttgtattatgtatatcttaatatttctatattctaaagcatatatgcttccttgctgaggaaatggtttagttagactcttaagaatttctacccatcaactgtgcaaggaggggtggttttagccaactaaaagaggcataaggctgtttgattcagaataatttatacacttagccatccaaggatagatcactgattaaacaagccttcggtgtcttccacttgatttggtttatgggagtgaatattgcctgatgatcactgattaatattagaatctggccggttgtctgtgatgactgtaaagtcctgtctgatggtgctttctcttgtagtgaaactc

SEQ ID NO: 85227 - DNA, 595 bp, Oryza sativa
gatgtgagatacataccagggatggcgagaaatctcatctctctcagcacacttgatgcagaaggatacaaatactccggtttaggtggagttgtaaaggtatcgaaaggttctcttgtttacatgattagtgatatgaattctgcaaacttatatgtccttagaggaagtacattacatggttctgttaccgctgctgctgtttctaaagatgaacctagtaagactaacctgtggcacatgcgtcttggacatatgagtgaacttggtatggcagaattgatgaaaaggaacctgctggatggctacactcagggtaacatgaagttctgtgagcactgtgtttttggtaagcacaagagggtaaaattcaatacctcagttcatcgcaccaaaggtatacttgattatgtacatgctgatttgtgggggccttctcgtaagccctctcttggtggtgctcgttatatgcttaccattattgatgattactctacaaaagtgtggccttatttcctgaaacataaagatgatacatttgctacttttaaggagtggaaagttatgatagaaaggcatgatagactactgtaca

SEQ ID NO: 85228 - DNA, 1333 bp, Oryza sativa
cagtagctcatgcattggggaagtggcatacaaattgcaggcttcctggagattcatttatccaccctgtctttcatgtctctcagctcaagcagtttgtgccagctcatgttccgatctttttcaattgccctctccatttcaacagcacattagagaactggaaccatctgcaattctgaattgctgtcttgttaaaaagggtaacactgttcacactcaagtgttggtgcaatggggagaaatgccatcggcttgtgctacttggaagattaccatgatatgtaagcttgttttttgtcatcgcctcaagggggtggcaatgtcacaccacagggtgtgttacaggtggaagaatcaaggcctggagctagaggtagaagacgatgggaaggtgggaaatggaaatgcatatcctgaagaaggcatcgtctagtgatgtgaatgtcatgtgtatgctgtgcggggacagtttttgtgaggatattgatctgtttaaatagacagttacagtaactaatgaaacgttgtcgggataatgaaaagaattcatccccactgttctggcggctcgacggtgaatcctttgactgcaagcagggcgtaacaatcttggccataccttcagttctgttgttgtccctacaccaatgtctgctaagtcaccatcacttggaatcccttcacctccagttggaattttcgctcaggtaatctgttatgctcttttgtacatagtcattgatgctgtttcttgtttacgtatagcatgaaaaataagatgttatttttcaaatactttgaagtattaatatatttctgttccatgttaagttcttatttacatctaagcaatctttgcaaattattaactaaaaatgcatggaaaaaattgtggcacctgattcatatggaagatgctagtcactaacttataaggtaataatcatgtgtaattgcatatgtggaacctgaggtgatggggaaattattagagggtaaaaatgtatgtgagtttgtaaatattttatttctcatgcttggagaaaatttagcttttaacacttctagttatgaactttttcaatatgtcaactttgtatttcttgtttgattcttcccttctttctgtgagtttctcatttttcatgagaatgttcctttttgaaggcctaaatacctcattgtttgactaactttaagggaaaggctcctgcattacatgttgatactgctcaaagaaatccagcaaggtgcttttgtggaaatatttgatcagttgtaaaacctcccagatctaaccagcttgaggatctaaatggtagatcccatc

SEQ ID NO: 85229 - DNA, 1235 bp, Oryza sativa
tccttgcaattgaggcaacgttgcaagttcgaatatatgaactaaaggatggctgtggcagcctaaacttgactataacttgtcgtgttagtcatatgaccccacaaattaagctctttcaaggtcccattgataagctacgtgaccaaaataggtttgtggttgttgcaacactgaacactttgatgattacagagttcaagctaacacatcagcatggctcaatcagtcggagatttgagtccagggttgtaccacatggaagtatgtctcattgcgccaagtttgcggatttagccactataggtgtggagatcttttggtcaatcttacccacttcgctacaagaaggcttttgagccttctactttgttacattctatttattttcaggcaaaaaatcacctacctgtaaatagtaagagcaatgcaagttttttattaggatttgtgccatatatattgccatatgaaccagaaccaaccaaggcttcatgtgtatgtcaattgttgggcaaaccttgccatatgagcaaaaaatatttttttttctttcaattgattttgtggctgttgatttgcacggagattgggatatcaaccacaacaagcacttttagcagtgattacgactccttccagggcaccagtaagttgatgatgtgatatacctaccttttttgttcttctctttgctttggatttcttgttctaacttcactcaatcagctaggaagaatatttatgcaaatttatattttcctgcctctaccctactccatattgctactagataatactatctccatattttaatgtatgacgccgttgactttttgtccaacgtttgaccattcgtcttattcaaaaaatttatataattatcatttattttattatgacttgattcgtcatcaaatattctttaagtatgacataaatatttttatatttacacaaaaaatttgaataaaatgaatggtcaaacgtttgtcgaaaagtcaacggcatcatacattaaaatacggagggagtagtattttctatctttgtgctcgaatactggctggctcatgttctattgacacatggacctaaaagagtaatatttgacaagaggctggctaaatacctggtggctgaactatgcaacacatttagcatgtcacacaagtggtgtgtttcctaatacactcaagcctgtacaacaaattctgcttcaacaagtaactaga

SEQ ID NO: 85230 - DNA, 1543 bp, Oryza sativa
tctgctattgtacctgctctgagacagccgtgcaggaggagctgcagcattggtagtagtttggtaatacttccttcattataaaataaagaaatttactccggtccaacaaaaagtatttcgaggtattgttatctcacggtatcaaatcgtttctgaccattggatctagctaggcatgataggtattgttagatccaacaatcggaaacgatttgataccatgatgtactggtatctcgagatagtttttgttggaccaaagcaaatccctaaaaataaaataagtttatttttcattacatataaatttgtgaaagtaaatacattgagagtacataaaaagataaataattacaataaatacattgagtagtatatgataaagtaagagtattaaaagtcttttggtttatattaattattaagatgtatgagatgtgaaaaaatgaacttatttgaaacaaatgaagtactatgtatgtagttctccctccgtcccaagttataatgcgtcttttttttagaaaaatcaaaatcgataattttgactaataatcatactaatcatatttatattaagtattatacatgttatatcactaaatttagacaatgttcagttcccttcaaacttccaataaatccgtcacatcaaatgtttggacacattgtccatgagcattaaatgtggacgaaaaaaaattaattgcatagtttgcatataaattacgagatgaatcttttgagcctaattacgccatgatttgacaatgtgatgttacagtaaacatttactaatgacgaattaattaggcttaataaattcatctcgtagtttacagacgaaatctataatttattttgttattagtctacgtttaatacttcaaatatgtgtccttatacttaaaaaaaattgcacacaaactaaacacggcctaatattttaaaatgctttcatgtgacttttttcgcgaggaaaagggaaaatatattactcctcagaaagattacattcgccaggtaggagctcagatacacacagagaagcttggaatcgccaaaccacacattgtttcgttctcagggcaggttgcgccaactcatgagcaacactatacctcctctatatctactttatagttcaacaaatggtttcactcatctttcattccttcattcatcatggaacggtccagattatctcgctgagatctaacactcatgatcgtctccacctcccacctcagtatacgccgcttttcctccagacgcgttctccttcccccaatcgctctccctctcggctcccgactcccgactcgactcccagtctcccacctgtcgcccctccttcccccaacctctctccgagcaaaccctaatcgtcgccgccaccttctcctctctcccctgacgccatcaccgccgtggatctcttcccctctctccctctgatgccgcagttgcatcctcctcctcctcctcacccgccacgccgcccgattctacgcggtgacgagccaaccctacgcagtgg

SEQ ID NO: 85231 - DNA, 1797 bp, Oryza sativa
gccaagtgagcaaaagagattgtttaacagaacgcataaaacgcaacaataactacccttaatcagcatgagaatcatcaagccttcaagttaaacatgcattgctttacataagtaaagctgattaccttaagctttacaagttgtttctctaacattccaaacaaaccaatacattgcattaggccttgttcggtttggatgggattgacgaggattggaggggattgagggggaataattccacaccacaataagtgtggaaaaaatcccctccaatccctccctcatggggattaaccaaacaaggccttagttggtagcaataacattgcataccaagctgagtgcaggaattctacagttttcagttttttttggcaatctttggcaaatttttcagtacgcaactagtgcacatatgcagaccccgacaccccgtaaagtttatattcatatattcaactgtgaaatatcaacaatcaagatatgacacccgtccaaaaatttcctaggcctattatgtgcactaagtatgtataagtttgaacagacaataagtaaatctaatggaccataataggttcagaaagggatccaattgatatacagttcaaagttcaaacactatggattcttacttacgaactcaaggtttcaaagttcacaagaaggcttcaaccctcaaattccagttctgccaaaaaaaacctctacttggtggtaatgtttcctggaaagtgatttggcatttttaaaggtagttttagtctgtccaatttaaagaaaaaaaaattgatcgattattgttaaggacaaccagtatgtagttgattactatcttaaatttggtagcaagtctgcaatggccaacctaaaattctaactttctaagtatttacaaagtagcagtctaaataattcaatcaactgaactgagtattgcacacagaagttctttttgatatgaggaacattgcagcaaagttaagttacatgagtgaattcagtattatctaaacataaagaagaatcaccaatccagctattattcatggaaactgggaagactgcatttcctttaggattggctaatttcctacacttagttatacctataatatctacttcttctagggctaactaggtataacttcaactcacttatttaccgtgcaaaagaaaatgtaacttacagcttcacatagtttacaggcgatgcaacgctcttctccagttggatagcgtctgagagcatgctctcctcggaagcgagggctcaaaggacccttctcaaatggatagttgatctgtaaggaggtaggataagaaggtaaatacaagcatgcaattacattataaaggaaacagtatgccaaattcaccacttaactgtaacattcttctcgaagaagtacttgagtgtcagcatcaaaccgcggaccatttcagtcaaaaacaatgtgttgatgctcctttcaaatactgaagcaagaaagttcaaaataagcattaaagggaatagtggatcacaaacttttccgatgcatagataaagagtatcattagaaattcaccagcattccaatctttcgctatctcctttgcaagcttctctttctcctcatcctctggtaattaggaagaaaaagtataagaaaaaaatagcgacatcacaccaattagaatggaacttcatgagttgttggctaggaagttctgcagactataataaaattactacacgcaggcaaggcgtgtttcatcatattggtttccagacataactacactgtg

SEQ ID NO: 85232 - DNA, 746 bp, Oryza sativa
gtttctttcatgatcgatttgttgttgttgagatggatcggaagcggtataagcaaatgtcgcgccgttgcgggaattccccgatcatctttgcgtgcattgggatcgacccgccgctgcccgtcgtcgtttggtcgccggcggccgccaccggcgccgcggcgcgcagccggggagggagcaccaatggcgggcgaggcggcatcaagggcgggaaggcgtgggttatttgttcttgggcgtcagccgatagctcccggcccagcccagcccagctgacgaggaatctaaggttgcgcatggccgcaggggcatggcagtggcgcgcgggcggcgagcgagagagagcaccacacggtggcgctgagggcggcggcggcggcgcgagcgcaaccagcgggaagccgggaaggcggcggttgacggagaccatcgccattggactcactggagcagcaggggaacagaggaaggaagccatgtgtggtggcattttgattctgggcgaagcttgatgagtttgggggccaagcttgggaccatggctctgggtgatctaccacctttctcgcggggccttctacctcgcgcggattcctcgtgttcaagtttcaaatccagaggtgacctccagtgttgatgcccagaagatgtttgatgaaatgccaagaaacaaggagctaaccacagcaagtgttgttcgcgtcaccgtgagccatgtgctctgtccagtgaccacagatgat

SEQ ID NO: 85233 - DNA, 736 bp, Oryza sativa
ccattaccctaatccctaaaattccctcccctacctcaatcaagcaattcagatccgtctatgggctaaatggttccctgaagtatcagcaaagttctgacaaacagactgtctgtagtggctccatccaccgttgcctcaacacaaactgcttttattccaggcaggttcatacttgaaggatgtgttattctacatgaggtgatgcatgaactaaggagaaataaacaaagaggcgtgattctgaaactagattttgagaaggcttatgacagagtgagatggggattcgtttatggggtgtttgacagtgattctgaaactagattttgagaaggcttgacagagtgagatggggattcgttatggggtgttggacagagcattttcatgaaaaatggattcactgggtgaaaagctgtatagaaggtggaaaagtctgtatcaacataaatgggtagagatctaatttttttcagcacttacagaggcctcaggcaggaggatcctatctctccgctgctcttcaattatgtgagtgatgcgttgatccagctatttgatgcagccaaaagcgccaatatcctaacagggctggtcccacacctcttccctgggggattgactcacctacaaatgcagatgatacagtgatttttatcccataccttgctgtgaccaagttccttctttactgctttgaggacatgtctggtctaaagattaactatgataa

SEQ ID NO: 85234 - DNA, 585 bp, Oryza sativa
acagtagcccatcatatcgctggaaaaaaaatgcaatgtttgatgaggtgtgtgcgagagtggtaatgaagttgtggatttgtggttgccgccgattgttgcaggaggtgaacgagatgtgggcggggctcgggtattaccggagggctcgatttctgctcgaggtgagtagcgagttgattgatcacgaattcatggtcgaaacgacggggattgggatgaggttcacttgttcagtgcgttctgtggagcgcccatgaaccgtttgatgttttgtccaaaggagagattttatttggaacccgttttgtgtctgacagaggaggggattattgctactagttcgtgatgtctgctgcattgttttcgctggcaatctcatgtgaagttatcagttcatctggtgaagatttggctagtttgggtggaagaactgacaagaacattagcagaaatgttttttccttgaaagatgaaatgaatgaataagtgcctatgcatctatgtgcatggtgctgagcaactaatagaaatgttgctacggagcaaagcattattctgggcatgcatttttggttcaatttc

SEQ ID NO: 85235 - DNA, 759 bp, Oryza sativa
acagtagttatgcatggtcttttgaagtcttaagacaacaggtatttcacaaattttaagaaaaaacatgataaaaaatagataattttgtatgggtgctagtcgtgcaattgcgcgggccacccggctagcaaataaaataaattctaaacatagaaaaaataattataagagttaaatagaaatatgatttataagtaaaagaatatcagaatgaaaaatatggaattttaaaaaaaaagttcatctagaacacagcgataacatataacaataaagaggggagaaacaacaagcctatgaaggaatagagtgttggcggctgatgggacatctaagaactattaacaaaaccccgaatagtatcccaatgatgattaaaagaagggacgttagacagactgttaaacagcacgatcacggcggttggcgggacttctaaaaagtaaaaaagtaaacccaatgataaccatgttcgatttttaaaatctccatgacaacaaagagtgaagcagcgggcgagccatagaggagtacaacggtgacggagcgtggggctcctcaccaggagaccgcgcaggcccccctttgccggttcggccggggacgctaagtgaagttctaagctctcaatctgtggaatgttcgctaaagtggaaacgcgcaagacacgggcgatgtatacaggttcgggccgcttagaagcgtaataccctactcctgtgttctggtggatctgtgtatgaaggagctacaacg

SEQ ID NO: 85236 - DNA, 695 bp, Oryza sativa
tgtaccgcctgcgccatataataatggcatggcatgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaagggaatatgcagctcacatggtgtccgttgcatgatgtcatcaacagggcaggtggtttcgtcctgggtttgcatggcgtccatgcactgtgatcctacctgccccgttgaggcgcagctgctacgattgcctgatgggctgaccattggaggaggtatgtgcagctggggatcatgtgactgatgtgctgccatgcgttcatccaccttccgtgccacctcctcttgcatgttgagctcgtagctcgataccctatactcaagatatgcaatcttcgcctcggtatctctcttgcttctcatccgactcctgtacgtgtggatgtcctccttgaaaccaatcttccaaggaatcacccctttccctcgtgttcgtcctgaatgctcgggagtctgtaggg

SEQ ID NO: 85237 - DNA, 3646 bp, Oryza sativa
tgcatggtttatatatatatatatatatatatatatatatatatatatatatatatatataaaccatgcatatatatgtttcaacacatatatatgtatatatatatatatattatattatattatattatatgtatatacatgcataatatatatgtatttatacatatatatgttatgcaaatgcatatgtatatagatatatatatatatatgaccaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggtagtggcaatactcgcacacgtaatagccgcaaaagttagttccctgcttttgctttgcgcactacaaataaatgacaaacaacgagagatctaattaatatacacttgtatgtatttgaatcggagaaatataaatgtagagcatgtgtattcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaacattgtcaaacgtagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtattgaaaaccctccgccgtcgggccctttgaatctccattctacaacgataaaagggagtatattattttctatagtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcatacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttctagaagatgctttcttcagcgttcgctcatagtccgatagcttgatggcctccttgacagatgcagacatacccctgaagaagttcctgacactggggtctataggaatcttcttttctagacttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggcaggcggtggagctgggggggcccttgactttgaaggtgccggaagaggagcttgcgggggagtaggtgtaggagcacgaggaggagtcggtgcaggatcctgaggaggagtcgatgctggagcttgaggtggagacggtgctggcggagcatgaggaggagacggtgcaggatcctgaggaggagatggcggagccggaggagatggtgcacgagacgccgtttgtcgcctagggaggatgatgtaccgcctgcgccatagaataatggcatggcatgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgccgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgtcacctcctcttgcatgttgagttcgtagctcgatacccggaactctaggtctgcaatcttcgcctcggtatctctcttgctcctcatccgactcctgtacgtgtcgatgtcctccttgaaaccaatcttccaaggaatcacccctttccctcgtgttcgtcctggatgctctggagtctgcagggcgagtgtcagctcgtccctatctctgtctggtcggaacgtgccctgagaggaggcttccactgcatctgttagtcgtcgcgcagcctctcgtatctgatcgccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcaaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctctgaatctgggacaaaactctcatgatctccgcgtgcccttgttcttcggcattacaccgtactgacaggcacgt

SEQ ID NO: 85238 - DNA, 1739 bp, Oryza sativa
tgatgcaaaagttaagattattcggactgataatggaacagaatatatcaataatgaatttttgtcatatgtctcagatgaggggattattcaccagactacttgtcctggcacccctcctcaaaatggtgtaactgagagaaagaatcggcatttgctagaagtggcaagatctctgatgttccagatgaatgtaccaaagtatctatggagtgaggctgtgatgacagcagcatatcttatcaatcgcatgccttccataatacttggtatgaagtctcctgccgaactgttattgggtaagcgagagttcaaggttcctccaaaggtgtttggctgtgtttgttttgtgcgagatcaccgaccttctgttggcaagttagatcctcatgcaagaaagtgtgtgtttgttggctatgcttcgagtcagaaggggtataaatgttgggatcccattgggagaagactgtttgtgagtatggatgtgacatttcgtgagtttgagccctattataaaagtaaaggagatcttgaccaatttcttgaggaattctcgactgtcatggaggttgatagtcgagagggggagagagagagaggtgacatacatgaaaaaaatgttggtgacaagaatggagaggcagtagtgattggatcaataccatgctctattgatgatgcgagtaaagaagtagtggaagtcattgaagatacacaagatgaggatagagaaatggtccctcatgaagaggatggagaagaaggagaagtagttgttgggacaattccatgtcctatggagggagccgaaagggtgaaacaaaaggatgtgctagtttaccaaaggaggcggtttgatagtcagggggagaaaagaaaagggttggtgcaaagtcaaattgaagagttaccacaccaaaaatgtccagtccctgaatcctcccagagtctctctcctccagcctccttggcttctcttgagacaattggtaatacttctccaactcttgaacatgtagaattacctcttgcacaacgtagagagactagatccaatgctggtagacctcctatacgtcttggttttgagcatcttagttctatgcatgacattgcaaactatatcacatattctcatgtttcaccagcatacaaaacatttattgcatcattacagacagtgcctataccaaaggattggaagtgtgcaaagcaggatccaaagtggaaagatgcaatgaaagaagagttgaatgcccttgtgaagaataagacttgggagcttgtaaaacttccaccagaaaaaagggcagtgggatgtaagtgggtctttacagtgaagcaaacccctgaagggaaggtggatatgtataaagcaaggttagtcgcaaaaggctatagtcaaacatatggaattgactatgatgagacatttgcaccggtggcaaaaatgggtacagtgagagctttggtatcttgtgcggtgaactttgggtggccccttcatcagcttgatgtgaaaaatgcatttctccatggtgatttacatgaggaggtctacatggagatccctccaggatttgggaatagccagacagttggaaaagtatgtaaactcaagaaatccttgtatgggttgaagcagtctccacgtgcatggtttgataggttcaggcatgcagtgtgtgatatggggtattctcagtgtaatggagatcacactgtcttttacaaacata

SEQ ID NO: 85239 - DNA, 574 bp, Oryza sativa
gtcccagctcccggccactggattcgagcagctcaccgagctcacacaccttgacctctcggacaccaacatcgccggcaaggtgccggctggcattgggcgcctcgtgagcctggtctacctcgacctctccacgagcttcgtcatcgtgtcttacgatgacgaaaacagcatcacacagtacgctgtagactccattgggcagctctcagcaccaaacatggagaccttgctcacaaacctcactaacctggaggagctccatatgggaatggtggatatgtccaataatggcgaattgtggtgtgaccacatagccaagtacacacctaagcttcaagttcttagtttaccttactgctcactgtcaggtcccgtatgcgcatcatttgctgccatgcgatcgctcaccacgatcgagcttcattacaatttattgtcaggttcagtgccagagttcttggctggcttttccaacctcactgttcttcagctatccacaaacaagtttcaaggatggtttcctcccatcatcttccagcacaagaagttgagaacaattgatctttctaag

SEQ ID NO: 85240 - DNA, 600 bp, Oryza sativa
caacgccattcaccagtggaccagcagctatggagtcagaagagttcgtgtgaggaccaaagctgatgacatccatttcatctgcctgaaggtgacggagatctccgccgtcgtcgtcttcgtcgccgggaaggccatcgtcggcaatgtaaccgtcgccgtcgtcgtcttcttcttcttcttcttcaccggtctcgacgtctccctcaccgcctcgatcaccatcgcccacctgatcagacgtgacgccccgttccatttcggcctcggtggcaacattgctccggccaccgatgctccgacgaacgccatcaccatcagacgcgtcgccggcgaagacaatgaagcccttcctgcccagccggcgccgcgtcacctcaccgtccatggcagcgccgccgccctccacggccactgcacgttgccggttgcgtgtgagctggtacaccagccagacactgacggcgactagcaggacgacctggaggatgtgctttggcctaagaagcttctttgatctgtggcatctgctggatggctgcctcaacatagtgaatcagtctcagtttgtgtgtgtggtggtagacttgttagtgttca

SEQ ID NO: 85241 - DNA, 982 bp, Oryza sativa
ctcaggcacaagcacttgcatctacatatagacatcctatagattggatcatagactcaggagcatcaaagcatgtcacaggattgcataatactttcacatcatacaccccttatatccactctgaaactatccaaatcgctgatggtacatccaagcctattcatggtatagggtcggtagagtgcacatcatcaatgaacttgtcttctgttctgcatgttccttcctttccagttaaccttctctcagttagctcggctattgatcaactcaagtgcattgttgtatttgatgagaattcttgtctgttccaggagaagtggactgggaggaggattgggactggagtcaggcgtgatgggttgtggtacatcaatcatgaggaactgggactagctgcggtggttggagatgttgagaaggagatcagtttgcttcactgtcagttaggacatccatcttttgagattttgagtaagttgtatccagacctctttagtagagtggataagcatagattggtgtgtgatgcttgtgagcttggcaaacatactcgctctacatatgttggcattggtcttcgtaactgtgagctcttcatattaatacattctgatgtttggggaccatgcccagttacttctgtgagtggtttcaagtggtttgtcacctttattgattgtcacactcgtatgacttggatttatatgcttaaacacaaaagtgaggtccttcgttgcttccaagactttcataaattagtgacaactcagtttgatgcaaaagttaagattattcggactgataatggaacagaatatatcaataatgaatttgtgtcatatgtctcagatgaggggattattcaccagactacttgtcctggcacccctcctcaaaatggtgtagctgagagaaagaatcggcatttgctagaagtggcaagatctctgatgttccagatgaatgtaccaaagta

SEQ ID NO: 85242 - DNA, 586 bp, Oryza sativa
aacatgtcctgtctgtgtgatctgataattcaacatcatttttaacctgtcaggaaaggtacaaacggtggagtgacctacaaaggctttcttgttgccacagcaggtggcctaatcataggtctgacttttgtttttgttggactgttgactgtggagtgctcatttgacgtggctcttcgacagcttctagtaatacccatctctgctactgctggtttgcttggcagtctgattgattcagtgttgggtgccacactccagttcagtggatactgcagtgttcgaaaaaaggtaatgttttctgtgacatttaggtttgaatcatacttgaatcaaatgcatgtcagagccatgcttttccatacatcgtgagatcatgatttcattttagaggtacttccacttatagctcaaagatttgatccacaactttgtttctatgattgaggtataaaattacataggacttgtaaatttctgtgtgaaatttgtcttaatatgtcttatgtatccccattaaaaacaatttttcatattctacccttatagctctctatcatttgtgagccgttgtagtgaaatt

SEQ ID NO: 85243 - DNA, 595 bp, Oryza sativa
cgcggctggtatcggcatcggctattatcgctatcggctggaactactctatcggcttgtcagccgatcggctgttttgatatactatttgcatatcttgtcagttgcaagatcaaactgactggcacgctcgcatttcaccaagatttggacctgcactggagttaagcagatctcccaggccggtgtattcgattttttcgtcaacacctacccagattgtttgtcctgtatttgtaattgacacagttggctggattattgaaatatatgagtataatttatctagaaccataatatgttgatacgatatgcagcgatattaaaatgaatcgacatacctatatataactacaaattgattgatccaacaacgagctatatatctgttttagaggcaaccggaccagataaaggaaaagctaacgcatgcgtgggcacttcaaaggcaaaaattatagagtgatagcatataattaagtaattaaacatgctcaatcgccaacaaagtgatcgagctaacgttgcttaggacaacacgaaggctcgctagcaggagatgtcaacaagcgcttacagtggcccgtgtgataag

SEQ ID NO: 85244 - DNA, 806 bp, Oryza sativa
ttttggtgaaaaggatgttgagtgcactgccaccatcgatgagggatctgcgaagcttgacgttgcgaaccactaggtctagtaccagggggtaccgccccgggtagaccactcggtcaggatgatcggagcgtcaaactcattgttgtctccgaccaccaaagaaattggggcgtatcgggctgagcagcgttgatctctcattcggtcagcttttgcttactcttagattcataagccaggggtccgccaaagatgtggttgagttccttgtgatggtcttgaaaaccagtcggggcatcatcgtcatcgtcttcttcttcgacgtgctttgatctccgtcgaggcctacgtggttcttacgtgcgttcttggcgtattgttctgcaaactgtttgtagatgaaacaatcttttgccacatgattggaattgggatgatgcggacattgggagttcatgatcttgtcaaaagtgttgacacgcgaacgttgtcagaaggatggtgttgtagttgtcacaagttcctcgggcttacgcttgcgatccttgtgattggcacttccactcccttctgtagtcggcgtatctttctttggcttctaagtggtgcccgactgcttggacgcgataatggcatcttcggctttggcatactcgttggctttttcaaacatctgtttgaccgtcttgggaggcttgcgcccgaacttgccgactagatcttcgtgacgaattcccttggtgaaggcggcgatgataacgtcgtcggtaatgtcggagatcttgttgcgttgctcagaaaag

SEQ ID NO: 85245 - DNA, 1556 bp, Oryza sativa
taagttgggtgcgtgagtcatgctggccacatgagacgcacatgtaataaaccaactctagcacctccattggtgttcgaaagataattctacacgttcactggtcctcgaaccagtacgtagcaatctctcgcaccgcaacttccattggtgttcgagaaataattctacttgttcgctggtccccaaaccagtacgtagcaatctctcgcaccgcaacctccattggtgttcgagagatgattctacacgttcgctggtcctcaaaccagtacgtagcaatccctcgcaccgcaacctcagatggtcgaggtacgactacagcaataacgcagcggtcctcgcaccacgacttcaaatgatcgagagacacctactcactggttcttaaccattcaatcgtagtgatctctcgtacatttacttctagtcgttgagttacgactactacctggttcttgactagaggtgtagcgattctcccattacctctacttcaacaaagttgatatcaggtacacaatatcgccaagcgttttacccagagatcccttaccacaaaaacacctagcattgaaacctatcctaatgtccttttacaccgtcttgacaaggcctccgaggaacctaagggaacttcggctagggacgcccagagcggataaggccttgtcggatcctgtagagacaaaagaccatgtaagatctggtcgtgtaagagttctcaccgtgcgtattaaccaagccgtgtaatcggaaattgggttttccaacttcacggctgggggctaggataagtgcttattcaaccgatgcaggtcaaaggtctaagagccttatttcccgagaacgattctccgacgacaaggctgggggctagggagagtgtataactcaaacaaattgactgatcgaagttggtaaaagagtagacgctcatatacaaaacattggtatgtaaatttaattcatttttagttttccatacatattataacatgtcaccctttgagcgttcactcgggggctatttctatctaatattcttttctaagtattgatttcaggaaaactctattcgacatcgttgaagactccatgtctctatggttctacaccaagatcgacaaaggcgagtacgacaaatgttgacaaggctccgtcgcagactctacgcctactcgattactcaagaacggttggtggatctcgacaaggaatacggaatgaagagatggtgtacctgtcgagataaaatttcttgacttcaatccaaattctcgattacagcaagacgggtaacttagtcatatgctctgtactttcttggttgactttgatgattgactcagacaaaccctttaggtgcccacacgaggctgataaaggaagtttaacgttatctctgaactcaccgagaacggtcacgtgagctcgataacagttcctctaaggtttgcggttgagaatatgaactcgttcatttgcattgaagtcggggactactgtcagggttatggataccacatacctaatagtagttgactaaatctcgg

SEQ ID NO: 85246 - DNA, 5139 bp, Oryza sativa
  unsure (1)..(5139): unsure at all n locations
tttcatcaacacatatacaacaccaacattaaattaatttaataaaataaatctactattgtatagtattcatgtttcaggttaaaatgttaattattatggttttaatagaaacttgctcaaacatggagaaatttgacttagaaaaaccaaaacatcttcattttaaaatagtggttgtactatatgacaaccattatatctagacaatttacacccactaccaaaaaaattcatttttcctgggagccaaaaccggtcctggcatgcggttggccagcacgcatgcacgaaaatgtctgcaaaaatcactattttcgcatgcgctcacccttaatgcagcacatacaataatcgatctttgcatgcaactgggttaagtggcccgcatgcaaagatcggttttcgcatgcagacaagttatgccggccgcatgctccatgaggcccattcccaaactggccatttgggaagatcgtgtctcgtatgtaatacaacatttcccgcaatttcataatcgaaatttgaaattctacgcataggagctaaccaagttgtcattctaactacaatattgcattgacatgtaaatagtcttagaataaataacacaaaacatttatggacgtgtcatacatatattacaaataaacaacagtttcatcacgaacaaaaatattatattttcactatatatgttcttcctcccactctcctagtgggttgaatatgtcttttattgcgatttgactctccttttcgtagaatagcccaagtgcattgtacgcatcatgatgggtgaaacggcagtgctcagcgcacatgttccatataattgtgtcgtacaaccgatttgctacgtaagggattgacgggatctatggacaaagtggacaatatatgttacaaagttatttttgacagaataccctgtatggagtgcaatatccggacttacttcatcactgttagttgtgtacctcttattgactctaaccatctcgcacatgtgttatttacatacggaagtcttgggggttgcttaaaacactgtgaacataataataagagaccggtcaatactaacaagtcaggattctacgaaaaatggtgttaatatcatttgtcagtactgacaagcctgtcttggcgtgtagattattccttgtcggctcttttactggcccacctgttttgcggtaatacatatgtgtgttgctcgaacaaaacatttgttatagttacttagaaatttcataatagcaattatgcacatatggattattacattacttacaaaatcagaatactgaggaactccatgaacgtttccttgtcgtagtgtgttgggtccaatgctacgaacaaatggtcctttggatatactaggaatagtatatagtgatcgctgcaaacaagaaagatgaattagagacatcaattgttaaaaaggatgtattactgcggaaaaaaaatacttagatttacgagcggctgcttatgtaaaagcataagggactgttatgacatttttgtcggcatgcactaattaacatcgctagtgccaagtatgttcctcaaggcgctaagtattgcattagcggcttgagcattcctgtgctcgttctcgtcgtcctccttcgtgggatcctcgggtttctacaaaacatagcctttttcgactattctccaaatagatgggttaatagacttcaaatgcatcttcatcttatgtttccaagcgacatagcgcgtatcgttgaagtacggagctttgccgctataggtactcacataagaagtagatgtggatggatagtcataaggaaacgtatctcccttatcaccatctttgccatcccccgtttggcccgacatgatctctccaagcagttaaggctaattaggagattaggctctgataccagttgaaagggtcaattaggcctagagggggggtgaataggctaatttaaaactttatgcagaagctaaaactgaattagggtcggaaagtttgatccacagccagactatccgaaaataatagatagtctgatgttggatcagactgtctaatctactaaagagtcacaacaagaagatctagcacacaaacaagagtatagcgcaaacagcgactagatctatagcagcacaattaagcaaagctaaagagaggatgaagagagatcaccaacgatgaagttcatggagttgttcccggagttcaaatccttgaggggattctactctccgttgaggagctcactaagagccgggtctttgctaaccctttcctcaagaggttgcactaagcactcctccttctactaaggggtatctctgtccttgcggagatgagatccggccttcacaaacttctcccggccaaccacacgcagagcggtggctcgggagtgacacctagccgtctaggagtcctcaacctccaagagtaaaagacaccacacaactcttggtcaaaccctagtgctcaagatcgagtgaaacacacactaggccctcaaacaccaaatccacaaccacatggatccaccacacaaagaacgaggagggagaaagagctcaaagatccaaagcaccttagcaccaagctcaacccaaagtgaatgagaatgaatgagttgggtaaccctagaaaagggttaggtgaggggtatttatagattcccccaaaatgtggccgttgagagagaatcttttcatcccacctcggaaagtccaaggtgacatcagatagtccgatgttttgacccccaagcaagccacagatagagaacgaaattctggagaatttcgggcaatccgatcgatcggatagtccgatgtcatatcggatattccgttatttttgaagcaagaatttcatcctcttacagagactcaagttccattgaatttcggagtctctgggtcatcggatactctgatcacatcggataatctgatttcaaaatcactcaagaggaaaaaaacaattcaaaacagagagtgaagttctgagaaatttcagatagtccgatgtatcagacaatccgaccttatatcggatagtccgatattttttcgccaacactcagaccaaagacagagagcaaagttctatgaaatttcggatagtctgagcatcggatagtccgatcaggatcggatagtctcacaagaataaaacaagaacacttcaaacaaaggattttgagcactagtgttctaccaattatatgcatgtggtatccctcttaatagtacggcatcctaatactcaagaacacaagatatacatggattagaagacgattaccacaaaacatgctgcaatgcttttaaactcaagttccactcctttttatccttgcattcatctcaacaaaaagcattagtgaacctctaattgtgttgtcattaacaccaaaacaattgaggggtcctagatgcactttcagcagtgaagcttgaactgtagtcggagagggaggagtcggcgcttgagcaggagatgcgggtgatgacctcactagagttggggaaagtggactagtgttgacgcgaaaaacacacactagcctaggagatctgcttagctctagtgtaggtccaaaggttgatgagatgcgggcgtgccagtcagtttgatcctgcaactgacaagatatgtaaacaatagatcaaagagccgatcggctggcaagccgatggagtgattccgaccgatgtcgatacaagccgatagcaatagggtttttgaactatcggctataattctgatgtagaatccgacacttgaagcaaataacaatataaaggtaatcggctgatgatagtaaaatatagcaataatataatccaatagaaaccaatcggctaataatgatatgatagaataagcactgatctgaaagttaaagcatacatcggctggaggaccgatgtcattaaatccacaagattagataaacagtgaagcttttgttgcaatcggctaaatccaacttgtatgtaatccttgtaagccgatgcaatgtctagannnnnnnncctgtgcagcccgatngctctcgcccnnnnntgnnnnggggttcttcggacaaggtctataaaacacctcactacactcacttacgcacactgccaaccaaaaaaaggggtctctgacgcgtaaataataagagactctattgtactatattgtatactagaataggaagagagtagagtagaagaagttagaagaattccggagttgtcggtaatcttctctcatttctttaattctgtttattactctgatttcaatataatattctccctgagtaatttaaatttatcttgtgagaattatctcttgtttagttcctaaatagcatacaggattattgttcactataatcaactaaaatatagtgattgctttggtgagttgtaaacactaaagtagatattaattgcttagacgtggtgtttaggtaattattatacagtaattgctgtgtatcccacggtatgtttgaggtaggtgtagaggtggtgacagccctcgagatcacttaagtcctccctgtccgggtacgtagtagagcgacatctgggaacagcaggttaccagtgcccgaagtattgcattaggattaaacttaagctttccctagacattgtttctcactagtagatcctctctatccttgcctatcctttccttggtgtcnttaagtgagcagatgaaacatctgatcacacacgttcccttggattcgctaccctttcaaatactccgtaggggaagtgcacatcggtatatccatgcgcttcggatttctatctgtgctgtaaaataccacagtcacgcccaaagggggtttttttggatccctgcaactgacaaggtatgtaaacagcagataaaacagccgatcggctaacaagccgatggagtaattccagccgatagccgacattagccgatgccgattctagccgatgtcgatagggttttgagcaatcggctatatgtccaacatagataatgatacaaagacaatcgactgatgataataagatataataataatataatccaatagaaaccagtcggctaataataatatgataggataagta

SEQ ID NO: 85247 - DNA, 577 bp, Oryza sativa
gacaacgagacgggggaacagcgcaaagcccgagaagcagaagagctacgcgtacaacaggaagccgaacgacgccgactggaagaggagcgccaagcacaagagcgagaacggcggcagcgtgagcaacaggaacgcgaacgggctgcaaaggaggctgaggaccgacgacaacgggccttggacgccgggcgacgagcacgagaacttatcgtgcagcaagacgtcgagggaactgcggtctttcgcacccctcaatagaacgcggttgcagcgatcaccctcctcgacaccctcctcaaggaagacgcactcaaccaagctaatcacgtcgtcaacatcttgaccctgaccaagaccatgatcgttgcctcggtcccggttaactccgcaagcgtccgcacgccgactggcagccgagttccccatcttcgatctcaagactatcaccagccgagccttcagcatcgccggcgcaggatccaatcgcaggagcaggggtcacgacgggcgatctgtccactcgccttccgaacgacacagggagcaccgagttggacgggcacgcttcccacct

SEQ ID NO: 85248 - DNA, 1224 bp, Oryza sativa
catttttcagttgaggtagatgtgagaggcgacgtcttggatgagctagttgaagccctaaagcagcctggtttgagcacctgcaaacaaaaccacacctccagctgtcaatcaatcagcttccaaatttgccaaaattactataagaaaatcttgcaatggtcaagcacgtttaatacacgtctaataaaaccattttctatatacagacttagaacatattgtttttctcaattttatcaaaattatctaattgaatgttgtgatttgtcagatacacattaaaacaaaaccctgctgaaattatctgaacttcgcataccacctgctgaatcactgtaaaacaaaaacatttttttctctgaaccttgatgttcatcgccaaagttgggttaggcagtatccaacacatgggcctaaattgtccctttaggcaatatacatacatatgaggtagtgtaagagatacattacagaagaaatttggagagcagcaacatttacagtgctctcctgtctaaacaaatcgttccttgcttcaattatctttggacatgtggtctatatatactctgtacatttcaataatcttgagacatgttgtctatactcagtccattacaatgctctccagtccaaacaggtgaaatggattgaagccataactcctactacgagtatatgaaataagagtattaacaatgtatatatttcttaccaacaatattgtagatatgcagtgatccttgtggcagtgcaattcaaatatggtatctaaaatatgggtaattatcataacaggataaacaagctacaaaggatttatgccacatgtaaatttacttaattaacttgcaatgtcaactggctgaaataataatttttcgagatgattacagcactttaaaagcaatagcttcaaaggctaacaacaaaaacactatagctgataaaaaaggtacggtaaattatatttcttgccttcaatagtagaaaagaaatagaactgcattgacaaatgaaagatgtccagaaatctcaaaacttttttacatatctagctatcaaagtcacatatatgcccattccagtcaaatatatgattaaattaagaaatgcacaaattggaatacccagaaactgcatcacattagtttgagctaccatgtaataataatctactgccacatgggaatatgatattggggtaccgagctcgaattc

SEQ ID NO: 85249 - DNA, 587 bp, Oryza sativa
cttggatgcatattcatttcctgtgttcttatccttttctgtattgattggtgggctactcagagtgcgttgagcatcactgaacccagctgatgggctggctgctatgggctggccaatggaagtatcctgagatgcaaccggcgatagagccatgcaaggcatcagagaagatgtctgggatccagatggagattgcaagagagcaagggaatgactctgagcacccttaacaactctgttcacttgaaaagcaacaatgccgctagagaccgtgttctctgtgaaactcacattccacacaaattctttctcaagcagatcagtgatctctctggatatgcagcccttgccagttggattttccagcatcagtgcctcaactgaacgaccaatcagcctctgcgctaaatgcccaaagataataaatgtagtatctcctgtgtcatctcctgctatcacactgagtttgaacctacagaatgtaatgtagcattagctgtaatgtatcggtgtctgtattgcttcaattgctttatcacgactcacctaggtgaagctgagccagttggggggcatgtgctgtt

SEQ ID NO: 85250 - DNA, 672 bp, Oryza sativa
  unsure (1)..(672): unsure at all n locations
cgtgctgcagaatacgtgcctgccatcataaagcgttataccttgatggggcgtccattcctgtccaaacttgaaacctcaacatccaggtgtcgctcgacaagtgccctgtatccatctacactgccatccccagaagaaaaacaaatttgggaaaagggaaaaacccccaaaaaaaggccccaaccaaaaattggttaaaattcccaaggtacaaantgcataatgagaaactagtaataacatcacaaagaagcattctagcgagtacctcaaacacccctcgaagaacaatgcagttcttttactcgtcgtcttaagcttaggattgatgataacctggtatccaagggacacaaggaaaataaaacggcatgagaaggcggcaatattgcctaatgataattgttggtgaaggcaactacataggacaaatgtactactactcacaagaagatcgaaaggacggcgatcctgcgcttcaatgtccttcttgggagcatagctgatgtattcttgggtatcctccaggacgataatctatgaaattttaacaggtcgagcaattcagccatgtgtcaatcaggaacaaacataagcaggtaattaaacagttgaacagtagacgacttagtggagtaatttggagcaattaatgcaatggaataatgc

SEQ ID NO: 85251 - DNA, 538 bp, Oryza sativa
ttaacaacatatgtcccccacggtttctatctccatatttggtccttagcctcctctaggcacaggtgaactcgtgatatcacattacaccttaaaatacctatcgcaaagcgatgaactaactataaataactgcattaacttacaggaggcatcttcgttccatcatgggcagcatatctggagtcccattcattggctgagccgtcataacctatatacacgaacgcacaaacattaaaatcagcacttaattagactacctgattatccagcaaagtactaagtgtttgtaccagtaggatagtaatatgctgagggtccatattcattggtctgatacaagatgttggcattcactggctcctggagcaggggagtgatcgacctgtccaccggcgacgccgcattctgcgcattgccggcgcttgcagatccatagggcatcccggcaggctgcaattcacaaaaaggaccataatttttagctacctctcctccaaacaaaccaaaaggatggcacaagcaacacatcaca

SEQ ID NO: 85252 - DNA, 1048 bp, Oryza sativa
cgacacatggaacacatcatgcacgttgcccaaggagccgggcaactcaagctggtaagcaacttctccacgtcgagcgatgatacggaagggacccacataccgaggtgcgagcttccctttcgtctgaaacctgtgcacacctcgcaatggcgtgacccgaagatacacaaagtcatccactgcgaattccagatcacggcgacggttatctgcataacttttctgccgggactgtgccacctttagattatcccgaatgattctgactttagcttcagcttctctcaggatatcagtcccgaacacttggctttctccaacttggtcccacaatagcggtgtccggcatttgcgcccgtacaacgcttcatagggtgccatttgtatgctggcttgatagctgttattgtaggagaactcggcataggggagactcttatcccaggtcttcccgaagtccaggacacatgcgcgaagcatatcctctaggatttgatttagacgctcggtctgtccatctgtctgcgggtgataggcggtgctgaaattcaatcgagtacccagctcttctggaagcttcttccaaaagtgagaggtgaattggcttcccctatcagatacgattttcttgggaataccatggagactcacgatcctagcgaagtagagctccgctagtttgttccctccataggtggtcttcacaggaatgaatcgagctaccttggttaatcgatccactattacccatatagagtcatatccaccttgggtttttgggaggccggtgatgaaatccatcccaatttcatcccatttccattccggcacttggagaggttggagaagtccggccggtcgttggtgttctgccttgacacgctggcacacatcacatagagccacaaactctgcaatttcccgcttcatgctaacccaccagtatttctccttcaagtctaagtacatcttggtactgcccgggtgaatggaataaggactttcgtgagcttcctgaagtatcagctgtttaagttctctgcta

SEQ ID NO: 85253 - DNA, 641 bp, Oryza sativa
tgggaagtgcttaggccgactcccagtgcttggtgctgagagatcccctcataatttccccaaagcgtaaccatgtgtgaataaatgttgagctagtagggttgcagccacgagtaagtcttcccttgttattgtgtagccagaatgccgcaaaacttccatgcctaagcgaactgttgagagtagcgtttcgatttctgactgtgttagcctggaagtgcttgtcccaacgcttgtttctgagtcagtgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagtgagttgctagaacccatggctcctttgccgacgctgagtagacggcaggtgacgggtggtgacaatgagtccgtgtcgagcgctgattttttcggcctttagagcgagattcatacaatagaatttggcatgagattggattgcttttagtcagcctcttatagcctaaaggctttgagtgactagat

SEQ ID NO: 85254 - DNA, 811 bp, Oryza sativa
gttatgtaagattcagctgtggcagttccagcatatagccactgggatccttcagggcattcttctgcccagtactcaggaggcaaaatgtccaatgcatttgaaccaagtagggggaaatttggtttcccattggatgtaaataattattcatacagctcagggacctcaagtgtggaaactttattagatgcatcatgcgcaaatcatgatggtgttgccaaggtaattccagtaaaggaagcggaggtctcatgcatgcctgggtttctcaataatgactgctctgatggcgatgaatattttgataccccccttgttatggaggaagatgccctcgaagaaggtaaactcttaggattattttcctgattttagttgcgatatgattttaagcatgctgcactaagcaatgatgaccccatttcataggtcaggtaattagatttacaagaacaataattttggtcatgaagctctttgaacacttctctgtgcattttaattgagtagactatgggttttcagatgactcattgctaagtttcttgtacagcagagttcttatagatttctgacatacatatatcaatctataaaggttgtcaatttaatctgatagcagattattaattctttcattctcatccaaatgagtgtgtgcaattgatgtctctcactctttgaactatcatagggagcaattgtttaattcttgtcagctgtatctttttcagatcatctgcataaatatgaatcatgtgcatcagtcaagggccagatctcaaaacccaggaagcaaactgctgaa

SEQ ID NO: 85255 - DNA, 2705 bp, Oryza sativa
ctgctcatcggagactcgggcgtcgggaagtcttgcctgcttctgaggtttgcggtgaggatcgcttccttaccctgtattgagatttctttttttttctttttagattataatttaaggttttgtttatttgaatgcatctcgtatggcaagtccccgggcaaagtggccagaagcctgtgaactttcaagacaccaatttagttcattggaaagataagaggatacttaaaatttgactagagagtatcacctaattggttttattcaaggcatatgtatgatgcatgtttgcgaataatgacttggcatcggcaacggtgacaaagtagacattgattgctttattgcttggggtatgttcattgatccaagataaaaacaatgccgtgggagatttgtaatggacttgaatttgcatgacaagttcctccgtagggtgccctgataatgttatttgctgtttggccaatgataaaatcttacgtagaatcatagaaataatcataagagtttatctgaattttgttctgctttgggtagtttccgtgaacaatttggaaaaaagattgaggtgttttggtcattttgtcaaggtctgtggcatctcaagttactatactttcgggacaagcttgtcgatactgatttagttagtagtagtgactcgcctaaaacgagttaagatctggagagtttctgttttcaatgtcctcattttccaacattacatctgacagaaatgcaaccagtaatgatgatcaagtgggagagcgtttacttctagaatcatgtgctatggcagctgtattcatagtctgcatcatatttttgtttggtagctcctcctggccttgattaaaggatctatcttctcatttcttttgcaggacgattcatatctggagagctatatcagtaccatcggtgttgattttgtaagttcaatttttccatgtgcataagtttgcacaaatgagccttttttttttctccttaatagccttttcactccatgtttgacctgctagaaaatccgcactgttgagcaagatgggaagacaataaagctgcaaattgtaagtaaaccattctagtgaaggctgtaacatttttccagactgctaagaaacttcagctctgatatgtcaacttgttctccttcagtgggatactgctggccaagagcgatttaggaccattacaagcagctactaccgtggtgcccacgggatcattgtgagcactcttcacatatgtcactatccatctcccatggattaatattaccccgtgcttgctaattatgtaatgtatgttatgtaggttgtttatgatgtgactgatcaggagagcttcaacaatgtcaagcagtggctgaatgaaattgataggtatgctagtgaaaatgtgaacaagctcttggtggggaacaagtgtgatctagctgagaacagagtggtttcttatgaggctggcaaggtatttttttgctttgtgtttccattaccctcgcataaatatcttttgacttccttgtggattataccttgttcaactggcatacatatgttttaatcattgacaggcccttgctgatgagattggaataccattcctggagaccagtgcgaaggatgcaacaaatgtggagaaggcattcatgaccatggcaggagagataaagaacaggtgacattccctctagatatttgaaggcttattctaggaaattgctattttgtgcttaatcatcatgacctcctgatatatagttacataaggaaagaattcatagaaatgaacatactattgctggaccatcattattggtattagcattcacttgcattacctgacaccttgttctttgtttgaataggatggcaagccaaccggctacaaatgcaagcaagcctgcaaccgtgcaaatgcgaggccaacctgttgcccagcaaagcagctgctgctcttgattatcaatctagatcacaatagtgtgcttgtttgtgcaccaagcaacacttaattggttgctctatccctgtaaattaagtctattagtactatcaaaaagcttgatgtgttctgtgtcggatattattggaaaaagtctgtcccctaactgtaacgaagcggcagatgctgtgggcctgttttaactgcctgttcatatttctatgtttcaagtggcatcgatgttcgactttattcgattaatggttccacttgcaaactgtgctacgaaatgctgacggagtgcaatcttgtcataccaggcgcgcactgcctccgtagtaagatattttactgtagaaatttatgtggaattatccgatgttttacgtcctttagaaatttgcgtgcaattgggacgacgttttgcattgaatttgttgatactaacaccaaactcaaattatgacgtttctacgggatcaaaatgtgattagcctaacatgctagttctactcgagttctggccgcaggatgtacaagcagaaccacatttttgtttgcaagagcaagacggtacatcgacacaatgcatactcctggatgctcaaaactttcacagcttgtttccagcaacaaacctgaagcatgaactacccttcacagcatatatgagcaaaaagaacactcaggccgcgttaccacgatcggatgcaatcagtatattcaaggtgcttattttcctccca

SEQ ID NO: 85256 - DNA, 1039 bp, Oryza sativa
ccaaggacatcaattataaggtccactttgcgatccgcccatttgcttcgcgattatgacgtatatccccgagtggaaacgatgtgaccaccgtgaccgagtgaccttgaaagtagtgagatagtttcttgatagtaattaaaacaccatataatagcttttgaacctgaggatatcttgtcttggaattagccaaaacctcgctaacgaagtaaattagtcgttggactttttggacatggccttcttcttcacgctcaacaaccaggactgtgcttacaacctgggaagtcgccgacacatataacaacagcggctctcggatgtggtgaagctaggactggtggagtagtgagaagttgtttgaagtcttcaaaggctttttgtgcttcgggtccccactggaaattgtctgttttcttcaacagcttgaaaaagggcatcccccgctcgccgagtcgcgaaacaaaccagttgagcgccgccatgcaaccagtcagcttttgaacatctttctgggaacttggcggcttcatgttgaggatggcattgattttccccgggttggcttgtatgcctctatgagacaccataaatccaagcagcttccttgatggtactctgaagatgcacttttcagggtttagtttcatcctaaaagcgcggatgctcgcaaaggtttcttctagatacgtgatcaaatcatccttctgtttggtcttgacgactacatcatccacataagcttcaacattgcggctcatctgagttgaaaaacatctctggatcatgcattgataagttgctcctgcgttctttaatccaaagggcatggtgatgtagcagtaggccccgaagggcgtgatgaatgaagtctttaagcagtcggattctttcagtcggatctgatgatatcctgagtagcaatccaaaaaactgagtagctcgcagtcggccgttgagtcaactacctggtcaatgcgaggtaacccaaagggatctttggggcaagatttgttgaggtcggtgtaatcaacac

SEQ ID NO: 85257 - DNA, 552 bp, Oryza sativa
tcgtcggcgcctcggactcgggaggatcagcatgaagagccgaatgcccgcctcgacattgagcgcggacgtagtgatcggcgtactccccgcgcaacggagggtgcctcttcgtccagggtgtcacctcgacatggacgtgaggatcagccctccgtgcccccggttggtggtgttggctgtagagcctttgtggcgagtcttcggaatgtccgttggcccccaaggttccggcccaccatcaccgagaagtatgatgggagcgtcaaccccaccgagtttctccaggtctatacgaccgggatcgaggccgctgggggagacgacagggtcatggcgaatttctttcccatggccctgaagggacaggcgcggggttggctaatgaacctgccacccgcgtcggtccactcctgggaggatctgtgccagcagttcaccatgaactttcaaggcacctatccacgcccaggtgaagaagcggacttgcacgcagtacagcgaggggatgatgaatcccttcgctcgtacattcagcgtttctgccaagtc

SEQ ID NO: 85258 - DNA, 1527 bp, Oryza sativa
  unsure (1)..(1527): unsure at all n locations
aaggaaaatattatcactgcataaatctgaatttgtgatgtgtatgaaagcatgatatccagtaatatcaatagaatactctacatgcaataccattgcttataatgatgtccaaagtatcaagtgatggtgcatagaagtataggactataggggcttgtagcagcagaaatattagaatggcctcatcctgaaactaaagtatgcagtatttttagtccataacggtctccacatgtctttagtagtaacaatgacaaagatatacagggactgtcacacagtcagtcacatatgtgggctgggccaagcggtgggaggagaaaaacaaaatttgcatcaacaagaagcacgtgaggtaactaacaatgtctattggtaaaaattgtacaaatctacgaaacaaaacgtctagaacaatccatgcatacaaacttttataaaaatatttctaaaagtaatgaccttctcaatctcagatgattcacattgctagcgttcacctttagaatgaatatcctactctgctcttttcagcttggaatttcctcctggaatcaaataataataccaggttgaattttatattgacaatgtactattatttgcatatttcagaaaaaagctagtgagcaaggcatcatacactgttaactgttcaatgtgcaagatgtctaaaatgacaggggaagtatgcagtacgacaataatcaaatctctataacttcgccactttctttactatagtccctcttggtggtgtttggatccagggacttaactttagtctctgtatttagacactaatttagagtattaaatatagactacttacaaaactaattacataaatgaaagctaatttgcgagataaattttttaagcataattaatccataattagagaatgtttactgtagcatcacatagactaatcatggattgattaggctcaatagattcgtctcgcgaattagttcaagattatggatgagttttattaatagtctacatttaatatttataattagtatccaaacatccgatgtgatagggacttaaaagttttagtcccatctaaacagggtcttagacttttttctcgagaatacacaaaagtttttcatgcctttgtatctagaattgggaggtagctcctcctagatttaaaaaatcatccaatattatataagttaagttgtctaaagaagattatatttcacatgttattaagtacccacggatgatttgcttctttttttcccccaaagggncaaattaagggtactggtgccgtcttctccttcatctatctctcagttgtatcattttccacgtacaaaacatgctttgagtcagtgctaccactgataaggaaattgatattggcattcatactaatactaactaaagaggaggaagggcaacaaaggatgggcttgcaaataaatttaaggtacttgaattgcacctcagtggaggcggtggagagcctagcctaggatatgagcattttgtttgttacct

SEQ ID NO: 85259 - DNA, 677 bp, Oryza sativa
tccatcccatgatgaagacaggcggccacatactcctgcagtcgttcccatgcttccggaatagactcgtcccttgtatgctggaaactggaaatccttccacaagagcattggttttgcccatcgggaagaatttcgagaggaatgccgtaaagcatttgtcccaggtgttgacagcagcacggttggcatagaaccactgcttcgctctctcgagaagggagaacggaaacagccgcagcctgacggcatcgggactgacgcccttgataatgtacgtgctacaaatctctaggaactgttgcatatgagcattggcatcctcattaggcttggcacagaacgggctagcctacgccatcgtgatgaggctggacttcaaatcgaaatccacatctcctatgttgacttgcggcccgatggccacattatcagcagagggagtactgaactcgtgaagagtcttgcaggctattgtcttgaaggtcagtggcgctggtacggctggtttctttgtcagtagagttttctgcggagcaacgactcgcggcctaacgctccggaagaaagcttttggattttctttaaagttttccggcaagttgaaaccagtcatgcactactctgttttcacaacaaaaagtgaaaacaaccaaggttagcctgcaaaggaaatg

SEQ ID NO: 85260 - DNA, 600 bp, Oryza sativa
ccatccacatcgtcgtcgtgatccggtgaatggtgggggacgtagcctcgtgccgcgtggcactggttgattgtatcgcgaagatcgacggggcgcctgcgaggtggggagcgtgcccgttcaactcggtgctccctgtgtcgttcgggaggcgagtggacagatcgcccgtcgtgacccctgctcctgcgattggatcctgcgccggcgatgctgaaggctcggctggtgatagtcttgagatcgaagatggggaactcggctgccagtcggcgtgcggacgcttgcggagttaaccgggaccgaggcaacgatcatggtcttggtcagggtcaagatgttgacgacgtgattagcttggttgagtgcgtcttccttgaggagggtgtcgaggagggtgatcgctgcaaccgcgttctattgaggggtgcgaaagaccgcagttccctcgacgtcttgctgcacgataagttctcgtgctcgtcgcccggcgtccaaggcccgttgtcgtcggtcctcagcctcctttgcagcccgttcgcgttcctgttgctcacgctgccgccgttctcgctcttgtgcttggcgctcctcttccag

SEQ ID NO: 85261 - DNA, 632 bp, Oryza sativa
aagattctcgcccacccattcaagtcaagtggtgggatgacgacatgcaacctcagggaatcatgataaacaagcaaaaggaagccgaggaagtatgtctgttgaaaaaggcactcgggcaagctactcgtatcgtaaacgtaagtctccttatacgcagcttcaaccatcctgtttgccgctttgcacaaatgccgacaaactcgccttgcagagaatccatctcaggaacgaggcgaagactgcgactcttgaaaggctagttccccatcttggaaccattgaggccaccagaaaccagctgcacgaagctaaagagcttgctaggaaaactgagcatgatctaagggatcggattgccgagctgcaagactccaactttgaactgagcggttcatgaaaaggtaaatacaacctctatccaacctacttatgctaccatccttgtaatatcaattaacaagaagaatacagtgcaagctgccaagatatttgaattggaaaagcggatccaagctctggagaatgacaaggccgaattggcgagacaaagggactcggctcggaaagacgttgaaggtactggtgactaatactccaaaaaccattcctttctttatgcccactcgttg

SEQ ID NO: 85262 - DNA, 595 bp, Oryza sativa
acatgcgggcatacttaagcattccaagagtccgacaaattagctactctgtcacaccagatgctggaaatcatgacaaatatatggtagtccacatagagagatacggcagtaccagaagctatacatacgtattgattttttttaagtcatcttctatcattttcttcaaaattaaagatcaatgttctatattaaatgatcacatgtctttgtattagctagaacaagattatgctagcttacccatcatgcggcctgaacactcatggaaccggttggtacatccagcaaggctccattgctgtttgcatggcctatcatgcgaaggattattgtgaatacgacttacaatcaagtgcaaaaacatgctatttttttacaaaggcaaacatacctgcaggttgtcttgcaacgaaaaaacatgcgccgatgacaatgtagcacaggaggaggagaatccccttcaggtaatgtgatgttccatcctgtaaatcaagcccattaattagttgacacattgaattgcaacatgtcacttaagatgttatcctgttatctgagtaattttcggtgactaaattccatttccacc

SEQ ID NO: 85263 - DNA, 637 bp, Oryza sativa
aggtcgactctagaggatcccctaaagagtgaatctcattgaaggaacaaaatgaacatttcaatttttttcagcagtctcggtaatcaaagttatgaatataccattgctctatagcacctctctctggcaaaatattagcattttgtctcaagacctccttatgacactatattaaacactatgggcacacaatacctatcatgtaaaagttttttatttttgctaaactcaagtttcacaaggtcaattacatcactttactgtggcattagtgagtattcactccattttgttccatacttttgataggtatcatcttcacagactactgagaatgcaggccagttcaagatctgccgatgtggggaaggagacccaaatacaaacacatctgaaagagatcgagaatttccgattcccatgtttcttttcaaccaaaccaacaatgtcatcttcccaactgcacaaaatatttattccttcaggaaaattgaggttggattaaaaattcacgctcagcataaaacaaataaatgatagtaaaaaagcaccgagtccacagtttcctcagactataattaaccattaccatcattcaccggagtcaaccaagagagaccctagatctcactcg

SEQ ID NO: 85264 - DNA, 532 bp, Oryza sativa
tttgaccccgcgcccgtgagcccattccttctcctcgaagctcccttgccccagcactgcttcgaggtcggttcccgaacctacatagccaccccttaaaagccgcccctccccctctcgctcgatccccctgtttctctccaagccgccgcgccgttgccgccctgccctgttcgctgtcgccgttcgttgtcgcgcgtgtcggaggagccggcacgagcgaggacgcgtgacgtggactccgggcgcaccctctccttcctcttccccggcccgaggccggagcgatcacgccccgtgccgtcggccatcgtcactgcgccccttcaccccgtcacggtagtgccttcctctgttcttcctcctcgctccatctcctcctcttagactcgggtagtagcacgagtagaccccccgtagtcagctggcgccgccccaagccttgccgccgcccgctgtgtgctcgccgacgtcgccgcccgagctcggtagtgtctctcgtcgccggcgtccctcggtgcgtttcctccta

SEQ ID NO: 85265 - DNA, 1101 bp, Oryza sativa
ttttgctgagttcgctattagcttggataaaaagaacaatgtaccacctgagaagtcattaaagctcccatacaagattgatggtgacaaggtagggagccacacaatcttcttaagttttaataaagtggagaactggacgaaagcactaaaatacacgttgtgcaacttgaagtgggtcctctactgatttatcggcaatacgagtttcgcaccaccccctggatctttgtgtgcagcgcaatcatctaagagaaatttagggtttcgagtttagctcaagattttggtgaggagtgttgctggtgcactttgtaaacactagttgatgcaataaaatcaaaaagtttcaatctacatcttcaagtttgtcatctaccggtgtttatgggtccagacggtctaaccgcaggtctacgcacggtttgaccggtgggatagcggcggtaggtgttcgggtggtctaaccggcgaggctttggtggtctgaccgacggcaggaaggcggttcgaccggcggcgacaggacttcatcatctactccgtttgagggtagtttttatttccactaaaagtttctattttgggtttttggttaattctaccattcaccccctgatcttatgcgatcctacaagtaatataattgtatatacatgtgtttataattttcattttctatatgcaatcttaccgttcttccattttggaaacatttttttgaccgtgaggctcacttcactatataggtgagctgtaattttagccgtgaaggtccacttaaatacttgtggatgtgttctgatggtcggtcgtctgcaaagattcattattgtagacgaccaacttaaatagatagcctatcataaatcataattgatatatttttgctgacgaccggtttaagactccacgtacaaacaccaccatcaccggcttcttttagttgaaatcatggtttagtcgaaaacagtatcaatttacctctgaccaacatgtcaaattgctatatagatgtgctgcttgtttactcccatgtgttatgctttcatcatagtattatactacttccattaacgggtattagcaagacttaattac

SEQ ID NO: 85266 - DNA, 1701 bp, Oryza sativa
ttatcctaaaatataagtattccgagatgattttgtgcgaattaagaaattaagtgaaattagatgacttaaagttgtgattagttaagaagagaggcagataaattaaatataatatgattgtgattggttgagataaaaagttaggtaaagaaaaatagctatattttaggacgaatttaaacactatagatagatatgtacattttaggacaacaagagaatttactgaatacttttttttggctatatatggttatgccgagaaaatggataggtatggctcgaagcctgtttctgtgtccacaatatgtccagaaaaattatagtatagcctcataaaaaggatcaagcaattgtagctttgtgaaaattctagtaagcattagtgttcagtagcattctgcttttctctctctctctttttctctctctcttttttttacctagaagcattctgcttttctcttaaaggcatgtcttttttttttttaagaattacacagtacaacacacgcacactcactcctatgaacacacgcaaaccctacctctattttttttaagaattacacagtacaacacacgcacactcactcctataaacacacgcaaatcctacctctatgagcatcttcacactcacccctataaacgcacacacgcaaaccttacccttataagcatctttgaagactaggccagccaattcattctggagattgatgaagttaccacagacactgctttatttttagaattacatagtacaacgcacgcacactcaccccgatgaatgcagacaagccctaagtacaacacacgcacactcactcctatgaacacacgcaaaccctacctctatgagcatcttcacactcacccctataaacgcacacacgcaaaccttacccttataagcatatttgaagactgagccagccaattcatcctagagattgatgaagtcaccacagacactgctttatttcgcacgcacactcacccctatgaacgcacacaagccctacccctttgagcatcttcgaagactgggccgcctcgctgtcgaggggtatgtcgcctaccaccgaaagcacaaagccgttaaatactggaaaattcgctcccatggagagttgaacctaggacctaaggtgctactgaggatcttgtaaccactaggctacatgccctttcgcttgaggcaggtttttttctctatctctactattataaaaattgaaaatatttttgctaagattttggtacacaatccgagtccatttgcaatacgctttttgcggtttgtccgcttccatgtgatcctctgcagtccatcatccttacgagcccgtcatatgctttaggccgagtttagatccaaagtttttcttcaaacttttaacttttctatcacattaaaactttcctacatacacaaacttctaacttttctatcacatcgttttaattttaactaaacttctaattttagtgtgaattaaacacacccttactcgatgttgtttgcctggctatatgttcccgaatcgttttcttatggggcatttgcaaatttgccaccggttttttgaatattgcaaggataccactcgaatgacagttctagtggcatttttgcaattttctagtggcagttttgcaataatgattcaaagtagtggtaaatttgcaatt

SEQ ID NO: 85267 - DNA, 1912 bp, Oryza sativa
cagtttccaccaccaccgccgtcttcctcaagccgtcaaacacacgattagggcatcaacagggagagcaaaagaggaggtagctcaggcagaggtagaaagtagaatagggaggagagatgcggatctacgtgaagacgctcaaagggagaataatctccctcgaggttgcgaggagcgacaccatcgccagtgtcaagcacaagatctacgccgagcgaggtaagacctctcttagtgcaagctatgaggcccgtacttctagtcaaaaagttagcccaaagacacctagcctacagggcaagcaccgatatatgtgtggattaattggatagagacacaggtaaggaaatgaagcccacagtgggcgtgacctagcccaccaaatccacaacttaattccccaactacccctctctctgtgttcggccgtctctttttcttctcccggtgcgcaccgcatcccctcccgcatctcgcttgcatcgccaccgcttgactcccctcctccctccaccgacggccggcgccggatctccttcctccgccgccagcgccggctctgcttctcatctcctccctccggcgccgcagctgtggttgccggctcgcgcggcgaccggcagctgtggatggcaggaatccatccgagagatcagcgtttcgtcttcaacgcgaggcagttggacgacaaccaaagcttggccgattgcaacattacccataattccacgatacacttcgtattcggcattccctgcttttacgctaccccggtgcggattttatgattttcatatacctagaactttcgatctgattccgatttagaatcgtgattttaacaaccttgctacagactaaagaaagtttataaacgtgctgacattacatgcttatatatagttagataaaaatgtgttccctaaatattactccctccgtttcaggttacaagacgttttgactttggttaaaatcaaactagttcaagtttaactaaatttatagataaatatagtaatattataataccaaattagttttattaaatcaataattgaatgtattttcgtaataaatttatcctaggttgaaaatttgttatttttttctattttgggagtacaaggtatttttttcatattacagttgggctcagaaagacttatttttccccgttgagatcgtattgaagtgaatgtgactgctccctttattgtcaaccgtatgaagacttttggctcgtggtgacctttactctactctcttccaggcatacgaacagttcaaccgccttccccggtcagagagctcggattcgagttcgacgagcaaaggagacaggtcggattcgagttcgacgagcaaaagagacatcgccccggcaaatgtcaaaacagtgcactgcccagattgccaggtccaagctaacgtgtactactgcaacaccaaggaggataacgaaggctgtgtgttctacaggtgcccttatttctcggtgagtgactttcctattgttttgctcatgcttatgtttataattaaaccaaatttaaaattaaattagagttgattatatggttgttcaccacaaattattctacagtatttgattttggatcgccaaggacaaaagttttactcgtaaattatttttaaattgctaataaaatgattcacatgtatataataagcataagctaaacagattttggatcgctaaggaaaaaaagttttactcgtaaattatttttaaattgctaataaaatgattcacatgtatataataagcataagcgaaacaataaagtcattcccccgatctatttctgctagtttggaactttggattcctcccgttcttcatcttgacatttttttttccttgtagatacacacaggctggtgg

SEQ ID NO: 85268 - DNA, 529 bp, Oryza sativa
actatcatttgaccgaacatcaagacatgcaatgacctggaaattttaaggcaataagaagggcgagaatggaagttgcattgacgctaaaacatttggcgatacaaagcttactctctttgcaaggttcgatgctttcctacgagatgggacctgtgttataaatgcaagtatgaacttttacatcgaagaagttaatgaaaaggaactagcaacaataagcatacatatagcagctacctttgatcctgaagtgtttggactgagaaaatttttcaaaattgaaagcccagtagctgcagtaaaacaataatgggtatgcttagaaaaatctgaagtatctatatattctgcattattaagtattaacagaccttggtgatcaagaccagtcaagttatcagaactcaagaatctacatgtttcaatcctgtcttaaaatacattgtacatacttggctatggcatatcataacacattcaatatcaaactgcattttacctccgctcttttctgggtgaaactgaa

SEQ ID NO: 85269 - DNA, 556 bp, Oryza sativa
acccctgcagtaggagagacacaggcaaaacagagtgatcagtcagctgcaaatcagcaagcagagcctgcagaaacagagctttgacatgcacaagtagagtaggcggtgaactcacttgccccaccaaagctcctgcgcggaggcctcatccttgacgatgcgcttgtccctcggcgaccggccggtcttggcgccggacagcgtcgccagcgcgccggtggacgtgatgaacgaccccttctcgtacttgatcgcctgctcgtacagctctgctcgcccacatcccaccagaaaacacgtcacttacacatgtcacgagttataatccctgaacaaaaattacagccgttctggcgtcgcgtcgcgtaccagcaggcgagaggttgtagagcacatgggtgaacttgagggagctgtcgctgacggcgatggtcggggtgacgtgcgggtggtggtggtgcaccggctgcgggtgcggcgacggcgcgcccttcgccgcggcctcgcccttcctagccggatctcccctgacgaccttcgggccggtctcacg

SEQ ID NO: 85270 - DNA, 548 bp, Oryza sativa
ctcggtaccctgtaatggaatgattttcattgagcaggcagaaactacagaagaactcaatgaatggagaagtgcactagagaatgctctggcacaggcacctgttgtagcaaatactgttggccaaaatccaattttcagcactgacatagcagagcctgctgaagctccagctgaacagtgtaagttaagataactttcatcagttgcccacgatctaaagtactagattcagctagggggttgggaccctacattctacttgaacaggcaaatcctatcgtttccattgcagcggacaataaatctatcattggcagacctgcagagtttgcccttgtagatgctgatggtagtccaactttcctggagaaggccttaaagttcattgaagattatggtgagtgttttttttttcaaattttaatttcatgctatcctggtgaatatcagtaacagtcaaatagaagtatgatatttatctaaaacacaataactcattgtatgtatatttattaatctgtagtttagtgacgagcagaaacata

SEQ ID NO: 85271 - DNA, 604 bp, Oryza sativa
tgcataatgttttcatttcaagttctttatatgcatatctttagggggagcttcacacttctctcatcattcaaaatttaaattctattatctttttgtgtgctttaaccatgttgtcatcaatcaccaaaaagggggagattgaagatgcacttaaaccccctagtgggttttggtgattaatgacaaggtggttaaagaggactaacatgtttatcaagtttattcataggagtttagtcccaaagcgagttgtgatggctaagaatgcaaggagaccccccaatttgaatgttcctaagtgcaaaaaacaccgaaggtgattagactaggtttttcactttcgaaattgagtttagaaaaaaaaccgtactattaagaggggtttcaagtgtggttctagggtatacaaagtgagtcaaaatatttttggaatcatttttgaaaaatgattttctcctcgggacagagagggctacccggaggttcttgccggaacttcccggtgccggttatttcaaaaagtttcctaagtactgccaggaagttcctgcacttttgcccaggaacctcctgcaagtttccagttaaacttggagtaacg

SEQ ID NO: 85272 - DNA, 1130 bp, Oryza sativa
cgcaagctagagagggcgagtgagaacgagtaaggagaatgaagggagtcacttccgagtcgggtcggcacggtcacgagtggccgacggtgcgggagtgagttctccgttctcagcccgggacagggaaacaaggggggtgctcggagtcccgtgtcacacgtcctcgcacgcaccggcctccccagtgcttgtcgacgcccgacggcggcgagatcgtagcgagcaccaacaatagcgcggcggtgatggaagtgaaacgagaagaggattcgatgggacgggctcgggttttataggtggccgggtaaggagcttcgaggggaagaacccgactcggaagagccggtcaaggagaggagctggcggtcacgcccgtggtccagcggccggcaggcggtcacgggcggtgtcgggcaaaatggaaaaaggagggggaaaagggagctctgttcttgccgaaacggggaatgggagagggagaggagagcgcgtgaggcagagagacgcgctgcctccacgtcttggacgcacgcgcgcacagggtgggggcgagcggcaggccggcatgggcggctgcgcggcgcaggcggccagggctgacgcggcgacgaccgggcggtctgccacgcgcgggcgagagcgtgcgcgacgcgagggcgcggcggaattcagaggcggcggcgggaatcggcgccgggaggggagtgagcagagagagagagcgaagatgggagagagaaagaacgagagagcgagagagctctctctcggttcggctcggcgcgtgcaacgcacgtgcgaggctgagggaggagaaacggctgagagagggaggtgggctaatgtcacgcccagaaattcccggatggaatcccaagcagaatgtgcattaaaatccccgtccaggaccatccggggtacacaatcgacaatgttgacatacagatccacgtcttacatacattataaagtctcacagaaatgcagcggaaaaacaaaagaaactggagctaagccttgacttgaacggcagcgggaacaccactccacaggcatcctcgacggcacggacgaagcctactcctcggagaacaagccatcggacacatactcgagctctgaggttg

SEQ ID NO: 85273 - DNA, 515 bp, Oryza sativa
tcggtgacgaactgcggggccggggcgcgcgcggagtactcgccgtcgtcggatgcggcggcggcggcggcggtggcggcggggcgggaggccggcctgggcggccgggccttggaggggatggagaaggacagcttcttctcctccatggcggctgcgcgatttggggaaagcaaagcgagggggagatcgagagagagaagggacacgaggaaatcgagcgcgtgtgcacgacggcgaagagaagtctcccgtggacttgttgtcttattcggagtcggtggccgcagcccgcatcggatcaagttgggccgggcccattaacctcttgggcgggcttattctttttttggaaaaagtacaccgaaggtccctcaacttgtcatcgagttacaaaatcgtactctaaccgcaaaaccggatatatgacatcccttaactcacaaaatcgttcactttaggtcctttggtggttttgaacccaggtttgtccgacatggcgactgagtcagcgt

SEQ ID NO: 85274 - DNA, 614 bp, Oryza sativa
atgtgaaggacacggttgttttgaaatcggttccattccctttttcagccatttcaacctgcacctacacctgtcccacctctggctggctggatgtcaaaccctccagcagtaacacatcctgctgtgtctggtggagctattggatttggtactcctacaaatcctggtacctgttctaattactgttacaaactattattaagtggtctaaatggaaacagcacacatagtctgttgattcatggcattcttcttttaaatcttgtagctgctatattaaaacatcctagaacaccaacaactgccaatccttctatggattatccatcaggagattctgatcacgtctccaagagaacgagaccagttgggatgtctgaggaggtatttgtcacatctctttgaaatacattttgctatttctagtgtacgctgacactttataataccattgcattttgcctaatcattattgacatatatacttgattgtaactataatgatctaattttgcaggtgaatcttccagtgaatatgttacctgtgacatatccacagagtcatagttacccgcaagatgattttcataaaaatgttgcacggacattga

SEQ ID NO: 85275 - DNA, 540 bp, Oryza sativa
gttagattaagatggaaatttccttactcatttcatttgaaccaatcaccatttaccaaagtatctacagataaaggaaaacactcacaggaagaccaccatcggcatcaatggtagtcagaagacttgtgttgtccatgtcccatatcttaatcaagaattcatctccagcagccaaaaacctgttccgtgtggtatcaaattggacaacacccatcgatcgcttgcgaaatccctggtaagttctcttgacagctccttcactttcattccattccactagatgtgattcgccatccttgctagtcccacaagaaaataacctactcacaagggcaaaaagaatcagtgaaaacaaagacaaaaacccagttacccacatgaatcatgctaacaaagaaataattatgaaccttgaaccatctgcactatatgccattgttgtgcaccaatgtcctggcgcatcatagtcaactctggatcccaaattatcatatagccaagcctttatctttccatccaaagcagttgagaagatga

SEQ ID NO: 85276 - DNA, 595 bp, Oryza sativa
ttaactatatatcaaagtacctttgatttcattcaaaatggaggcttcctgaggaactggttcatcgtggaatcttaagccatgtgaaaaataggagaggcaggggttggataaaaactgaaatggaagaaagtggtaaaaagaccactgaaggcatggagtgcatccaaagatttgggtttggataggagtacgaggaagttggcgatccaacatccaagtgccagaactacataagaatttacataattctttcaccggtatcattcctagtagtattaggaatatgtggaagttagagatccaacattttggttctcctggctatacttgggtttcacctctagtccacccagcttcctgggactaaagattgtagtacttgttgttgagctaagtgcctaagtcaaaagaattaacaattaatgcagaaaacttactcttttggttcaaatataagttctttgaaaacagcatatccagccactgctgcaattccaagtcccgcaactattacaagactgtaggaagccccttcagcaaatgtcactggcttctcaggtatgttgtacgtaggggaatcaaatggatcttc

SEQ ID NO: 85277 - DNA, 677 bp, Oryza sativa
attcatggcataactttcagtcacatcctgtttcaaatttgttctccaaggcgtgagaggagcacaccaatagttcctccaatggcaagctgtgttgaataccagaagtttttgtttgtcatcttcatcagaggatgaatagtgaagaattaaatatgaatatgtctttatattttgaagtcatttttatacacaaagtatccatattagcttttgatttcaaattacggttttaacttgatttctaaaatttcattctttcattcaaacaagctgaatttcctacgcgattgtgcagggctagtttatagtttatggcaagtaatatcgcatgtgttatccagtttgtgcatttatttcaaaatgcagctaatacagcataaaagaatcattaccatttggagattcctcttaagaccaacacctttctggaacaactttgccacttgataaatagcttttggttgcccagcattaactgctcgaagaaagaaattgcatgctgtcatcacatccctctttactccaatacccttgagatacaagacgccaaggttataataacccccatgttccttatgctcagctgcaatttcaaaaaattcctttgcctacaaaatgagttagaaaaacattaagttgcctaaaccattacaaggtgcggaacacaggttttt

SEQ ID NO: 85278 - DNA, 5286 bp, Oryza sativa
cgatccatccaacgacgcgcttcgtccgacgatcgtcgatccctcgcccaacggcgcggcggtgagcgtgacctacggtgcgtcgttgacgttgcagttcgcggttccgccggcgaggagagcgcgcggcggcggcggcggcggcggcatcgggctcgtgtcagtcacgatggtcgcgccgtcgttcacgacgcactcgttcgcgatgaaccagaggctgctactcctcgacgccgtgaagacggcggcgctggcacgggccagcacctaccagacatccgtggtgatgccggcgacggcggccttggcgccgccgggctactacatggtgttcgtggtgaatggccacatcccaagcgaagggatctgggtccacatacagtgacactgacagggggtatagctgcaagggcaagactgtagtacagtacgagtaccattttaatctgttgtcaccatacagttgatagtgtgacactgtgactgttaccgcttgcatgagacagtaagaaaaagaaaaaagataggagaatgtctgtaaaatcgggggctcttgaaaaggttcacgtgaaccgtgcgcacgtgatgtttcctcagacgcatctgctcttggcaactttggccgctgccgccacggcgctgcaaagcttcggttttttcttgccatgcgtgtgcgcgcggtgcgagtaggcggacaaaaaggcgtgcgagtaggctggtgtagtgcaacctgctcaggagagatccattcggttacgcagccatgttggggtgggattgggaacgccgtccgtgtgcgcgcctcgccggtggggcggcttcggtgcgtcacgtgtgcgcttgcgggtgacgggagcgcatgggccacgggtagcgaggcagcggtggccatcatcacacggtcagacggtctcagcctcccagggaagaggggaatttaactatttaccactatattaggtttcttaattatccaaatacccctcttaaaattgtatttaattttttatcattggagatagacaacttcttatttttttaccactttatggcacgccaacaaggctaccctatcattttcttccttctccacctcctctctatcttctctccccttctccccaatcccccctcctctcgtctgctcttcatctctccctccagttcggcgttcaccgtcgtgaggtcctccgccttcatatccaccgtggcgaggagcaccttcgctgttgctcggcctccatcgccgccactccgcctcctcctccgccgctagaagcccgttcgacgccgcttcgcctcctctgccaccgccgccgccgctgctccgcctcctccattgccgctctgcctcctctccactgtcgccctcctcctccacggtcgccgctgcccgccactgccctgcctcttccacctccggccgtcgcaaccaccatgaaagagccggcaaggaggtgaacgaggaggagtggctcgcagtgaggcaagcaggggcccaatccatggcggcggcggcgcactgcgtcgtccttgtgctcatcctcgtcaccgctggcgtcattgcctccgccaatactgttgttgctgctcgtcccggtggttggcgggcggttggatcctcaccgactacgacgatggatgaggtggagtaagtgggtggagacggaatacgacggcggaagagggtactcgttgatttgagttttggttttgctacttttgcataaacggtggctcgtacaagaaaacggaatgtgcttggtggttgaaaaccgccaagtataacgacgagttattcttaagaaaaaagaacgtttttctggatatgtgatatattcatatttatgtacaaaagttatttttagatggagagagagatcaaacggtgaatagctagctgcatttcaaattggctatcttcatgcaaagtgggttatcctggtagtttgaggaatttaaaaacaaaggaatggttgggtattccatgcattttaaaatgtgttctcttaaagaaaaaaattattctgtctcaaaactattttttacttcttaaaatacttaattattcatataatcaagtagatagtctaccctaacagatacagtggaaaatctgtttaaaattgggtcaggtaaactcacagttcttcaaaccatacttcgcgggaaataaaccaggatattgttgtaacactacccaagaaccacattttgactcggttctatccctcttagagattgtattatagattatcacgtgtaaacttcccaagctcttaactagtacaattttaccaaaaaaatctatatattaattgcttatcatattattttagaacgacttaaaataaatcattttactttccaatgtcaaaaaaaattgctttgaccactgattgataatatatcatactccctccattcttacatattcgtcgttagaacaaacaacttttttgcaaaagttagtgcatttgcttgataaaagcgtcatatattagtgactggaggtaatacagcaaaataaaaagttatactacctccgtcctaaaatataacaactcttagctatgaatttggacacacggttgtccagattcatagtagaaatgcttatattttggaatggagggagtaccaaataatgtgttttgttactataaaaattctttttataacaaaagtagccatttatcagtcttaaaaaaaacaaaattagccttatgcgcaacaagttagatctacccctaaaaaggaacttgtttttggttccgtgagtctcatcggttgcccatgattactaataagccaaaacgatttgttagagaataaaaattaatttatgggtaaacttttatatatttgttcgtagcgacctcaaaaccaacgttaaaaagaaattacgttgaaaacatcttagaatcaagttaatttttttttaaaattttggcttttgctttgatttattagatcaaccgatgaggctctgtgactgttggttgattgcttcttttgttctcagacataaatgagggcgatcgcaatgaatatgcccatggctgtttctcgattatgctatgcgtggccactctgaagtctaaagacgctttgtggttgcaataccaaattctgaagaaataaccagaacaaactgggcgaatgctgaaatctcaatgagcagacaatgaactaaagaggatggttatgttactggggaaaaaaaagaagctcacgtaccattactctgtttctagttgtggacagtcccttatccccgtgcatgaacaagagttaactgatgcctgtatggtggttggagtaggtgtcacttgtcagatctcttgcagtgactggttgcattttcttgcaaatgcttctggctgctgcatctgcatgtatcgcttcttgtgtgtgaaagactgaaagtacatctattcatgtaccaaccattggctcagttaacattgtagcgattagatgcttctttagtactagtagattgtagtctacaaccgatagcagtggtggtactagtaatttaacagccaaattgttctgtaactctattcatgtcttgtagctgttgcatcccgtgaactcttgggacagtcatgttcatcgattccgaaatgaatcgactctaacacttgccgaacaccagtagtagtttttttttttcctttttggagagactgaaaacttggagtggttagttcagagctagagagagtgttcatttggtcaggcgtgagtttatacgtacttcatcccagaggccaacatagccacatggccagatccatatgggcttcggtctataagccgtgttgggtcaagatcacgtaaatagttagggatagttattcactcctaggaggctgggccgggccggaccgtgcggcccatttggccagcactaattgctgctattagccatttcattttttagataatgtattatgtgtagtccatttcttgaatatttgggccgcactaattgctgctattagccatttcattttttagataatgtattatgtgtagtccatttcttgaatatttgtttttttaatgtaatgcttataagcagatctactcgtaacatgttttaaatgttattctaaaaaatgtttcaaatgtttttcttttgtaaaaccaaaagaaacacagattgatatgagccatgagttcttttctcatcttttttctttgactcaatataaggagacatactacaaattagtactactcacttcctgtagagaataaaactcaagtttgaatctcctaaagatgaagatgaagataaaaattaagtgttttacacaaaacgagatggtaataacatgtgattaattgagttttaattattacaaacttgaaaaatggattaatctgatattttaaagcatttttcatatagaaagttttcgcacgaaacgtaccgtttagcagtttaaaaggcgtgccacgagtatccaaaattttatcactcacttaggcctgatttagttcccaactttttcttcaaatttccaacttttccatcacatcaaaactttcctacacacacaaacttccaacttttccgtcacatcgtttcaatttcaatcaaactttcaattttagcgtggactaaacacacccttatagaagaaacgaacaggggagtctcacttcctttcttgtcaatcagccaggttccttctgaaactgatgtaaggagtacttctactactaataaccaggtttctctgaaacatgagcctgaacagctactctgtcaggctgtcactgccgactctaacaaaggaatctgcaaataggagtccatccaaacacaaaacaagattggaacaaagtggcttcagacttcagagcctaccaaaagaaggcacatgtacaccaaggataccacaaacagcacagaaatgaacagcctaaaagcacatgaggctgcttaaagccaagccgaagccatcacacctaatacttcaaatctagccgttctctgtaccaagaaccgaacactcaacgacttaatcaccatggacacaacttccctgaaacttcatcacctcgacgtctgcatgacgagcgacagaaacatccgatggagttgaagaatctcccgtttcgtttcctgacgagcaagagtacaacaacgtcaacgacgcccacgataacaacagagcaaacagaaatggaagcaatggaacaagagctcacgttcccagattggttctagtcactatatccggcggatcacgggctcctcgtccc

SEQ ID NO: 85279 - DNA, 579 bp, Oryza sativa
taagagtgaagtgcatcgtctgcataataaaagaggggtcaggctgaaaaaggtgaggtttggatatcagctaatgtcaaccaaaatgtgtgcatcctcaactaaagaaaaggagaacatatattattcttcatgcgtgcaaaaacacttctcaggaatccagtagatatttttgtggtaaattaatcaaactaatcatggagtggtaaatttatcacactaatcattgcaagtgatgcattatgattgttctatatatcatgtctcaacagagcagcgaatatgtgacttttgttgcttttgttaactttgtaagaaggcccggtgaattaacttgtaagaaggataccttggttagtgaatttgtaccgtgcaagtacaaaaaatgtaacacttcaaactcctcatcattatctttctggttgatcagaacttgatgctccattaggaggtgtggacaaagcgctggttgatccattctctgctggtggaggatttccccattttctctcagattccaagggttccaatacataaacaccaccatcagtcaggcctagagcaaactgatttgcttcc

SEQ ID NO: 85280 - DNA, 750 bp, Oryza sativa
tatagggcgaaggggagctcggtacccatacagtccatatagaaatacagttaggaaataactgaaattcggaattaaaaataaagaatattagaagtagagtatagaggcaatatagaaatacaattaggaaataatagacatttggaattaaaaataagaaatatcagaagtaaagtatagagtccatatagaaatacaattaagaaaaaaatagaaattcggaattaaaaataagaaatattagaagtagattatagagtgcatataggaatttaaaactaactatattttggaataaacataataaaattaaaagtagagtttagagtccgtataaaaatacaatttacaaataactaaaattcaatattaagaaaaacacgggaagaagagtttaaggtcaatataggaatacaaatataggaatacaatttagaagtaactgaaattaaaaattaaaaattaaagaatattgaaaaatgagtttagagtccacatggaaatacaattagaaataataaaatttcagaaataaaaataaataatattggaagaagtgcatagagtctatatagaaatacaatttacagaaaattcggaattaaaagacgagtctagagtccatataggaatatatattatttacaaataactaaaatttgatattaaaaataattaataactaacacgtatatgaaatataatataaaaattcagaaataaaaaaaataatattggaagaagagc

SEQ ID NO: 85281 - DNA, 610 bp, Oryza sativa
atccgacttgctatagggcgaattcgagctcggtaccctaaacgaaaacaaacaactgagggaatacatccaaccactagctatctgagacttgacaccggtacactcacactgtcgcacacacatttacaacaacgacgacgacgacgacgatcaatggagatgaccgagaagagattcaaccgaagagcaacttcttgggcggctctcccttggcgcggtactttgctgcggcctcctcggccttcaccacctcctcccctcgccgcgcctccgtcgccgctcgcttctcctccgccgccctgtgcaccttcgccacgccgttcatcaacttctccacctgctccgccttcttcctctccaggtactcctgcatatatatgaaccgatcgatcaactcaatgattcacacacacataattgatctctccttgttctgcttgttgatgaacttagctgagctgaacttacttggtacttcttaatctcggcctcgatctcggccaccttggagttctcccatgaggcgatgtcggccaacttcttggccgccctgtgcgcgaaagtttcagttaaccgagggctcatttggaatgcaggaattttatat

SEQ ID NO: 85282 - DNA, 3229 bp, Oryza sativa
gtctaggtaaaattgccatctccaataatcaatctctctctaatgttcttcttgtcaattcattaagctacaatttattatccgtttctcaattatgtaagttgggttacaattgcttgtttaccgatgaggatgtgaccgtcttttgaagggatgactcctctgtagcattcaaaggcaagttaaagggtgatctctatcttgtcgatttcgatgtggatagagtgaatccagaagcttgtttgattgctaaatcctccatgggttggctatggcatcatagactagcccatgttggaatgcagaatttggcaactcttctaaagggggaacacatcctcgggctcactaatgtcacatttgagaaagatcgtgtgtgtagtgcttgccaagcagggaaacaagttgggaatccacatcctatcaagaacatcatgactacaacacgccctcttgagcttctacatatggatttatttgggcccgtggcttacataagtattggaggtaacaagtatgtttttgtcattgttgatgatttttcacgcttcacttgggtgtactttctccatgacaaaagcaaagctcaagatgtcttcaagcgctttgcaaagcaagcccaaaacctctatgatctcactatcaagagggtgcgaagcgacaatggaggagaattcaagaacactcaagtggaggaatttcttgatgaagaaggaatcaagcacgagttctccgccccctatgatcctccccaaaatggcattgttgagaggaagaaccgaaccctcattgaagccgcaagggcaatgcttgatgagtacaagacttcggatgtcttttgggcggaggccgtgagtaccgcatgtcatgccatcaaccgcttgtacctccacaagatcctaaagaaaacttcatatgaactcttgagtggtaagaagcctaatgtttcatattttcgtgtctttgggagcaaatgttttattttaagtaagaggccttgctcatctaaattctcacctaaggtggatgagggattcttacttggctatgaatcaaatgcacatgcctatcgtgtcttcaacaaaacctccggtattgttgaagtcactagggatgtgatatttgatgaatctaatggctcccaaggagagcaagttgttgtacatgttgtaggtgatgtggatccaagtcaagctataggcactaaggctattggagacatacgaccagtcgagacgcaggatgaccaagaggatagggatcaacctccgtcatcgacatccaatagccctacaagtgttgtgtctgctgagccagaagttccgggtcctattgaccggaacctccggacatctccaggcccggaagttccgggttctacagtccggaacctccggaccagtggcagtgaagacgtgccaacggcacaagtggatgggatcgatgctgcgggcactttagagtatactgatcaggcttaggtccccccagtgcaccatccaagaatatatcacactgtccaaagagatcatcccgtcgacaacatacttggtgacataagaaagggggtaactactcgttcttgtgtcgctaacttttgtcaacactattcgtttgtctcttctttggaaccaaccagggttgaagatgaacttggtgatccggattgggtgatggctatgcaagaggagttgaataacttcattcgcaaccaagtatggacgttggtggagagacccgaccaaaatgtcatcggcaccaagtggatcttccgcaacaagcaagatgaacatggagtggttgtaaggaacaaagcccggttagttgcgcaagggttcacccaagtcgagggtctcgattttggtgaaaccttcgcacttgttgctcgtcttgagtcaatctgaatgcttttagcctatgccgctcaccatgatttcaggttatatcaaatggatgtcaaaagcgcctttctcaatggacccatctcggagttagtctttgtggagcaaccaccggggttcgaggatccaaagttgccaaaccatgtgtacaagctccacaaggcgctctacgggctcaaacaagcccctagagcttggtatgaatgtctccgagattttcttttgaaaaatggttttgaaattgggaaggcggacactactctcttcactaaaaagtttgaaaataatttattcatttgccaaatttatgtcgatgacataatatttggttctactaatgcctctttttgtgaagaatttagtagtatcatgactaaaaggttcgagatgtctatgatgggtgagctaaccttctttctcgggctgcaagtcaagcaagcacaagaaggtaccttcatctctcaaaccaagtacgtgaaggacattgttaagaagtttgggatggaagatgccaaacccatcaagactcccatgcctaccaatggtcaccttgatcttgatgaaaatggtaaatgtgtggaccaaaaggtatatcgctccataataggatccttgctttacttatgtgcatctcgtcccgatatcatgcttagtgtttgcatgtgtgctcgctttcaagcggagcctaaagagtgccatttgattgccgtcaagagaattctaagatatttagttcatactcctaatcttggcttgtggtatcctaagggttgtgactttgagcttttgggctattccgattcggattacgccgggtgtaaggttgatagaaaaagcacaaccgggacttgccaatttcttgggcggtcccttgtttcctggtcctccaagaagtaaaattccattgcattatccaccgccgaagccgaatatgtcgccgccggttcttgttgtgcccaactcctttggatgaaacaaaccctaaaagactttggctacaacttcacgaagatcccactcctatgtgataataagagtgccatcaaaatagccaacaatctcgttcaacactcaagaaccaagcgcatagatattcgccaccacttcttgagagatcatgaaaccaaaggagacatatgccttacccatgtgagaaccgagagtcaattagccgacattttcaccaagcctttagatgagaaaagattttgcgagcttaggagtgagctcaatatcttagattctcacaacattaagtgatgggtagttggctaattcatagccaaagtgtcactaaaatgtaaattaaaaaacaatgagcttttatg

SEQ ID NO: 85283 - DNA, 1899 bp, Oryza sativa
ccatgatcgccaacctccccatctccttcatctaaactccccgcgcctcctcctcgaagcagcggtcatcgacgttggagccccctccgttctagtcaccgacagtagccaccatcgtgtcggccgcatctctccccctctccatccgccgctgcccccgctccaccgtcggctgcctctccccccctccgtcgctgcgcccgctcgactgctcgagagaatcaacaagagaagagaagagaaaaagaaaaagaaaggagagatgtgggtcccataccaatttctctcacatacatataggcccccatatatttattttatattttttgctgagtaagatgccacgtcagcgaaaccagacttctatactacctcgggaccttttttttttgaatggttttacatggtttaggggtacatatttctggtatcgtggttaggggacctcagacagactcgggtaaagttgagggactactggtgaacttagtcctaatgttttatgatttacagcccgtccaaacgggctttttagcctacacggaaaagattttacggtcttgtgttttacactagcattgggccaattacaggccttccaaacaagccttaagtctcacgtttttccaaacaggccttccagcgagtgcctcgcatgaaccctcctctccattggctggtttggtttattcattcttcttaatcattttattggctttggcaggcatcccgttagtcaggcgagtgggttttgggtgaagctgtcagccgccaaggccaagttccacccagtgacaaaactagaatgaaaataaagtgtcaaaggtgggaactaaatgtatagataagtgaaccaagtatatatcgctatgtttgaaataaactcacttttctaattaatatttagattttaccccggttttcattagcatgcttttcaaacgactaaacagtgcatttcgtacgaaaactttttatatagaagttgctttaaaatatcaaatatatctatttgtcaaatttgtaataattaaaaattaataaatcatgtgctaatagctttcttgttttacgtgtgtcaacttaatcttcatctttattaatttcaagcaccactgaccatcaaacaaaaatcagatcattcatatgaatttgttgataagtaattaacaatgaaaaccacattgtcttactcgttaatttcacaccattccccaatcatgaggtctcagcccataacaatagctaaaatattttcaattgggccatatcatagcaaataagactagattaaaaggcatccaagcgaacaaagcagtacttctatctagttatcttatttctccaaaatgacatgtataccaaactatcacagagctagtgaagtaaggtgcttgggatctagcggatggatctagggacttgcgtcccaacaaggcccaacactaaattcttccatggttccaccaccacctacctctctgtctggtgagcttcctcaacttgaccatgtatagttcgattcacttcgtcaaaccgttaggaactctccactccctgcatatttacaccggtttccatcacgatcttgcaaattagtggtggcgtgtggctataaggatcctatcatgtgattgttgcctcgttttgtttcatggttgacatggatagacgttattttaatgattcgtgttctagacatatgtaaagcatcgtgttctaaaaacattcttggggttaggctacatgccatttggattatttgatgcattattaacatttgtcatatcctcttgtcgtgttttaacctccagatttttttgacgggaatttaacctccagatttacttcacagaaacgaacaggggcgagaatagagataccggacatacacatttg

SEQ ID NO: 85284 - DNA, 1516 bp, Oryza sativa
  unsure (1)..(1516): unsure at all n locations
tcctgcagcccaagaattatttcgcaatgctgttccacatgttgatgaccagtatatagtttataatctgtgaaattgttcaagcatgtacggaaagcagagcataaacatccatacctctcgttgttgttccgggttcgcagaagccaaggaagtctgaaggttattgcttggagcttgcaattcccccacgggcaccacatgcttgacagcttgttgcattggctgcattgggctagagaagcgatggtgctgatgcaacattgctgggttggccacaccattcctacgatttggcatgtgtctgaagccctggttggcattttggtgaaacatctacaaagtaacaagcaacgatgttaagtgaagtgaatcctagttaattattaattgctccctccattttaaattagtacttctctttctagacttattctaagtcaaacattttagtttttgacaatcattttttctaaactcatgtagtttgacatcatgatattcatggatttagattcaataccttcataatatataatttacttgtcaaagtacactgttttttaaaaattaatggtaaaaaataaacatgtttgactaagagacacctagaatgataagtaattcttaaacgggggagtagctgaagttgcgagtaattgacaacattagcaaaaataagtagatatgataattggatacaattagatgctggatctattgtgttaaaaaagaaaaaaaatatgacaatgatttagccaacaggaatacctggtgaggattatgcagatgtntaggcattcctccatgcgaaggaccactcctctggccaggctgcctttgcatgttatatggcatcatcatgtttggaacaaaatttggttggaaccccaagcctgcaggtggtggtggtgggaacaaggcaggcacaccatggccaaaattgaactgatggggagcaatgtttggccctaatgtaggtgccattgttgctagggctctaacacgagcaaaatgtgcctggcaaacaaagaagatatgaatatcaagcttaacaaacgacctttgtaacatggaaaagttcaatgttagcatagcacacttagtatcaagtgtcaatgttaagaaacaaaatgtactttcagttttttttttcatgaattacaaaactcacaagaaaagataacaagatgtacaaaacctaccctaaaaatcaaattcaaatgtaatagagttagtacataccgctaaaaatgcctttctctcctccttccgttgagctacggcaacatataatggctttttcccaaccattttcccgttcatttttaaaatctataatatttttaaaaatattaattgcataatactgaaaaatatttagaactatggaattgggagtatgaggatagcacaaaagaatcattttttaacatacagcattgttagcgtcttcaacagttgcaaaagatacaaatccacaacccttgctccttccatgcgaatcaagcatgac

SEQ ID NO: 85285 - DNA, 527 bp, Oryza sativa
ttgggaagaaaagaaaacatagcaagaaggacaagaagaggatgtggaagaaaaaatccatattttggcggctaccttacagggaagatcttgaggtccgtcaatgcattgatctgatgcacgtagagaagaatgtgtgcgatagcttgctggggctattgctgaatatgcttggcaggacaaaggacgggttgaatgcgcgtctcgatctacaggagatgaacattcacagtgaacttcagcctgttacagatgagaagacaggaagagtgtacctcccaccagcttgccacacattgtcaaaggatgagaagatcaatgctatcatgtctggcagatattaaagttccttcgggctagtgcacgagaataagtaagtacgttaaattggaggatctaaagctggttggaatgaagtctcatgatcgccacgtgctaatcacacagatcttactagttgctatcagaggcattctaccaccacaagtccgtcacacgatccaactgctttgtgccttcttcaatgc

SEQ ID NO: 85286 - DNA, 601 bp, Oryza sativa
gtgcgtggcgtacatgtagtgagagtgggtctatgcgtgaattgaattgtccatttttcgcagcgttcaaatgtgttgtgacatttgcaaattcttcacgccggatgcatccttaattttctcttgtaaaattacgttgtccgtgtatataataccacctctgttctaagatatatgacgttgttcacttttcacataatatttgactatttgttttattcaaagatttagtaatgaataggtagaagtataagttaagattatatttttatgataaaataagtcataacaaaataaataatatttttttaattagatgaatggttaacgttataaaaaaaagtcaatcacgtcatatatttttaaatggagggagtatatatcaaactgaaaaatgtttacctggtaaaaaaagggaaattttcatagtagtctacatagataggataatcaataggtttttcattttcgtttcttttcgttcaacatatcctatctatgcatgaattgaattgtccattttgcacgttcaaatctgttgtgatttttttttgcaaattctgctcgccggatgtgtccttttcttttgacatggaatgca

SEQ ID NO: 85287 - DNA, 684 bp, Oryza sativa
ctttggatcaacagagaacatggtgctcgcttcaatgaatggttcaaggatcgtgtagcacggtcgaccgatggcccaagtgagatattacaaaggttggcaaggggtccatcttgggatgttgacacatggcaagggatgatatcaatagatacacattttacaccgtcacacaaaatgaaaaagcacagtgcaaaacagtggagtccatatagatgcatatcaggatcaggctggatcgagcacatactacggccgcatagagcagatatgggagctgaactatctgaactttaaagtccctttgtttcgttgcagttgggtgaatatccgcacaggtgtcaaggtcgacaaggaaggcttcacattggtggacctggccaaggttggatacgcagacgaaccattcgtactagcgaagcaggtcgaacaaattttctacataaacgaccccgcaaacaagaagatgcacgtcgttagggatggcaagcaaagaattgtgggggtggacaacgtcgtcaatgaagaagaatataacaagaatcttcatgtcagacctcagatcgaccttgacgatgatcccgaagatgaagtggcttacgttcgttcagaccattcggaaggcgtaccactgtgaatgatgcatttaatttgtattggagccttaatgaatgaattacatat

SEQ ID NO: 85288 - DNA, 9626 bp, Oryza sativa
caggcatgcaagctttgggagcaaagttcataccaaaggcttcttttcgattgtgtcaatgttgctcttgttgagatcggcgagaacaccttgctaagtacattcccatggagcaaagcacactcaagaacatggatggacgcctcctctcctgcattggggatagaagtctggagcatcctgaaagattggatttacggggcacggatgttcgtggtgagcaggagagataatgctgggatcatgatagagagagttgtgaagcaggaggttgaaggaacatgctgggtgaaaacgatgaggacgcagttggttgacatcaccgagcaaattgagggtggagtctgggaggagctcgtgggagaagctgtgctggattttgttcctgcctgtcaacgatgatatatgtctttgcaagttacaactggtgaatttctgccctttttttgtacactgtttatgtcattttacgccaggaacaaatgtgtactcgcttcgtcccaaaataaatcaacttctgtaattcaaactttgtcctaaaataaatcaacttctatcttcttatctactctcggttcgcaaattgagaaattttatttattaataccccttaccacctacccaccaatactaatttgctatcaatagggggtattttagtcttttatcctctcctttaattttgcactggattgctatgagttgcttctttgtaagacagagggagtatgtatttctagctgattggaagcttgtagtagcattttaaacttttgacaaattttgctatagtacaatcaaagttttttctgcataatttgttagtggacatcgaaaaacgtgacatagctgaagaatctaataatctaaagttggctcttttgctagctttcgattggtccacgtggcgcctcttactttgaaggaaaatcataaatttatactacagagaaacacctaacaatcatatatgaggaaaaatctagagaaaaatattacataatcatatgtgaggaaaaatctaaagaaaaatattacatatggattccagaggcttccaaaactatcttccctttccaatcacacaaacttctactcattttccttctataaatataccacacgtccacgcgtactagtattactcctaaaactcttgaatatatagtaaattcaaaattattaagtaaacaaaaatctaaaacaacaaatttacattcattttccttctttaaatatactacacttactcggtactactcctataactctataatatattgtaaatccgaaatcattattaaaaaaattacaaaacaaagaaagaagacaacattgctttcgtatatcacggaatatgatcgttaataactcatcagccaaaaaagccaaaaaaatcattaatacatcgttagccaaaaaatgtttttttacacatgatatattaaaaaaaatctaaatataccaatgattaatctttcaaatattaaaattcacaaccatgaatatgaattctgagtcagtataatattttaagtatataatatgtgcgatttggttgcctaggacatgaagaaatgagttaaatagtaaccatgagaagtgtgtcgagttaggttgtaataggcttcgttggggtaagtgatccttaatggattcgtttggtatggaagtttgatataaccagtggtgtctgggttgggtttaaactcatattctgccttgtattacgtagcattactgctaaatacttcacttttcctttataccttagtgaaagctgtcactatctgtcatccatagatagggccagcaatcacctttctaataatagcaatataagggtatttttaaaactttcttcatttatatcactaaatagcatgataactcctataaaacatggccaccttcctaacattgccaacacacagtagttgaaaggcggtaagcattccttttgcaataagtaacactttttatatgttctttgagagcctaagtcaatgtacagttgaaatccccaaattcgctctaaaattcataatgataactcatggtcactttaagtagattttttgatgccaaactaagttttagatgagatttgtgcagtgcgttgctaaactagctaaatataacactgtagctgaactaacccataaatatcgttttcttttcttttatttttcttacatagaggcttaaatctcatctaaaagttcagcagaaaaatctgctcaagtaatcgcaagttgtcaaacaaatataacgttctcacaaacaaagatactgttgtaaatattgattactattaaccatattatatgtaacatcattagaactgtagttcttaaccggttttttatttaagaagttttatgtatgtcgttccttatttttgcttatttagaatataatgtaatacttcaatatgttcaggaattgtgattgaccaagacatatgccatccttcgggttttgatttttatttgtgtagacatacttattaggtatatacattttagaaaatcatactgtaatttaagctagttattccaaaaatctttagttccgtttatcagatagggttttgatttttatttgtgtagccaaacttttcaggtatataaattttatgaaacaataccgcaatttaagctagtcatttaaaacatctttagttctgtttgtcagataggtttgggcagccatgtcatgcgcacgtgcagtaatccaaccaatgcacattcggcccacatattaaacacaagtacggttttagtctttgataaatcgtgtattattactgtagttccgcaaaatgtcaaattaaaattaaaggtaaatgatagttttcatatttacaattttgtgaaatttgctgcgtataattcggtacttctatgatggtataagtattaatgaatatttgtttataatctattgtatataatgtcatttctagtgtaatatcagacctacgcattatacaattatcttcaatgaaaatcatttcactgctgacaggcttcaactgcttacacgcaacctaatgttacatgtaagttaacgtctacctttggttattttatttacttttttgtgctcatcttgattgttttttccatttaactctaatctttttaatatgtagttatgcacgatgcacccgtgctgtttctataggtgagacaactttcggtttatgtttgatgataatatcttttatataggtgtggttaacaaaatatagattgggtaccatttgatagcttactttattgagacacgaattagggtcataattgtgccccttctaaacattatagccactttttgatctatcctctcagtgtactgtatttttgctggacaaacttgtctgtgaacttttctgaaactaatgttttgtgtctttttatttggactattaagggctactgattaggcttgaagtaatatactttttaactttgctatgcagttcccccatatactatcttgctgtagcccgagaacgaagctatttcgggaagtttggcgatggatcaagcatcaagaatgaagtttcttcagagttgcctgagtttctaaacgttccaaagattgctggtcgtgtcctaggcgtgatgttctactgttaaatgcttgtggactgtggtcgataggacctgtctcccagggttgtactcccttctttccatactataagatgtttcgacctcaacatctcttattcagatttactaacattcatccatatgaattgacttgtatataaagcacatacatcgatccacatatctatttaaaactcaaaacactttataatatgaaacggaggaagtaggagtgtggtattgttgtggagatcgatggcttgaatgaacctccagctagctaactcaccatcaccaccgttgcctgaaggctgagcctctagcatcaatatcacaaagacgggagcagagcgtcaccatcatgggaacatttgctgctctccatttatgcgactgttcacggagttaacgcttgggaggatttgggagcacgatgggctttactctgggcctataccaactccaggacatccaattctgatccacctaaaatcaactgggttttacgagtttggaaatgaaaaagtacatgaaaggtccctcaacttatcactgaattataaaatcgtcactcaaccgaaaaaccaaatatataacatatcttagcttacaaaatcaggtcactctgggtccttatacggtattaaccctcgatcttctctcccctcatctcccatcctacttctctccacgcggctgaagatgagcagggggtgcgcgtggtggccaacggcaggcaatgcggccgcctgaggacccctcccctcctcctcgccggccagcctatggtagtgcggaaaagcagccctcctcctacggccacctcgccgccgcccaccaattcgtcatccccaacgccatccgcctcgtctccaccggcgccgccaaatccccatggcggcggtgcaacccaccatcgccggccagggtcccctcccatcttgtgcctggagccccgagcagtaaccgtcgcaacgaactcctctcctctttgcgctctctcctcgccggagcaccaagaagccaagagctcgtcaccttcgctgctcgccgatcggagcaccaataaagcaagaacgcccccctcccccgcgcgcgcgctatctccgtcacttcactgacccaagcgccaagaaaccaagagcaccaagctcctccgcccgcctgctaaccggagcaccaagaaaccaagagccccgcgccgcctctgctgctcgccgaaggcaatgaagcagttccacagcaggcatcacatctggctgtggagccgcgtccatgacacatacctctgcgcagacgacgacgggagcagcgtttccatgtagttgggctgtgcgtttgtgcacgtgacgtgggcggtgcataatggcggatccatagggtggtccggacggcaatcggtcctactattaagaaaaaaggagaatagcgatcccgcgcccgcacgcgcgtggatcaaaaggaaggaaagaaactgaagcgtcgcggtcgcgcgacttgcgccgggcccagacatgcctttctcctcctcgccctgacgccctagcgacacgtcgagccgccaacgtgattagaatcacgcgatcatatcagactagcgtcgtgccgccgccggcccatgcgctgacgtcatgacgcgccatgccgcctggcccgcccaccccagtccgctcactgccttggcagctgcagagccgcagtgctgtagtgtgtgcccgccgcaatgagctgttgtcgagccgaggaaaactagaaaggagccacggactcacagagacttgcctcctaacctccttgctgcagtgtgccgcgcgcccgcccgcgtagacccataagggcacccacaatggttatctataggctctctacaagagatccatgtcagcatattttcttacttggaaagtattaaatgaagagagagagcaaagctatctactaacatagagatagtctatagagaaaaacgagtcaatgcataagagagctatagataccaatgtagacatactattaaggtggtttactattaatcgagtctattgctgatatgtacatgttttatagagagcaccttactttaccattgcgggtgctctaataaacaaaaagtagtacttaattttctttaaactttcatagtcttataagcttcgttaaatgaaaattttaattaattaataattttggatgttttaagatgctttaatatatcattgtaaacttttggtgatttagtctattctgtgtattgtactccatgtattagtatcattagatttattgtgtttagaaaaaaaaattaggtcggaccacccatatcctaaatccgttaccggtggtgcacatactccactagaacggcttccccatcctcatgctccacagcgccgcaaatggatgatacctcgtggccacaaacaacaccaccatcgttcatctttgtcgactggctcgctatgctatcaggtgaggatacacacactactctcatagaagcacaccatgcatgggctcgaatgagtagagtagcgtccaattaatgtgtcgacgccggcaacccgcggcacgttgaccggcacggcgccgtacgtacccacgatgaggttgaggtgatctcgtctcccgcgtcatcgctaccgccacggcttcgcccgtcaccaccgccgcctcgcaggccgccggaccttctcctctcccacctcgtcctgccgggtggcctgcccagagaggagaatagtgagagagagggagaggagggggagagatgatgatgtgtcatcctgatatgtggggttcatgtagagtctcacgctaactcagctgccatgttggataaaaccgcggttaaaaccgtgcaaggaccaaaagtgatcaggttttataaatcgagggatgatatatatctagttttatggttggacgatgattttataatccgatgataagttgagggaccttctatgtacgttttccatttggaaataaaacagcatcctagtatcctacacgtctgtaggttggtaatatctcatcgcgaaaaaaaaaggttgctgatatcggatacggaatacccaaaggatctcgtatacacacgcaaaacatgaatatagaacgaggggttcgcgctagtggcatggattcagttgatcggaatttcatcccaagtccatccacgtcgtcaacggaggctcaatactctgtgaggttgttatatggaagacggcgtggagttagatcgggatttggcggcgacgagagaggaagcagagcgcgagatactcaacacctggatatgggacaaggagatcgacttattgcaaagggagatcgaggagcaagacgaactaagagtttaatagtatcgcccgttgatgggctgaaaatttatacacgtaagtaatagatggtaccaatagatgatacgtataataactagctgctaagttacctacccacacatccctaagcagttgatttttatttttttaatcagacttgtttccttctacccaatctttgatggagcaatggttaagtcattggacaaaagctaggactgagggctggttctcaggatttgcatcgtttcctgtgctggagctcggcgattgcattagcgcccgctgccttctctctccggttttctctctcttccacctatgatttctatgacgtggatgcttgtgtcgctggcttatcgtactctattatacctgctctaagtcgcctttgacgcgagcaagagagagaagacgacctatacgtgtggaggatgatcgaggagcgacacggagaaccctgtcatctcgaagatcatgaattggagaaaatatatgggccgcccgcatacgaaactgataatgactctgatgagggtggagtgtctttttacagcaatggaaggaacattttcatgaaatacggcgatgggtttaggtatgaagacgggaacccttattatgcagctgatagggaggagacatgggagaagcaaattctcagacaaatgaagtttcccatccccgatctttcagaatcttgggaggggtctcttgtggttgaagggccattcaacttagatctaaacctaacatttacggatcatttgagtaagtccactagtccaattcgtgtactaacaatccaaatgccatctgttatagaaatagtttttatcagtacagactcctttatctaatcacatttagatcacaaacaataattcaagatgtactgatttgactttttttttttgattttctacttctagtgcctgcactccccaagtgggaaaggcgatggttagatagggacgggaaggaaccatgacgtcgggctatccaagtacttggtctgaatctgtcttctcctagtaatgttccattggagatctatggtatatttgcattcagagatacacgcaatagtcagatgcgcaactatgtctttgactactcaagagaaaacccatgtaaacttaagccggtaagtacttgacgatgccataccggtttctctggtacttcctgaacaattaatatatactacatattgcaggtctaatctttttcaaaaatatgttaattacaatccagggtgctcattgcctccaatctctgatgacccctcctcgaggcatttatgcagttgggattgtgctaattgagtatcgcctaattattaagggtcaaaaggaggaagaagatcaagtgttaatagatggatactctatgtacgctccatctttctatgcagattttcaaaagctcatatggcacatcaacactggtcatttcggcaccatttatctgacaatttttgctatcccgaaagctgtcctggttgatttggagtttgaggtgtgtcaaattgaagataaccacgagcatgattcactcgcaatagttgcaacctactttaacattaatacttcttttattatcttcaacggtaagctgggtgttggcaagctacctccgctcacattgagcgcgagacatgataaacatttctccataaaagtttataaatactacaaccattcgggttgccatcccgatggtgttgtcaggaactgtagattcggtacagaatattattttgaggattttctatgtgaaagcttgtcttttacacctcaaaaatatggaaagagttcaaaaatattgtcccgtaatctggacggcattcagatggctatgaagtcgacatggtttattatgtgtgaaccatgtctataaagatcaaggccaaagttcatgtaaagtggtatgctgtcatatatattctctattctctcatatataattctgtattttataccacagtttttagattgaatatataaataattgatacgagtaccagctggatatctttgtactctgtatttgatgtcacagttagcttttctttttctttcctttttcttttcaattcattcgtgatggttctatgcgacccgtcgcgtctcggcctggcttgcttgtttttcaacgaagcagaggcactgcagagcatcgcaacacgagggagcagaggcgctgtgaaatccaagtgctcgctcaacgcgcttgttcgcgtgaaattctcgaggggatcggtctcatctcagtcgtcatcgacgacggatcagcggcccaaatcacgtgtaggcgtaaacggacctgactgaaaccgcagggcagttgaacagggcagggctaatgggcgatcgatcgcatccccacgccccattacacacctctccttcctttctcctcctcttcttctcttcctactacgctataaatttaaaaaaataaaaaaaaagttgaaaaaatttatgtatagaaatactatatatataaaaaatatttgaatttaaatttaaatttgaatcgggtatgtaaacttttggtttataaactttgggtctataaactttaggtgtataaactttagatgtatagacatactatgtatagaaaatatttaaattcaaatttaaatttgaattag

SEQ ID NO: 85289 - DNA, 3912 bp, Oryza sativa
cagagtgtcaggaaaccatcacaaatctaagcaggcagctgcgagctcttaagagtccggcagtttcaggcaatctagacagcccagtgtccaactccagaccaagctcatctgactacaagccccagtcacttgcatgcattcttgctgaaggggaggactccagcactgaggatgccatttctcctgcaaccaaagaggtgcactccaataaagaacctgatgctgcatcacggaaaagcgtagcacaagatggtagtgttaatgctgtcctcaaagctgtggaagaggaattaacacaagccgttgttcatccgatcttcccagagccatcccaagagactatttctgctgatctcaagaagaagagacggagccccagcttgctgggcaggataatgttcagaaagaaagtggaaggcagctagatcatgctgctgatctggtggatgcactgtgatggtaaaagcttgcaaaatctagtagcactccaccactatgctgtcactggagatttcgactttgaacgaacgagcttgttctgtttgttgagcattcctgttccttagggtgcaacctttttggacacgtattctgtcacagagactgatgacttgtggaagagactctgagcacatgatctgtatcggttttccttgacatggacaaattttctttttgtatttatggcctccatggttgtgtaaatgttaatttaataagttaaaaattcgttcttgttcactggaatacgtacatgcaattctttttttctgtctgagcggctccaagtttcaagacctctctataccgtttggaaaaatccatacaccgacatgagattacaggtacagaagtagagattttggaaaatatcacaaattcacaatggaaaagcattggagctggattgcttctgaattctgatacagcagtcagcagaggaagatatccattgtgccttttgaaaccacaatagagatatactgttagttgccctgtagttgtagccatttgaatgcaaaagcatttcaagattcttttaggtagggtgaggtcgccaccagtactcatcccaagaaggattctctcatcacagggatgtgaccttctgactttgtatacagaatactatatttgctttataaacagctgaaaaataccaatcatgctttcctttccaaaaaaaaaaaactaatcatgccggtgattgtcgtaatcatttacgaggtgtacagtacagcaccggcccagctgatctcaacagaaagaggcacaattggcctaggcctcatcatctagaagcaataccgtctaaactaatcctgagtcagcacaaaggatggccatattcagatattctaaaggcggccgtgacaggatagaaggcaacaccatcaagccactggggtttccagactctgaccgatcgcaaaaacaaacaaaagtctgaagcgctaatatgcttgcgtcaaatacaaaagaacggcatcactgcgtctgcatgctactgacaattttctcaaggctttatattcctcgagtcatttgcgttgcagttgcagacaactggatgcagttctgctccaataattagattatcattcaggttgcagacaggaactcatccaggcccggtgatgcctgggacggcaagagcttgtctttttctttcatttttttttgtgttattttctgctgctgatagactgatgatggcaattgtttgtcacttgtcagtcatgtactctgcctcgtactttttgttgctggatagcgttattcggcagcgtagccatgttatcatgtcttatcttgtaggctttctttgggttgtaatgcaggccaaatggcaacttgtaggatggtttcagatccttcacgccgcgtttggtttctgaaggggactgagatttcgtctcctcccatttggttatagctatctgtctatcaccacaagtttactgtttgcttgtgttcttggtccaattcagacttctgcagtgctgcttgcttgacctgcagctcatccaaattccatgtatacttttcttgccatggttatcctttgtaacactaaactgtctctgcacctgcgttgaaagttgatttgcgtgtgatgtgtaacacgtgttcatgtattgcaacttaaacttcatcacaaacttgtttcactaatttgtcaaagttttgctttttgcaagtttgcaaccctaggaacttcattacgagaggtgatagtacaaatgatcaaggacagaagaagatgccattctcagtcatgcaattttgtacttcaacaaatgagtcttttatttttttgaaattgaagctcttccccgatccttttctcatctttattccagattatagttatagaacctacctccaggctccagccctacatctttacaccccaaagaaaaagcaaaaagaatgaaaggggagaaaaaaaaagaagaacgaattacgaatcagaagctcactatataagacaaccttttccatctttttaatcttttgacctttttacatgtttacatctaggtaacaacatctagaagatacaaacatccatggaaaactgcagccgcgatgtcctaactcctaagcatattgtcagaatcagccattaactgctgctaattcctgtttgacaagtgagccacctgtccctctcatcagtgcttacgtcagtctcgtaatgagatctcgaacaggtcggagtcggcgtccgggtcgccggccgacgcgccgccgccgccgccgttctccttcctgctcttgctcatccgcgacgccgtctccagccagccggagtcgacgcggcccatggagaagaggtcgccgctgtcgtcgaagtcgaggcccagcgagccgccgctccggccgtcgtcccccgccgacgcggcgcggaggaagcacgggttcgccgtgcgccgcgcgttcgccggcgcgtaccggaacttgccctgcccgaggttgaccagcgccatcacgtcgaagctggaggcgaggaccgggtacatcggggccgagaacgcgtcggcgttgcagctcacggcgtggaccagctgcccgtccaccgtgaagaacaccttccgcctcgccggctcgaagccgcagcccaccaccttgtccacgcccgcccacgacgacttctccgactcgtacaccagcttcatccctgccatcgaatccgcagaattttcagctcaagatttccacggtcgcaacgcgaggaagattcttggaacggggggagtgattgttaccgtcgaggtagaccgcaccgttggagtggaagccgatggacgacgcgtacgttccggccagcgactgccgtggcggcgcggcggacgcggcggcggcgaggcccaacgacatgaccgtgtgcctctgcttgtcgtggtgatcgtcggctttcgtggcggctctggtttcttgggccgcgttcttggcgtccggtgcaaagctgatgagcttggcgcggtcgctctcgctggagccgtccctgccgcggcggctcgccctcgacgccgaccactccggccgccgcgtgttgaggtagatgatggtgatctcgaagtaggcgtcctgcgggaacggcgcgccggcgaggggcgggccgggcagaggcaggctcatcctggcgaggcacagggcgctgctgttccccgccgcgtcgtggtcgccgccgcggagcgggctcgggatgctcccggggagccacttcttggcggacgccgagacggccgccgtcgccgcggccaccaccgggttgagccgcaccgcctgcatccgctccgacgaccccgcgggcacctcccacgcggcgtccgccatgtcgcggctgtcccggagtcgcaggcggggcagagcccccagagcggcgacgacgacgccgacctc

SEQ ID NO: 85290 - DNA, 762 bp, Oryza sativa
ttttgcagctgaagtgttctacatatacgtgccaagactcaaaactcagagagccaacctgacaacctgtaaacaaacaaaagatgcgtgtcctgaaggtgctgctgctactgctctacggcgttggcaacatcggttgctcaacggttcctgacaacacaacagatatgctctctctgcttggtttcaaggaagccatcaccaatgatccattaggagtcttgaacaattggaacaaaagcatccacttctgcagttggaagggcgtctggtgcagccccaagcaccctgggcgagtcacggcgctcaacctcgccggccaaggtttgtccggcaccatcgccgcttcggttggaaacctgacttctgttcgttcagttgatttatccagtaataacttctccggccagatacctcatcttgccaatctccagaagatgcaagtccttaatcttagcttcaatacactggatgggattattccagacaccctcacaaactgttccaacctgaggaaactagacctctatacaaacttgctaaagggtatgattccttcggcaataggtctgcttagaaatctagtttacattgacctttcccggaataatctgactgggatcatcccggcaagcctaaaaaatatatccctcttagaaacaatctatcttcaagacaaccaacttgaaggaagcattcctatgagcttggccgattttcaaatattttggttctggtcctagggggaaacaggctatcagg

SEQ ID NO: 85291 - DNA, 620 bp, Oryza sativa
attaagtaggttttaagaatttaaaacacaaacttgggtacattgctaggcttgcccataaccgagggcgcggctattcgaataggttttactctgatcagaggtgtacatctttacccacaagacacgtcttcctcacgtgcaaccacgtgccacataccaccacggcatatggacggaagacatgacatagtttccaacccatcctagccatagacaagagtaccgacccaacccacctacggccggaacccccggacaggcaggcagaattgagcccctagcagcaggacaccagccctgtgccatgacatctcgactaccggaccgcagctcgtgtagctttcatttgtcctagagatgtccatcgacccccgacttcgtccatctccatccatgtacttttgtttataaccagactgagccacaaactaagccttacccactagacatgtggaagtacggtagtgctttgcaacagaggcccgaagaccggtccttatgtggccgaggtgctactatcaaaaccatgcaccccgagcccagcctaaaaccattttgagggttttgaatagagggggaggtgtgcatccaattccacagtaatccaaccattccat

SEQ ID NO: 85292 - DNA, 653 bp, Oryza sativa
aaggggcggcgcacggtggaccaagtccacacgtggcctcgggtgcgcgtccaccaggtggacggcccagatcggccaaggccgatcggacggctggggacagccgggcggcgcggctggggcaaggcacggcacaaagccggcctagccaaacgacggcgcgaggcggcgcggcaagggggaggcggcaaccgtctgcccggcaccaccggcaacggcgcgggcacggagcgcggagcgcggcggcagcgacccggtcggacgaccaccggcggcggcagcacgtcgcgaggacacccgggaggcggccgacgaaggggaggaaaagggagaggaaggggagtgctcaccgagatgcacgacggcgaaggggcggccgacggcaaggaacggtggcggcggggctcctcaggaagacgtcgcgacggagctctggcgacgggcgtcgctcgggatggggcggacgggctcggcctcgatcggcgaccgaggaaggaggagctccggcggatttccggcgaagaggggcggcggccgaggtcctcctcgtcctagcggagctgagggaggcaacggcgcgggtcggcgtcgaccgaagcggcggcgcgacgcggctggagtcggcggcaagcggcggagagaggttacagggc

SEQ ID NO: 85293 - DNA, 2351 bp, Oryza sativa
tcaattgggtcaagaaacgatgcggcgcaagaaagattatggacaacaaaccttaatttggggcaattcatggcctgtcggtgatggctagggcgtggtggcagcgaggtaggaggacacgcggagaatcagaaggggaggggatggggcgggggatacaccacgggatgcgccggttggccttcgccctacttctttgtgcatgcttcatggaaacggttgagggagaaaaatctatactctcaggcatagttgggccggattttggtttggcccattagatgaagacgtggggcctcttgttcctgctaatggctaagcagttggcttgcctcacgattggattcggacgttgagaaagaattaatttggatgacgtggaagcatgtgaaggctggaaaatatcatttaactacactaaagtggggatgaattatgtaggtttataggatgcaacaatgaccttctaccaaactggatgagactttcttaaaaaggagactccttcctgttctggaaggatcaatggaacaatgagatactgaaaaaaattaggtccaattcacatatgccataaatgaggacatctctgcaagatcttttatgcaacaagaatcatatcaaaatttcaacctaccactgacctctcaagcattaagaaagtaacatgaccttctaccaaactggatgactttcttgattctaaagtgaatgatgtctagacatacatctggggctcagctgaacacaaattaaaaaacgtttaccacccctgctatcacattgatatggaagagcaaattcacaataaaagtaaaggtcttgttctgcctacttctgctagatagattgaacataagggatatgctacaaagaatcaaggttaatttgcatgaaggtgcaaactgtgtgcgatgcaacaatataatgctggaagatgtaatccatcttttcttctcctgcacttttgcccaacagtgctggcaatgccttggactgtactcggatccatctatggagttcatggatatgatttaaacaataaaatgcaattttgacaacctttcattgtcgaagttattggactgcttgttggaatatatggagtagaagaaatgatgccatcttcaacagcatacaagtatctttccatctatgaaaaagaattttaacgaggattttgtgtgcatatgtacatggaaaaggacatcgacaaaccccaatagcaatcattgcttgattctcttatgtaaaaccagtttgtaaataatttgtacaaacatattaaatatcacaaaactactacttaaagttagagtatcgcggaactacatataaagtaacaaagtgatcacaaaactatgtacttagcaccaatttaatcagaaaacttggaggtttatgatttaaaccctaaaatctatatttttgatatttttttaaatatatagtattgcaatacttttgcttaaatctatagttttgtgataaatttgttgttaaatttgtagttctgtgacacgtcaccttaagtctattgttttatgacaatatgattaatgtctttgtggttttgtgaaatttactctatatattattgtaataacccatcctccagaactgcatagcccagcccatttgatgagcaggtccacttacacatactatcccaattacacttttgtactcgattcgtgtaaaatgattaacacagaagtgatatggttgaagggacaagcctatatcagttggtttcgctcttactcaattagtaagatgatactaatcaagtgcacataacacgcatcggccacacaggtcacgtcgtaattagaccaggatatcacacacacccctcaaaggacgtgacgtctaattgggccagcatgtcacacatacccacctccaaggacccaacatccctcgcggtccaaattacccacagagccacataggcatacaggcaaatatctaggaatgcaacccctcttagcacacattcatatgttcagtgtcgatgccatataccatgacatgtgcattagacagagatcttacgcgtgccatgcgctatatgcccgcactctgacaagtgtagtgcaattgcgagggtcggcactgatactatttgggatagcatgtcctcgagaaccacgcagcccagtccatccgatgggcgagcccgcttacacataccaccctatttacactttcgtgcttgttcgtgtaaaatgatcaaaccagaagtgatacggttgaagggataagtctttataagttggttctactcttgctcaactagcaaggcagtattaatcaagtgcacgcaacacccctgggccatataggcc

SEQ ID NO: 85294 - DNA, 1159 bp, Oryza sativa
ctacccactatctcgcgaatgaggtgataccgccgtaaaatgtgtttggacttttgatgcgatctaagctccttggcttgcgcaatggcaccactattatcgcaatagaggtccatagggctagaagcactagtcatcacacctagttgagaaacgaatttctttatccaaacagcctcctttgctgcttcagaaacggcaatgtattcggcttctgttgtagaatcagccactgtatcttgcttggaactcttccaactcacagcgcctctatttaggcagaacacaaatccaaactgcgatctaaaatcatctttgtcgatttggaagcttgcgtcagtgtaaccatttacaacgagctcttcctgtcctccatagactaggaacatatccttagtttttctcaagtacttcaggatattctttacagctatccagtgactctcacctggatctgattggtatcggcttgttgcactaagtgcatatgaaacatctagacgtgtacatagcatagcatacatgatggatccgattgccaaggtatatggaatcacactcatcttgtttcgctcatcagtcgtttgaggacactgattcttgccaagattaatgccatgtgacatcgttaagaaacctttcttagaatcttgcatgttgaacctcttcaacaccttgtcaatgtatgtactctggcttaatccaattagcctctttgatctatctctatagatccttatgcccagaatatatgctgcttcccctaagtccttcattgaaaaactatttttcaacgatgtcttaacggattcaagcatatgaatatcattcccaatcaataatatgtcatctacatataggattagaaacaccaatgcgctcccactaatcttcttgtatacacaaggctcttcttcgtttttgacaaagtccaacgccttgactacttttgtcaaaacgaatatttgaactccgagatgcttgcttcaacccataaatggatttctgcaatttgcatatctttttagctgattgtggatcaacaaaacccttgggttgtgtcatgtacacatcctcatcgagatttccattgaggaaagctgttttgacatccatttgccatatctcataatcgaaataggcagcaatcgctaaaaca

SEQ ID NO: 85295 - DNA, 620 bp, Oryza sativa
aacaaggcatgcttctaggttctcgtactcctcaccacgatatagaatacaatcattcggacatgcgtgaatcttttgaacatccagtcctagagggcagactatcttcttagcctgatacgttgtctcgggcaatttgtttccccccggaagaatgttcttgaagagtttcaataaatcgccaaatgccttgtcactaacacaattttttgccttccattgcaagaactccagagtggtatccaactttttgtgcccctgctcgcaacctgggtacaacaatgttctgtggtcctctaacatcttgtccaatttatgggcccccttttcactttcgcagtcctccttggcgtcctgcaacatctgaccaagatcatccgcaacgtcgttaccatcagcatccctttcctcctcgcccatttgatttccttcaaatccagtgtactgagcaaagttcggaatattgtcgtcttccacttcatcttcttctatttcaataccttgctctccgtgggatgtccaacaattatagcttggatgaaccccgactcaaacaagtggaaatgaatagtcctggatgcagaatactccttctgattcttacacttattgcatggaga

SEQ ID NO: 85296 - DNA, 909 bp, Oryza sativa
aagaagaatctagttagcgtctctactatgtagagaaggttttagacttgtgtttgaatccaattaatatgtcctatctaaatttggaacttttattggaaaaggttatgacagcagaggcttgttccgcttttctttggatgacatgtgtaataataataatgttgtgaaccatattagcgagaatgatgagtccaatgtgtggcattcgcgactctgtcatgtgaatttcggttgtgtgacgcgcttggctaatatgagtttaattccaaaattcactttggtcaaaggttccaagtgctatgcttgtgttcaattgaaacaacctcgcaagcctctcaaggcatctgaggcgagagatttggcacctctagaacttgttcattccgatttgtgcgaaatgaatggcgttttgactaaagggggaaagaaatatttcatgacactgatagatgattgcactagattttgttatgtgtatctattgaaaacaaaggatgaagcattgcattactttaagacctataaagttgaggtagaaaaccaaattgaaaggcaaatcaaacggttgaggtctgatagaggtggggagtatttttccaatgagtttacatctttttgcgaagagtttggaattattcatgagaggacgcctccctattcaccccaatcaaatgggttagccgaaagaaagaaccgtactctaactgagatggtgaatgccatgttagacactgcgggactttccaaggaatggtggggtgaggcagttttgattgcgtgtcatgtcctgaataaaattccaatgaagcataaggaagtaaccccattcgaggaatgggaaaggaagaaattaaatctctcatacctacgaacatggggctgtttggccaaggtaaatgtatctat

SEQ ID NO: 85297 - DNA, 636 bp, Oryza sativa
gaatatgaattcgttcatttgcatcgaagtcagggcctcctgtcagggttatgggtaccacatatctaatagtagtggactaaatctcggtagtatccaccacatcccatgtcctatacggaacaaccctgtggatatagaaggagttcggaataaggaaagacaaccagagttttacatgaaaacgacaaagactactcgaattgtatcaatattggtttcccaatttctacttgaacaagagaaatcttatgtgtataaatgcaagctcccttagaagaaaagggggtacaatcaacacacgaccacttcaatcaacacccaacacaatcgacatagaagccacaacatagaagcctacatacgccaagacacgccgtcggatatcaacttcagggataaacacggctagtaccctacggtgtctccggatactgtcagaaaagatgaaagcgctatctctgatctcgccgggcacggattcgaggtgaaaggctaccctgttgtcgactacgagtcagatcgtcagaccgccatgtcgacaacagttagataggctaccccaagtattgtactggtgtgattatcatgaataagagcaatactggcttcggccaacaggatgtagggttatta

SEQ ID NO: 85298 - DNA, 800 bp, Oryza sativa
ttttttttttgacaagaaaacttgcagggctttgcccagcagtgtattttaaataaagaaaatatttacaaggttacaaagatacatgcggctcacacagagatactataaggtttgtacccaattaaaaatagtttgctttaaaggatcattcattctacacatatgcagaagaacttctttgtgaaaagagatctccatgcctggaaagagggttgaatgttctgaaatatgaagccatttctttgtttccagatgtgccaagctgccaaaaagaaaatttccaggaaacccttctgagaaaatttgattcttgctagggagatcatttggaaaaactccaaattgttattccactcaattcccaggtattgccaacagctgatgctgaaaggacataaaaagaagaggtgtagccttgtctctctgcagttcgcattgcacaaaacacacgtgagatcatcatcttctttggcacaatgtcttctatccagcatatctcttttattaagtctatcacaaaacattagccaggcaaagactttgatcttcatgacacattttgttttccatagccaaatcatgggtctggggggttgcaatgcagaataatttagcttatagaatttcttagctgtgtacttatctgagccccagataaaattccaagcatcccccatccctgattgtaaattcaaactgtccagaaccccctgaagttgcaagaattccgagtaagcctcatccgagaggggtagagcaaaagaatcttctaggggtcttgaacacatggccttgac

SEQ ID NO: 85299 - DNA, 603 bp, Oryza sativa
acccaatgttcacagcacatggatatgcccaccaacaaaccccttatgtaaacaagggaaaacagtcagctacatcctgttatctttgtacagcgtgatggtagtacaagttaacgcataactcaatgcctctgcacacagggggaaaaggaaacaaaaataaaaggaatacatacacacacgaaaagccaactgctcaatacatgaacggcatctgtctgttatatacagatcgaatgaatgaaaccagctcatccaaagagatacccatatgatacacaaaacaatatgatctagtggttagcatcaatcggtgcaccaaaccttgccttgtgatatcctgttgcatagattgatactaggcgcagctgcgtgctattaagcccctctagatatggtacaaatgctttctcaagcataatgtagatatccaccaagcagaatacaacagtctgaaagaaagtgaatacgatatcagattccaacacaggacattcatttttttaaaggtgatatgtattaacgtgcacataagcatatattattacacgtagcttctgtaaacaaaagctggaatgaatttaattatttaaaacatattga

SEQ ID NO: 85300 - DNA, 601 bp, Oryza sativa
aagtataaaaggaggaccttgcccatagagaaggggttgattctggccagatttagagcttagagcgggggagaagtgggctcacactttgtagctcattcatacacaaatccacaaaaacacaggagtagggtattacgcttcgcagcggcccgaacctgtatacatcgccgtgtctcgtgtgtcttgccggggagtaatctttccacatacagttaaatttttgagagagagcttgagattgcaccctaagcccccggccgaaccggcaaaggggggcctgcgcggtctcccggtgaggagcctcgagctccgtcagcttgtttcttcgatttgcttgcaggaataaggttgatttgcaccggcaagatcaacaacccacggagaggtgtatcgatcgctaaggcgcaacacaacgtctcgtacggttgtagtcggatcgttaacgtttctcccaaatcgtagttatcacaactctcatcatgatagaccccccagcagccttgagtgttgaaaagtactcagggttcatccagtggtatcacatcttgcgctgttcggtgagtttttatcatcctatacctagacaatagccatccaa

SEQ ID NO: 85301 - DNA, 506 bp, Oryza sativa
tactagagaaattacccctgtgatccgaagagtctaaccgatttccacctttttgtagttcgctgtcaaatgagctggtagttggggtgcttgacttaacataagctagaaaagcagaagactcagcaaccctcaagttagtctttattggacgtgaaaacattactccgggagatgctggcataaaagcaaaggcataaaccttagaaactattcttcaattgggggatctgctaaatcagctaaaggaaatggtttaaggctcaagatacttacaagcttggtcgccgccttcagtagagactagtaaaccctctggtgtgcctttttgtttaggctcagcatcagaaggattagactgcaaacatatcaagaaatgcaagggcatttaacaagtagactgatgcaaaaaattcagcatcttatcatcatcaattgaacatatgaggcaaaaaggcatgctctagcatctaaacagaacacaaaggtagaaagatactaaatag

SEQ ID NO: 85302 - DNA, 586 bp, Oryza sativa
  unsure (1)..(586): unsure at all n locations
ttgtttagcacttttaaacttagcatgccggttttgcattgagacaagcaaacttctagtcntgatgcatccttttgagccttcgtttgcttcatatgcctagatttacacaacctacataatttattggtgttgtagatcccagatgtactagctatccttgacaaaaatctgatattactttattcagtgttatgttcttatgtagagtcacttctgttatttcagttgacatggatttgtgcccatcttttgtgcaggttatacgcaaaagaataatcgagaaaggacttagagttgatggcaggcaacttgatgaagttaggccactctactgtgaatccagcacatatccaatattgcatggatctgccctgttttcacgtggggatacacaggttctctcgcacacactttaaattgaaggaacattgcaacatttgttttccagtaaagtgaccacccacatggactactttatttgtaggttttatgtacagttacccttggtgctcctggtgatgctcagcgattggattcaattgttggtcctccaacaaagcgtttcatgcttcactacagcttt

SEQ ID NO: 85303 - DNA, 678 bp, Oryza sativa
caccctgctaattttatccttacacgacagcaacacgtcgtggatgactcggtcaaggttggtgtccccgggcccacctggcagcgtcactcgtacagccttctctttccactcttgtgcacgccgccgtatctcacgccccttcttcccctccatggcctcccgtatcatcgccgccacctcccctcgccgcgcgttaccgccgatctccatcccgatgccccactccgtcctcttgtaccggcagttcgtctgctgctccgcgaagaagggccagctcagcatcggcacgccggcggctaggctctccagtgtcgagttccacccggagtgcgtcaggaacacgcccacggcgtcgtgctcgaggaccttctcctgcgggcaccacgccgggaggacgccacggccctcgacggcggcgtggaactccggcggcagcgcggcggcgtcgccctctccccccttgacgaggtctgggcggacgacccacacgaaggcgtagccgctgtcggcgagcccccacgcgaactccagcagctgctcgctcgtcatcaccgcgatgctgccgtagctcacgtacacgacggagctgggccggtggccgtcgagccactcgaggaggccgtcctgctccttccagaggttggaacccacgccgtgcagcgggcttccggtggg

SEQ ID NO: 85304 - DNA, 937 bp, Oryza sativa
tcgtagggttgccccattgccatccaatgctaccctgaaatcactggggttaattgatagaaatggagttgtcctgggggttagctttgcatttgttaaactcggcttccctggagtaggcctcaggagtactattctacttggcaaggagggattttcttccttaaaattagaactctgatggaactctctcattgctgctccattttgctcttgaatttgctcagttccagtttgtcttgtgccatcactctcaaaagaaccaagtggctttagtaccgtaatccgttttttctgaggtggtgctagattggtgtgagaccctaccaactgtcttgagaaaattgagttaggttcttcaagaaatttcagaaacaaatctttgtttgaacttacaaccctaagagcttcttgtaagtcctttgaatgaagcggcttctctgccatgcctaagcattttttctccatgacacttcctcgcaaaatatccactctgttacttgtgttcccagaagaccctcctttctgcgaaattttgtcctgaaaatagctcatccgtgtttgtgcttcagatacttcatacacatcattatattgaactgcttcctgacaaaatgggtggatatcttgtgtcgttgactttatgagacgatgctgctcttgttgctttaagtctttgtttagtgcttttaactggttacatgattgacttttcctgaaaccacttttggcctggtgtaaaactggtccattagcaggtagatcctcctcaaggcccattaatcgggcaacgacacctggtggctttctctttaattccacttctttagtcatctcttttgctaataacacttttaataaagttgcatttgattttctacgtgaagaaccatcacaaggtgcctggcgagaaacccttttttattattaaaaaaag

SEQ ID NO: 85305 - DNA, 714 bp, Oryza sativa
tgtgtaaacctaagtaatagcaaagtacttatttaggtagtatataattcgcatcaatattgaaatatgtttcagctaggagcgagttcacctcttgttgtagtttctttgcacggctacgtgtgatcggtccttgaaatggtgtaacggattgtctctcatcagcggctaagtcagatgattgtcttgagtgttcatgtgacagggctggggcacatcatcctcccccctcttgaaaaggagtcgttctcgactctgtttcatcaaaaccataatagggtaagatcggcaacattgaatgacgcacttacaccatattcgcctggaagatcgattttgtatgcattgttattgattttggcgaacactttgaatggcccatctcctcgtggcatcaattttgatttgtgtctttctagaaatcgtttcttacgtagatgaacccaaacaagatatccgggttcatagaccactttctttctatgcttgttcacctttccagcattactgcgcaccttcttttcaatttcttcattagtcttttcatgaatcttcttcacatatgcagcacgctttgaagcatccatgttagttctttcctgcaatagaagaggtaacaaatcgattggtgcagtaggtttgaactcataaacattttcaagtggacacatgtttggattaatttccctaatttcaatggacggttccaggaga

SEQ ID NO: 85306 - DNA, 642 bp, Oryza sativa
tcgccgccgactggtgtccccgcctatacgtcggttggtcacaccaccgttgatgggcatcgtcatcttcaccgccggcctgcctccgtcgccgccgactggtgcctccgcctacacggctggcctattatgccgccgctgttgggcgtcttcgctttcaccaccggcctgcctccgtcgccgccgactggtgtccccgcctatacggtcggttggtcacaccaccgttgatgggcatcgtcatcttcaccgccggcctgcctccgtcgccgccgactggtgcctccgcctacacggctggcctattatgccgccgctgttgggcgtcctcgctttcaccaccggcctgcctccgtcgccgccgactggtgtccccgcctatacggtcggttggtcacaccaccgttgatgggcatcgtcatcttcaccgccggcctgcctccgtcgccgccgactggtgcctccgcctacacggctggcctattatgccgccgctgttgggggtcttcgctttcatcgtcgaccgccttcgtcgccgccgactggtgtcttcattgttattgatggacgactttgttcccacattggccacttctgccatcaccaaggggaatattacaaagctaagtcatcatttatttt

SEQ ID NO: 85307 - DNA, 888 bp, Oryza sativa
atccttcttttcagctcgcggacgagctgctcgtcgagggggggagagatgtcatgtgggggcgccactaccaccgcaggagcaggccggaggcacagttgcagcaagcagcatgagtcaaggttgcaaacttagaaagaatcatgcaaggaaagtattaattaggaggaaataaatgtcattccttgtatcagaggccaagtgcctataaggcacgtaatcagcaacatttgaagataagcaatttgagatcaaaattcctaatctccctccttgttccctaacctccctctgttcaccattgagcgtgcagggaagaaccctgccgccgcccctgatcccggctacgaactctatagccgcggtccggctatcctcggtgtcaacgcacttgacatctcaataataatttcatgacttcagctttattttctaattagactttatgactagaaaagaagtatagggatgcacaatcaatatcaactatgtttaagaagtgccaattactcatttgcatgtcaaaattttggattccagggtcaaactaaagttgaggatttaactaagcaagttgatatcaccttattgatcatgttccatcgtccgccagtaggcacacacgttttctcattcccggagacatggtacttcagctgaagattgaacaattaaattttggaataagtgacaaattttttcttcaaagttcaaatgaaatgcatctaaatgcagcataaatacctcaggtgtaggcaagatgcggccacacacaatggcaggaagaccattaactctaattccaaactcctccacacacctctcaacgttacagttgttgcgaacctgccagaaatccaaaatttgagaatacaagtatcgggcatg

SEQ ID NO: 85308 - DNA, 2695 bp, Oryza sativa
aaaacgcattttccaagcagcaaaacaagccgcttgtgagcaaatgtatgtgaaaatggggattttcacaagtggttggccagcccgtacgtgaaaaatcaagctttcatattttgattagctacaccacttttttttgatgaaatatatacgacttatggtgtataggatttggactcgagacctcatagtccacacacatccatttaccatctcattttcaagtacttgttttgaattaagatgctattcttttgacttcacctccccgaaacttgaaatgctcatttgatcttctaaatgatcttaaatgaaaatatcatcacttacgaagttgtaggtctggttgagctcgacatccctcattggaggtcgtttgaaatatagatttgagatttataaaaatagatctataagatcttgtcgtaactttttggacctctaaataatctcaaatgaaaaagttgtcatttataaagttgtaaacctcgtcaagatgtacaagtttgacataaagcttatattcatcgcactttatatgaaaaaagttaggtgtagatatgtttttttttttggaaaactgattttcacaggtaagtagattaagccgctcacctgtgaaaatgctacgatgtacacttaagctacctgcatgtgaaattgaggtcattttcacatgtgtgcggcttaagtgtccacctatgaaaaccggttttcttataagtcctgacagaggattctcttcacatttttacaagctggttttcttttggatcgtttatgaaaataaagcaggggtgcctgcagaaatggttttttattagttcaacttgcatataatacaagatcatgctaggtacaacatcattatctacgtatacatatactattacattattgaagtaatatattgttataaataaaccatgacataaagtcacaatcaccaatcttcatattatcaccgttagaaggtacgctttggtgcttcatattatcaccttaattatcttaacttctaacacacaagaaccattttcttcttgttggactatacacttatcaatatgttgcaattgttgtgcgcgactcagggtcgcctgtaataacgcgtggggtttcatgcatcttgttcattacatgccggaccatatttcttagcttccaatccaacatatgtcgtcttgattgaatgcatcttgttggctatttgtttcatgttcatgcgatcacttggtaatttgcgcgtacaagaaagcgcaagttgtagcagagatatcaagcactggtggacagcattttccagtgtcatatttgtttgattggagtccatggacttttctgcgagtcgagcatcaatcacttgaaatatctggtgtggaaagttactctcgacaaagctgataatgtcgagtccgtctttgaacataggatcagtcggtctttttcctgttataagctccaggatcactatcccgaaactataaacatccccagaagtagatggatgaccacctcccgcgtactctacataggtatgaagagaaagtacagttatctatttagctgtctataacaaaagctgaaactgaactcagaagtagccatattaattacctggaggaatataccctatggtacccttaacaccgactgtactattcgaacctgttgatgtcgaccaagagtcgatataaaatcttgcaatgccaaaatctcccaaaagagcattcatgtcatcagctaaaagtatattgctgggtttcaaatcacaatggatagttgttcttccgcattcatggtgtaaatagtccagtgcatcggctatgttaacacatatgctaattgtttgtcttaaacccaaacgtccgggagctttcccaccctctttgtcatgtatccaagtgtccaagttgccattaggcatgtactcgtaaactaaagctttgaaaacgttgcccgtactgtccacggtcgagcatgcagttatgattggaagaagatttctatgttgaatgcttctgagagcttcacattccgatatgaagcttctttcggcacctcgcatctcaaggtcaaaaaccttcacggctacttccaacttacattccttcaacttacctctgtacaccgtaccatagcttcctttgccaataaggttagcctccgagaagtttcttgtggcttgagctagatcattatatgagactttaaggaaattctcaccaaaagattgcgaggatatatatttttctcttggcttcatcttctcaagaagtaagaagtagaccactaatatgagtgacatgaagccaaatatagggatcaatactctaatcaaatagtactgtgtttttcttctctgggaaacaacttggcatgggggcatacggagatccatcactcctccacatagtcctatgtttccctggaccgaaacaacagtaggatttgcaaatattccagtcattggtatttttccttggagacgattgtatgaaaggtccagtttgctcatgactggtagatcatttagtgtagtcggaattgtgcccgacaagctgttatgggaaagattgagtacgcccaggctctttaggtcgccaaaagttactgggatattgccagtaaggaagttattgcccatttggatgtttgccaggtctttacactggctcaaagtgccaggatctcc

SEQ ID NO: 85309 - DNA, 1122 bp, Oryza sativa
ttgagttttgagttagggttttgagtttagtcgaaatttttgtaaggagtgctgttggtgcactttgtaaacacagagagaagtaataaagtcgtcatccactttaagagttcttcgatttatgtttcaccgggtttcggcggtctaactggcggcgcaccggcggtcagaccggcggcatcgcggcggtccgaccggcgaacacacgacggtcagaccggcggcgacaggagtccacggcaggctttctcggcggttcgaccgatcgatctacatcggtcagaccgacgttcatcaggcggtcagaccggcgcaactacttcggttagaccgcgatccatcgatttcgagggtaacttttatttccgctaaaagtttttcggtttttgggtataccaaccattcaccctcccctctggttggcttagttattgtgattcgatcgtacaagtggtatcagagcctcgttttcttttttggatttttatcgatctaaagttttttttgccatggctactcccgctaggttttcaactaagcctcatattttcgatggaactgattttcctcattggtgtagtaagatgcaatcttacattatggctgaaaattatgatatttggaggaaagtttctcatccttatgtgattcctgaagccattaatactgatgctttaaaaactgaatttgaaaataattgcaaagctcgtaatattcttttgagtgggatttctcgttctgattatgatcgtgttgcacatcttgaaactgctcgtgagatttggaatgctttgaaaaactttcatcaaggaacaaataatattaaagagcttcgttgagatctttttaaaaaggagtacattaaatttgagatgaaatctggagaggctttggatgactatctttctagatttaataaaattttgagtaatcttagatctgttgattcttcttatgatgctaattatccacaatctaagatttctcgtcactttttgaatggtctcgacatgtctatttgggatatgaaagttacatctattcaggagtctgttaacatgtctactttgactttggattcactttatactaaattgaaaacacatgagatgaatattcttt

SEQ ID NO: 85310 - DNA, 1421 bp, Oryza sativa
ttcctgcagcctggttcctctctgattgcatggaagaccaaaaagcagactgcagtttctcgttcaagtgcagaagctgagttacgagctatggcagccttgaccgctgagatcacttggctgcgttggctcctggaggattttggagtttttgtctctcccccgactccactcttgtcggacagtactggtgcaatcagcattgctcgagacccagtgaagcatgagctaaccaaacacatcggcgttgatgcctcatacatgagatcgcaggtgcaaaatgaggttgtggctcttcagtatgttccttcagagcttcagttagcagatttcttcacgaaggcgcaaactcgagctcaacatagttattttttgtccaaactcagtatggttgatccaccatgagtttgagggggggggggtgttagatgtattgtatagctagctgtgtatttactcccttcttgagggtgctttcttcatatttgtattgagctttgtgtatatctgtttggcccagttggcccatttaatctgtggtccaatatttgcaacagtctgaatgcatctgttggtgtggttgttatgggtggcattaaccatattctgatgcataattgggaggtaccatgtgcagctgaaatttccttaaaggcaagttcttactcagcaaagatccctatcgttgaaggagaggttaaagttttcaccgaccatcacaatcaactatacacctctcatctaaaactaagttcaaaagaaggtcagaaggaggtttaagtgcgtttgtatgttgatggctttttagcattaacagcgaagtcttgtcaagtggagaatgaagaagttttgcgggatgaaaagggcgaaacatgtacagataatgataaggtaattgccattctgctttgagtatgccaatgcaccttaatttatgttcatggaaattttttatctagtgttacaggatccataaagatctgattatgaagtatagggatacaattgataaaatgatcgctgagaaggcgaagagagctatgaatcttttcccctctacagacccgctgctgcttctgtccagtgagaccgagagcatgctaaaattgccttagagggtaaggctatgagcttcttcttcttcttcttcttcttcttcttcttctttttttttttttgcattttataatatcaacagaggtttttacatgtgtgttctttatttccagctatggagatgtgtaattcgaggcacttgttatgatccatttgtaaaatcaaatgtgtttttgattattattctgtgatgaacaattgggcattggagattattggttttgttatttggaatttattcacgaagtggttttggagatgattggattcacaggtgaatatacaggtactgctgtggttttatg

SEQ ID NO: 85311 - DNA, 691 bp, Oryza sativa
ttaagtcttcaccgaccggcttgcctgagccgcccccgactggtgtctccgtctgcacggctggcctattatgccgtcgttgttgggcgtctacgactccaccaccggcctgcctccatcgccgccgactggtgtttccgcctgcacgctggcctattatgccaccgttgatgggcgtctacgtcttcaccgaccggcttgccttcgccgccgccgactggtatctccgtctgcacggctggcctattatgccgtcgttgttgggcgtctacgaccccaccaccggcctgcctccatcgccgccgactggtgtttccgcctgcacgctggcctattatgccgccgttgttgggcgtctacgtcttcaccgaccggccgcctcgtccgtcgccgactggagtttccgcatgcacggctggcttattatgccgccgttgttgggcatctacatcttaatcgccggtcgtctcgtctgttgctgactagtgcccttacctctacgtctggtttatacagctaccactactgatggacatcatcatcttccgtcgccgactgattatgccgccgccgactggtgcttttatcttcacaactgcgcgtcttcactaccggtttgcttctgttgccgccgacttgtgttcacttcattacggcaatacaactttgtcatcatggtggggcgacttca

SEQ ID NO: 85312 - DNA, 1253 bp, Oryza sativa
ctacaactcggcctacgcgcttaacaagcttgcttttgcttagtacctgtagcgagagtgaagcctcggccggcgatggtgcaggtggcggagctgatgacgaggatgtgcctccgggaggcgctggcgctggtgcgggcggtgctgtggctgctggggacgcggctggggacgctggcgctgtgcggggggcggtgcgtgtcgtgggggaggtggccgttcgtgctcacgttcgcggagatgccggtggagcggcgggaggaggcgctcgggcggtggagcagggtgaccgtgctcccgccgctgcgcgccttcttcctcgtcgtcaaggtcttctgcctctacgtcttctactcctgggtaaccactcctcctcctcctcctctcatggcctctcgtacaccgctgatcgatcagctgcgagttcattcacgttagatttttttttctcgcgttttgcccgcgccacgcacgtgcgcgcggtgatttttctctcgacggatgcacgtacgtacgcccgtgagggacggactaagcgttgtggggactgtttatgtatttgtcaggtgatttctaaaaaaaaaatcacctagattttttttacccttagatttacatgcaacgaactacaaaagaatataacaaatacatatttaattacacattatttttatctaaattacagtgcacttacatgttatatcaacctaatttataaaatataaatttagttatataggactgtaattttatattttaaagaaaatacaaatatatatcgattttgctatatatttgtcgacaaatttttccccaaaaatttgacagatgtaattacagtacaatcgtagtgtaattacgctgtaactatagtgtaacttgtatgtaactttcaaaaatctctccgtaacatgttatttcggtaaaatgggggtcgtgggaacaaatcctttcacatatgtgtgtgatatgatttgttttcttcctcaccaaaacaaatcttgtaatagatctaacgattcaaaattatgtgaaacttacatataagttacactgtagttacatgtaagttacagtgtaattacatataagttacagtgtaattacactacgattgtactgtaattacatctgtcaattttttgggaaaaaatttgtcgacaaatgtatattttacatgtaagtggttgtatggaggccaaaaaaagtgtcaaatgacagcaaaaaaaatcacacgagagatgatagcaaaa

SEQ ID NO: 85313 - DNA, 693 bp, Oryza sativa
agcgtgcaggcggaaacaccagtcggcggcgatggaggcaggccggtggtggagtcgtagacgcccaacaacgacggcataataggccagccgtgcagacggagacaccagtcggcggcggcgcaggcaagccggtcggtgaagacgtagacgcccatcaacggtggcataataggccagcgtgcaggcggaaacaccagtcggcggcggacgaggcggccggtcggtgaagacgtagacgcccaacaacggtggcataataggccagcgtgcaggcggaaacactagtcggcggcggacaaggcggccagtcggtgaagaggtagacgcccaacaacagcggcataataggccagccgtgcagacggagataccagtcggcggcggcgaaggcaagccggtcggtgaagacgtagacgcccatcaacggtggcataataggccagcgtgcaggcggaaacaccagtcggcggcgatggaggcaggccggtggtggagtcgtagacgcccaacaacgacggcataataggccagccatgcagacggagataccagtcggcggcggcgaaggcaagccggtcggtgaagaggtagacgcccaacaacagcggcataataggccagccgtgtaggcggtgacaccagtcggcggcggcgaaagcaaaccggcggtgaaaatgtagacgcctgaca

SEQ ID NO: 85314 - DNA, 644 bp, Oryza sativa
agcctcggcacggcggcgagcgaggccgggatggcgccggtgaagccgttccgcgacagggacaccttcttgagccagcccatcccggcgaacgcgtcggcggggatctcgccggagaacttgttcccggacaggaagatggcgcggagcccgccgaggcccttcacgtcgggcatggcgccggcgaactcgttgtccatgaagctgagcgtgcggaggccggtgaggctcttgagcggggcgaggtcgagctcgccggacaggccctccttctccagctgcaggccgagcacgctgcccttgctgcacaccacgccggcccacgccgaggtgccgccatcgcaggggctcgtgccggcggcccaggtgtccagcgcgccgccgccgtccacgatgccggccttgagcttgagcagcgcgtcggcttcctccgccggcgccgccgccaggaggcgcgcggcgtcggcgaggaggcagaggcaggaggagacggctagcacgcgcaggaggcacggcgctccggccatgtccagcccgccggcgccagcgcctcgacgaccgcggggcggggtggtgggggtggcgcacgtagctttctccggagaggaaaagtaggagagatcgcggggaagagagctgattca

SEQ ID NO: 85315 - DNA, 872 bp, Oryza sativa
caccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcaacctgatgggtttgtagttgaaggtcaagaaggcaaagtgtgcaaattgttgaagtttttgggaagcgcttcgcgtgactgctccctgttcgttcgcgacggctcgccttcctcttcgctcgcgtgtttcgtgccttcgtagacacttgcgaaaagtttcgaccaagcagccggtctttccgtcacctcggtacgtgttcaatatgttgcgcatatttgatctgttcatgttatactgtgtagtttacatgtgtagatctaatgatgcgttcatgctagttttcatctgtaatgtcaatgatttatttatggaatagattaaatcattctatgtctataatctcaa

SEQ ID NO: 85316 - DNA, 1772 bp, Oryza sativa
acatcattatccactagcaataattacatataaaacttatgtaagcatgcaatatcatctataattcattgaattttacaaatcatcatccaatcatcttccttcacattatttttaacaatatgcatttttaacaatatgcatatatgtatccatcatttttataatacttaatatatattcatccatataatcaagtgcgggatatcatatttcatctataatttcatacatagtctgctaaatgtatctctctgaatatagtttgacaaaccagttttatttattgttaataactaatataatttttacttttatctcgattattaaaaaatatttaaagttacatagaaatttccacagcaaagcgcggggaatcacctagtatctttaaggcatacacccttcgttcaaaaagaatcatttctatggatgaatctaaataaatgcatatccagattcctaataagaagtaccgccgaacaccaccaaacacgactttgcaaacacatagaaacaatggagtatgtggaccttgccgacacaatgagcaatgcatcatctgagagagacaaccgccgcaacgggtgaccagattctcggtgtagatgacccaaggttcctcgtcgtgcattgcgtcaagcagatctagggccgaagggcgtgttctaaaaaaaaagaaaggcaatggctcaagaacttcactgcaaatatgcggatcttacactttggaaccaaaatgggatagcggcaaacgtgtgcttggaccattataagttgggccggaatggtactgggacctcggtgagggccctttttttcctcaatgtgactgaagccaacatgagacccatgataggttgatcggcttccgatcggctccttttttttaaaggaacacaacaggggaggcacctgttgtttgggaaaactttattaataaagtaaaaggggtctgaaaagaaaattgcaacaaactaatccagctcatggctacatttttgtctctcttattcaatctcaacaacaaaaggagaagattaccctgaaggagctgcctccaagaagttgtgccggaatgggtttaccacttacatgcaggctgggccggaaccatcggtacgccagaacgactatacacgtaggtgaatccaaatcgcaagacataaccgacgtttcattttttgtattttctagttaatctatgcttttctagttaatgaggccgaggatgtagtcgttgatgaacagctgcgactcgaggaaagggacgagctggtggaaggactgtgcgccaccagctcgatcgtgagtgccacagtggagagcggagttcagaagcaccttgagccaatgagccatgtgctgccgagtgaagaagctagcgccctgatccaatgaaccatgtggtgccggacttagagaaggtagcgatgaagacgttggtggcacgcgcagtcagatgcctcttgttgagcatggcgctcacaactccctgcctggacatttaccagccatcgggacggcggcagcatcagcatgacttgctctgacttgttgatccgtcggccacttgggccgttgaggaatgaggaggcgaccatcactagtacaaatccttctatctgtgacgggctctaatatgcttagaaatagcgggccgtcacaaggaagtcatcttaatcgagccgaaaagtgcccgattaagatatggtcgtacagacatgttagatgggtataaaacttaaacccgtcacgaataacacctatca

SEQ ID NO: 85317 - DNA, 1471 bp, Oryza sativa
cctgtgtttcttttagctgggccggctgaagataagccaaccatagcctgtgtttttagtactaattctatttgggatcaacttcagatattctctctatgggcagaaagtgacaggaagtacgggggctgagtttgtcatctgaagatgtgggtcaagtgcttgcaatcacaggtagcattttcttgtgcttttaccagtgctattgatgatagtatcctgcagaaaatgatgcatgtattttcttgtactttcttcctagacgaccaaatcttgtttgctgattaaaatagagtgccaagaactgaaaaggcttgagcttagacaaaaaccaaccagaaactgaatttgaacgattctaaggtttctaactgaatttcacattcttccgtgtaaaaaatgcttatatattactatggaaaatttaacttgagttctgtggattgggagtagtctgctgaaaagtgttattagccagtgcttgcaagccagatagaacatccaagttctatacttcatctagtaatgtttttgtggctcaactttctgttatttgtaatggcaatttcttttcaggtgtcagtcttcttgtgtatcaactcttcatttatcctcgtatcaataaggttatagggcatattaaggcttctcgaattgcagctgtgagtaaagagtttccattatattgttgggaagtgtatcactttttttctgaatgtcttacctactgttctttatcttgcagattctgtgcatacctattctctttgcatatccttatatgacatacctatcgggacctggattaacgatcatactgaacattgcgtcagttataaaaaataatcttggtgtgagtatatttccatgtcaaattttaggaatctatgtatgcgattttcagggccgatttgtgcaagaaaaaggtagctttgatatttaaggactgcagtttgccaagtgacagacattaactcagaaatttttatacgacaataggacaagataaatatgatatacatctattattattatccaatctgaccttttgtggtgaaaatggagttgattatacaagacaagacagcacatataaaattattttctcatcttatgtatttgcaactttgatgaaaatttatcaatgttaatgtataaataggttcttgttacactctcttctaatttatgctatactatgttaggttaccatcattacaggctgtttcatcctacaaaataatgctgtggtatgtacccaagataatggttaatttcgacaacattttatacaaaattgcttctgattgatgattgtaaaactgcttacagcctcaagaccaacgaggggctgctaatggcttggcaatgacaggaatgtccttttttaaggcagtggctccagcaagggcgggcattgtgtgagtatactttatttagtgtaaccatgtaaaatgttttatgagtatac

SEQ ID NO: 85318 - DNA, 514 bp, Oryza sativa
tagagttccgggtatcgagctacgaactcaacatgcaagagaaggtggcaaggaaggttgatgaacgcatgcccacacatcggtcccatgatccccagccgaccattcttcttgaaatggtgagcccgtcagaaaacagtagcagctgcgcctcaacggggcaggtaggatcacagagcatggacgccatgcaaacacaggacgaatcgacctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactcgaaggtcgaagttgagttggtcgaaggcgcgtacgaggacctcgagctggattaccctggaggagacggtgagacgcatcta

SEQ ID NO: 85319 - DNA, 514 bp, Oryza sativa
accccaattattgaatttgaacctccatccaaaattgacaaaaagttgcataaccgttgtttcaagaatacggcatgcagcctttaaaagctcactatcttcctcacacttttggggtatatcctatgtgataccctaaaacaaaaaatttttgccatctaaactgggccgtagtacatgtctcacggtccttgtgcccctcattctgatagagcaactatgggcatcgggaatttctatctaaatatatgtatctctacttttggtggtagggtggtttttattggtagtagggtgttttttatgtcttcattctatctataagctaacaaattttataataaatggccgtaccttctttaaagcaaaagccagattttatccattaaaaaaataggcatcgggatggtatgtgctctaatctaccagaaaaccaggtgaaacatgagatagtgtgacaatggaagaaattaaggagatgattagatgattagatacatacacaaaccaacac

SEQ ID NO: 85320 - DNA, 550 bp, Oryza sativa
aaagtgctatgggtaataataccaccttcgaaatctaagtgaagaggtctcaacttaaatacggagctagtcgagagtctctgttgaccggttgagatggtgcgcggacaaccaggcggggcgaggcgaggcgaggcagacagttgctgctgcgctctctcattttgtaacagacggtaataaacacggagaattgatttcgtatcaatgaacgcgtcggttacggaattaaacgccgtgaattgatttgattccgtcggttacggaattaaacgccgtgaattgatttgattccgtcggttacggaattaaaggccgtgaattgattccgtcggttacggaattaaatgccgtgaattgatttgattccgttggttacggaattaaacgccgtgaattgattctgtattaacgagcgcgtcggttacgaaattaaacaccgcggttgatgactccgaacgttactctcgcgctcgcatatatatactccgcagcgaccagaacgacgacaaagttcttcacgactcttgtacttcgagttcctcctcct

SEQ ID NO: 85321 - DNA, 1414 bp, Oryza sativa
cccccccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacaatcatattaatttatattttaagtcttctctagctacttaattaatcatgcgctaataagatacctccttttttttgtcacacttctttttgtcacacttgtttttttgacaaatttttaggcccatcgcttggcatattggaggaaaaagtgaaacgacatattcgtaaatgaaaaatgatttgtgaataaatcttttgtatacgtgttcttaacgatctaaaagcaccagttgaaaaaaaaaactacgatgaaaaaaccccaaaatcgagaaactttactataagaaaagatgcataacagatggatgatgcttggagggtagaatactaatttttttcagtccattgctaaaaaagatttagaataaatatcatcttgcagatctgtgatcagtctggataggttatttatttgcataagcaaaatgtaagtctagttttaagaatagaatgaggatctctactttttccacaatgggttttgatttgttagatctattctcacatccaataattttggacagtcttgtatatcctttctctagcttgattaacataatctttctgataaagccctttgccaaatgggtttaatggttatttcttgaagaaatgttggtatatcattgctaaagatttttacaggcttacagctcactttcatgctagttgatatgaacccactagggtataagaagagggggagaatgaccacagggtcgtgctctaaccctaggatacgcccctaatgggcccaacttataaacaatccattcgacccaaaagaggtgacgtagcaccgtgaacaaaaaatactcggtagtaaaacgacaattgcggctgctccataactgatatggacatgtggctagatccatttgaaagtagacttgataagctttccgtgaagtacttgcacgcccaaatcggagttcgcatgaagtcgtggcggccatcagaagttggcgctgtcctgcagtccgaatccaacccgcgtgaatcctctcccctttgtatcctctccattgttcctgaataaaacaagagtgcacatatctccggggtataaaaaagtggaacatgaactcaagaatgaactctcctgatagttgatttgacgtgcatgagcgtgggtaataggaccatgaagttgtacttgtggggacgtggatgtatcaatggtgttgatgtcctcatcatcctccccttcttgcattttaatcgtcctcgactcaagctcatcttcttctcccaaatacgacttcaaat

SEQ ID NO: 85322 - DNA, 4538 bp, Oryza sativa
agatttgaccgagggggtaggacgtaaccacagtgacccgatgcgcttggaaataatggcgcagtttcctcgaggccatcagaatagcgtaaagcatcttctgggcctgagggtatcgggttttggcgtcccggagggcctcactaacaaagtaaacaggccgctgcacctttcggcggggccgatcctcttcactaggggccgtatccccggggtgctcttcgtccaagtggcctctcggggcacactcgtctcctgcgctgatgacctcggggtccgaagatgacaggtgcggccttcccacagtggcctcggggccgtcctgggggtcgggggctcctggcgtcgtcagacacgcgggcaaagggccagctccggtcgtcaggggcctcaggcctccgttcggctcgggggcctcttctccctgctctctcccgggtcgaatcagcacagggttagcctcggggtcgaagggtggtaggtgcggccttcccgcagtggcctcggggccttcctgagggtcgggggcacccagcaccgtctgacaagcgggcagagggccgactccggtcgtcgggggccttaggccaccgttcgactcgggggcctctcctccctgcctgctcccgggccaagtcggcacagagtgggggtgcgcagaatgagaattgtcctcatcgcgctccacaaccaacgctgcactaactacttggggggtcgctgctaagtaaagtagcagggactcatttggctccggggcgactagaaccggaggagagctgagatacgccttcaactgggcgagggcattttcagcttccttcgtccaagtaaacggccccgagcgcttgaggagcttaaataagggtagcgccttctctcccagcctcgatataaaacgacttagggcggccatgcaaccagtgacgcactgcacatccctaagtttgctgggggggcgcatccgctctatagctcgtatcttctcggggttggcctcaatgcctcgggcagagaccaagaacccgagaagcttgcccgcaggcacaccaaacacgcacttatcggggttcagttttatgcgggcggagcggagattctcaaaagtttccgctagatctaaaagtaaagtttcttggttgcgcgtttttacaaccaagtcatcgacataagcctcaacattacgtcctatttggctacccaaagaaattcgagtagtacgttgaaaagtaggacctgcattctttaacccgaagggcattgatgtataacaataggttcctacgggggtaatgaacgcagttttttcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttgaggtcggtgtagtcgatgcacatccgaagcttgccgttcgccttgggaacgaccaccgggttcgccagccactccggatggatgacttcacggatgaatccggcctcgagaagcctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggcaatccgctgcctcggggcggtgggggcggaggtgccaagcctctcgtcaccaccctcgggcttggtcgcagcagcgaggtggtccgcgcgctgctccatgcaagcgagcgcgactttaaggtcgccacggacagagatggggccaccggggcccggcatcttcatctggaggtaggcgtagtggaccgccgccatgaacttcaccaacgcgggtctccccaggaccgcgttgtagggcagactgaggtccgccacatcgaagttcacccgctccgtgcggaagttggctgatccaccaaaggtgaccgataggtcgatgtgacccaacggccatgtgtgccctggcgtcacaccgatgatcggttgagacggctggagcaccatccccggggccttgatagcatcaaaggccgcgggggaaaggatgttgagagccgctcctccatctatgaggacacgccccaacttcacattgcagatggtgggagaaaccaccatcgcaatctgccctccccgggcaacgcacggtgggtggtcggtctggtcgaaagtgagagcaacctccgaccaccgcgcccgacgcatcgcctcatgagtaggggccatggccagaagctctcgcttcatagccttgaagctccggcgagagacgtgagcacacgctcctccatcgacggtggcaatggtggccccaggttcttggaaacctaggtcatcatcaccatcatcgatgtcaacagcgggggccttctgcttggcctcacttcgccgtttgctggaaggaaccgccggggacttgccctcacggcgttcctgcctcctgtcctcctcccacttcctcgttcgctcagccaggtttttgactgcacgacagtccgcgagatcgtggagggaggtgttgtggacggagcaccacctgccggcggggcgctccctgctgggagtaccagcctctttctttttgtcgctcgcaggcctcccctttcgagtggcccgcggagcgcccttgacggcgaggacatgaccctcgtcgccggaacggtccgacctcttcttcctcctcctgtcacgccgccctgtctgagcggcggatccgggggcggccgaagctgccactccggaaccggaggagttccatgtccacgcttcctccttacgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcaatcccggtcgtatagacctggagaaactcggtggggttgacgctcccatcgtacttctcggtgatggtgggccggaaccttgggggccaacggacattccgaagactcgccacaaaggctctacagccaacaccaccggccgggggcacggagggctgatcctcacgtccatgtcgaggtgacactctggacgaagaggcaccctccgttgcgcggggagtacgccggttattacgccggcgctcgatgtcgatgcgggcatccggctctccatgctgatcctcccgagttggaggtgtcgacgagggagtggcggccgaatggcgcgcagcagccgccgctcgccgcgccctccgccttgacgacacggagccggtggtagcggcgccggaggtcttggtggtggcggaccgtccaccagcacccaggcgctgctgtgccgtcatgaccaagttggccacgtcgtccagccatcgctgggctggagactccgggtcagggacgacaggcgggtgtcgtaggagcgcgccagcagcctgaagcgcaccctgaggcgtgctgccgtcgccgtagacgaggaggcgacgctccccatctcgccgttctcctgcatcacctgcgactggtgatgccacggatttgtcgaccctctcaagcgcctccccctgcttagggctttggcgcggaggaggtgggggagtacgagctcgacggcgtggattcggctccccatcgtcgccgctcacactcggagagaggtcgtgcgcttttccttgctcggccattaggctgaacaagaaaaacttggcgcacacggaagagtctgagagctcagaaaacacacactgagccccctacctggcgcgccagatgacggagctcgtggctcctcaccgggagaccgcgcaggcccccctttgccagttcggccgggggcttagggtgagatctcaagctctctctgtatgtggaaagattgcgtgctctcaagagaacatgaaacacaagcgatgtatacaggttcgggccgctgagaagcgtaataccctactcctgtgttttggtggatctgtgtatgaagggactacaaagtgagagccaacctctccctcgttctaggctctgaatctggcaagaatcaat

SEQ ID NO: 85323 - DNA, 1278 bp, Oryza sativa
caaagcttgatgcccatgtcctcgcagtagtcgccgaagagttcactagtgaattgggtgccattatccgtaataatacggttaggcactccaaaacgggtcgtgatgcccttaatgaatttaagagcagagtgcttatcgatcttgataaccggataagcctcgggccacttagtgaacttgtcgatcgcaacatacagatactcaaacccgcccggggcccgtttgaacggtcccaggatatcaagcccccagacagcaaatggccatgatagtggtatgatctgcagggcctgggccggctgatggatttgcctggcgtggaactgacacgctctgcatcgccggaccagatcgactgcatcattgagagctgtcggccaataaaatccttgacgaaaggccttgccaaccagggtgcgcgaggcggaatgggctccgcactcgccctcatggatgtcagcaagaagctcaacgccttgttcctgaggaatgcacttcaggaggattccgttagccgcgcgccgatagagggtcccttctaccagcacatagcgtttggaaatgcgttgtacgcgttcactcccttcgcggtcctcaggtagagtcttatctgtgaggtatgtttggatctcagagatccaagcaatcaatctaagggagcttggagcgctcccttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccgtgagagttcgtcggctatcatgttatcccgtctgggcacatgccgaagctctatcccgtcaaaatggcgctccatacgccgtacttggcgcacgtaggcgtccatctgcgggtcagagcaccggtactccttacagacttggttaacaaccagctgagagtcgcctaacaccaggaggtggcggatccccagcccggctgccaccctgagtccggcaaggagtccctcgtactctgccatattattggtcgctcgaaagtcgaggcggaccagatatctaaggacgtctccggtcggggaggtcaacgtgacccccgcaccggcaccctggagggacagagaaccatcgaactgcatcacccagtgggtggtgtgaggcagctgcgaggggttcgtgctggcctcggggattgagacggtctctggagcccgggtccactctgccacaaatcgg

SEQ ID NO: 85324 - DNA, 563 bp, Oryza sativa
cggtgcttctgcagcacggactcatgatggtacgtgtggaggaattaacagcacgtaaacattggtgtgtgaataaatttagaatctgtgagtagttaaatcaagtggttgagaattttgttttaaaaaatgatcttttaaagaattttcgaagccaaatattgaattagtcttacttgtcttgattttacgacaaaaatatattcagttgatgggatagataggaaattaatgttatggatagagcctatatgttttgcaccaaagttaattactgtttgctttgcaggatggggtgacttggcttatgaactcgcccaatgagtcgctaggatacattctagcggacaatgggtacgatgtctggattgccaatagccgtggcaccgtctatagccgccaccacacttcgctcgtctctagtgactcggtacattcttcaatttattctctaacgtaaccaacatttggctataaaattaaaacacatgtctatacaaagttatgtttaaaagttaggagtaccatatcatggtaacatgcattggtgaagccaagattaa

SEQ ID NO: 85325 - DNA, 635 bp, Oryza sativa
cctccaaggtggtcattcaaccgaccccctcgcaggttcgtctcactctcattgcaaccatctttctcccaaaaggaagttttttcttactcattttgttcgtcttctggttttttcttctgcttcagcgatgtcccgtcgcattcctcccgccaccccaagtccggccagtccgaggccgaagatccagcggccgcagaggagcggaggcgagaatctgaccggcgtgaagccgcagaccgccttcgggaagctgaagaggccgcccgggaggccgcccggattcgccaagcggaggaagctgctcgggaggaggccgcccgggctcgccaggctgaggcaacagctgctgctggcgcgtcaactgggcccactgtcgcgtcccaaatcgactctaaaattcatcctcaaaattgtgcaaaagaataattaaaattcatgtgaaagcctccaacaattaaaatgtgcaaagataaaagtcaaatgaggcttggaggatttttgtatatttcctaaaagcctaaaatacttaaacaaattttagtggaattttcagagcacaaataataatggaaaagaaataaacaaagttgaaatggttttataaaaagaaaatcctaaaagaagttcttttt

SEQ ID NO: 85326 - DNA, 816 bp, Oryza sativa
tcacaacttcagtttgtccatcagtttggagatgacaagtagtcaaaacaaaagcttagtccccaatttggccgacaaagttctccaaaaatagctaagaaatttagtgtcacgatcagaaacaattgtgtttcgcacaccatgcaagtgaacaatttctcgaaagaacaaatcagcgatatgagtagcatcatcagttttatgatatggtataaaatgtgccatttcagaaaatatatccacaaccacaaaaatgctatcacgccccctcttagtcctaggcaatcccaacacaaaatctattgaaatatcttcccaagaaacagtaggaacagagagaggcatatacaaaccatgtggatttaagcgtgacttagccttttgacatgtagtgcagcgagcaacgaatctctccatatctcttctcatatttggccaaaagaaatgactagcaaggatgtcctccgtcttcttggcaccaaaatgtcccatcaaaccacctctatgcgcttcctgtaacaacaacaagctaacggagctagctagaaggcatagcctgttagctctaaaaacaatcccatcattgaagatgaatttgttccatgttcttctatccttacaatgcagcaacacatctttaaaatcaacatcatgcgcatatcggtctttaatagtttggaggctaaaaatcttatagtcaagttgtgtgaacaaagtatatctcctagacaatgcatcagcaatgatatttaccttccctttcttgtgtttgataacataaggaaaagaattaattaattcaacccatttagcatg

SEQ ID NO: 85327 - DNA, 1013 bp, Oryza sativa
caacacatatacaccatgatccatctttctttggtaccaaaatcaccgcaaccacacatggactaagagactcacatacgtacccttttatcatgcaattcctgaatttgacgctgaacctccttggtttcctcagggttggttcggtatggcgcacagttgggtagtgaagcacctgtgatcaagtcgatttgatgctcaattccacgcactggtggcaaccccggtggtacttccttgggaaacacataagagtactcctaaaaaatgttagaaacagcaggggggaaaagaatactgcatatcgtgaagtgaaaacaaagcatttttgcataccgaagcataggcaaccgaaggtaaggcaatcaattcattaatatcagatttagtagcaagtaaacactttgttttcaaattgatctcagttttcttgccagcagattgggcatttttatgactcccacccttggatttggcagctttagcaacatcagcatgcaaaatatctttaggagacatgggatgcaacacaattttcttatcatggtatagaaaagaatactggtttgacctaccatgatgcatagaatccctgtcaaattgctgaggtctacctagcagaatattacatgcttgcatgggcacaacaccacattcaacatcatcatggtaatttccaattgcaaaattaatgtacactagttttgttacctttgccttaccactgttgttcagccattgatgtagtatggatgtgggtgcggtttggcgctgagttcaagcttctccaccatctcgctgctagccaagttattgcagctacctcaatcaatgatcatgcggcaagaacgttatttgatgacacactttgtttggatcaacgtgtgtcgctgattttgctccgccttcttcatttgtgcgctgaggacacgctgcataatgaggctctcatagtgatccgcatcttcagccccaatatgctcttcaggtggctcattatctacatggtcagc

SEQ ID NO: 85328 - DNA, 525 bp, Oryza sativa
cgccgatcacgatcacccgccgcccgaccggcagccgcgcgaggtcgtccgcttgccgcagctgctcgatgaacgccaccgcgtcgcgcacgccgtcgagctgttcgccctcgatgccgagcgccttaacgcccgccagcccgagcccgagaaacacggcgtcgaagcgctcgcgcagttgcgcaagcgtgacatcccggccgagcgcctgcccggcctgccattcgatgccgccgatcgacagcagccagtcgatctcgtgctgcgcgaagcgctcgacggtcttgtaggcggcgataccgtattcgttgaggccgcccgccttgtcgcgcgcatcgaggatcgtcacgcgatggccgtcgcgcgccagcgcgtgcgcgcacgcgagacccgccggcccggcgccgaccaccgcgacgcggcgccccgtgtccgccgcccgcgcgaacagcggcttgccgcccgcctgttcgcgcgccatctgccagtcggtcgcgtggcgctgcagcgcgccgatcgccaccg

SEQ ID NO: 85329 - DNA, 817 bp, Oryza sativa
gcgcaggttttgccactagttgaggcttttgaatccatcaactttgacttggtaagataactttctgggtacatcactttagatatatcggatatcccatatatctgctcttagctttgtatttgtcgaactgtgttgtggatttttttgccactctaaaagtgtgatgcatttttactactaaaaaggtactccctcgtcccaaaatataagggattttgggacgaggggacatatcctaggatgttcagattcatagtactaggacgcgtcccatccggcccaaaatcatttatattttgggacggagggaatggtattaggatgtgtcacatctttttgcttggttttttatctgaccagtgacgctattgatgaatcataacaacaatactgccttgtgaattttcctcaacgatactgattttcctcattcgtgctattatatgaatgttaaccaacagttgaaacaatttagtcttgtgtttgaccatcaaagccagtggcaaattcattgtcttatgaatcagaaagaaatgtatttgactatatctggaatgaatctgtgcagagtatggtagctactcaagtaggcgtgcaaaaaatttctggaattacactgtatgccgtgcaggaaaagaagctttacgaacctttgtcagacatagaggtaaagataagcaaattcggtactatcaattactctttcttgtagtgttctgcatgtttgtttgctaaagctacattctcgtgatagcattatagttctttaaagttctcatgataaatttgttgaacataagtgctcgagcatgtg

SEQ ID NO: 85330 - DNA, 890 bp, Oryza sativa
catctttcacgaaaaagacttgcgttacatcattggcaaggacaaaaggttggtccgagtatccaaccttgttaaggtcacccgttgtcatcccaatgtcatcaatcattactcctccaccagtcaacttaacccattggcactggaacagagggactttgagaggaccatagtcaggttcccatatgtcctcgatggcaccgtaatacgagccagttgttccatcgtgtcccatggcatcgacacgaacaacgctgtttgggttcgtgctcatcatgtcttgggctctcgtgtagaatgtatacccattgatctcatatccctggaatgtcgtgatcgacccagacggtcccctcgccaagaagacaagttgttggttgatcgactcgttacccatgagatgttgtcgtagccacgcggggaaagtatcaatgtgatgccgtgtaatccatacatcggacttaccgatgttcctggcgcgaactagagccaagtgctcctcgatgtatggagctaccaatgaagagtgttgtagaacagtgaaatgggctttacggaataaattgttgtctaccgtcataattgctttccttccgagagttccctttccccgtagtctcccttcatggcgtgattccggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgtgtcattatattgaaaaatgaaggtggaaatatcaactca

SEQ ID NO: 85331 - DNA, 1238 bp, Oryza sativa
gccgaggagttaatttttgaaatattggatcaaggtatcaatcccaacattgtgttttttaatacaatattggacagtctttgcaaagaagggagggttatagaatctaaaaaactctttgacctgttgggacatattggtgtgaatcctgatgtcattacatacagtacactcatcgatggatattgcttagctggtaagatggatggagcaatgaagttactcactggcatggtctcagttgggttgaaacctgatagtgttacatatagcactttgattaatggttactgtaaaattaatagaatggaggacgcattagctcttttcaaggagatggaaagcaatggtgttaatcctgatattattacatataacataattctgcatggtttatttcgcaccagaagaactgctgctgcaaaagaactatatgccaggattaccgaaagtggaacgcagcttgaacttagcacatacaacataatcctcatggactttgcaaaaacaaactcactgatgatgcacttcggatgtttcagaacctatgtttgatggatttgaagcttgaggctaggactttcaacattatgattgatgcattgcttaaagttggcagaaatgatgaagccaatgatttgtttgctgctctcccggctaacggtttagtgccagataattgcacctaccggttaatgctagaaaatcttatagaacaggggttgcttgaggaattggatgatctacttctttgaatggaggagaatggctgtactgctgactcccttacactaaactgcatagttagaaagttacttcacaaacgggaggtaagcaaggctgaggtttacctttctaaaattgataaacataacttccacctagaagcttccacggttgagtcgctggttttgctggtttccaacagggagtgtgatcaatatatgaagtttctcccagaaaagtatcgccccgttctgaaatccagggctggttgatactgcctgcagttacactgctgtaactagacattgttgatattcttatagaccttattatataaagatgacattctggattgcagcataatgggagatctctctttttgtctgttatgtgtggactgctagttatgaagagcaaacccctgttccaggtcatctcgaacaaacgactactggttatagcacagttttatcattcctggcatgcgtacctgataatggttataatcactg

SEQ ID NO: 85332 - DNA, 1647 bp, Oryza sativa
gtctgaaatttctgctgtcaactgttgcaacactgactgattgatatggtattctattatctgtggggggcaccctaattttggcaaatgctttctgtgcaatgtaaagcaagaaattcttatactgattactataccagtgcatgtgaaattgtgagttcagatttgagtgcacatataaatggtttttgtacatatctggagaattcactcaagaagtatgcagcgtattttgtatttctgatcacaaatttcatttaggaaacactgacatttttgctccagttgaactgcaaagtaaatggtatcctataggtatgacccaaatatatgcagtattatgtaagtcagtacaaatttacagtacatttgctcttctaaactcattctagcctcccagagttatttttcttttcttcaatggctttatgtcttcctaaaataacatcataccctgtttgctctggttgttagaggttgcctccactgtccacagagccaaacagatgcgagcgtgcttttgtcgggaacacaattggtcaggcaaatggggtgtatgacaagccactcgatctccggttttgcgattacacaaacgagaaaactaatctgaaaggaaaatctctagctgcagccttgatgtccgattcaaagtttgatggggccgacatgtctgaagttgtgatgtccaaagcttatgctgtgggggcaagcttcaaaggtaaactaactcaccttctgtcattcatcacactattgctgcattatttccaaaatcatgtacctttgaattgataaacagaacactagatgcttatatctcaattgttttcaggaacggatttcacaaatgcagtaatagaccgtgtcaattttgagaaggccgatctccaaggggcaatcttcaggaacaccgtcttgtcaggatcaaccttcgatgacgctaaaatgcaggacgtcgtgtttgaggacacgataatcggctacattgaccttcagaagctatgcaccaacacttccatcagcgcagactcaagattagagctgggctgcagatgatccacccaaattcccacctttctataaccgtttatgtcaatgttaacagtgtttcgatgattaagtcaagcctgtttatagagccgacatgaatccttttcttcgatatgtatctacaaacctctgcacaacttttcttccatatatgtagtatttacaaacctctgtacatcacacatattcggcatgcaatcaaatgcactacaagccacattttgacattcatgtactcacaatctgtgcaaactgcaaacaccagattacacaaaaaggaagaacattatgcctctcccatacatagagattgctcacaatttctggaataacattactggtggttttatgcatgatttattccatgagatcactatagcaacactctacattaccatgtgtgctagcttgcctgccaactcttttgttgcctctctcagctcctgccattgttgccatgcatgcacactgatgatcagttcttcttctatgctactcgactactatatatagccatgggtaggtaggccatggcgatgcctaggtgctagctgcaccgtcgtctacatggccggcccgtcgccgggcacctgc

SEQ ID NO: 85333 - DNA, 1169 bp, Oryza sativa
gtagttttgaaatcgactgggatactgcagcccgttcatatagagttatgcagtacggtctcagttccaacatcgtgcttggaacgctcttggtctcacccatcaattggaaatctgcatcacatgttcttgacaaaatatggtatcagctacccacgtgattaagcccttgaaaacatgtgtttgacattttgactaagctgaacctttgcatgtcaggcatcacatcagtagaaactgattcagttagaggtcatgcttatgggatgtgttgccgcgcaaatcatgattcacctgcaaatgcacaagactaaaacttaaaaaggttttaaaaaggcagctatattattcacccatatagttattaacagagacttaacaaaaggggaataaaccccaggtgatctcatgtctaatactcccagtaacaactaataataataagcactagcacctccagctccaggtcctatgtgctagtgcagattgcacatccaattacacaaattattgctgcaatggggattactggagtgttctaactttctttggcgccttcatcaggtgcagcagcggcaacagcatcctccttttcttttacttcctccgagcttacctccctcggcttctcttcggttgctggcgccttctctggctcagcggcagcggcggtttcagttgtttctggtgaagtgcttggggcaccatcttcaacagggacggtcttcttgacggtaccgaccttcacgtacttgcccataaacttgtactcccagtcctgcaatgcgtcgagttcaaatgggccaagaccagagatgtcaccggtcaaatcctggggctcgaaggacatcttagcgagtgctctgctggcatctttgccagcgaatagcgcataaggtccaccaggtccatagaacatcctgcatatggccgtcaaaatgtgaatggtaattagaaacacagttaaaaaatatttaagtatccactttcaaaacagaatattaggggcaatgcaacaattcctaacacaaataaacatgcatatcctgagactatgaatatattatgtagacatcatgtagcacaatccctcacctaaaaagccacaactgtccatgtgttttgaatgggaaacagtgtagcaaagaaatgattgtcattggaaaagt

SEQ ID NO: 85334 - DNA, 527 bp, Oryza sativa
tgcgttcccttgaatagtgattgttcccttcggtcccggcatcttgagcacttgatatgcgtagtgggatgcggccatgaacttcgcaagtgcagttctcccgatgatggcgttgtaagctgtatcgaattcagcgacatcgaaggtgatctgctctgttcggaagttgttggcttggccaaaggtcacaggcagcgtaatcttgcccaaaggtctggatgatgattggggagtaattccatggaagggttgatcagttggtgtcagctcactttgtggaattcccattgcatccaaagtggtggcaaaaagaaggttgatcgagctgcccccgtcgatgagaactcgtgctaccttgatgttccgaatagtgggttcgaccacgatcggataccgtcccgggataaccgaggttttgggatggtctgcttccgagaactccatcttctgctcagaccacttcatcctgggtgcagccccctgccatgtcgaacaaacctcgcgttccactttcttgtattctcgct

SEQ ID NO: 85335 - DNA, 736 bp, Oryza sativa
atcttcgaacacttttctaggatgatgagtaggccagaaccgagaacatgcgatattaactggcaagccttgcatgccccaacgacggacctctcgcatctggacgatcctttcacggaacaggagattcatcgggcaatcaaggagatgccagctgacaggcaccagggccagatggctacacggggaacttctttaaagtttgctgggacattatcaagggggacattatggcggtcttcgaatcgcttaataatctgagatgtgcgaacatgaacctcctgaactcagctaacatcgtcctgattccaaaaaaggaaggcgcggatgaggtgacggactacaggcccattagcctaatccacagtatagcaaagatcctctccaaaaccttggctttgcgactacgattacacatgcgaaccctcgtcacagtcaatcaaagcgccttcatcaaaggcaggagcatccacgacaacttcctctatgttagaaatttggcaagaagataccatagaacaaggcggccaatgcttctcttcaagcttgacataaccaaagccttcgattcggtgcgttgggattaccttttagccatgatgcaacatcatgggttcccgcagaaatggagagactgggtgacggccatactcactacctccacctcgcaagtactactcaacgggataccaggagaaaagatagcacatggcagaggactcagacaaggggaccc

SEQ ID NO: 85336 - DNA, 1796 bp, Oryza sativa
atgtaggaataagtcttggctggttggtcttggtcttgtggtgcctttttcctgtttttcagctttctaggacagcatctctactttcagtttggatgctctaggacagttaggacagcagtttgttgagatgctctaggacagtttgttgggatgctctgctctaggacagtttgttgggatgctgacagcaccctcttagactagcatggctgcatggctgctacaagcagctataaatatgtatccaatcctctttgggaggatatggcttttgtgtttagtgaatgaagaaaaccagaaaattgccccatctcgagtgccatcctcttctcaatgagagtaaccattgaaattctaacatgcacaacccgagctaaaacattgagcattaattcccaaaatatacctgcccatattcactgactatgtcaaaaccaacaatgccaaggtcaagatccccagattgtagtttgcggacaatatctttgggcttctgaaaccaaacctccaagtttgggacctgcataaaggaaagaaaaaaatcaaaacatgtgatttaaatagcactgcgactttttaccttagctatctcctacaccgttatattccaatactaattttctaaacaggcagccacatttccacaaatagctgcagatcatgcagggacaaagtcataggaaggtaaagctgctaatgctacccatattaaatgaaataaattaactaaaatctctccaaactttaaaaccatatgcaagtgtggaaaaggtacaataactatgctaggtttcattaaaaatgactactgtttctaaaaggacatctccttgtattgtgaacacacaatgtgatcgatggggtattaaattgacaaggatgcttgaatcattttaagggacaaattttctgttgcttcatccatcagtgcaccagaagttcagacaaaattcgaattgttgaagggaagaaataaactaaaaatataatattgtataagatggcagtatttcactcatactgtcgaagggataaagtaactttagggtgtgtatagttccacgctaaaattggaggtttgattgaaattggaacgatgtgacggaaaagttggaaatttgtgtgtgtagaaaagttcaatgtgacgtttttggggttcaaactttggaactaaaccgggccttagtttggaattgctattgcgtatttattcaaccatcaaaagggcattcatactaacaatagtgcatatacaggaaatggtaaactgcaatgctttgaaaatggactagcccatacgtatacttatcaatgaatcagagagcctaagtggcctactaattcgatagtaggccaatttccagtacagaaatgacgaactgatagaagacaatgaatggagatggaaacctcacctgcgggatatctgcggtgtactgccgcgggttgaggtgcctgactgacaattggcaactctgcaccccgaggcatgaacagcataataacaacccaaagtcaacaaaatcaccacgtaaatacagaattcgatagatgcaagcaggaccggagacgatgtgcgagaccttaaggaggcttagggtttgctcggacatgcggcccttgctggggagcccgatacggacgaccgtgcggtccgcgtacagcggcgccaccgccgccggcttcgcggagacggcggaggccgccgaagcccccgcccgcggagcgagaaagcgcgtcctcgccatccccatccccacagccgccggcgcgcggaggccggacggcggcga

SEQ ID NO: 85337 - DNA, 631 bp, Oryza sativa
atttatatatatcccaaagaaaaatgttgcaaccaccatgtctgatttctgtgtatattattgtttattaaatccaaaattgaagcgttggctgtgtcacatgtgaaaatatgcagagaaagtgcattaacgactgccttggagtgatacagactttgagggacctagggatgcagccataccttcattaagctgcattattttgaggcagacctgggtattgaagtccccaattaaattgtacacttgtactaaggccctgtttagatggggaaaagaaaatttttgggtgtcacatcagatgtttgaccggatgtcggaaggggttttcggacacgaatgagaaaactaatttcataactcgcctagaaaccgtgagacgaatcttttgagcctgattaagccgtcattagcacatatgggttactgtagcacttatggctaatcatggactaattaggctcaaaagattcgtctcgcgatatccatgcaaactgtgcaattaagttttggttttatctatatttaatgctccatgcatgtatccaaagatttgatgtgacgtttttgggggaaaaaaattttgagaactaaaccaagcctgaatagattcatacggttttgttgaaaa

SEQ ID NO: 85338 - DNA, 1496 bp, Oryza sativa
  unsure (1)..(1496): unsure at all n locations
aagttgagaaagaattcaagcttcttgctcctgtgtcaaagaaaagaaaagtgggtagccaaagaaagaataggatcccatctgctcttgagagggcaaagggaaaggctcaaagccaaattaagtgtccagaatgtggtgtctttggcccaaggaaggaaagtgctagatgtgaactaactggcaccaaaaagaggtgtgctgtattttcatctcaattattattcattttcttgctgttatatgctaactgtttttcttttggcaggaagaggaacaagaaancaccancaaaggtgggaaggaagaaatcaaagggtgttagtgatgaacaagtaactacaccaagaacaagagcagttacagctagagaaggagctgcagaaacacaagtgcagccatcacaaacaagcagccctggaccagtcactaggaggtaagcaccattatgctcttttcatttttctctagctttcattacttattatacactgaactaaacttcttttattatttacaccatcacaaacaccaggaggttggcattggagcttgaccaaagctctcaagtagctccagctatagtggagccacccaagaagcttacacccagaaaaaagctcgcaagcaagaagaaaagtgcaacaccacctaaacttttggattgaaatttgtcaacctgctagtgaaattggttatttgtggtctactatggcatgatattttggaaaaactaattgcaagtaatgtgcgatgatatgtgcactttggtatggcatattttgctatgtggtgtgaatatcttaagtgtatggcctaacgaacttaagtgtatggcctggcctgatgttgctatttctattattgtgcttttgtaatgatgtatggccttgcgtaatggcatgtaacttgttatgtatggccttcacagtaactctgaacttgatagtggttatgaacttggtagtactatttctaacgatgaagaagttattatgggataaaaattgatttttgttgcgcatgtgtgttaatgatgcagtatgttatgtgttgagttgttctcaagttattatgttttatcatttattcatgtgtgcgtagttgatttaattgtattatgttggctattaaccacttgagaatggaggggtaaaattgtcatttcactaggccggtccatgctggcatgctgatgtggtgctccaacccaacgaaagtggcaaaaaattagggcgtaatctctctctagtggtaaatatgttaggccaaatctaatagtggcatatggagagttgacactcgtaagagtggcaaatagttaaatttcccgtccacaccaccctagtagatgaaggctgtgttagttgagcgcaaaatttagattttggttgaaattagaaatgatgtgactgaaagttattatgtgtatgacatattgatgtgatagaaaatgacggaagtttgaatccatctaaacacagccgaaaagagga

SEQ ID NO: 85339 - DNA, 727 bp, Oryza sativa
cacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagccccggaacatacccgcatgacgatcatgtataaggcaaacgttgggcctcatatgcaccactgcaatgtgcactctctctaggaaccagtaccagctttcagtgttctcactctctacaaatgcaaaaccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtaagtattattattcctctgggcaatggtggctaacaaacgaggcaaattatcataagaagcttcaaatgtgccatacctcatctcaataatcttttgtttggctctccaggcctttgcatagcttatggtgtacttgaatttgttctcgatgtgcctaataattgattttggttcaaagccaatgttaccaacaacactgctgtacatctcacttcccacaaaagctgaagtgatgtt

SEQ ID NO: 85340 - DNA, 864 bp, Oryza sativa
ccacgtggagcagctctgcgacgtctgcgtggtgcaaaccagcggcggctcccctttccccagcagacgagcttccgagccaagaaacaactcgggctcgtgcacggggacttgtgtgggacagtgacaccggccacaccaggagaacgacgttatttcctgctgctcgtcgacgacctctcccgctacatgtgggtgatggtcctcggcagcaagggagaggctgcggacgccatcaggcatgcgcaggctgcagcagaggcggagtgcggccgcaagctgcgcgtgctgcgcaccgacaacggcggcgaattcacggcggctgaattcgcgtcgtactgcgctgatgagggcattcagcgccactacaccgcgccgtacagcccacagcagaacggcgtcgtcgagcggcgcaaccagacggttgtggggatggctcgggccctcctcaagcagagggggatgccggccatcttctggggggaggcggtggtgacggccgcctacatcctcaaccgctcgcctaccaaggccctcgatggcaggacaccgtacgaggcttggcatgggcgcaagccggcggtctcccacctgcgggtcttcggctgcctcgcgttcgccaaggagcttggccacatcggcaagctcgacgacaggagcaccccaggggtgttcatcggctacgcggagggctcgaaggcctaccgcatcctcgacccggagacacagcgtgtgcgcattacgcgcgatgttgtgttcgacgaaaggcgagggtgggtatgggacaaggcggtggatgatggttcgactccgacgtacgacgacttcaccatcgagtacggtcacttcgagggagctggggga

SEQ ID NO: 85341 - DNA, 2178 bp, Oryza sativa
agctgccccggcaagtcactggccatgacgaccgtgaccgcctggatggcaacgctgctgcacgagttcgagtggacgccggcgtccggcgccgtcgacttgtcggaggtgctccgcctgtcgtgcgagatggcagtgccgctcgaggtccgggtaagcgcacggcgaaatgtgtgaggctctgcacgtctgcagctaaaggcgtgatgcaccatgacttgatcgtgtagtttgtagccgtgaccctcgtgcttgccgatagtaaataagcagctgggagaaaatgtgcaccagctctgctctgaatttggttcagtttttaaacagtttttattgtgtgtgcgccatcagtgactgagtgagtataaggcttccaattgtgtaaaaatatgcaaaaatctatcaaagataatatgtgtgcagtattatgtaaactgtttgtcatgtctacactatacctgcacgtgcaaagggtcgccatctcatattggattactttttcatggaacttaaattctgaaagcaatatcatcatgtatatggtaggtggtctgtctctgctctatcaatttgaccatgaaaattgccgggcaaagcaaatgtacagatgtgtctgtaaatactggcaatattcaagacaagtaaaaagaaaggaggaaaggaacttgacaagaaaaattagaattggtaatttggaattcccttatcatcccagatccagcaccaagagcaaatttggtgtcaaactcttccatagtaaccccgggtcaaccccaaaaggataaagatagcaggagccttgcatcataggaggcggacagatttgctacggggtggaattacaccatccatctttattgcagaaagcccaatttattcagcgtcacgcaagaaaaggtacaattcatacgcacacctatccaacaaggcaataaggtctcacaattatatcaacaggtacataaagggtatttcaacccatatgcttgtcaaaggtataactagacgagcacaatgtacgatggcacagaccaaaatttcctctcaaataagcaccgcagacacttcaaacgagagctcatttctgattatggttgtagtatacttcagcgagcataagtaaaccgatgctaaaagggtcattgacagagaagtatggcagacttcacaccaagtcacaaccccagctccgaaagtagtttgcgccatctaggagtttcctcatcaaatatgtaggtcagctttgtcaccaagactccactgccaccaatctgcagttacaagttaatgagtacacattaaaacaattggatttatcaatggaactaagccatacacgttcaaaaaatatatagcaagggccatatatgttctgacaataagttctattatgagctcccatatcagatttatcttttgcgctgacagcagtgagaatagcacagaaacatcttttgataattactcatataagcacataaatataccttttactacaacattagaaaatttctaaagataagagacaattgcccacatgaaacagaaaaggaaaagggagaataaggggagataggcacacatttccgtttaaaagtattgaggtaaaatatcttacagatctcagctgttgaatggacttgtaaagagacttctgtggaactactacattaatcgcataatattccacagcaaccttcccatcacgtgagcggtagactggacttatggttgggccctgtttaaatcaaaatgagtgaatcaactcataagctttagtgattttccacatcagtatttcaaactacagtggttccagtcagataatcatgagcaaagcttttgctataagtttgaaatgcaaaactagttttatttcaaaggacctaaaagctttaaattgcccagattatgatgaagattaatcaggtctagatattagagcagctacaatacaattatatttccagttcaagattatagagtgctaatttatgaatgtggaaaataatattatttttaaagagatattttagcatctgccacataagtgcacatattcatggtcagtatataaaaaggtaaaatactactttggatacttttagtgatacctgtaatccacataacgatgtttggctgagaactctttccgccacttcttccgcactgttcccc

SEQ ID NO: 85342 - DNA, 1176 bp, Oryza sativa
tctcgtttagtaccacctcgataactcgaggcgatggaggcgggatggtggatctaagtggagtgtgactgtgtgagggagaggtgctggacatggatgccggcacggtgcggtgcgcggcgaaccacgcgccgctgacgccgatcagcttcatccagcgcgccgcggccgtctacggcgaccgcgccgcggtggtgtgcggggagaggcggtacacgtggagggaggcgcggggccggtgcgtccgcttggccgccgcgctcgccgcccgcggcgatgtggtgagtggaacaccaatgctgctagctcttttagcttatcgtgtgcgcgagcatttgctacttagatgtttcttcttttgaaccaacaaggtaggaagtggcggatgcagcttagatcgatggcccgaaagtttttggtagaaaacttgttaagtatgctaaacatatagtttacgagtaatatttccgctaatctttgccatgagcccatgaatagttgaagctagataacctcacgtcctcgcggatcttctcctatcagtactcttgatattaatgttctctctatgcatcagcatgtaaacagcttgattttttgttttgagaataaacagcttgattcagttagcgataaagcttctgcattgccgcgtatacttcttcagttagtgggataattttaccttgctgctaatatcctcgtgcattgccgctatttatatttttgcaacgccagttataaatctgagtctacagtctactgacaccgagtaatagtagcgaagtcatgaaaactctcgatcatgcgaatggccttctctgcagtttagatctttcacttttatactttcagtatgaactgcgaagtaatgtggcttccatgcaaattattggttattcggagatccataggaattctggagaaaatggtaaggattttaggtcccactcacagtccactccacctcttcatgttccttggtcaggccactcaacgatcgaaataatttcgacctgatttaatcatgggtcagtctgaaaactaggcccaggcgtatgacccacattgtcgtgtgtcccatgttcaggttgctgtcctgagcccaaacgtgccggctatgtacgagctgcacttcgccgtgccgatggccggcgcggtcctgtgcacgttcaa

SEQ ID NO: 85343 - DNA, 519 bp, Oryza sativa
ccttcttgctttcgacagagcagggtatggggaaaattatccaaatcccaagaggaatgtaaggagtgaggcattggatattgaggagctcactgaccagctcaagcttggacagaagttctgtgttgggaatgtcgatgggaggatacccaatttggggtgccttcagtatataccaaacaggtaaagaccgaaactgcaatactgtaccatcaatggtatatgtgacccttcactctccagaaatgtaaagatacaactactgtgtgcaggcttgcaggagcagcgttagttctgcccattatcaactactggtggccttcttcccccgctgagctatccaggcaagccttcatgggtctcatcatgccagagcagaggacactctggattgcacacaacataaacttccttgctctacctctggatgacccagaagtggctcccttcttctgcggcagccatgcatcatcctgcaatatttagcaagcatgatatggaggtccttcagcacatgat

SEQ ID NO: 85344 - DNA, 639 bp, Oryza sativa
agttgggcattgttgtacctcaaggtatgtatttgctagatacttcgattcagccttatgtgtaataagagccctctgcgctacaaagaaaacacaatatcaacatatatgaagaactctaatgttgcttgtgaaccacttcagggttaccattccgtgcaatcctataggatagctcatgtattatggaatcaaggtcgtaaagttctggcattggcactgcagagccgtatcagtgaggtgaacactgatttctttatgaagcatatttttacattgctttagcaaatagttctgtttcagtaacatttggtatcatattcctttcaggtttttgcagtggatatacacccaggtatatgattgttctgtaatgatgtatatttgcattttcctggtctgctagtgtgtttaacattcaagtgttgtatggtgatatgcgatatttagcctgttttatcatctttggcaggacaattttatgtcactcttctagttgataattgttggttctttttatattgcttttaaaatttgatttttgaacagtgaagttatgaacatttgtggcttatcttttatgccttatcatgttcccttttttcccactttatcttccttacattctttattactaaa

SEQ ID NO: 85345 - DNA, 1148 bp, Oryza sativa
tgatcagccgtcgttgacttttcattacaaatctctcacattaggtgcggaaaagtctgaaaagaatggtgaaggttatccttggtggaagaaatgaaaagaagttctttaccaagatgaatggaggtaaattattagcatgcaaattcatttttttaatgatactagctccttgcttaaataatacaaaaatacataatctccactgaattttaactaattttgtcaccaaaaataagtttactgttctttgtttctgcctgctgaagaaaacaattgtttggggagggggggggggaagcacaattgttgaccccttggttatacttctgtgaacaaagaactttgattgtgttaagcgcttggcgcttgcaatttcttgttgtctgtttggaacaattttgtttgaccatatatccatgctctatttacttatatttgaaatttagcacattattgactgttattaccagacatggctatacacttcaacttggacttttggacacatcatatgtgcaccaattatcgattagcatgcattattttcttattcctcttatggccttctagtacctttgtttgaaggaaacttgttctgtgggctcaactgctttaggattgttcaatttagtttgaacaataactgtctagaaccaaaacagcataagctctcctgtggattgggatatttgacacgaatatccagtgaaaatcacagtgctgattcataaattatcctgttcagagagtagttctaatttctaaacatactgggcacataatatatttctggcttagtgttatgatcataatgatctgtacttttgagtaaaggtcctgaattctctttaagatagggaaattaaagcaaactaggtgataccccgcgctttggtgcgggattcacgaatgagtatatgttaaatattgtcgaaatgatgaaagttgaaatgttaaaaaaataatatgaggaagatgatttgatacatacttgttgatctctataatataatattatagatgatatgtcatgcttgcatgggatttaaaataggctagaatagtaattgctagtgagtgaaaatgtggcatgcttgcatgggattttaaatgggttagaatagtaatggctagtggatgatgat

SEQ ID NO: 85346 - DNA, 727 bp, Oryza sativa
acaatcgggacgtgaaggagaaacaaaataattcttgattaatatttgtatccaagatgctaggaatatctaagattaatggggtagaaagagaaaataatactactggaaatgtaaaagtatgcaggtcacgctaaacttatatttggcattaataatttgggtatcttgagttttttatggctaacctcttaagattatacagcattgatatcatggaactttggccttccaattatcatgggcataccacaacctgttgattcccttcaaggagcaacctctatctgaaaccaaatgcttccattcagttcaagaaaccagcagagatgtataaaagcatagaggctaactgtacctaccttgaaccagaagtgattagatcatgcactggagaaaacagagttgcctcccaacagctcagtatctttcaataaactttaataaatttgacagtgtcatataccatccaagtgctgaactgggtcatgttgctttggtagacgaaagctcttgagtaatttgataagttcatacgtccttgcatgatgacccaaccggaggcataactccaaaggggtaaatccatcctgaagtaagcatataaaccaaatcatactctcatttgacagaagcctttatttaagagaaatgcaggaataagtagtgctcatgcatgtctcttaaataccatctgaaattatggcactggaaatgcatcacaaac

SEQ ID NO: 85347 - DNA, 1256 bp, Oryza sativa
gcaaatgtgaaactttggattgacgtccaaatcgaagttcataagaagttttgatctcaagaaaaccagatttgaaatatagcatgcagtgttaatcgcctcagcccaaaattttctaggagttttatattcatccaacatcattctagccatctcaacaaaaacacgatttttcctttcaacaacactgttttgttgaggaacacgaggagaagaaaattcatgttcaagacctctttcattgcaaaattgttcaaaagaagcatttttaaactcaccaccattatcacttcgaattcttttcaaagaaccaggaaattcaagattcaatcgaagaaacaaatcacgaaagtgttgaaaagcttcgtccttagttgccataaagaaaacccaagaatattgagaaaaatcgtcaacaataaccaacacataccactttcctccaacagattgcactctagctggaccaacagtgtccatatgtaatagctgtcctggtgcatccgtcatcacagaaacaataggagcatgtgaagaagcaaccatcttagcatgacgacatggtgtacaaaccaaatcaagatctttcttaagtttaggcaaaccacgaacaagatccaaaccacttaacctagtgagatgatcaaaaccaacttttttttagtctacgatgcccaaacatcacatttttatcaaacttagctaccaaacatgttatgaaacaggattatcaaaatcagctttaaacactctttcatagcgagaaatattcaacacagaatcaccacaagaatcaaaaactttacttccaattttcttaaagtgaacctcaaaatcttcatcaacaatttgtgaaactgaaagcaaattatactttaggtccttaaccaaagctacattcttcaattcaaaattttcatttaccttaaccaaacctgtagcaagaacggcacttgtagaagcatcaccaaagataatccattcagtcttggatgcctttcttagggaggagaaccaatttttatcaccggtcatgtgccgcgaacaactggaatccacgatccacacgttctccttccttgccaccaaagcctacacacaagcagaagtcgaagcctcagtactggggttagataataataaaaatttaggaatccagtattgagatacacgaccagaagatccagtaggcatatatccatgtgcaaaaacagtttgagaattttcagaaaaattcctccaaggccggtctgacc

SEQ ID NO: 85348 - DNA, 664 bp, Oryza sativa
cagcaacatattcagattcagccgttgattgagcaacactagattgtttcctagaagaccatgtaatcaatgatgtaccaagaaaatgaaatgttccactagtacttttcctatcaattctacaaccaccaaaatcagcatcggaatatccacttaagcatatagaagatgaagtagaataccaaattccaaactcaagtgtatgattcaaatacctcattattcacttgaccgcttgacgatgtaaaacacgaggagaagcttgaaaacgcgcacacaaacacacaacaaattgtatatctggcctagaagcagttagatacaataaagatccaatcatacttctatactccttttgatcaacagcttcaccatcttcatcaggatccaacacagctgtagaaccaattggtgttgaaattggcttgcaattctccatcttgaaccgtctgaaaagatccttcgtatacttcgtttgatgcacaaaagtaccttgaggtgtttgctcaatttgcaatcccaaaaagtacaataactcacccatcatgctcatctcaaattccctgcgcatagtctcagcaaactccacaaccaaagcgtgagatgaacaaccaaagatgatatcatccacataaatctgaacaaatagttgattatcaccatg

SEQ ID NO: 85349 - DNA, 1517 bp, Oryza sativa
ctctagatgaactaaggtcacgagtgaaagaagctcttggatggaccgaggataatgtggagattcatttttatgggagatacgatgttggtcaagggcataagtatatattaaatgtgataggtcagttggaatgggaagtttactttgatttggtaaaagagtctcagtttagatctctagaggtgtttgcatcaaagttggtacggaccgtagaaaatttggatctaaacaaatctccttcttatcattacgttgagaagaattttgtgacatattcttctcgccgtggagggggtgcaagtaagactgagttggtacgagaagacttggagggggaaggagataagaagagacctttgcttggaaatgatttaggggaggcaggaccatcaaagagacattgcggtagtgatgatgtggatgcagcgagggagatgaaaagggagttagtacaagaggggcttgatctaagtgaacatttgtcggagagtgtgcattggtcgttgtacggaggcaaccctgaatacccgacggaagtagcaagccaatatgtgaatccagatgattactttgatgtcgaattgagtggtggtcacgattctgtctcagtagaagtcaatagagaggaggttgacgaggaggcaagtgttgagcaatatgatgttgaatttgctgaagactctgatgatgaccgtccattccctccactaactaacaatgacaagttagcattagaggaatgtcgtgcgtttgagaaggtgtttgggaggaagccagacatcctgagtttagggacctaacacatgcccatggtgcaatactagatggcggcatcaacctagatcagttgccagaacattctaggtggatggtctcagaaagggtttagagttcccatccatggtcgcattgaagctatggcttcaggagtacgccatcgtgcaccatcgtccataccgtgttgtcaattctgccgcaaataggaggtacactgttaaatgtgaaaacccacggtgcaaatggaaggtccatgcaactaagaggtctagtggcacgtggaggatatcacgggttggtaaggaacatagttgtgctactgccgaaggttcagggagccaccggcagctgacatctaagttcatagcaaataggttatgcaatgccataaaactgcaacctacactctctgcttctgcgttagctttgtatatatttgaggttttccagtatagggtgaagtatggcaaggcttggagggcacaagaagaggctatgaagctcatttacggtgaatggggtgaagcgtacgtccgtttgcccactttgctgcaagccattaagcagagaaatcccagtatggtctaccacatcgatactcatcctgatagggttgtcaacgttgatggagtgaccaagaaaatttttatgcgtgcattctggtgctttggtccttccgttgaggcttttaagcattgcaggccagtactagctatagatgcaaccttcctaactgg

SEQ ID NO: 85350 - DNA, 602 bp, Oryza sativa
gagtcatgtcgtgatggtcacaacctcacaggctgcaccccagacctaagcacgacccaccagtagtcggaccatgccgtgctggccatgggctgcacctcaggcctaaacacggtttaccaataatcgggccatgccgtaccggcttgaaggcatgcacagccctgttgagattatagacatataatgatttaatctattccataaataaatcatgacattacagatgaaaactagcatgaacgcatcattagatctacacatgtaaactacacagtataacatgaacagatcaaatatgcgcaacatattgaacacgtaccgaggtgacgaaaagaccggctgcttggtcgaaacttttcgcaggtgtgtacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagat

SEQ ID NO: 85351 - DNA, 676 bp, Oryza sativa
ggcagcatcctccggtgatgatttggtcgcgccatcttcttcctctgatggtttgtgagcctctggcttttcaaggtccatgctatcctctgatggcttggcgctgtcatcatcttccactgatgggcttatcaagaaccacactgtcctctgatggcttcgcactcgcctcgtcttcctccaacggtttctcaagaccagcattgtcctgtgttggctccacacttcccttgtcttcctctggttccttctcaagagttacagggtcctctgtctgcttggtgccagcatcatctttctccgatggcttctcaaaggtcgtactgtcttctggtagcttggcactcgcctcatcctcctccaatgttttctcaagagcatcattgccttctgatggctttacacttccctcatcttcctctgatgccttctcaagagttatagtgttctctgatggctccacgctggcgctatcgtcctgcggcggctcctcaagagcactgctgtcttcggatggctttatgctggcctcgtcgtcgtgttttggttcctcgacagctatggcactttctgatggcgtttctatggatgcactgctctgaggtggtgcctcctcagaaacgttgccgtctgcagcttcgctaatgcttatgctactctttggagtgttatgagg

SEQ ID NO: 85352 - DNA, 695 bp, Oryza sativa
ctggtgaccaagttatcgcctagtcttccagttgttgtggagataccctcagtagacaatatgataaccatgatcgagagacaaaacaactatactccattgtcttatagttttttcccccacgttcctaactgtgtccgtcccctctcaaattatctatcatggattcactgtgagcaagaaaacagcagatggtcaagaaatcatggtttataaagttatgtagatgatatttcatcaagaaattatagtttataaaactgttgtgacatgtgagatcaatgaagtaggcaagtagcaggggctataggcacttcatttaatctcagccataagaaccatacatagatgtgatatagttggatcatttcttgacttactaagttgtaatggaaccagtgaattgcatgttttcagttgaagttgattgaccctcaatcatctgaagcagatttggccaaagaagcactttttactaaacatcctgaaatggagggtaaatccaagtatttctttgtgtcttttactaatgtgagattaactggtgattattttatgacaacattcatgtatggctgtttgataggttggccaaagaatcatcatttccaaatcttcaaattggaaatcaaaaacatatttttgattgattggtttgggggtcctaagcctatatcccccactgataccttgaa

SEQ ID NO: 85353 - DNA, 744 bp, Oryza sativa
tttttaaaattttagttaacaacttaattaatcatgcactaatctactgtttcgtttttcatgctaggacggaaggttcccaaccttaccttaagaacacacccgacatatcaaaagttttgcactgtcgcatactatttgttatagggtgtttagatccactggcaaattttttccccgtcacatcaaatgtttgaacacatgtacagagtattaaatattgaaaaaaaaactaattacacaatttgcgtgtaaattgcgagacgaatcttttaagtctaattgcaccatgatatgataatgtggtgatacagtaaatatttgctaatgacatattaattaggcttaataaatttgtctcgcagtttacatacggtttatgtaatttgttttattattagattacatttaacactttaaatgtgtgtccatatatttgatggaactaaacacagcattaattgagtttgcattggttgagaagataccgagaaatattatggtttctaatgtaaaatttaatttgtagttggtgacaaccatgaaatgctgagatgatacttgtttccgaacttcagctgaaaccagggttcacaatttcgacgaaaaccggtcgaattccgcgaaatttcgaaaattcgacaaggctcgaaagtagaagccgtctgagattttgataagtttcatcaaattcaaatttgaattgattaaaagggaaaaaataaataaaatcttataaatagt

SEQ ID NO: 85354 - DNA, 528 bp, Oryza sativa
tggttcgaccccgctgccgacttccatgactactccatctctggaaccccttccacctcgtgtaagctcagttcaatgtcaccatgacggccgtatacacttttgttttaaaacaaatagtagaaatagttacatcttccgtctctaccaacaaacacttgcacatacaataagcgatgggataaatccagtgttttaaatagcgggctataacatttagcagttgacccttctcaagcagctctagacggagatttaaaacctggataaatctaactcctacaaaatgaccacctgaattctgtagaagctaagacaaatcacatgtacaagccatcgatttgattaattatttggcaggatattcgtggacgagacgccggtgagggtgctgaagaacctgacgagccggggcccggagttcgagttcccggcgaagcctatgcggccgcgggggagcgtgtgggacgcctccgactgggcgacggacggcggccggaccaaggtcgactgggcccgcgcgccatt

SEQ ID NO: 85355 - DNA, 1224 bp, Oryza sativa
taccatggatgcaatttgtctgtacctttccagtaagagtaagttttgcacaagttgggttttcaggatcaatcttcccacatgtcccaagagggaactcgctaagggtaaaggaggtcctttcatcctccaatgcatctctcgcagtgggatctagcgttgtcagatagaagtaggggattccatggctctcacctggcactccatcactatatgaaactacattgctgtatgtacaggaagcagggaactaagttcagcaatcagaaagggtttgtaaccatgtgcgttggttgttttcaataccaaaacaagaaatattacccaaaaggagctccacttagatcacttgatattgtgctgcaaaaagaaattgcatatgtgagtgaacaatcagtggacatctagcagatacattattaaaagaaagtcaaaacaatatacaatagtgttttaaatagccaactgcactcgcgtaagtattttttgacagtgactgctacgctattgtagtatcatgtaaaaaccagcgaaggcagctatgacaactctgctaaatccactaaatgctgtaccgctactcaatcaattagtttttatcaatttagttttattttgcctgggcttaatttgaaatttgttttcttagaaatcaaaactatttagaatcttgaatatccttgttttcacctgaacaagtactaaaatattagttaagaaactttcatactttttatgaactttacaattaatttcaagtaatacatgacacatatgagtaacttatgctctaaataatatggggggaaaaagctatattgaccttgatgctaaaaccatagcttttcattactagataaaaatctgtctggtatatttgacctaatgatgtatgcagacattaaaacgtggccagaggtttccaacttcacaccaatttgaagaatattgtctatatttatttattttctttgcgaggaattttgatggaactgtaagttttcgttatccaattggcacagtaggacggcaatttagcaaaacacctattcaattgtaaatcatgacactgaatgtcacacaagtaagggaagagcaccaccaatttctcaatactaagcagcctcaggcgattagattactagccactaccaacacttgcccgcgctaagaacccccaatttcgatcgaaccacccattgtcatctcctaaagaaccgaggc

SEQ ID NO: 85356 - DNA, 2327 bp, Oryza sativa
tattttaagtagatatataagcaaaaaatcatgtactcacacactgacatcgtatcggaataggatgacgtatcaaaattttggctagaatttttttaatatttataatagtagagatagatagtatgtgatgtatatatgcggtataaggttgtctataaccagatatgactcaacctattaatacgaatctaaacaggggacatgcatgagatatgacatattcatagtattaaggttgagtcacatccggtcgtaagtttttatattctaagacaaagagagtattatctaacaaatgtcaatcttctctctcatctttctctccccttcatcgcatactcccttcgcccttaaaaaacgaatctagtattagacgtgacacatcatagtaagacgaatctggacggaggcatgtccaaattcatttgtactgggatgtgttatattcagtatttggttggttttttatgagacggagggagtatgtattcctataagcgggcatcacaccattgttagtacctataactcaggagcacctctgtgtctagtttatatgaagaaattacgtgagagagacgtttttatcgcacatatatcccgttcgtgcaaataataattccacgcgaaaacattccaattcctcagtcatccatgcgacccgctgttagttttcggtacgtgttgctcagcatataccactatcaactttgttataaccctttttttcccctaacatttcttgttgcaattgcatttcgcagttttagtgtgtttcccatttaattacccagatgatgaaattgaaatgatatgggcaagggcaacaagtgtgcccattactccagctagaccctgacgaaaaacacagacaattttttttaagataataaaaagacagacaattagaaaaaggaaaaaaaagaaaaataaattcaacaagcaacttgtgacctgcagtgcagggcatgtccgatgatcacttaattaatttgtttgaaggcatgttccgacgatctaatttggaacttggcagagccacaggtggatacgactctgcttttgccgcagaaatatgtgttctgcatgtatggtgatattattgcaccatcaattccaagtttgactgatttcaagtttgtttgatgacattaattacaacgaatagagaaatgagctgtactactagcgatatgaaaaatgtggaaaatcatatttatctgtgatttgtgtttgtttttttttcttcaataaatatctatgaagccaaattgcaccataaaaatgggcgagtttagctgtatgcctgtattatacagcaaagcgatttagatttggtggcaataaatcagtaagataatttgcctctagtttgtgcttaataatgagttcacacttcaaatgctcagttgtcttacagtctttccattagtaccgtttgcctcaacttgttaatggcaaggtttattcgatcatggaatcatggatacgaaaccacacgaacaaaagaaggtttcacattttcaaaattatatattaggcattttcacgctttgtcccattaaataagtggacacagtctctctgaaaattaagctggtcgaccaaccaagctggccatgttcactgtaactgatttttttccatctccctcaaaacggaatgttaaaagaagactgaagttgaggaaacacaaacacaattcatataccacctcatatgtcccaaattgctcgaaaattcttcgcaatacattcatgtcgtgagagacaagtaaaatcatttgtcattttgaccatccctgctatatggctctcacacaccatacctcgctttcatatcatttctttcccccacaaaacataagacaaacttataatggacgcatcacttgcccgcctatcattagtcgtcgccctctctctttccctctaaaagcaacaaaaaggatgagatgtaaggcaagagagtggctaagcccgcgtgacgataaccacataccaacctctcatgttttcgagcgtgtgctagagagactcaggtggtgtttagatccagggacttaactttagtccctgtctttagacactaatttagagtattaaatatagactacttacaaaactaattacataaataaaagctaattcacgagacaaattttttaagcctaattaatctataattagagaatgtttactgtagcatcacataggctaatcatggattaattaggctcattagattcgtctcgcaaattagtccaagattatggatgggtttacataatagtctacgtttaatatttataattaattttcaaa

SEQ ID NO: 85357 - DNA, 3333 bp, Oryza sativa
gcggggaggaggggaggatgcggatggaggggtggctgtacctgatccgatccaaccgcctcggcctgcagtactcgcggaagaggtacttcgtgctcgaggacgccgcgctccgctgcttcaaggccccgccgccgccctcctcctcctcctcctcctccaagcgcgaggtgactctctctctctctctctctcgtactctgttcttaatccgtgcatttttggtgcccccgtgagatcctactggtgttcgtcccccgttccgcgaaattttagtttcggtttttaatttcgatagcgatttcatcccccccggtgtgtgctggtaggaggtagtagtagattagatacgctccggatgctggtcgttgtctctcccgagggggagttattgtttccgttttttaacggccgggttggttgagatgaatcatgaatgcttcatgctcgcgcgcggcgcggccagtaattgcaatcgcgtggttgattcgtcacgacgcagcgctagttgcttctgcgaattcagagtaagtgacaggatggttagagtggtacgacgattccgccttagctgcctcgaaatgttgccgcgttaggtttgcttaatatccctttcacggaaaaaaagaagaatggttgctgggacagtgaggatcacctaagcagtatggaggaatggaagtggagccaaccgtagcattgaaccaaaagcaagagatggttatagtaatggcatggtgtgagaatatggcatatgtgatagcgtgcagttgggtgaagtgaactctagagtggcttccatttctgtctaatgggagcttatgaagctgtcatatttcagtaacatggtgtacaattcaagtgtgttaagctctgctttctcagctccactcgttatgccattgctgcattgctttggggttcttaccatggattccaaggaaaaccagcaagtcattttgatgtgactgcatcatgcttacagaaggaaaaaaggagggcatcttttctacttcttcttctttttgggctgtggggtgttaagtgtgcaaacttgtatatatatggggagggcgtaatgatcatacataagttgtaccaagcctctttttttttttgatacggtaccaagcctttgtttgcaacatgaaaacctctacgaattgatccaatacctttaattagtggaacaagcctttttagaaaagaaacagtgcaaagtttggctgctccactcctatcaattccgtgttcttatgaaacatggtaccatgctttttgctaacatttcccttttgggtacaggatcctgttagaagtgcaataattgattcttgtatacgtgtcacagacaatgggagagaaagtgttcatagaagtgtaagcccatatttttattactgtttttaccatctttaccaaaaagttacacagacaacatttgattatcttcctcaccattttattgacaggttttttacatattcacactctacaatgcctctaatcattatgatcaacttaaggtaaccactagtgttgactcacctaatctgaccttggagctattttttttttttgtacttagtgaaaataagattagttctcatcaaccaatgcttttcagttgggtgctcgaagttcagaggaagccgctaggtggatcaggtgtttgatggagtctgccttaaaggttggagtttttcttatttattttatttcacacaatcattatgttcaaaaaagcactaacgtgatatctgtcatgtgagcagtccccaagaaaagatgagcatattgttgcttgttcacatagaagatggcaagcttttaggtaagctgctatgcagatcaatctttattttgtcaattactcagcaatggactggagattaatgcactgtttatttattgagaaatgctcatacagttagactcccccttttcttttctttcctttttcagtttataaagtttttcctctttttgtatcttttgtcactgaaaacaatatgcaaattgtgaaggctactgtcaaatgtttggcacacatttgataaagtttccaaattatctaccattgtgctagccctcttttttgaaaggcataacctcttgttagtgctggaaacaatcagtagttatggctgtatgaaatgccatgagatcatttagtttagattgaataattgaactaaataattctactgtttttaaatgggatgcagcacatgctcgtgctttcaagtgctctagatttgcttcaataaatggagatatataagagatcaatgatgcctatatgtaattttatagatcaccttttctttttttgtaaacatataattaatcatatgattgatgctttgttctgagtttgactgctagcatctacagtcctatgctacatcctctgttgtacatatttggatagaagtttcattttcttcatcacttggattgacgtttaattataataagaaagtacccaactgtccttgttctattggctaatcggagactatatctttgcaggctaagccgccgcagtaaccgcatgcactcaataggtaactatcgtcttataatgtactccctctctaaaataaacaaaattctagaaatgttataatcaagtttttctaataatggctattaataatgtatataaatttttcagcttgatcattttaaatggtatctttagattcttttcatgaaaaatcattttcacataaaataatcaacacatgaatattgaaagtgagagtaaaagtttcttcttggaggctgtaaaatggcaaaattgagtaaatattcttaaattaagggagcaagacgaaattatagtactacttttagtgattcaattaactatctttatttcttattttaccgttctgtgcaaaactctaccagattggactgtattttcttctgtccataacgatcctatggcatctgatgttattgcgccttctccatggacaatatttggctgcaaaaatggtaagcataaaaaaaatctcctttctttacatcactggattttgcgctgaatccgacttgcatttaggattgcgtttgtttactgaggcaaaggatggtggttcagaggggaaggtaattcttgttctcagaaataatgtgttgtgtggactgtggatggattatgaaattcaccatgattttgcttttttttttctcagtattgggatgatcatccagctataatggctgttggtgttgttgatgcgaattctgaggctgtattccagactgtaatgtcccttggtcaatcaagatcagagtaagatatatcatccctctttg

SEQ ID NO: 85358 - DNA, 510 bp, Oryza sativa
caaactggttgttgtcttaatttataatgaaccaatatgtcttttatgaataataggtggaggatatgtaatatcgccagtcaatcaaggaaaacaatcggttgtgaagcatatgcttgctatagattggaaattctggaagtcttatctgtttaccgcatctgcaaaacacatcactatacgcatgctaggaagagtagcaggcaagtcttgtgatgcatcaataaaccattgcctgatgtgttttatcaaacttcattctgcaaattttcatattattctgagctaacttacctttataagcagccctgcgggaattcttccgagcaaaaaatggaaattgtgcttgcatagagttctcgtcaggtgagttgacaagggatatgcgtctgcaacaaggtgaaaatgagcggataaaaatcgaaatgctgtcagcaagtgaaaataacaggctagaagatcctacagaaggatcactgggtggttctaatagacacttaagtagcgctg

SEQ ID NO: 85359 - DNA, 3898 bp, Oryza sativa
  unsure (1)..(3898): unsure at all n locations
cctcatcgtccgcctccacaactccctcggcaacaggtccgtctaaaccactctcctttattttcagttttttttttacttcattcaggtctaaaccactcttcttcttcttcttcttcttcttcttctcttttcagtttttttttacttcattttgcactttgtttgtgcgtttgtgtggtaataaacagataattcacattaattttgtcttcacaagatttttgtgtctaaccattgtgtttaactgtcccatcaccttatggcctattctttttctctttttttattcttttcttccttttagaaaataaatttatggtcttgtttcttatggtagaagtcagagatgtaaaacattttttttattaaaaaacattgtggttagagtgttataagcagtttcgctgcatatttgtaagtaatactgtaaaataaaagtagtgatttgattgagatgtcgtggatgaatagtagtggaaaagatatgcaccagcttttcaaactttcaggtaggagtacagtttatcattgattggcggcgatagcctcctcctcgaggaaataaactttataccccaaagaagacaaaagcttgtgccattagtttaatcccccatttgcgaataaccaaatccagggctccagattccatctcgtttggcctttcatggctgccaatggtggctgcctgcctcctgctcatcctcatgctcatgctgatgcatatgcaaatcctgcaattgatatggctgctctgctgctggctgctttgctgctggagcatcaccacttgctcgagctggaccacactaaactgttcggctcagtgcttagctaagcttaagctattcatgatgataattgtgtactgcactagtgtccactgcccaaagccatatatgcatccatgatccttaatttcgtagtatactatagtttatttgcacatgagtggcctgccccagttgctgaattcaatgccaaagcatgattactttaattaatttgattggttatgtaattacaaagaggaggagaagttgtgttccaatgatgcactggatgctcaatctacctgtaactgttgcatttggaatcaaatcttttgctgcagcatcaaaatcttgcagattatacagacttgtttaacagtttgtttattacaaaagcttctctgcttcttttgtttttagctgtttcatgtgacatgatctgggttgcaattgcattgcatcgatcaatgctttagctagctcttcttgttcttggtgctcatggtgcttttgtcatttgttgccaacaggtggtcagccatcgccgcccagatgccgggtcgcactgacaacgagatcaagaacgtgtggcacactcacctcaagaagaggctggacgacgaacggaagctcgccgccgccggcggtggcggtggccgccggccgcatacgcgcaagcagcccaaggcggcaaagagcgccgccgccgtcaagcgcgaggcgacgccgtccgtcagcgtcgacaccagtagcggcgtgacgtgctccacggtgaccgagtcgtcgccgtcgtcggccgacggcgaccaccggcggcagcagcagcaaacgcagcatgccgctgtcaaggaggagagcttcagctcgggcggcgagctgccggcggcggcggcggcgcccacggcagcggccgacatggacgagagcttctggtcgtcgacggaggtgaccgggatgatggccggcctcggcgacatggacgaggagctggccatcgccggcacgtcgtcggcggcggcggcgaggagcgacgacatggagttctggctcaagatgctcctcgagtccggcgacatgagggatttggccgtcttgtaatctatttaatttaatcatggcagaattaagcttgattaaattaattaactaccgggaagaattgatagtatctcttctctgttgtttttttttaccttcttttttcatcttttttttcccagtttccagtgagaaaacgatgggaaattcaggtgatattttcacctttgttagaaaaaggaatactgtagtagtagcaaaaatttctttggttcgttatcagctggcttcagaattagatgcagtgcttctgtgctttgtacttaattaattaccctcgaaatgagatggttaatgttattagtagctttgcttagttaaatactgctccaaattgactgtaatggctgattatgtctcactgtgtatcagttcatggctggctgttgtattaggcttatgttttaaggtgttatacagatgtttacagttagtttttttttttacaaaataaactggggtagaaaaatatgttaccaattgccatgtctctccgaaggtcgaagattgatattcttggaggaaaataatactatcattttgcaaatccaataaaaaggacctttacacacctcaatgctgaaccaaaccatccaaaaaacagttaaacgaaactatcacaatggccacctcaatgctcacgtagcatcaagaagaaatctcaaaagattttagaaacggttaaattctttctgtgagtaacacatgacaaacattttcgcagcacatgacaagaaaaaggttgtggtaattaattaagggtttgatatcctgtcatgtacagtactccaagatgtttacagagagacggagattttttttttatgaaacgcagtacaaagtacaaacacaagcgtggaggaaatatttatgacttagcaggggataatttgctttaatcctacgtaactataaattttgtgcagtaaaatcatgttatttatatgtgatttcattagaggtttcagtatattttttctgaattttgtatggcatggttacctcaaaaaaattatatataagaaacaacattaataaagggtgccgagtactgaggatcggacttttggtatcaaattattgtaaaatgaaacaaatcctcaagttaaacccaagattcagactacgtccacacctactgaactggcttattgaacatgtacttgctgctaattttcagaaactaattaatctcaaagctcaatcaccatcggaacgtacagtgaggtattacttatgtaggtgtctacgtacagtgtacttgctacaaagaagaggtgtatatatatatatatatatattccatcaaaagtaactgaatatttcaaatgctagacttgaacataagattctatcaaatcatgatcagctggcttaccttattaattacaaaatgtcaatgactaacaaagcatttttcacaaaatcaactatgattaactaattagaccggattcttggttgacagtttcaataaaaaggcatcactagatcacaatgtacgggttcacaataaggtgaataaaatgtgaaggtgacatcagataaaataaatgttctcgttgcttttatgctcataattattgctaagtcagagaagaattagtcatgttgctctctagataattgatcctagctgcaagtaaatctgtccttagatcactagcagcagctaattcacaactttcacacatcttttgggttaaagcaactatacactaattaaccttagatcagctgacgctctctctcctctctctntctctctctctctctgacgacccttggctaatttctttggacgaacacattacacacgtacagctagcatgcataaactgacagctgaaaaaaaaatacgtgaaaacacaacgtctccgtgtcatcgaagagattacaaaaactaatgtgaagctggccatgatcgatgcctgttcatcaacgtttcattctttcaaagatttccaagcattcttgaccgaccaagctaatggtcagctgcaagaacaaatgtctcgctgata

SEQ ID NO: 85360 - DNA, 9316 bp, Oryza sativa
atttttcttaccggggtctggttttggtttccttccacaaaaaggaaagcactgtttctgcacggggacatcgtccatgcatgttcattgaactttggttggcaatgtcgtggaagatgaatttggaagaaacaggaggaggagatagctacctctccggcgaggaaaaatctgtgcaaaggtccccatcgatctcacgtgggtgtgtggagccaaggagcccaaagagtcggcacacttccctttcctcaagctcacaaagagtccttttcgtggctggttgatgtgcaattctggtgtgaaattatgtattcctccaaatggtaatttttcaatgcgatctgatgttaaacgtgcgatgaggtgattcgtgttaatggttattggttactgattttgagcctgtgtgctggattgattaaaatttatagattataatattagcaaatagtaggtgaaaagtacgttatctaaataattttacattattaatttatagaaattttttagtaaatcattttttataagtgtaatgcgaatattccatacctccatgaacttagaaagaacagtgttttagtagagttgtcagactattgaacgaacaagatagaaaagacgcggcactcatgccatcttaaaatctaccgcttcctaaaaaaccaacctcgcactaggatacgatatatcctaatataatgaatctcaacatactatatcagattctttgtagtaaaatatatcacattatagtgcgaggttgatatttttttttacaaagggagtactccccttgtcccctgcaaaactaatttttgggttcccggctaaaagttgttttttttatgaaacagaaagaaagagtactcacttgtctctaaatataaataattttagaggattgatgaagggttgtgttatcgattcgcctaagattgattataagccgtacaatttattaacaataagagtaatttatggataaaactttatatgtgttcttagtgatttaaaagccaaaggggaaatataaactttgattaaaaaaaagaccatcaaaatcaagttttaaaaatcaaatttgttaacggcttattagttggagggcaaaagatgggagccaaaggagatggaattgaatgatggaaaattacaattgggtgaggtgagtaagtaggtagagaaatagatatatactttctccgtctcatattaaattaatttttagctcctttcgtttgtcttaaaataagttcatttttagagcaaccattgcattgcaatttgtgaaagtagggattagttgtattgagagaagataaaatgaggaataattatattgtgatttgataaagtaggggtattttagtcttttttgattttgtattgctacgtgtggaatgggtgaaaaatgaatttattttgggacgaaggtggtaagacaaatttggaactataaaaatatctatgttttcttgtaagaaacggaaagcattgtttgaaaattttcggaagcgaaaacaaatttgaaactttttttgtcgaaaactgaaacagatacaacaaggccactacccattgtcaggaagccgaatcggtcagaaaatttttgaaaaattacctggaaattgtctcaaagtatgagacaaagtgatatgtgaactgtgatgttatccttatgaataaagtggtatttgttagttgctaaaatctgcaatttttattattgctgaagaaaaaaattaggtagagttcggggatgacttttcctaacctcaccttcaactttttacgtgcacgcttttcgagctattaaatggtttgtttttttaaaaaatcatactaatttagttttcaagttttttagctaatatttaattaattatgtgctaaagagctatttcgttttacatctaggagggaaaggttctcaacttcacaaatcaaactcggtacttgaaaaccttcacaactaccttcacaatcaactttaatgactaggctaacatattgttttcgatgagtcatcaaaattattaccttgttatcaacatgttcgttgtctagaaaaaaaaaataatcataaatacaagcacatgtactaagcctataacttaaattcggattgacaggtttctccacaagcggaaactagtaacgggccgagctacactaagagcgtgtccatttgaagcacaatggcgagaaatatgtccttcgtttttcgcgcacttcacatcctaaactgctaaaccatatattttttttcaaaaatatttctataaatagttattttaaaaatcatattaatcatttttaactttaagataattaaataatcaattaattatatactagtggctaacctcatatttcgtattttccaatcagcttctttctcctcctctccaacactctccaacgtaacctaagtccgtttatagtactgtaagaattttactcgtagtttttgttacttccaactataaggtggtgtttagatccagggacttaattttagtctctatatttagacattaatttagagtattaaatatagactacttacaaaactaattacataaatgaaagctaatttgcaagacaaattttttaagcctaattaatccataattagagaatgtttactgtagcatcatatagtctaatcatagattaattaggctcaatagattcgtctcgcgaattagtccaagattatggatgggttttattaatagtctacgtttaatatttataattaattttcaaacatccgatgtgatagggacttaaaaactctagttctatctaaacagggcctaatttgcatatatggccaaaacaaatgcaatttaatttggacggcgatatctcgttccccttctttttaccactggagagaatacagggggtgtttatatgggcctaaaactttttagcccatgtcacatcgggtgtttggacgctaatttaaagtattaaacatagactagtaaaaaaactaattttataaatgagagctaatccgcgagacgaattttttaaacctaattaatctataattatcaaaagtttactgtagcatcacattgtcaaaatcatggcgtaattagactcaaaagattcgtctcgcgaattagtccaaggttatgaaataggttttgtaattagtatatatttaataatctaaattagtgtctaaacatccgatgtgataggaacttagggacttgaaataagtccatggaaaccaaataggcccacagcatatgcatagaatttctacagctagctggcgttggaacttgaaatggggagagagattgcttgcgtctgtactgcttgttactgttattcgtctgacgtctcttgatttatttaactagcagtggttaacatggttaatatactggattagtttaatcaagagtacaatttcatgacaggagtattactactattcaactggttgtcctcgagaaagagcgtatatgcagcgtgaagtcaaatggaacgcgccaacttagaaaggaacagtaggaaacattcctttgtcccatttcaagatatccatgagaaaaattatattattacatgaagaaaatatatattactgctacatgcagtcggatgcagctagttctgatgaatcatactactactattttccaagtcagcaatataaagattagcttccgaagtactggaatattggtgtataggtttactagtaccaaaatttttttttagcaataaccttgagagtcgatcgagggacaaatttatcgcttatttttccaaacgtaagttccaaattagtacacaaatattagtaaaaacatttttaaatcagtatttaatttcgggctccgaggtactcccccgttccataaaaaatgaatttaagaccgaatgtgacacgtcctagtacatcctataaatttagacagatgtatgtccagattcgtaggactagattgtgcacattcggtactaggttggtttttttatgggacggggggagtacatagaactatagaagtagcagctatctttatcatttctttctttctttcttgtctgctctgtaatttttttcctactctatacaatgaattatcacaccgtctggtcgacaaaaaaaaaacttctcatctcaacaaatttcaaccatccaccacttcactttatatactccgtgcataaatcaaacgctatatagatatgttttgagacatgttgtatttaatttagcacactcccttcgtcccataaaaaataaatgatataagatgtcgcacatcataatattataaatgtgaataaattattatctaaattcatagcactatgatgtaaaggatgtgttacattatgtaggtttgtttttatgaaacgagggaaatacacaataacatactctctctgtaaaaaaagttattaccttcgtcccaaaatataacaatctagtattggatgggatatatcatatggctccatcgtttcgcttattcagcaaataagcgaaacgatatatttgcaaacaaaaaattaatttgtgaataaaaattttatatatgtatttttagcgacataaaagtaaatgctgaaaaataaatttcgatgaaaactcccctacatcaactctaattttaaagtcgaaagtttaaattttgacttaataagcataagcggaaagatgacggccgatagtttaacgaatctacacactctcttagccatatttatttgattaggatttgtcctatttaatttcaagttgctatattttgaggaaaaaaatagtataagttattttgttcggaggggagtattgcaaacaacgggccggtactcctaccagctgatgggatcgtagtagtacgaagtacgaacactgtttgcatttaattggagcaggtacgttgcatcaggtcaggagcgcctgcaaatcaagtcatatcaggtcaggcctggtttagttccaactttttcattgaatttttaacttttctatcacatcaaaactttaggtatatttagttttacgttaaaattagaagtttgttgaaattagaacgatgtgatggaaaagttgaaaaagttaaaagttggaagataaagtttggaaactcagcttacacacacaaacttctaacttttccatcacattacttcaatttcaatcaaacctccaattttgacgtgaactgaacacaccctcattcccaacccaatgactagaatagtgaccatagcattaaataagctgctaccgatgaaagatgatgtgacaaatgaataaatgagaaaagagaagaaaactaggtcttgtatgagacatagtttctacatatcatgtgagataagtagtattattaaatttaaatataaaaaagtggtgtttgcattgaaagagtagtatctagtgatagtttttttttatgatgtaaagtttatgaaaactatggtatgttagttcacaccaaacttcccccaaacttccaactttccatcacatcacatcacatccaaaacttttctactcacataaactcctaactttttttctaaactattaactttttctaaacttctctccaatttcaggaaacaccgtctatgttctagtattttgaattgggaatggcttcgctagctacgttgctagtagtagatcagtcgtcacaagagacaagaggaacagccacgtgtgacgattaattaataattaagcagcaaattaaactaacagcgcaactaaataaacaaccctgtacgtactagtacttaattatcaatgtaggaaaatttgtccgtttgtaacgcgattaatttcttcgtggccggatccatatcacgtgtgcgtcagttttcagtgtaatagtagtaatcagtttggttcaacttgaaccggcccttcgtcttcgtcaccggccgccggagtgagatcgatcgatcgagacgtacggcgtcctggaacggcggatgcatctgtcgccggcgggggccaccgttgccggcgtgctagctccagctagctagctgtcactgtcgatctctcatggcgggggccgccatggcggcttggagttggccagtaaccggaaaaccctagcagccggccggagtatagtaccaacttgcgtcatatcatcgaccaataattctgtcaaaatattaatgactgactaagatggagaaaattgcgagtgatatatgctgtgtaattcttttttcttacttttgcaaaatgagtgatgtgtaattcactaactgcgctaattaacaaagacgaagtattcctgagagaaaacaaattataaaagacttcactagctgaatcatatagagcaagaccgattgtctaatggtctgtttggtacagctctaactcctaaatattgctccaggaattgagtctggagtggagttgtggagctgcctaaacccagctccacaactctaggacattttgtgagatgtgagatagctccacccaactccactctcagttttggtggtactgaaactgtttggctgagctccagctctagaaggggtggagctgtgccaaacaggccctaactgacaggacattaaaaaactagtatatatttataaataagataatactatttctcctccctccacccgatatatatatatatatatatatatatatatatatatgagtatttctagtttcgggtttattttaaagagattaaggatgaggtgaaaaactttagtgagaatggttggggtggaagagtgatcgggttaaaatgaaaaaaataagaatgagaaatgatatactcctatgcgtccaatctttatgtacaacttacaacctagtattccgtatgcatgtactaaatgcatactccctctatccagaaaaaacgaatctagaatcagatatgacatattctaatatgataaatctggatatatgtgtatctagattcatagtcctagggtcacatttagtactaggttggttttagggacggaggaagtaggtgttgcttgtctggcccacacgataacaagctcagtgattggtagacgtgagacagtaggacgtgagtcgtacgtatagcaggttgtatatttatagataattttaaaacactttaaatgcttatatttaatttatggatagaagaagtatatataataaccctatgagatagctgaaattaatggacagatgaattatctgatttttgatagctacccccttggtaaagaaaaaaaaaatccaatcattggatttttttagacggagtagtatatgtttaaggacacaaacaaataaataaattactacaaaattaaaaagttgctttaaaataagtattttaggaaacacactatttaggaacttatggagcgtgcaaacggaaaccaaaaatccaaaattggaaaagaataataatactagcactaagattttttaaaggtgctatcaccgtacactaccgaaggcattgttacggatactataacttgttggtttgagcttataagtttcaagacaaaccaattttactaaaacttgctttctaaaataatttaaggagatgtttcgttggttaccatatactccctctgtttcatattataagactttctagcattatccatattcatatggatgctaatgaatctatacacgtatatatgtctagattcattaacatatatatgaatgtgggcaatattagaaagtcttataatatgaaatggaagaagtaagtccttaaagataaaagtatgacctactactttataaaaatagaagtttttaaaatatttgatgggaagagggcagtatgtgtaattatatgtccttaagcaaagtgaatgtaacttaatttaattggttaggctctttatagtgaaataagtccacatagattcaagttctagacttaacacgggtacccgtatttatggctaattattttttttagtggcagatatccatgatgacttcatcaatgtcaagacttactggacaagtctttctgagatgctcatacagatatggtatgcatgtgtgcgttcaatccaaatttcgaaatccattcataaaatccacagggctcaaaggacattttctcataggatttcaattcgttaaattcctttacaaaattattgctccccaaggagaccttagagactgtcttcacaccttgaatctttaagcaacaaagatcataggaaaacagcataagaaccatttgaattgaacacgggcaaaacacgtcatttgaagaatttgagaggtagctaggaagaaaggaaaattttgaaggaggtttggagtttatgctacaaatcctctaaaattgcaatgaaatatctatccatagaaatttcaaagaaattataggtacctactgtaatcctttatccaaagggtctcagtgaaaattgtcttataggagagtagtagtatttaaatccttcaaactttatgtggttttcccgtgtttcaaaatggagctagcctcatataccttatgtagtactccatccattttattttacgtgtatttgttggtttttttctaatatttaactgtgcatcttatttaagtcaagcattatttatcttatgttttatcatctaataaaaataataatactaatcataaaaaaatatttaaataagacgaacaataatattggataaaaaacccatgaatgcagtttaaattgtgtaacggaatgtgtattatcttagtgaattaagatactactccctccgtcccataatataagggattttaacattttggttgcactgtttgatcactcgttttattaaaaaaatttagaattattattattttcacttactttattaccaaagtattttaattgggcagttggctattgttaattgggcagtgtacgttgccagctaccgatggagaacaatccccgcagaagtgccctgtagcagcacagcaaatctcctgtacgcctggccgccgtaagcgcaacttgccccgagcgccattggcccgcccaatccaagctcgctctcctcctcttcatttcattcatctcacccgtgctccccggccctagctagcttagctctcgtcgtcctgcagtcaaagcagcaacagtgtcgctcacactgaacccaactcccggagtgcacaagcgaagaaacactctggctgtggggttttgctgcgccccctgacgatcgatagatgaaagctagcgcttgtgtgtttgtcgtccaaaatcaactggccgtgtttttgattcaaaatttttttct

SEQ ID NO: 85361 - DNA, 601 bp, Oryza sativa
caccactttcgcagtgaccagcaataagtatagtatatgtaacaagatcaggtcaacaccttggcctctcatcatctggatgattttaggaatttcttttgttaaaccaagcaatcggtacccatgataaggctattgtaggtcacaatctcaagttccattccttcttttgtcactctctcgaaaagatccaatgcttcctccattgaacctactttacatagaccgtgtataagggtagaaaaggtatacctgtcagggactaatccatatttcagcatcaggcataaaaatgattttgcagactgaacaaacccccaattacacaatgcagacataagaatgttaaaggtcattcccaagggtttaaactttccctccttcctagcttcctgaaggaaagataaagcttctccaaccttatcttgcttacagaggccattaataataatactatgcgaatattcactgggagagacaccacaagactccatttcttcaaaaagctccaatgccacgtctgtcatccttaagccgtgcaataaactgtcataggtgaacaccgagatttgcatgtttaggctgctcattttactaagaa

SEQ ID NO: 85362 - DNA, 511 bp, Oryza sativa
gagtttgcaaagggaagtgacaaatcaacatggggctctgttagagccacgatggggcaccctgaaccattcccactgaagtatgttgcactagggaatgaagattgtgctccattcaagctgatataccgaggtaaattttgcataataaacaaatagtattgtccttcgtgttaatgctgcgatgattggctaaattcatcattctgttttttatcgatctgcaagggtaatagcactattttatttaacttcaccctttttagtactatctgattgcataatggagatattttggagaaataatagatgaaaaaattggctgcatgccttgtggcagaggccagggatgtaaaatatttccattataaaaaaaataatagatgaaaagaaaagcaagaagttaatttaccagtctgctgttatgtttcgaaacagactttaccagttttagaaggttcattagttttacatttgattgaggccaaattggctacgacgtataatgctg

SEQ ID NO: 85363 - DNA, 595 bp, Oryza sativa
tatgcataacaacggttatttccatcgtgacctgaaacctggtatacctttcgactatattctgttgaagttataggctgtctatataccctagaagttaattagccttctctctttcctctttagaaaatctgttggtgacagatggcactgttaaaattgctgactttgggttggcaagagaagtatcttccagtcctccttatactgactatgtttccaccagatggtgagtttgtgtttcaaatttatctctgtataaccagtgaatatgtatacaccactttatccaaattattgtgaaatggtgaaggtatcgagctccagaggtgctgctacaatcgtcagcttacacacctgctattggtgatgcctattatcccagcccctgcattttactacttccatttttattaatgccagctcaacatgaaatttgagtttgtgcatataaaactcgcattgcatgaaactactgaattatataactgatagatgtgcacttcctcagatatgtgggctgttggtgcaattttggctgagcttttcacactgtctccacttttccctggtggaaggtatgtatgatactgtt

SEQ ID NO: 85364 - DNA, 560 bp, Oryza sativa
acaaaaaaatgggacagcaattcgacgtggagacaacatcaccagttcatctcaaagaacttctgatgtcttcattgcagcacctacagcagaaaaagaaagagttaaagttgcaaggcctctctctaactctactgattctgcaccaaagaaagatgggatgggacagcgaatcaataacattagcatactggttcagaagagaactgatagtccaaacaaagagactgcgaagaaagaagctggcaccaattctccactgcttccaagccctgctaataccatgcataagggaaatggtaaggttggtcggccaatggagattccaacacagaggtttgacagtccatcgacttctagtgcaacagcagggacagatagaggaatgcctaggtcatctatcccaagcccaagtattacaatacgaaggccaaatgggcttgtacgaccacctgagagcatttccatttcttctaagaaacctgatgcaggaggtgcttcccctgctatggggaaggaaaaggaacagggtggaaggatattgcagaataatattatcg

SEQ ID NO: 85365 - DNA, 844 bp, Oryza sativa
gaaatcaatcacctcatgtatggcaaatgcaaggatttttgaggagaaatcaaccggctgatgtatagcaatgttgaataagaaaacattttcccccctcaataaataaataaataataatatttggagtttaactttaactgattttttgtctaatttcttgctttaggttttgaagctggagccaacacatcaaacattgacccatggtccatcattggagatgaatcctctgttcacgtgacaactgatcgctcatcctgtttcagtcaaaatcctgttgctgtaaggatagaggttgtctgtgacgattgtccagccggtggtgttggaatttacaatccaggattttggggcatggtatgagttctatccatttttataagtgcattcctatatgaataatatgcaaaatagagcttgtaattgaaagtagtatcctttttttttacgacagtttacaataaacagtgctgccacagaaagaaactatagcaaagttatttattctgttcgaaatggtgaagaaaacaaataattaagctaacctattttttgtttgatttcaatttgcatttatcttttccttgcataatgctggttttttatcagattgttgtgcattgctcttggaaaagtgtaatctatagcttttcttcgaaccgtttcattttaccttctcatattttaatgggattttaccttctggttttgtgacgaatatgatcatttcaattttcagaatgtagaagaaggaaaggcatataatctggtcatgcatatcagatcattagaatcggtggagttgacagcttcactcacatgctcaaatggatcgcaaaat

SEQ ID NO: 85366 - DNA, 793 bp, Oryza sativa
ttatattttgggacggatggagtacaacattagtgcaaccaaatattaccacattgtatttcgaacatagattaatggataccatcgtaaaaagcagttccacaaagattgtacaagaagccatcaagagaccaaaaaaagtagaactagcatatcagtaccctgatagcagcaaccaaaaggaaacaaagtatgtgatatatgattgattctacccattagtttgtaaattgaacaggaaaacagctatattcaaatccacaagagaacactactacaatgtgatacaaacctaacgctccttatcattactccctctgtttcatattataagtcgtttgacttttttcttagttaaacttctttatatttgaccaaatttatagtaaaaatgagcaacattgaaaacacctaactagtttaattaaatttaacattgagtatattgagtatattttcataatttgttgttttgtattaaaaatgttagtatatttttttataaacttggtcaaatttaaagaagtttgactaagaaaaaaagtcaaatgacttataatatgaaatggagggagtattagtcaatttcaaaatataatcatcctcaaaagacatagaaaaacataatttttcacaacaaacaaaaaattattacacatcaaacagaagaatagaagatattactaattgtaacacaacagcttaacaaatcgtgccattatttgtcatttttcaaaagataatcatcctcaaaagacagtgaaaacttattttcccaagaaacaaaaacaaa

SEQ ID NO: 85367 - DNA, 1314 bp, Oryza sativa
caatattttgcaggaggtgcttaaggaggagacagccgctgggctgtggttgaagctggaacagatatgcatgactaaggatctgaccagtaagatgcacctgaagcaaaagttatttttgcacaaattgcaagatgatggtctgtgatggaccatctctccgctttcaaggaaattgttgctgaccttgagtctatggaaataaagtatgatgaagaggatttaggtcttattctattgtgttcattgcctagctcatatgcaaacttcagggatactatactttatagtcgtgatactctaactttgaaagaagtttatgatgctttgcatgccaaagaaaagatgaagaagatggtaccctctgaaggttcaaattcacaagcagaaggcttggttgttcggggcaggcaacaggagaagaacacaaacaacaaatcaagagataaaagttcaagtagctaccgtgggagatcaaagtccagatgcaggtataagtcatgcaaatactgcaagagagatggacatgatatctctgagtgttggaagctacaggataaagacaagagaaccggaaaatatgtaccaaaaggtaagaaagaagaggaaggtaaagccgcagttgttattgatgagaagtctgatgcacaattgcttgttgcttatgctggttgtgcacaaactagtgaccagtggattcttgatactgcatgcacctatcacatgtgcccgaataggaattggtttgccacctatgaagctgtgcaaggtgatactgttttgatgggtgatgatacaccatgcgaggttgcaggtattggaatagttcagatcaagatgtttgatggctgtatcagaacattgtcatatgtgcggcatattccaaatttgaagagaagcctcatctctttatgtactcttgatcgcaaagggtacaaatattccggtggagatggaattttgaaggtaactaaaggctctcttgttgtgatgaaagctgatattaaatctgccaacctgtaccatttgcgaggtacaactatattaggtaatgttgctacaatttctgattcattatctaattccgatgctattaatctttggcatatgcgtcttgggcatatgagtgaaattggtttggcagaattgagcaagcgaggattgctagatggacaaagcatcgggatgctcaaattttgtgagcattgtatcttgagagaatccattacatgccactgactttgtcacacgtctatgatttaccactgactttatcacgttctacgatataccatcgacttttgcttaacttct

SEQ ID NO: 85368 - DNA, 1817 bp, Oryza sativa
aatatatgctgatgatgcagtattatttttcaaaccaagtcaacaagaagccaaggtagtcaaggcaattctacagatttttggtgcagccagtggattaatgaccaactacaataaaagtgcaatcactccaattcaatgcagtcaggaacaacttcaggtggtggctaatgagttgcaatgcaatattcaattattccctatcatctacctgggattaccactgtccacaagaaagccaacaaaagctgaggtgcaaccaattctcgacaagcttgcaaacaaagtggcaggttggaagcccaagttgttgtcccctgatggccggctctgcttgattaaatccgttctcatggccctcccagttcacttcatgtctgtattgcaacttccaaagtgggcaatcaaggacatcgagcggaaatgtcggggatttctttggaagggacagcaggaggtgagtggtggacattgccttgtagcctggaaagatgtctgtacaccagtggaaaatggcggcttgggcattcgaaacctggagctcttcggcaaagcgctgcgcctgaaatggccagccaatcgcttacatcagaaggataggccctggacccttgttgacttcagactgagcgcagatgacgagaaaatcttccaatctgcatctgaattctgtgtgggcaatggtagagacactaaattttggtcggacaattggctaggtggaggaagcattgcctggagatggcccacccttgcgacttttattggtagaactaagctcacagtagaacagggactcctgggacatcgatgggtgagagatttgcaaggatctctctcggatatagcaatgatgcagtattttcagctttgggacgaaatccaacaaatcaatctcagtcaggaggaggacacaattcgctggaagctcactccggatggttctttctcagtgtcctcagcttatgatctctttttcatggctcgtgagatttctccttgcggacagctaatttggcagacaaaagctccgtcgaaggtcagattttttctttggctagcaacaaagggcaaatgcttgacggcggacaacttggcgaagagaggatggccccatgaagatcactgtgtactctgccaacgcgaataggaggattgcctacacttgttcgtcacctgtgatttctccaggcgagtatggcagctgctgcgagcatgggtcaatgtggatttccctctgccaggacaagcgggagaggggctgataggctggtggatggtggcacgatgccattttcgaagcagctacaggagcaactttgacagcgttttcgccttgacctgttggctgatttggaaggagcgcaatgccagaatttttcagcacaagcagcagaccgtggagcagttactggaagacatcaaagaagaagtttggatgtggaagtctggaggctattttcagattatgtaatagagacatcatactttctttgtagccttcgggcttttgtgtatggctttgattgggggggacctgtccccagcctaatctcgacatcctattgtcgatataaagcccatttgtaatttgttccccttttccttaatgaaatttggtcgaccgaacctttcggccgacccggcaaaaaaaaaagacaaggttagctccttcagtttgcaaaatgcgaagggtgtgtgtgtgtcactgttgaacaagcaatttaaactatccagtccttcaaggcaaagaacttgtagagctggcagctgccacagtggaggaagcttctcgagatttttgcaaccatctaaca

SEQ ID NO: 85369 - DNA, 701 bp, Oryza sativa
aaacatcatatccatggctatcaaacaaaaaggagacgtgatctcattgataccaagttcctttttgatgcattctacatttttatctggtcaacttaataattcccatatcattactaatatccaaacaaacaactcgattttttcttagaagcaataaagggatatattataaataaagcgagttgttcaaactaagctttaattaaaaccatccttggcctaatgggctctgatacagtggaataattagcttttgatcactatgaaatcctgggatgtcattaaggacagaaacagcgtcccaacatgttagcctgataaacttgtgctaattaaacggctaaaccagagcaagatcaaacgaacaaattgagtaaggaaaatgtaagacttgcatctgttctgctgcattcggcaactcgctggcaactggcacgacctgcaatgcgtgttcacaagaaacttgtatgttagaccaacttgcgtaccctgagatatcgtgtgttacaatagattctctgtgttctttagaaagacaaggaaataatccagacatgacaaaataaaaggcagagtacggatatatctacaaaggtgtttatgtagcacgcactacttgacaaatgcgatgcataccacctgcatgtctaattgtaacagaccagatttttgtaatggagaagttaccctcttctaaa

SEQ ID NO: 85370 - DNA, 677 bp, Oryza sativa
aaaagatggggccgaaagaaacaagcaacatagaggataaaaacagcatgcatgaaactagcatcaccaagcaagagagctattcaaacagttaactgggctgtcacaagcaggcttgctttgccaaatgaaagcattaagcttctaatacgttctaagagttagtaacaagagcatcataaagctatatattcctctccaactagaagttgcaattttgcctgccacttcaaaaggattacctactgctactgtctgtacatgacaaaaggaacctgcatatatcactagcaagcacaaatcaatctcattagttctttcttttttagatgccctggttgactgccaaggtagtgctgcagatggcacctctttatcagccacaactgcttccgctttagagcttctcaaactcctccttgtcatcctcgctgatgggcgtgctctttcattttcttccaccagttcagatttgactcctctgcgtctagtcctcgaatgctggttggctgatgggacctgatcttcctcaggttcgttaacatcctcagcaaggtcatcttcaccctccaaccaaggccattcagtaccacaaccacaagctagctaggcatacatacacaaacaatttagaaagccactcctgttcatatgtgtaaagtggaattaaaaatagg

SEQ ID NO: 85371 - DNA, 508 bp, Oryza sativa
caactgattgcgaagaagctctgactttgcttcctgttataaagaaagaaaaaacataaagctttatgactgtaatagtatgccgtcaaggtagaacatttggaagaaaatataaaaggtgctcaagacctgttcgccgagggcttttcttagtttattgattagggttattctagccatgttgacactttcaagttgctcaatgcactgcttaaggactgtttcctgcccttgaaggtcagaaatcaacgatgatccttgctgaatacctatgaaataaaaaaggagtaaggtgcgcatgttttgatcaagaatcgaagtgaaaggctgaaagcattatagtgtcaaagcatcatttcttcatatctggtctccaactttgtaaatacagaaagtcagggtacaggtttccgattagagtgaaatgcatggtcggtccttaaaattgagcagtggtgtcacttgggtccgtaaacttgaaaattgcgcgtttaggtccatgatcttg

SEQ ID NO: 85372 - DNA, 8532 bp, Oryza sativa
gatatgattgcagatgtgatgaggaagcagtttgggcttaagccgaaggatactggaaacttgtatcggcatccataccttgagtggtttgagagggttccattacctaaccgatacaaagttccagatttttcaaaattcttaggacaagacaatgtctcaacttatgaacatgtcagccgattcttggctcaatgtggtgaggcatcggctattgacgctttaagggttaggttgtttcctttgtccttgtccggatcggcatttacttggttttcttctttgccctacaaatctgtcaatagctgggccgatttggagaaacagtttcacagttatttttacagtggaatccatgagatgaaactatctgacttgacagcaatcagacaaaggcatgataaacctatgcaggattacattcagagattcagacagataaggaataggtgctacagtttggctttgaccgattcttagctagccgatctggcttttcagggtctgatagctccgatcaaggagaaattttcatctcaggagttcgaaagcttatctcatcttgcacagaaggtaaccctgcatgaacaaatgtttgcagaggctaagaagaatatcaaaaagatcaaccacgtgtacccttacatgtatggttccgatgaagaggatgattccgaagtagcagtagtcgagtgggtcaggagcaagaaggttgtgccattgtcacgactggaattaacccaataggcattccatacatgcgtgtattattccttgtcccaggaggcaaggtacaccaaatgttgatacaattcagagtttaacaagcggaagcgtaaatagttaatttattacatgggcgacgaaggcccagcacacacgaagataaacgaaaaacagctgaagactagggcgacgaccacagacacttgacggcaggcacgagctagacactaaagccttcatcctccaggaactcctcttctgggttggggaaaaaattgagcaagattgagtacaaccaccgtactcagcaagacacacccacgaatgcagaataaatgcaaaggagtacaaggcggttataataaaggggttagggtttgcagtaaacagcattaacaagacttttagttgctcagggtcattttgtaaagacgatcctagagctacacagtgttattaatcaaggccgtgaacccgcacaaacctgccttaacccaagacctacgatgattcagactaaactggcaaccagacctgggtcccagctcatcccaagccaaccctggccaaccattccacattttagttgttaaccatgttttaagaaataaaccactaacttgggtacattgctaggctttgatgtgcactagggttcccgatcttccgaaaggttctgataaacaaatatttgggcggagtcgcgacacaaatcgatccggcttcatgaacgcgcacgctcttgagccccgcaatcgcagcaccacgtctcctctggttatcacccgtgtcgaaacgcggatgacctcgccgagaaggctaatccctgtttgccaattgaagaatacaaacaagaatgagatagaaaacaaccaaaattgcagatgaatgattaagctcacaagttggggtcttacaaaccgatctagcggcgaaactgttctcgatagaataatctaagaaaaacccaaaaacctaaagatggcggcgggtactgatacatagagtttagggtcgtgcaaaccgctctcgatgcaaccctaatggagaacccaacacgatacacggcccaaaggcccaaatacggtgacgcaacaccgggatagattctagacatcaacttgttctgtcgattcccattgactcggaaagaatttggacgtgggaccaaaaccattggaaatgcgatcttcttagctttccatccatataaagaatgccccaatccgagcacgtatgcgacctgggcgcccattttagtgtagactggttctagactccgaattgcacccgaggtcgacttggtttgggcctccaccttgacttggacatcctcgaggatcctccatggctctaagtccttctccaagtgtctccttgtcccctccattgtacctaatcacaatataatcattaggtagcaatctattctcgaattcatacaaagaagaacataggaatgagctcacctctaaattcaattgtcgcgcacgagctcttgttatcggtccttgaatgaccgttggaggattgttgtttgtatccgaagtagtgatgtccgcattaggcttgcccataaccgagggcgcggctattcggatagattatactctgatcagagatgtacatctttaccgacaagacacgtcttcctcatgtgtaaccgtgcgccacataccaccacggcatgcggacggaagacgtgacatagttcccaacccatcctagccataaacaagagtaccgacccaaccctggctacggccggaattcctgagacaggtaacctaggttgagcccctagcagcaggacaccggccctgtgccatgacatctcgactaccgggccacggctcgtgtagccttcatttgtcctagaggtgtccatcgagccccgacttcgtccatccctatccgtgtacttttgcccatgaccagactgagccacaaactaagccttacccactagacatgtggaagtatggtagtgctttgcaacagaggcccaaagaccggtccttatagtggccgaggtgctactatcaaaaccatgcacctcgagcccagtctaaaactattttgggggttttgaatggaggagaaggggtatgtccattttcacataagccaaccattccataatatccaaatgatatgtgcatttccaaagtctaaagtaataaaaccacctaatattgcctaatttatcagcgaagcatctacctaaattcatactagtggaaccatgaatagagtacccactagttggggttttgtttatcctagggtgaacaaggtaataataacaatagcaataataatgaggtcataacaaaggtaaataagcatggctaaataaaacagtgataacgcgggaatttaaataaagcgataatggaataatttaaaccaaaataattttataaactgggattcagtatgctcaaggatgatgtgacttgccttgctcgcttcccaaacgtcggcttcaacctccacgtagagcggatcttctgaagctgcagcgtctacacgaacaacggaaaggaaaaaggcttttactcaaataaactccatataaaaaacagaaacaaaccataaaaatgggtccttgacttcttaaggaaaaattagagacttgaacggtccaagtccgagttcaaacgaccaagttatggccacttgaagtttatatgctctttaagtgaatatttgcgaattgcttcatttaaaattttagttaaaacaatttattgtgtgagctgaggggagggggcgcgcgggctgggtccaagggagtggtgggccccatgcggcagcccctcggtccacggtggaccgggtgcacccgcgggctcaccagccggcgccgtgggccccactcgtcagccgcacctaagggcacgggtggctgacggctgggccccatgcggcggccacacggcgcgcccggaggcagccacgtcggcgtggccggcgggaggcggcggtccacggctcacctcggtcgacgacggcgacggaggaggcggtcggtggcggagggagacggtggcgcggctcgggttgacgaggacggaggtgttccggcggtcggcgagctcggctaggcggtggacggggtcggcggcggtgcggtgaagccggaggagacgacgtcgaggcgggggacggtcctggcgagcggctaggcccggccgaaggtcgacggcgacggcagagagagaggacaacggcgtgggcgttaatccgacggggaggaggggcggcaaatggcggaaacggactagggaggtacggggagggtttatatagggttgggagtgagagagggcagctagagggtaaggaaaccagcgtgggggtcccggtaggcatcaatggcaccggcgagatttgcgggagcaaatctggccgtttgaatgcgggagggggaggggaaaatgggggggaaagggagagggaatcacggggaacatttcccccctcttaattgcacgcgggaacagtcggggcggcggatttggcggcggtggcgctaggcgcaggcggagagagcggcgggaggaagggatgacgggtgggccccacccgttagcgagggtggcgggcaggcggaatttggccgagagagagagggaggggatttttagggttttctttttatgaaaccttttcgactttgtttatttattgataattattatttgtgctgtgaaaattctactaaaatttatttacacattttaggcttttaggaaatgtacaaaaatcctccaagccttatttgacttttaactttgcacattttaattttggaggctttcacttggattttaattattctaggcataattttaatgatatatttttagggttgtattgggacgtgataaacctaccccccttaaaaggaatctcgaccccgagattcggaagaactggcaaagaggttgggatgggctgccttcagcttgtcttcatgctcccaagtagattcttcctcggcgtggttgctccactggagcttgcaaaaacggattacccgattccttgtcctgcgctccattgtgtccagaatcttcactagcttgtccacgtaggtcaagtcttcacgaacatcaatctgctctgaatcggcctgctcggacggcactcgaagacatttcttgagctgcgacacgtggaacacatcgtgcacattgcccaaggatgcgggcagctccaactggtaagcaacttcttcgcgtcgagcgatgatacggaaaggtcccacatacctaggtgcaagcttcccttttgtctgaaacctgtgcactccccgtagcggcgtgacccgaagatacacaaaatcgtccactgtgaactccagatcgcggcgtcggttatctgcataacttttctgccgagactgtgccaactttaggttatcccgaatggttctgactttagcttcagcttctcttaggatatcagtcccgaatacttggctttccccaacttggtcccacaacagtggagtccggcatttgcgtccatacaacgcttcatagggtgccatttgtatgtaggagaactcagcataggggacacttttatcccaggtcttcccaaaatcccgaacacaagtgtggagcatgtcttctaggacctgattcagacgctcggtctgtccatccatctgcgggtgataagcggtgctaaaattcaatcgggtgcccagctcttcttggagcttcttccagaagtgaggtgaattggcttcccctatcagacataattttcttaggaacgccatggagactcacgatcctggcgaagtaaagttgagctaacttgttccctccataggtggtcttcacagggatgaatcgagccaccttggttagtcgatccacgactacccatatagaatcatatccaccttgggtttttggaagtccggtgaagaaatccatcccaatttcatcctatttccattatggtatctgtagaggttggaggagtccggccggtcgttggtgctcagctttgacacgccgacacacatcacaaagggccacgaactctgcgatttccagcttcatactgacccatcaatatttctctttcaagtctaagtacatcttcgtactgccagggtggctggaataaggactttcatgagcttcctgaagtatcaactgtttaagttccttgtcgtccagaatgcatacacgatttccattccataaggttccgtgttcatctttcgtgaagccagcggctttaccctgcttcatattcttaaggatcccgtgcatatccggatcattcttctgggcctcgcgtatttgatcaagcaaggtgggcttggcttccagtgcagccaagaatccatggctaatgacacttaggttcagggcttccaactgttgattaagttctggtggaatgccgcggacgcaaagagaactgcaatagcctttttgactcagcgcgtcggccaccacgttggccttaccagggtgataatggattcccacatcataatctttgatgagctctaaccatcttctctgctgaagattcagatccgactgggtgaagatgtatttcaaactcttatgattggtgtatatttcgcagcgatttccaaagagataatgccgccagatcttcagagaatggaccatagcggccaattccaagtcatgggaaggatagttgccttcatggggtcgtagctggagtgaagcataagctaccacatgaccttcttgcattaacacacaccccaatccttggcccgaagcgtcatagtacaccaggaaatccttgcgattatcaggtaagattaacactggcgaggaaaccaacttttccttgagagtttgaaatgctctctcacactgcggactccacacaaatttttcttccttctttagcaactacgtcatgggcctggcaattttggagaaattctcgatgaacctctgatagtacctaccaaacccaagaaactgcggacctgggtgaccgtcttgggttgcttccaattggttatggctgttactgtttcgggatccacagtaactcctttagcagatatcacatgccctaagaacttgacttcggacaatcagaattcacacttgctgagcttggcatacaactgatgttcccggagctttcccaacaccagacggagatgctgcttatgttcttcctctgactgtgagtacaccagtatgtcgtcaataaagaccacaacgaacttttccaaatactccatgaacaccttgttcattaaattcatgaagaaggtaggagcgttggtcagaccgaacgacatcaccgtgaattcatacagcccgtactgcatggtgaatgcggtcttagggatatcttctgcacagatacgcaactggtgatatccggaacgaagatcaatcttggaaaagacagtggcaccttcaagctgatcgaacaaatcatcaatccggggaagagggtacttgtttttgatagtgacttcattaagagctcggtagtcaacgcacatcctctttgtcttgtctttcttttctacaaaaatcatgggagcacctcagggggaagtgctcggccatatataccccttctctttcaactcttccaactgcttcttgactgcggccaattcatttgttgccacacggtagggtcgcttgtacatgggagcggttcctagagcaagatctatcctgaactcaatctcccgctttgggcggcataccgggttgctcttccggaaacacatcaccgaactcgttggctacgggtatttctgatagtcctagctaatgaagtactgagttgccggtgggagttgggtgcgcaaagaagacagccggttgatcaggcttccggtacacagtgacagtacgtcttgtgcaatccactactacttggaattgggtcaaccaattgatcccgaggatcacatccaagtccttggtgtcaagaaggatcagatccgaggggaaaggaattccctggatctctatagatacggccggactataatactttgttgtcatagcccctccaggggtggtgatgagcagagagctcctaagctttgctacccccagttgatttctccccatgaattgcacagatataaatgagtgggaagctccagagtcaaacaaaatgatagtggggatggaatgaatgaagaacgtaccggcgatgacatctggagttgtcagcacatcttctgtagtaatgtggttcacacgaccccgagtggcatcctttccatcattgttggggtggggaggcgcttggccttgctgacgcctcggcttcgggcatttatccgtgaagtgcctaggctcaaaacagtagaagcacagacgcggctgaccttgaacatccctgcgtccttgactaggctgcacggccggtgcagggggacggggtggaaggttccctttctagttctgctgctgctgcggctgtgggacgcaaaccacaaattaaggtcgtggcgcggggcgaggctgctgttgctgctgctgctgtgaggaggatccccctggatagggattggtgtagcggatcctttggttagccccatgttgattacggaaattcgccaagcgacgcttgtgtgactccagttccttgtgcttggtctccaggcggatgctcttgtccaccaggcgctggaaatcagtgtaatccccggtgaccagacgcaccgaaaagtcagggtccattcctaccagaaacttctcctgcttttcttcatcttcacgaacatcctcctgggcgtac

SEQ ID NO: 85373 - DNA, 748 bp, Oryza sativa
aagtgcaaccgcagtttaacaacttccaagatcagattaactatgcagcgcaacatgctttgatcaactaatcaggagacctagtcaataccttaacaaacatggtaaagtctgtggttgatggtacaatagctgagcatcaagttgcgggaccagtttatctttcaggaggcatcttcccatattacaaaaacttggtaactggtaaccagaagtttgctaccaatgcaccaccaattcagccgatggcatcagcttcgactccagcaccacctgcgccatcatcggcaccaaggcaaataattaataatcctcgcctcttgtctagcgaacaaccgcaacatgctggtcagaatatcaatcggctgtcccgggagcaaattgcttgaatgtttttgccaactcagccaactggtggaccaattcagcagacgccgccaaggcagcagacagttcagtcgattcaacagcagacaactcagccgatacagcaacagatggtccagctgatgccgactgggttgaggacgcctgataatcggctgacgcatcaaaatgtgactcaggttgtccctgagcatctggtacacattgtacaactagatcaatcggttgcagcctaagttatccctgagcacttagtgcgtaatattcagccgaatttccataattgtcaagggggtaacttcaattatcaatatcagcctccttcgcctcatgctcagtatcaacaaggggctgcaggaat

SEQ ID NO: 85374 - DNA, 1727 bp, Oryza sativa
tcgtttctgaccgttttcatccctagctgccgatgatgagggagcgatgctcttgatgtctatcggggggagagtggacggagttttcccgacaagccatgccatcatgacgtgatcttgaattagcggcgctaaggcttggtttgtgatagtcttgagatcggagaggtggagaccctgactgccaaatggtgtatgaaccgaggcagagggctgccgagtgcttccctagttgactggactgaagcgggaaggaagacggagtcgtcgatgcccgaaacgaatcctattgcagtagtcggcgaaaaacttgatgtaacccctacttggcgcgccaactatcgaaacaagatttcggcaatactaaaaggggtagcaatcaagctggaaaagtggatgggtcagtagagaaaggtttatacaggttcaggccttgtcgatgagaagtaatactctactcctgtctggggaattattccgccgagtgtattattgatctaacgatctgggagaaaagttctgccgccctaggagtactcggacccctccttatatagggggaggaaccgagatttacaatgtacagcccatattacttacggactaggctaacagatatattacaattgtaactaactaggactacgggatatttccttgatatacaaattaatataattcccgagtccttttctaaacatattctacctgtataagctatcccctatacacagtcggatatacttgccatgtgggtatgtggtacccataatctccacaatttgtgtgcttaaattcctaaaaaaaatattggcaaagaagctgatccttactgttcgtatacgagcagttcctttgttgcaaagcaatgagcagtaaaactttaaatggaatttgaaatcatatgactttcctgcaaaaagttcaatccaaaggaggcttaaaaaatatcgtgaattgagatcacctacagttgctagtatcatcacgtacgaccatcgttggatctctcacatcacacaacagtattgtccattactctctctatcccataaagaagcaacacctagctacgcaatgcaaaattaaataagaggataaaggaccaaaataccccttattaatagcaaactagtattggcggatattgttgacgagaaatccatgctcagccgatggtgccagaactgtgttggtgcgaactaaatcgacgaacacaacggcttggtagatctgcttagctccagtgccggtccaaatcttggtgagatgcgggcgtgccagtcagtttgatcctacaactgacaagatatacaaagagctgatcggctatgttaacgaccaaatttggtaattcaagtatcggagatggaaccgaagcggaatccaagatagagatcgttccggaaacagagcaagagtcagctaaagtctaaatcagccgcgacaagaatcggcagagttcgagtcggataaggttagccgattgagccgattccaacaatgtgactcggtacacgttgtcaggttgagttaatgtgcttcatatggattgccacgcacggattaagtcctgaaaaggcaattgtatctattagttcggatattttatgtaatttccttatagataagtttgggtaaaagtctgccgcaaagacttatggtatcttagagtttgttagagataagagtcatgtccgataaggacattttgtatctcgggtata

SEQ ID NO: 85375 - DNA, 591 bp, Oryza sativa
  unsure (1)..(591): unsure at all n locations
tgtcctctatgcgtcagttcagcgatctgcatgatcacccttctttttgtagcatcttgcctgtaatggttgggatgaagcctggtattcatctaaccagggctaacgtgccatctctaagaggtaacacgctagctccggctggagacgtgtgcctaaaggctctcgtcttgacgggacggggcgaggcgtgcgtcagaccaccagtcgccacctaaccgttgatccgaccggtctgtgactggtcacagaccggataaaagagcgcgctgcattgcgctgcatgcaacgtgacacgcttgaccagaccgcaataaatgcggttaggtgagccctaccgtgttcacccaacctatgtacatagtgcaaaccccacaggnngggtcggggcacccnttncgggggggcccccccccccccttttttttcccgggtcggggcaggagcaacccgaccccccctcggggaaatcaggaggaggacggacacctcaccctcgggcccgacgtccccgaaggtgccaggccacgtgggcgattccatctgcctcaagcctccgggcgcaatactcccggtcccatatcaccgaca

SEQ ID NO: 85376 - DNA, 741 bp, Oryza sativa
gctgccctcgacactacacggagcggcgttgcctcagccagcacaagtactcaagtctcgtatggctcgtggggtgcatcagctgctcgttcgttgggacggtctgccggcatctgcaacgtcgtgggaagacttggacgatttccgtactcgctatcccgcattccagctcgcggacgagctatttgtcgaggaggggagagatgttatgtggggcattcagtatcagcgccggaaccgacgccaacagccagagcaggcgccgtgaggttggattaagttgttaggattagtttcagtgattaagtttgttaggaagattaagttgttagttcctggttagtagctgtttggttttccattgtaagcctatataggccattcggtttaagtgattaatcaagaaagaagttaatcccagttcctgttagtttccaccacggctccggggaggcgaggcgtgcgccctcgccctcccgtcgagcacagctacgcgctacgccatttagggccagcgcctaacaccttggtcagatacattcacaaaagcgctaaaaccatgtttcagtggcacagcaatcttgaggtttctcctcactccaacatttatcctcccggtttctgaattaggaaaaaaaaaggttagttcatgtcaattgtagatccaatattaaaaaaaagggttggacaccaaggaagaacttggtgtcaatggttttaagaaaggagaggtaaatattt

SEQ ID NO: 85377 - DNA, 1598 bp, Oryza sativa
  unsure (1)..(1598): unsure at all n locations
tgcggcctctcgccggtcagattctcgcctccgttcctctgcggccgccggatcttcggctcggattggccggacttgggatggcgggagggacgcgacgggacatcgctgaagcagaagaaaaaaccagaaggcaaacaagatgggtaaggtaaaacttgcttttgggatagaagaaaagacggtcgcaaagagagcgggacgaacctgcgagggggtcggttaaatgaccaccttggaggggaaattaggtttccctgggatggttctgtctcccccatcttgcgcagccccggggccccccttattttcctttttcctttgcgctccccctcgggctgcgatgttggcgcggccccctccgggcgcctgctgctggcacgcgccgccccgccccctcggggaggagatgggggaggtgttcctcccagtttcctcttcccccgggcgtcggtagggcggttgctccccgagcccccgacgcggggcccagaagcacgaccccctccgggggtagattgatccccccggcggctcccacctgcgccgccatggcccttaggagcctgctcctctgaggccccgaccgccgtcataatggtcaagatggagacgcgatctgggtcgctgcagagggggaggataccgtgggggatgagggacgcctccacggagttgagatttagcacccgttggatcagtatcttgaagtcctcgggggcccaatcccatctgaccccctggtgggtccgcatatagtcttcgggcccgatgtactcccaggcggcccgagcgcgccgctggagcggnncgcaaatcnccggaaaccccgggaaaacacccgggggggggaggtagtcgccgtacaccatggccccggtgagcccctgggatcgcaggcccgcgaggcggtcgaggacggcgtcatagccatcccccagatctaccggcgcccgccagctggggcctgcaccgggggctggctcggaagtcggagatgcgcttcgtcggcgaggggggtgtagaaccagtcgctcttccagtcatcccactttttgcggaggaccaggggatgtagcggttcaacaccggcccccgccgcaggaaatagcagccgccgaccaccgacggcggcgacaccgactgcacggtgaagaaccaccggaacagccgaagaaaaatatttttgggggggggnggggcccngncccaccccccaatgaacatctcgcacaggtgcgcgaagatggccaaagtcatcactgcgttgggggtgaggtgcgccatctggagatcgtagaactccagaacatccataaagaaagaagaaaaaggaggaaccaacccggccattgcgaaggggagaaagaagacggaccgccccgggtagtctggcgccgggcgtccctcacccagcattactatctcacggccggtggcggattccggcatgaagcggcgcggcagcccagcctgcctctcgctcacaatgcgggaaggcggtagtacgctaccgtcgagcagagcggagccccgtgccatgtcgtcggagaaagagagggttgagaacgagtgtgtgtggcgaaggtgaggcgcag

SEQ ID NO: 85378 - DNA, 842 bp, Oryza sativa
acatgttgccagcccgtgcttcccgcctctttgcaagggcaaaagcactcggtatgatgactaaagggtatgtctggattgtcacagatagcattggtattgtccttgatgtgcttccccaacattccattgaaagcatggagggaattgttggtttccggccatatattgcagaatctacaaggatcactgatttcagctctcgatttaccaccttattcagaactaagtaccatccaaatactgatattaggatggcaaaaatactgatctaccccaaaacccactatctttcaattatgggcttatgatgtggcatgggcagtcgcaacagcaactgagaaggttcataggaccagatctttgaacccaacttttcatcctccgggaaacataggcaagaacttagtagatgatctcccagcattgcctgctggtccagaactcctcaattccattttgcaaggagagtttgatggattggctggacaattcaggcttatcgatagacatctgcaggttcccacatatgagattgtcaatgttattggagagaaaactagagttatcgggttttatagtcctgattctggactcacaatgtctgtgaactctagaattatccatggtgatgctaaatttagcacaagttcttctgatctggaaaatatcgtttggcctggagattcaacaacagtgcccaaaggctgggacttcccagtgaatgctaagatactccagattggtgtgccagtgagacgtgattttaaacttttgtgaatgttgagactaatccgaacacgaatagatcaactgtcagtggctacagcattgatatgttt

SEQ ID NO: 85379 - DNA, 1129 bp, Oryza sativa
ccaacctcccgggtcagatcattacttttcggctcccagagccatttcacttgattaggcggctcccagagcctttttcatttttgcggactcccagagtccaaaagaaaagcagcaaagcaatccgcttccactcgggaagcctagtctatgatgctcgtagacattccgaatcacacaaattcgtttctgaccactcaggtcatccatctgccacataggctgaatctggttacgattcccacaccacaacaacttttcacaaagcactggcaaacaaatctacgcaaaaaaaacccccggggggggggggaaaaaaaaaaaaccaccctcaacatcccgcccttgactgtgggcacggctgttcgaacagttagttaacctctgcagaggggtacactttacccacaagacacgaacttactccagacactggctggtgtcggaggttcgtgacaaggcctttccaaagccaatcctgggtcacctcatgccacatagagggtctccctgaccaagatcgggccaactccggctttcccttaggactcccgggtgccttcctctgtttcggactcccaggatgcctctacccccacatcccggctttccacctctattggcatacaagatttcccaaaagcaactaattacttagccagggtgtcccataccaccatgtggttgcacttgttatgcttgatgaatttcccacaggaatcggtccttatatgcgaatacgggatgacgccacataggcacaacacccgcatcgcgagttttcacaattcattttattttcaaacacaccgacaccacatgtcgggttttcaaggcttctcaaacccattttccaagttttcgacaatcaacggtgtatgtgggatatttggtatacgcgcttagagagcacggataccgaggtaccacaagggtggagcgacaaggaatcagggtagtacagcctacaggaattagtgcgactactgggtaggtccgtcggtttggcacgcaaaccgaggccaagcaagttaagtgtgtgattctaataatgcaagttgcaaacaaaataataatgattttccaattataggagcaattgatcaaagggtgacttgccttgctcaag

SEQ ID NO: 85380 - DNA, 709 bp, Oryza sativa
tgtcacagtactttagtaagcaagcaatatatcatacatggagcggcgagatttatgggttcggcatagctggggagttcacagagactaacgatgaagtactcaatattcctgacccatcgaagctccgaggcaaggctggaaggaggaggactctcgcatccgcaacgatatggacgagtcggaggctggcagggtgaagcgttgcagcaaatgcgatgaacatgggcacacctacaagcattgtcctaaagacaaggagaaaccaagtgcggcggaggcaggactatcaggatcagcagcagatggagctcgccctacgggtgaaggcactacctccactcgaccacgtcctaggcgtcgtcgtgccacgtctggctacgtggtgtagttcttatgttctatgtcggcatgtggatttgcttgtaattcgtttcgaacttatcgatgtgtttatgtttcgtcatgtaatgtcagacttcggcatgtcatgtctttaggtctcgtgatataacgtcggactaaggtgcctaacgtctttaggtatgctgatgtatgtcggacttcgacacgtaatgttatgttatattattgaactctacatatatgttaaattgcacgtcatcgttatgtaccattagtaacgtttgctatatttaaatagcctgtactcttgttgtacataattaatctcatgattttattacta

SEQ ID NO: 85381 - DNA, 767 bp, Oryza sativa
tcctgcagcccgagctccctttgcagtgaggtaagtagtgttcttttattttgaaagatggcatactactgattactaaccttcaacatctctggtttcaggtgaagtggcttgtgaaggagctgttgtagagcaattttttgcagacgctcaccgtgctcctccttgagagctgcttctcttcatgacatgcaatggagcacgaaagcatgtcaaagcaggaagtaatgaagggcgaagtaggtcagaaacttatagtactatgtactatggtgttgctacgtagttgtgtggtattccttattattcattgtaccatgaataatttatgccaatgtcgtagtagctacatgtaactatattggctttcatggacacgtctatggtactagatgtaaaactgctagatggctttagatgaacatctcagatttattttccatagaatgcacatatgaaagtacctgagcgtggcgacgctggtgctttccatgataaagatctggctggtgtagggcggtatgctgctgaagccggagacatgcacatcgcagaagcctaatcatcagactggagcctcaactgaaccatcccgtatctgatctgtttagataaagacagttatattagaaatcgccaataagtctcggacgataattcccagcatttcacaacttaagaagttcagaattctagcagctattcgtaatgcatcccattgcagtattgcataacaaattacagagatgaatatcaatctcccagct

SEQ ID NO: 85382 - DNA, 1151 bp, Oryza sativa
atcatacatctatggccaaaagaatccactccaccagatctttgcgtgtgtcctgaatgctccatagtgacctacatatggggcagcatgacacttctcaatgatctgcatgccttcatctgccggaacgcatctccgtagtaagccatctgaacaaactctgtaaaggtaaggtgcatcccacaagtgcctacggctctcgtagatcaacttcttcttattttctcccagtggtacatgccccgcgaccatgaagttgacgatggttgcataccatgggtcagagtctgtgactttcaacagcatgtcgtctcgcggatagtcatttatcggtagctcctgcatgttagtgacttgcatacgcgacaaatgatctgcaacagaattctctactccctttttatccttaatttcaatgtcaaattcttggagtagaagaatccacctaatcagccgaggttttgcatcttttttagtgagcaggtattttagtgcagcatgatcagagtaaacaattaccttagctcccactaaatatgacatgaacttatcaatggcaaacactacggctaggagctctttttcagttgtggcataattaagctgagctctagtcaacgttttactagcatatgctatagcatggtgttttctatccttagtttgtccaagaacagctcccacggcaaaatcactagcatcgcacatgatttcaaacggcagcgatcaatcaggaggttggatgattggtgctgagatgagtgaatccttaaggattttaaaggactttaaacactcatcatcaaagtcgaacggaacatccttagctagcaaggcagttaagggtctagcgatttttgaaaaatcctttatgaaacgcctatagaaccccgcatgacccaagaagctacggactcccttgacattgacaggaggtggaagctgtcgaattacttcaatttttgctctgtccacctcaattcccctttcggagatttgatgtcccaggactattccttcacgaaccatgaagtggcacttttcccaattaagtatcaagtccttttcttgacatctttgtaagaccttgtttaagttctccaaacaatgatcgaaggatttaccatagactgaaaaagggctgcaggaat

SEQ ID NO: 85383 - DNA, 534 bp, Oryza sativa
tgtgtgattcatcgtggcaccctcattattgcagcagtccacttctcttcccccaacccatggctactatgtacataaccgtgcagccagcaatggttcccaaagtggtttcccaaaatttcatgtttgatgctcgtttctcctcctcatttgtaggatcagcataaagcgatataccgatattcatcccaaaaagaccaacaacggccactccagcagtaatgacaacagttgcagtggagagcatgacccccatctgtagaagttgattttgcttgtcatccaacatgatgttgatataatcttctgtatcatcaacatactctctcagctgcaagcatagagaagaaacgtcaaatctcaactgcacataaaacaacatgaatttggtttataaaccctcaactgcacaactccctggaccagtttcccacagttgcatgcgatgctcatataggagaatcaaaataaatcattgtaaagaacctcccatgaaatcaggaaaaaaacagagcaaatgccaatggatccatg

SEQ ID NO: 85384 - DNA, 586 bp, Oryza sativa
cagcacgtcacatgacatatcgccgtcaccggctcaccgccgcaggtccccctccaaaacggagggcaataacggaacagccctcacaccccgcacgtcgccgttgaagattgaagaacccatcatcaaatgatcaacaaaatcccaaatccaactgcttcgctaacctctccagatgaccacagatccgaacacacaccacacgttcgacaccacgacacacctccacgtggcggcatcccgcacgagcgccgcgctgtccggtgtccggactccggacgcgagcaccggccgagagccgcgcgggaaaaaggcatccgaggtcaggagcacgagggtacggggagaccccccgccacgtcggaccggacgggcccagggccccacccgtcagagaggacgacgtggctgcacgcggtggtgggccccacctgccgcccgcgtcagcatctcgtccttctccatccatcgcggccgcggggagcagtaaaaaaaaaaatgggtctcgccgggaggaagacgacgacgaggccgtgcgcccgtgtcgacgcaacgcacgcagcgctatgacttgggctgcaggaat

SEQ ID NO: 85385 - DNA, 1029 bp, Oryza sativa
aaagtttgcagagctcagtgaatatacaaccataaaagcacctagtgatggcatcaaggttattaacaaaataaaaacaaaaataagatcccgaatgtcaactatatcaaaaacatagttccataataaataaaacaaaaaagcagatgcattatgcatacaaaatagaagcgcatatctgcaagctacatttcagtctaaaatgaataaatacaggtagatagcaaaataacattctcctttcaagggtacacagggaattttctcttttcatttccatgtgcatacttcactggttcactagatacaagtatacaaccccacgcataccacataaacagattcattgacccatgcacatatgcgtgagccagtactatttgcagcatgtcatgcatcgctcctacaaaattgagaaaacagtggtgtgccacaaacccattccttgacctaatcaaaccgtgttcttagtaactatgttcctgcactagccaggactaaattgtcatgtattggaagcaaacattaattcatgcgtttaatgtggcaatagtagagtgggaaatatgtcagaaagagtgggacataaaaggaagagaaatatgagctcaaatactagtcataccaccaaggctttttgctgcattttttaggcttcctgagaaatattgctgaagaacatctaagctgattgttttttcagcttttcctcgtctcctttcagggggtttattacttttgtgaagcgaatcagaagcaccactaccatttggcctgccaacagatgccccattgttttgagagttgtcatcagctagcaaatgtctctctgacatgattgaaactttgttgccatcattatcaacctcgtggactctttggcttccattactttcaggcgattcacgaaagcaaccttcagaattctcaaagtgcacatttgtcttcaaatcttcagtctcaattattagccattacttatttgcagacaaacttcattggtgtctccgttgccaactacctttaggg

SEQ ID NO: 85386 - DNA, 2332 bp, Oryza sativa
ccaatactcttttgccatctagcatcaaaagataggactgatcaccatattctgttttatgtggacagttcatgcaagcatccctgagtgctcgtgcacaacttattggcatgcaagattggggaaacggtggtccagccggcacagatggctcacgacagaaccctgaagaaactagttttttccgtgctgatggtggatgctggaatactccttatggtcggtttttccttgagtggtattcaggaatgctgcttcttcatggagagagattatgtatggttgctgatgctgtcttctctggttccggtgtgaccatcgccggaaaggtttctggaatacattggcactactatacatgttcgcacccatcggaactgactgctggttactacaacacattgttgaggaacggttatcttcctatcacccaaatgtttgctagatacaaggctgccttgtgctgcagttgctttgacctgagggatgaggagagaaataactccaagagcagcccagaaggtactctccggcaacttatggtcgccgccaagatgtgcaatctacctctgaacggcgaaaactccgtgacaaggctcgacgatacgtcgctgaatcaagtcatcagaagctcaaggctctactcaggtggcacctcagggacatctttctccttcaactatgtcagaatgaacaagagcctgtttgagtttcacaactggaacaggttcaccaagttcgtcaggcagatgtcggatgccaggacatttctagccaggctcgagttcaggagagggcagcattacctctcctcgatgtcggttgtctgggtcgtcagccgggcctgtgcatagacatgaatcagaattggcaaagtgactgctagaaatgtagtgttgttcgtgtatctgtaacttggatcatgaatgtgattcgacagaattggaagagaactttgtgctcagccataccgtgatgatctggtttctacatgtgtgcttgtgatctgttgttagcttaacagctgttcaaggtcgagcagctgggctgggctgggctggatgtaaaatccacccacaaggccacaaggccacaggtcggatggcccagccataacccgagatgcgaagcccaacaggaaaaggataagggtgtggcatgtggcccatccaaattgggttgggagagggttccggcctacgtgcggcccgtataggttgggctggaactgtagagcgggccctggaagtgatgagactaacagctgccatttgttccaatgtgaaattccctgatgcaatcatgcaacaatggaactgccgctcgtaaatctaaatgaactgagatgtttgcatttgattgcttgtctagctgtaccgaaaattctgtatttgcagtattgcacagcatatgtgaactccttgggctgatacatcatacatgtagttgataggttacacaactacggttgagtgctagtagtacccaataagtatggccgtatgcatcaatgtacgacttaacatttccaccagatcccaaaccttttttaaagaaattggtccaaggttccatagcgcttacagggtagatcattataattcacatgcggcattagcattgggccacagatgatgccactgctaccgatatcttagttcctcatggtggtacaaaacattgtctggcccaagcaatttttggtagatgaatatggtgaatactgaagctctttttttttccacgaatactgaagctcattgatcgtacatataccggtaatctactcttcaatattcctatcttttttcttaccagacatgtgggcgacttgcatttatgcaaaagatgtcaaaaccatgatggttatttgagatggttaacgatgacaggcttatcatcgagggaaagataccaatgaagaaactagagattcatctcactagagttttatcagtaatatggctgaacatccaaaaaaaaaaaactattctactggagaagtcattcatctctactctgtatccctgaatgtgactaaatattttaccggataatgtacaactgtaattgaattttggacggcaactactctctgacaatagtttaaaaattgggggaaaaagttcatataatgctcttagttttttcctagagaaaatgcagctgcaaataaaatgaataacccaactgagcctccaaaatcttaaaaacttgggaaattaaaactgaaaaagaaataatgtgcctccaaactaatcgacttctggacagcgaagatattagtattacaccaattaacctttgtaacttgaacatcagaattttccag

SEQ ID NO: 85387 - DNA, 910 bp, Oryza sativa
acagtggtgcatgggtccagacacatcagttcaggttgtgcttcacatgacattcatgttgggttattgatgtcactgctttggtatctttgatcttttgtcagtcaaacgaagtacttttactgtctggtccaagccattgtgagtcaatcaccatgcgtgatacctatgaatacatgactgcagtaaatcaattgttgccagttgcctgattgatgtaatttgtaaaagcgaaacttagctgaaatatgtggttttcttaacctctgggccacattttgccaagaattttgatcaacagttgatttggatgcttagttcgcacacttggtggtaatattgaactcagaactagtatatattgtctactaagacaaaagctattacatatagactgtgaagccaccgtgatcatgtcagaattttgttacatgttcgcttcataattgttttcaaatctttccatgttagccttttgcatttgctatgtagtatatacagccaagctactcatcgttccttgttcccagatagttatatacaagtgtgggcttgatggctattgtattcatgcaaaagatcttcccattgctcattgttgaaatttcacttcacctgctttcaggatccctctacctcaatgggtacttgaggagatggataagttgccagacttgtcatatatggatagataccaacgaagaaataaagaatacatctcactcgggtgtgatattcttccgattctgaagggaagatcaccaatgcaggcttattcagacttcatgaggagctttcgagatgcttttaaagagtaccttggggctatagtgacagtttgtgctctttcttggtatttaagcatgtcatgttaaatttacagcaccagtaggttgtaagccttatataa

SEQ ID NO: 85388 - DNA, 560 bp, Oryza sativa
ggtacccctcttgcattgtatcctagattcagaggtcaaggagttggacaaattagttgatttcattaaagtggatatcgggaatggtggaaagatgatggcttctgatgaagatccggtgagtgaggtgaacagcaagctccgagatgcagccgtgtctttgaaccagatgcaggaccttatttttgctattagaagacaatcggcaaactttgtgaatgtcatagacccttctcaggacaactctggtatgctcatgttagtctggtgtcttttttggtgtggaagaggtttgtttcccccggaaaacatgaacattgtggaggataccccgagaatattgccagcgtaggcatgtgccatcctggtggaactttgctgtaatttttttgcccttgttggctgaatgccttgctctggcgtaggaaatggtatatggcgtgggagtatattgtcatcggtcatcaccctttgttaggtcgggttacaaaaaatattgcgaaccttgattggagctcgcgatcctgctgccatatgctctgttttttgaatgcattgag

SEQ ID NO: 85389 - DNA, 614 bp, Oryza sativa
ttggggttgagcatgtagctcagtggtacagcacctgtagagatgccacacacccagggctcgaatcctggttaccgcatttgtgccctgcataaggttttggtgggccccttctttaaagcaaagtcaggggggacgtccttcccccttgatgggagttcttttagatcttatatgttcagattctactttgttattatgtatcttgacttgcctgtgctcctttttttttctatgttttttttccttgtatgagtatatgatacttctttttttcttttggataattgatttgcaaaattggtattctttcagattagtggggcctctgaagctattcaggaagctctaatgcagataactgcaagactgcggaaccatcttttccgggacagaatggcttcaacagtccctaatgtgcagccaccttttggtttggtggatcctcagtttggttcatatgcgggaaaccatgattctatatctcctaggatttttcctaatgtgcctcagtttcataaagattttataggacgaccattggatgagatgtctgctccttggaccatgaaggtatcaatctatgtatttttttttcactttaagatgtcatg

SEQ ID NO: 85390 - DNA, 849 bp, Oryza sativa
cccacaaacatggtttgaaacagcaggagcatgatctcaaatggaacaaacatggtagaatacctccttaagatataagtatccataaatcaaagcaaacatggtaatttgtgaatactagatatcactcaatcttaataaacaccctacccaacatttacatctaaacatgttatggatcacaacctccatgacacaaattttggtcctgtgaacatatatttttcctccttttttcctaatagagtcaaaatgccacgtttcaatctggaaagctccactcctacatccaccacacaaacggttcacagtccataaaagaagtttctaatctggtggcagtgctggaaacttgcatatgatgccaatcttatgatctgcattgtgctgtacttcatactcgataacccctatctacattcatcgccgtccagaaagctaacctatggcgcaaaactgtggcacttttttgtacaattgtgccgagagaaattgaacaaccattaaagcacattatgcacatacaaacatctattcctaatttaagagggttgtggtatccaggagtttcacattttgcagcgcaatgctcattccacaaaccttaaaacctaacatcagagcaacaaatataaagcggaagtgagacacagggcaaaggcgagacgcaccatggagggtcgtgcgggccggcgccgcactggtggaaggcgaggatggcgcgcacgcggaggccgtagcggcgcgccatggcggcgagctcgaggtaccccgcccagtcgtacaccccgggcccctgccgctccacgaccccccaccacagctcgaccgccaccccggccacccctg

SEQ ID NO: 85391 - DNA, 663 bp, Oryza sativa
ttcatcatattgtagtgacgttatggaccaatagccttaaaccatgagttaatacttctggtttatcaggcgttatcagagtcatagaactctggtggttgtatatccgtccctattactagtaagttacatatattttggacattaacatcctgttagaaagttgcagatcttttgggcatcaacattttcgaaatatagtatcgaccaacaatttatatcatagtatacaatttttatacaatcctattggaagaaagcttaatcgaagccatgtcccaaaacacaagtacatttagtggaagaaaaacccgaagaattttctttttgtactacaaatttgttgatttttgtgtactacacgaaatgatttatatacaatactaggccttgtttagttccctaattttttttccaaaacatcacatcgaatctttgtccatatgtatggagcattaaatatagataaaaataaaaaataattgcacagttagggagaaaatcacgagacaaatttttttgagcataattagtctatgattagtcataagtgctacagtaacctacatgtgttaatgatggattaattaggctcaacagattcgtctcgccgtttccagacgagttatgaaattagttttttcattcgtattcaaaaacccc

SEQ ID NO: 85392 - DNA, 591 bp, Oryza sativa
tcgagtaagtgaagataaaatgttggctgttttcacacgaaatggctgatatagtatgcatgtaccaaacatatttattaattaattttaattgattcttcatttcaggctaggtcatcaatgttaatgtttattagcaccatgctaaccttaatggcaattggagggttcccatccttcgtggaggatatgaaggtatttatgaattgatatgtcataccagaaagagcaaacatgtttactctatataatttgttaaaatcgactgaacacacatatagaccaacgggcataaatagtaaaattaagtcagtgaacttggatacgatgtctggaattgattattcaaattcatactactgtaccaaaagattcaacaaagttatcaacacgaataaaaattttccatcaaggacatgggatagtgctatttaattaaaaaagagtaatggaaataaattcattttcaatttaggatattaagaaatcatgtgaagcatcgcatagaaaaccctaaaataatctctcttatgcatcctaataaaattcacaaatacttgcaatgtcttttgactctggataaaaatattt

SEQ ID NO: 85393 - DNA, 820 bp, Oryza sativa
tattttttttgaaaggacatatacacaaaatattagtagtagttattgaagtataagtattcattcgaataataatgtgcatccagaaattagtgtcctaacctctgaagttgattctgctatgtttccgttgttataggtataccataatccactgacctaatggaaacaaaacacagaaattaagctgctgcattgaagaaagctaccaataccaagccaactatagttacttcatacttacaataactgctacaagtgatcaagcaaaatgctaatcatgcgactattgttacaggtctatttttatggcaggagttccatgcaaaactcgaagaaactaatttccatgcaaattctaatgctccacaaatagccaagttgtgactactgtatctgtgagataatatttgacactgatctttcagttacgttacaagaaaaaacttaatatgaagagattaccataatttcatgcttgttgggccttttcttcttctaacagtaaatgaataatggatctgaccacttcattgtcaacaaaagttgccatctggaagcagaccatacaaacaagataattagaaaatacaagttgcagcatattgactgtaaactatcccgcgtgtattgtatcaagcctttccacaaagctatacaagtgaaccagccttttattacagtgagccaatgaggtcagggagagaaattatatgatgagatgtgcaggagacactacagctgcacaatatctcatttcatgagtaggtgttattccttgtacgttaaaacaaggggagacaccatacctctggctttc

SEQ ID NO: 85394 - DNA, 662 bp, Oryza sativa
cccagaggtcttcttactctaccttgcagttcccggtgttcctctagccaaaatgcaagtacttgagtctgattcggttgccgcagtgaagcttcggatccaaaacagcaaaggatttgtggcgagaaaccaaaggttggttttcgaaggcagagagctctctcgcaatgatagccatatccgtgactatggggtgaggtatggaagtgtgcttcatctcgtgatccgactatcagatccacgacgaaccgctgtgaggactgtttatggaaggaagtttaaattccaagtggaccaacgtcgaaatgctagatatatgaagcaagagatttcaagaaatgttgaaagtcccaatggtattggagagagcatgactttggtcaatggtgaaaagcttgatgaaagcacattaatctccaccatttgtgagaccaacacttctgataccgattttcttgcaaacaagtcagaaaattttaatggaaatgaaatagaagaatcttttgagcaattatccatttcttctgacattggaaacaatttacaatttgatgatgccaaggagaaatatcccctgattgaaccagttcttgtcaacccaagtgttacccttactccaaaaattacgggtatgatcgaagctacacttgctgggctagaaa

SEQ ID NO: 85395 - DNA, 603 bp, Oryza sativa
cattcatttgcttagccttaccatcaaagccttctcttctcccactggtcacatcactcgccttcgccctagcatcaaacccatccctcctcctaccaatctcatcagcacgaggcacgctgcttgctctcctcgcatccgggaccctacccccaacgccacccaccgacctcctcgctctctccggggcagcggccctgatcccgccgctcacgctccgccgcaagcccgcctccgcctccatttccttcccgacagatgccctccccggcatcaccgaggacgccctgagggtggagacgagcttggaggactccacggagctcgggatcctgctggccctcgggatcgacgacgtggaccaccgcaccgcggcggtgggcttggagggcttggacgccgagttctccttcccggcagcggcggcggcgggggtgcggcgagcggacgacgaggcggagaaggccttgggggtgagcgggcgggatcccgcggcggcgggtgcggccttgccgcggtccttgatgcgggaggccatggcgatggtagggttagggtttggggggatctgggggaagacgagagggagagggagatggtttg

SEQ ID NO: 85396 - DNA, 524 bp, Oryza sativa
gtacacttctgtacgagtaccgaaaagataatgacgccaaatcttcaatgcatgaacgactgcagctaactcaatatcatgagtagggtagttcttctcatgcggacgtaactgtcgagaggcataggcaaccaccttcccatcttgcatcagaacacaacctaacccaagtttggatgcatcgcaatacacctggaaacccttctttggatcaggcaaaatcaaaataggagctgatattaagcgacttttcaactcttgaaaactctgttcacattcttccgaccacttgtacttcacatctttctgaagcagtcgtgtcatgggcttagcaatcttggaaaaattctctataaacctccgataatatcctgcaaggcctaggaaactgcggatctctgaaactgtctttggttgtttccagttggttacggattccacgttactaggatcgacggcaactcctccggctgagatgacgtgaccaaggaatttcacttcggacaaccaaaattcacacttgc

SEQ ID NO: 85397 - DNA, 1197 bp, Oryza sativa
ttttcattgctgttgatcaacagataaacatattcaagccaagacaagaaacaaacccaggaaatccacccattcctctatgcgccattcctgggatatcaggcaatgaaattggatcaccaacaacctgcatgccctacaaagtaaagaccacaatggtaaggaaaatcataaaacttgtatatagtagtatacaagctattttcttcccaatcatacttgtttaccatgttacaataccaatgcatcatgacatatcttcaaccatcaacaattttcctactctagtggtgactataaaacacttctgacaccaactttaaattacttattctcagaaaaaggggtgacacatatggcaccgaaaaccaagaaggcaagaacagatcttgtggaatgtcacactcatgggtaaccaaatttggttcccagccaaattgtcaaacaaagcaaggtaaacacatactccctccgttttttaatagaagacacctttgacttttgacatgacgtttgaccattcgtcgtattcaaaacatttttgtaaatatcgtttattttgctgtgacctattttaccgttaaggaactttaagcatgacttatatttttgcatgatcgcactatttttttttatataacaaatggtcaaacaacatgtcaaaagtcaacggcgtcatctaaaaaacagagatagtaccatttcaatttgtatcctaagagacactcatagggacttcagcttaatattgcaaacacaacaaaggaactccaggctgaaggcaataccaccagaactttgtaacaaggtaggaacacatctggtgccaaatatacataaaacaggaaattgtgctggtctttgagagcattgcaagcatctcaacaaagggagaatggagaaaaaagattcaagcaactcgcattctcatgcatggtccatgacatcttaaagtgaaaaaaaaatacatagattgataccttcatggtccaaggagcagacatctcatccaatggtcgtcctataaaatctttatgaaactgaggcacattaggaaaaatcctaggagatatagaatcatggtttcccgcatatgaaccaaactgaggatccaccaaaccaaaaggtggctgcacattagggactgttgaagccattctgtcccggaaaagatggttccgcagtcttgcagttatc

SEQ ID NO: 85398 - DNA, 1618 bp, Oryza sativa
tgatcctggcaagctcctgcaattctttatttgtttttgtagccttttttacttcccctcaaggacataaacaaatgatttgggttgtttcacacaatgcatgaattgaaacgaatcattaatcataacatatcaattaaattggacatgactaaaaaggactggtgcgtaaacaagttaaagtttctctcctaaatgcataaatgaagtagatgttctattgtatatttaaataattttagaaactagcacatatatgtaaaatcaacatacttctatggttctaccatctaaattgttgcaaaattgttgagttcactactcagaaaaattatgtcaatacagcaggggaggacctaccagtacagcttctgcaaatgataaaagtagaaatatgtgtctcaaacttcacaaaataatgcctgatagatataagaattgagaagaaatcaccaatctacataccgcagccagtcacaaaaggcccacggacgtacacagggaggaccccatggaccatatgcatcaccaaacctaccttcagctaataagagcacaatgagcttcctgcaatagacaacaagacaacagtactcgggcaatcgcctcagtgacgagctttaaggaagacggactaggccttgatcttcatcttctctccttcagtcttccctactgccaatatctcttccagcaatcttcttccatctagcagggtaaggtccagcttatcactgttcttcttctactatcattctgttacgagtcctggatctatcataagcactgagcagcctcactcccacacattgttatgcatcttatcatttggaaaattacttatatatatcataaaataaactgaggcttgtaggtgccatatacttaattcatatcagggtactggaatagagacatgaagctgtataacattctctcaccaatgtacatatcaaacaaaaatgcaataattaggctagtttccttaatataagtttagaaaatcaacatgatgggctcatcatacaaaaaaaagtttgaagctttcaagctccaagcatatagcttgcatgaaaagagaactgtgcagctaaccatagcatttctatctcacaatgaaaagactgggatattttccaaagaacctagcaaagatccatcatgttgaaatttagtcactattcagcataattagcctcttcgaccatatgcaagtctgcaaacagggcacgcatattcataaatatgaacacataaggtcactagcttcattgcccacacaatcatcatcaccagcaactcaaccagtccatggtcactaccttcaggtatttgaaatatcagggggctagtggttcacttaggacaaatgcttgaataagacttcgggctgcatgcatctggtctggtgtgccggatatcaaaatagcagtgtccattgcattacccatcggatctgcgacagttatcttagcccctgaaaactgcacatggcttaattatgtcagatgatacatccaaccatttactggatatgctacaaaatgcactagccgaatacaaacctcacgaattctgtttaaacagcctccatcttccccacatagagaaggtaaaa

SEQ ID NO: 85399 - DNA, 530 bp, Oryza sativa
gatgccactgtactaatacatgaggtaagatgaacataaatcttttggacaactaattccattattaccaacttgatatccactgccatttccatggtggctatgattctatattcctcccttttgagtgcttgccatcactgcttatgctccaaggtggtttccaaaagttcaatatattatttgagttatcagttctgttttttctgtctgtcctagtgtcctgtagtaaaatatttcactctccaattgatgtggacgacaactggccaagtgcatcaccaactaaccttgcatgtttttgtatactgttagctgcagaatgttctcttctaattattgatgatattaatcactagttaatggcaataatggtattgcgtgtctaaactgtgcaatactcgtttctccaggcaacatttgaggacagtatgaaggatgaggcgatcgctaggaaccatagtacaacaaaggaggccatagcagtaggcacatcagccggagcataccgtataatcttgacccacttt

SEQ ID NO: 85400 - DNA, 605 bp, Oryza sativa
tttcatttacaaaaatccggtcaaatacaagcaaaatggccttcacggctaatggcattcccttctccagctccagctgcgcctctggctcagaatttgtatcttttgcaacagaggaatcatctgctttcttatcattgtctttccctgactcatccctgtcctccttatcatgatctttttctaaatcatccttttcttccttaccaaggcctttctctgaatcatccatttctttgttactttcatccttttcttccttagtgtggtccttctccattccatggttgccatcaacagaacaagccacacctccgtcgttttccttagtttgcacatgactaacttctctgtccttatcaatggcagttatcacaataaccctctcgtcacaaccagggacaacttcatcaaccctgatttttactccagtctcttgccttatctttgcaatgatgcctccacccttgccaatgacattcccagattttgaagtagggcagagaatgcggaaaataggaacaccaggttgcactatcagttgaggctgctgcaaagaattgtgctttgttttctgccacttgccccgaccattttgctctgaa

SEQ ID NO: 85401 - DNA, 565 bp, Oryza sativa
cccattaagataataattggatgtaacttatttgaatcaaagatagctagtaatgaattctattatcaagaaaaaatatacacaccaagattagggactaattactactcctatcaactatatattaacggacatgattaaccaaaatgagagcgttcattagttaattattatattaattaaccgctcatccacatcatgcgtgcatgtatatatggtgtttatttttaatcagtaactgaagttatcatgacttttaactttttgcctagaaagaagtcggttaattactttacttacatggacaagtacgtatgtactgtactgccgtacacgtacgtattttggaatataagatacagggagtacgtattcttgtacgcacacaacacaagactcgcatgtatatatatattgcattggcgttgagtgcacgaacacgcagttggagcacaaaaatggcgtgagtgcaatggtcttcttgtaagaaaaataaaagggtccaaatcctggaaaaaagagaaactgatttccaaaaaactttaaccgttgttgaactgaactg

SEQ ID NO: 85402 - DNA, 779 bp, Oryza sativa
tagctcatgttcgtaagcaaactcatttttttatatgttacagatactaaaatatggaatctctggtgcagaatttgaatttagtatctttttgtaactagagaacctgaaatgggcgcatcattttttcaaaacgatggcgagtatacaagcagaaacacaacccaggcttcacacgaccagcccgtcctcgtctctgttttgcatttgcacgagaaatccaatcttctactatgcttgacattttctgcaaacaaaatatgacaaaacagcttctattagatatgttttgagatgatttatcatatcaacacatgcataaaaaagttgataggctgagctcatggccaacttatgaatttcatgtgattattactccggtaaacatgggttaaagaagtccaacccatgagctcacaatgtagcctaatagaaccccacaacaaataatgccaagttgccaagcatcaagcatttttattttgactttcaaaagcattttttgtttatatagaatccaagcatgttacttcaatcagaatttaacttccaagattttaaataactaaatagtcaattttagtgcaaaggcatccagtagatagaattttgtaaagaaaaccacacattactaaatattaataaaaaaaacttgaagttttgatgacaacggacctaagggtaaatctttatggtagcagtgctatgttagatggaccagctgatgcaattttcacaagatccattaacagacaaagacaagaccagagtccaaaagt

SEQ ID NO: 85403 - DNA, 707 bp, Oryza sativa
ggaaataaaatataacataacaatattgtgcaaaatgtgcattctagactcatccaatagtcgaactagactacagttttattgacaataagatgttatctgccatttcaatatgattttggtagacaatacagctttcagaacaactattagcttcagagaaaaactattccttctgtttctaaatatttgacaccgttgactttttagcacatgtttgaccgttcgtcttattcaaaaacttttgtgaaatatgtaaaactatatgtatacatataagtatatttaacaaggaatcaaatgatagaaaaagaattaataattacttaatttttttgaataagatgaacgatcaaacatatttaaaaaaatcaacggcgtcaaatatttagaaacggagggagtacatgttgatgtcatggaaacgaaagagagaaatgcttatatatatatatatatatatatatatatatatatatatatatatatatatatatatactccaccgttctttttgtatgatgttggttagttaaaaatatactaaccaacgtcatacatttttggttggaggcagtatttactaaccttcagttctcgcttctcatcacttgtaggtgctaggtttgagctggtaaaggcatcaattataatgtctgattaagtaaaaggaagtgaaggaacaacattttgcataaaaaagattg

SEQ ID NO: 85404 - DNA, 606 bp, Oryza sativa
gctcccccaaagaaggggaggagcttttcgaacacaagcgaccgcttggccaacccgggaaagacgaccccgccgccagcgcgctccacaccgccgccaagcccaacggcggcctcgccgaagccaatgttccgccgccacctcgccgcccaccaacggcgacccaggccgcccagcgtcgctggtcgcgcctccaacccgccacctccgcatggccaacgcgccgttgccgccgcctacgcgcggccctcgcgccgtcccgcgcatcccaggagacgtcgccgcgtcttgggttgccgggccgagcggccgtcgaaaagccgccgcaccgctgctgccgcgctgggcaggttgcgcctgcccgccgcctccgcgcccgggctagccgcaccacgctgccccaggcgcccgccgcctccgcgctcgggctgtccctgcagagccaccgccggtgagccgcagctgccctccgcctccgcgctcgagccaggccgaccgagctgtagccgcacgccgccgcgccgcctcaagccgcgtcgcgccgccggcgcgccagatctaggcgaggggtggccggattcggccttgggggcgccggatccgccg

SEQ ID NO: 85405 - DNA, 683 bp, Oryza sativa
cattcgtatggtgcttgaacaacttatgctcacaacaacacactttcggcgcttcacggtagtgccatatccagtagcgcgcacagtccacaacagcacacatgaaaagcggcagctcgagttatcactatcaactttcggcgctgcctgttgacataaagtgaatcacgcccacgggtgatcgtcttgtcacatctaatgaataatgtatctcattgagttcacatatattgcagtgaaaacgacgctatataattgacaatctgaaggcaacctcttcatatcttctttcccactaccacaccacacacgaaaatggaagcctattaattggtaatacgtaatctagaattgagattatgtacaacattcttcactacaattttacattttggcagcaaaccaaatatgatcaaatgcaattttaccttaccaaatatttggtagtgccaaaacttgcttatattttggcattaacaaaatatttgtacggtaacattccaaatatgccctaaaaaataataaaattgtattttaccaatcttggagattttaatcttgcatagttttcaatataaaaagatttgataactattgatatttatataaaaaaaatatagagcacagtacaaaatccccctcccccagggcggcaagggggcccctgcaaaattccatgcccc

SEQ ID NO: 85406 - DNA, 642 bp, Oryza sativa
cgtacagcgtgcacgaaaccgatcagctcacgctcgtatgctgcgagcgcgcgatggcggggtgcccccggcctactgaagaaggcaacagggtggctgtcctggacgagccccgctccgaagccatgagacgaagcgtcgcattcgacgatgaagggcttggagaagtccggcatggcgagcaccggggcggtggtgactgctgccttgagcgcgtcgaacgccgttgcggcctcccctgaccaggagaaactatctttcttgaggagggcggtgaggggcgcggcgatggcgccgtagttgtgcacaaacttgcggtagtagcccgccaagccgaggaagctgcggactgcgcgcgccgagcgtggcgccggccaatcccgcacagcctgcaccttggccgggtccatggcgacgcccgcctcagagatgacgtggccgaggtacgcgacggacgcgctggcgaaggcgcacttggcgcgcttgaggaagagctggtgccgctgaagctcgctgaggacggcgcggatgtggcgcagatgatccgcccaggtcttgctgtaaattagtatatcatcaaaaaacacaagaacgaaacggcgaaggaacggccgaagtacgtcgttcagggctgcaggaatt

SEQ ID NO: 85407 - DNA, 598 bp, Oryza sativa
ccactcccggtggcttcctcagctgtgcgctgggcgcgctctgtagcgcggcgcacgtcacgcgcgcgacggcgtctcgcgtacgtgcggccccacatgacatctcccccctcatcgagagccagctcgtccccgagctggaagtcggggtacttggcgatgaaagcgtcggcgtcttcccacgtcgccgaagctggggactctcccttccattggatcagcagctggcgcacaccacgtgcgaggcgcgtcttgacggctcgttccggctccgggaccacggcaccatggtgaacagcaggcaggggcggtggagcatccggcggggagccatggaacttcttgaggaggccgatgtggaaaacgtcgtgcagacgagctcggggtggcagagcgaggcgaaccgcgacgtcgttgatgagctcggtgatgcggtagggcccgtagaagcggggcctcagcttgccggcgacggtctgtggcagtgaagatgccgcgcgctgcctgaggcgtagtagggcccagtcacccacctggtacgtgacatggcgatgtgccttgtcatagtggcgcttctgggtcgcctgtgcttggtcaa

SEQ ID NO: 85408 - DNA, 612 bp, Oryza sativa
aagatattcatcccatttttggatcagcacgcacgcaaacgcacctcgttgtcggcgaccaacgagacctgcgcgtacacctcgtccgtcgcggcgtccgcctgcaaacagcacaacgggaggagcagaccctctctctcaatcaatacctcgaacacattgcgctcgcgcgagagcagcaagcggcgagcgcactcacgtggaggctgacgtcgacgacgcggcagaacacgtgcggcggcaccgcggcgccggggccggagccgggcgcggccccgaggtgctcgaggtggccctgcggcaggtacacgacggcgctgcccttccgcggcagcggcgccacggggccagcgcaggcgtgccacagctccaggcacaccgcgccccccgccctcgcctccgcaggcgccgtgacggtgccggtggcgccgccctcctcctcgtcttcctcctcctccacggtgttgaggtcgatgcccaccatagccgcaaccccccaccggcagctcgccgcgccgccgccgcgcttgcttccaacgcggtcgaaagaggagagacggggagggaagcgaggaggggaggcgatcgaggtccctcgcttgggtttaatgg

SEQ ID NO: 85409 - DNA, 730 bp, Oryza sativa
acaatcttcttacacattatatggtgcaaatggcatagaaaaaatagcatgcctgtgataacctattccaaatcagtttgatacaaagatgtcagatatcggtgttttcaggaatcaggattcagaggtacatattgctggggcatcatacagattaagatctactagtatttgtgtgtgaggattctggcactacaatacctgagtacagtgacagtcctcttgtccctgaccagcaaagccacgtttcagcgatgctacttcgaaccatctaccaaagtagcgaattgggtcaaagttcttggcagtcatacccttcatcatcaaacctgtgccgccatcatcagaagggctatcgaatttcaaaggaaccccagccttgtcgatggctgctaccacaccaacctggcacaattttggctgtacaaaggtctctgcagggatagcctggtcaactatgagagattaagagtacatcgataccatgttacaagcctgaactggtaatctcactccattttccctcttctcttaattgaaattaacaagttttatgtatccaatcaaaattgcaccagtaaaattctctcaatcctcaacagtaaaaatatcttttcttaaaaaaaactgttcttgcttagtgatccagaggttatctctttgaattaccccgtgtttagttccaaagtttttcttcaaactaccaacttttccatcacatcaaaacttt

SEQ ID NO: 85410 - DNA, 1139 bp, Oryza sativa
atccaaccaaaactccttatattttgggacggagggagtagctaatagggaagcgataaaaataattttgattttgaccttgagtagaggcacttccaacatatctcaattgtgcctgttggtgtcttgcggtggaatattaggaagcactattcaatgattgcacaagtaaatgcataatacaaagcactatttacaacacacttttgtgtagtaatttttaaaacataaactagacttccatatgccagttgttgactaatgtacagcaaatttggtgacttaaataaagtttgatgatattgttctcctgtttgtcaaaattcactaaaattttcatgagattgttatgtggcttatggtttatcaaactagaagacaaatataatgttgctatactgtatatccatgtctggaagtttaagttacataaccttttcttttcttttacaaatagtcaataaacaaaaaattcttatacaacctcagaaaacccagagaatttagacaaaatagcgcaaaggacatactttgtaccacacaaacatgaaatgaatttttatagccatgtagttaatctcccataccagctaggctgcatctgaaaatgccaagtacacacaaaatatgcaaggcagaaaatgaaaagaatatatctaacatttctatttcatgttgtaaggcacacatgatacagaatgacatatttgcattttggtactgttttttcttctaagaatagcgtgggacctatgggcaggggactaagcctttgctcgctttatttatatatatatatatatatatatatatatattctgattacaagtggtcaaaagtatgctgggtgataatcttcatcgtcgtataccatgagatcttttacgatttgatccattgttggcctcttgcttctttcctcaagacatgaaatagctgctttcaccatcgcttttgcttgatcacaattgaaatggcctttcagcctactgtctactatagtgtccaggacctcaccactagtgagcatctgttttaccacctgcacgaattgcatcaagtctatgttttcttcttctattgttatcccacttgaaactctagtcccagtcacaatctccagaagcacaaccccatag

SEQ ID NO: 85411 - DNA, 649 bp, Oryza sativa
atagaacaaacttatcccctagagacagctctaatgggggtatgcatgtgggaaggcaggattctgccagctcgtacgttagcgcaagtcgtggtgatgatggatttagatcaaacaattcatctttcagttcccgtgcatcaggtccaaatgtgttgcaaggaaatactccaaaatcatttggaaatgggtttggtcagttatcattagggacatctgattcatccaaagagcttcttgaagcggctgaagaaacaattgaggaactccgtgacgaggcgaaaatgtgggaacggcattctcgcaagttgaaggctgatctggagatgttgaagaaggaatgttccgagaaatccaagcaacagactgagctagaagctgagctgtctgctgcgcatgctgaacgggattcctataggcaagaaattgaagagttgaagtcatctatgaaagaggtaaccacgcgacaaaaggttggaggaacctccaaatatggggactggatagatctgcagaaggaacttgaagatgatgtgaaatttctgaaagaatcaaatgcaaacttatccatacaactgaaaaatactcaagaagcaaatatagagcttgtttctattcttcaggagttggaagagaccatagaagaaca

SEQ ID NO: 85412 - DNA, 546 bp, Oryza sativa
atgatacctaccctcctaatgccttgtttagatcaaaataaaatttggccaaagacatgacatcaaatgtttggacacatgtataggacattaaatgtaggaaaaaaaccaattgcacattttgcatgtaaattgcgacacgaatcttttaagcctaattactccatgatttgtcaatgtggtgctacagtaaacatttgctaatgacggattaattaggcttaataaatttatctcgcagtttacaggcggaatctataatttgttttgttattagtctacgtttaatacttcaaatgtgtgtccgtatacttcaaaaactttacacccaagaactaaacacaccctaatataggcctttcggatcccctccccacctctgttttctatctcccccttctctgatatatgtatatccacatttttactaaaattttaagcaagtttttctcctagaatactacttcatctgtttgatatcataagtacgtccacaatatgtgttacaagatgtttttactttggtcaaagtcaaactacttaaaa

SEQ ID NO: 85413 - DNA, 717 bp, Oryza sativa
ttagaattagatctcctcagaacctctgaatcatcttgtgcttcagacaattttctctgagcttcctgttgtttttgcttaaactcaagcctttgagtttccatctctgcttgctggcgctctactttatctttgagattgacgataagtgatttagaatcatgtatctgcagctcgcttgactccttttcatttgtcatgtatgtcaactgagcttcgagtccagaaatgcgttccgatagctctatgttttcctgttccaggtccgatatatgtagctctaggtcagctttgcaactctccagttcagttacctttctttccagaaccttattggcagaaacatgggaatctatgctgcttgaaagcacaaggatatcttgccgcacctcatccaagcattttgaagaaatgctgctttctttacgtgatgcttccaggcattcctccaactgactcttctctgcctgaattttagaaataacgctttccatttcaactttggaacatcgcaaatcatcattttcctgctgctgtagctgaattttagccttcaacacatctgtctcaggttcactatccataccatttctaaattggtatcctcttgcaccactagtttgaacaccttcccctgccatggaatgggaactgtcaagcttctgcctcagctcagataactcaagatttctttgttctagttcctcttggcttttt

SEQ ID NO: 85414 - DNA, 1008 bp, Oryza sativa
cagacaaacaccatgtgggtataaaacatttgcgaattggaagcataatttaactgtcgtaaaactcaattccaccgttggattggaccaaatcctcgtacaagacaaaaccggcccacatggaaacgagtaaggcaggtcggagtccataggagagcacgtcccaggcatggtagggggtaacattgaaccaacaacccttcacaacaataatagacgacggcgatgaacaaaactaggacgactctttcttctcttccacctccgcttccttcttctcctcaggctccttctcctctgcagcctcctcgaacgtctctccagggacaagctcagggacatcatcgtcgtcgtcctgagcgttacctgcgctggcaccagcctcagcaccgggtacctgcttctggaactgctcagcaagcctcctgaggttgtccaggttatcaggtcctgcagataggtaattaagggtgatcaaacaagagtatgtatatactactatgtgagtaggacgtacttaaagactaatgcttggttcagatatttcaggattagggcgaggtgtgcaatattgaactcatattcagtaaaaccaagaaaaaagtctcatacccaactggttgatgattgttggaagcagatcttgcagctctgtcaaaattagaaagccaaagatgagaacaccattatgcaggattgaagaataacatagggtcaacgacgcagatgcaaatttgcgtttaaagggtttgttcatctcaagattttttgccggatgtaattcaacacaaacaagagaagatatttcaacctattcattcatgttaaccactaaacatgaggctacacaacaatcagtacgcaagatcttaagcaatgacttactcttcgtctgtggtgttccactcactacccatgtatttgcaccaatggatgcttgcactgcaggaaggcaagaatagaagacaatttcagaagaaaacagggagcgagttatcaattctatag

SEQ ID NO: 85415 - DNA, 900 bp, Oryza sativa
ttgcaagcaagcttgagcataatgcatagcctatcacaaggctgctcgttgcgtagtactgtttcgccataagagtagagtgaaaacctgcaattgcgtaaatatcagcaaaatattcgtaaacctgcaattactaatgcaggatgtttgaatgtgctatattttccaagtattttgtggtcgatctggctcctaaagaaaataaaaacaagagtatatgtatatgctttcaagtaagtcattcttgactagtaattataaacaggcaaggacatgtgatgatgtgaaatgactacctggctactgcaaactctcaagatatccaatatatgcgaattagataaagattgtttacaactgattgataaaataaatttaggatgggccatgctatttcactttgcttctgcatgtaggactagcaaatctaaggcattaaaatcaaaagtaaatcagaacatgtcatattgcttggcagctgcagagttgagaagaaattttttctgtctagagctcacatccacatgaatgaacacagcgatgccgtgtaacaaaacaacaactccacactaatcacttcatttcccttgtgaagaagatccaaataactcatcttgtactggtagacagtattaaacaccaagatgaacacaaaccccaactactcaaattaatgcacacaattcggttttgttcccttcattgcatcaatcagaactgtagaaagaataacccactagttacagccattggaaaccgcagaaaatctccaaaattggcacattttaccactgccgacaagccgcacaatagcaaagagaaaaaaggaaactatcaacccacaagaaagaatggcggcaaaagatcctatttttcggcaaaaagaacccatccaagaaa

SEQ ID NO: 85416 - DNA, 783 bp, Oryza sativa
aaattaaataaatccctaaatgaatatacaaggtggtggatcttattgttctactcaagggtgcacctgcgcacattctacgtacatgcagtgcataaatatcgtacacacatagtatgatttaatggtttgtgaaaaattaaaaccctattatgatgaaagaagaccagatttaactactatattttctaatcatattaaatatatacaggaaaaggtccaaatatccctcccgctcagtggcggatccaggaaaaaaaagtagtgggggctgaactaactaagccagcataaatcgaaacatctcacatataaattggctacatgtatagttcaaagtagacacgtcaaattaatgataagtagagaattttgtccataccaaaccaatatccaatagatgatgtttcaatgccagtcacttattattcttcattagtaatctgtacaaagaaaaaaaaagggcaaatgaacgattaatcgaaaatgacttattttgaattcaaataatttagagacttagggagagaatggaggcatggagcataccactaatttctgttgaggcactagcattcgacgctttttcatctcttcaaagtgttggatgattttttcatcactaatacttctaaaaatctgcttctcagtgtagcaaatcatcaagtcattgagccattcatcccccattttgtttcgcaaatctgtctttataagagacatagctgagaagaccctctcaactgaagccgttgccaccggaagtatcaatgataactcaat

SEQ ID NO: 85417 - DNA, 744 bp, Oryza sativa
agccaatcaaactcattgaaccaagttttttgaaaggatctccactcaccaccttgccatttacgaggaaatatagtaatattaggttgagttgggccactcaatgcatatgccctctttacttgatctctaatttcaggtggataaacttcaattggtttgcgaagccctggatcaccaattatatctgattgactaaactctgccctaggcctcttcggctgacttaaattctcggtgctaggtgaaggatctgtgttgcttgaactagaataatacgtgagtagtgttctttttgacatgttgacaatctaaaaagtaaaaaggtataggaaacaattataagtttctgtcagagaatcactaacttactgaaattgaagtcactgaaaatctgaaattgaactcttgacacaatttatattcagagaatcagatgttagtagtttacccaatggccaatgcaaagtagcagtctagcagactagcagtggcctgcccggctgcccctgtgctgtggctgtgcccaactgcccacggcgttgccggcgccgctggccgcttgcggcctgccgcctgcccgcccgccttgcggcctcgctgggagctgggcagctggcagtcgagtcgccggcgcgccgcctcccctacagcgcggcggcgctttcccgccggctggcccgcgcggccgcgcccgccttctgttcgccctgcccgcctgccttgcggcctcgctgggcgctg

SEQ ID NO: 85418 - DNA, 1817 bp, Oryza sativa
tagcaaagtacactccaatgattcaactacctggactaaatatacttaaatatatcatccatttcgtgcatgtttgtcatgatgtacaaataggctgctttgtactctttatccgttaggtcacgaggcccttggggacaaaagggtcgtctaggatatttaaaaatgctcaaatcacacaagctttcaaaggttgcagtaccatcatcatatcgagggttgtgatttcgacttgatcttgcagttgacttaaaatagagtgatagaaaatttgtggtctcctcaactaaataggcttccactattgaaccctcaacacgtgacttgtttccaaccttctttttgattttttgaataaacctagcaaattagacaatcataataaatgaatcaagactaaactagtccagaactgaatggtatgacaataattgattgtttgtagctccttacctttcaagtggaaacatccaacggaattgcacaggaccaccaagtcgagcctcataaggtaaatgcatcatcaaatgttgcatggagttgaaaaaaccaggaggaaatatcttctccaatttgcagatcagaataggtatgttctgttccaacctatatacattttccttattaagctctctggcacataattgtctataaaagaagcttaactccgccaaagtcacccatatactctcaggaaggaagccacggaatgctgcaggtagcaaacgctccataaatatgtgataatcatggcttttcatgccaaaaatctttttctgtgccaaattcaccccacggctaatattggctgcatatccatcagggaatttcagttctttaaaccacttgagaatggtgaccttatcattcttatcaatacaataagatgcctttggcttatgccacttgccattagcttttagttccaaatgcagccatggtcgatggcaaatctcctctaaatcttgtcttgccttcacattgtcattggtcttatcagcgatgtcaaagcaagtattccaaatagcttcagcaacatttttctcattgtgcatgacatcaatattgtggcgaagcatcaatttgctgaagtaaggaagtctccaaaaacatgatatatgtctccaattgtgctttttcccataattatcagaatctgttatggatgcattcatttgagcttgaacttgctctctgaaagttggcttggtctcccatgatgtattgttgtgtcctttcgaaatgcatttgattgatttcgaaattcgtgatcagttggaaggaaacaccgatggcaatcaaaccagcagctttccctccattatgagccggaatgcctttgattcacacaaacatgtggacatgctagttaccattggtgctccaacccacaaaatcaccataggcacgaaaatcatggactgaccaaagatatgctgccttcatagtgaagtttttcttcttcgaagcatcccatgttgtcacaccaacccatatatcaagtaactgatccaccaaaggttccaataaagaactcaagttctttccaggatgttgaggaccagggataacaagggcaagcattatgttctctggtttcatgcaaatacctggtgggagcttatatggtaccataaacacaggccaacaagaatatgttgcagcattcatgttgaatggtgtgaatccatctatagctagatcaagtctaacattcctgggatcttgtgcaaaattagaaaaatctctatcaaattgagcccatgcttcaccatctaatgggtgcatcatcacatttggcttatgtggagggtgtt

SEQ ID NO: 85419 - DNA, 1788 bp, Oryza sativa
  unsure (1)..(1788): unsure at all n locations
acaactgagatggtgtacatcaagcacattgtgacaaatttggggctcaacacttggggttttgtgctctacaacaaccttctttcgctgatgatggcccccttcttttggttcttgacaggggagtacaaatcgctcttcaccgcgatagaatcaaggggtgagaggtggtttcaggttgatgcatttgtggcggtggcattgtcatgtgtgtttggattgctcatcagcttcttcggtttcgcgacgaggaaagctatctcagcaacagcatttacagtgaccggggtagtcaacaagttcctcaccgtggcgatcaatgtattgatctgggacaagcactcgagcccgttcggtttgatctgcttgctcttcaccattgctggtggagttctctaccagcaatcggttacaaagaaaggaattaccgcgccgcagcatgaaccagaatcatctgagcaaaccaaagatgacaatgagggcattgagcttgatgaggagaaacaaagtttggttccaacttctaaaagctccaatgcttgacttgcatgcttagatttacattcagagatcctttaatcttgaaataggcttttgtgtagtgtgaatccctgcaacaaatcacaatgttaatctagaagcaacttccttgtgtcacccaatttcttcaggaatactgaatacaaatagcactgctgttgtttttttcgtggaatggcttattccaattgtaaacttgtaatacactgctggtatggagtatggacatatcatagctgacaaaactgatcattgaacatggatttctcttattgtttctattggatagataatagttactggcacttcttgattctgtcttgtgatggtattcaattaaacatggtctttcttttacttgtgctgtgatgggcatttcaatatttcagtgctaatttctatgaaaatatttcgcatgttgcaaaatatcatagaaaaaaaagggcatattacaacaatttgtccttctaaccatgtacaccagcatttggctaattcctcggaatgtcaagtttttctttatttgcgggtttcatcattgagaagttgatggaaggtaagcactagtaatgaaatgtgcaagatcaatcctcttttctaactgatgatatctgaagaagtagcagtcaaaattgacacatcctaatgaaatttgtctagaggctaccataagcaattcatgcacaggaatcagaacaaagattattcccagttgctactgagtttaactaccagacctctgtcaagtacaatcttcaagtgctaatgtgtgctcatgtaggctgatcttacatgaattggaattggatgagatgtcactagaatcttcaattcatgcagtcactttcaccgcgcaattggggaagcatgtatatatcagcaatctcaaaaccattgggtagaaaattttacattctgaatgaaggagcaaagaaatagtaacatgtatatcacactttacataaaccattgaaaccctggtcaagtacaatttccatagtaagatctcaaaaatatatataaaaaaagggctgaaacagtgctggttctagctagaagcacacaagcagagaaatgaattaagaaaggactgcgctcagttagatccgtgttagtgacaactggacatctncagcatacataggggcaaggagcataaatcagtcttctctccgccttctgtttccggagttcagaaagtgctcaaaatatcagacttgttctaatggcaaaattcgggaccaatgt

SEQ ID NO: 85420 - DNA, 631 bp, Oryza sativa
cagctggagtttttatagagccaaaacactggcctccattcttccccgtcattcatgttgatatctcaaatgacatacccgtgcacttgcagcgagtgcagtatgtcgcttttgcatcactcctaggtacaaataatcagtaattgactattttcttaaaacatatctatttttcaagaactataagttatcgaaagtgtaactacgggctaagattatgcatacctctcatgcagggttggtgatatgcctcttctggaacataatatgtgtcagtgctattgcgattatgtggggcggtatggtttcagagaaattcatcttatttaatttgcattcatgccttgtatgttaagcttatgtccctaatttgttagttttgagcaaatatgttaatttatttcatctatgcagaccctagggcctggtttctggctgccatatacttcattacaggatgcccaggtgcctatttttcatggtaccggcctctttatcgtgccatgaggtactacatataatgcccttactgattctctgaattaatattagcaaacattatagtattgtactagagtacctggtcaaaacttgatcatcactacttgacacttggttgtgtatatccact

SEQ ID NO: 85421 - DNA, 617 bp, Oryza sativa
acaggaatttgcatctaagtcaagaaacccactaataacataaaagatgttattatgaggggtacacgcaatggaatttttaaggatgcacctgcagaaaggaccatcttttgtctgcagtaaatcaatatctttacaagaatggcaatgtgtcatatgtttgttgttagcttcatatattggtgaggatgagaacttcatactgcaccaatcaattctgccagaaactaaaggcagaagtagatagactactccaataggcacttgcatctcatggaagtatttaataccattgctaacctccaaatggtcatcaccaataagaaacgaaagaatagttgtctgaaatcttctagcaataattacctggacaaacaaaagttatatattctcaatgaaatggtctaaacaacaatagcctagttatcaaagaattagagaacataaattgacaatttacctgttcttgattgagatggatgatgccaacatatttcatggtaacactagcattgtcttgcccacctggcaatttaaatgagctagaagtaaagtcagatcccaaatcacacttcaaagctaacagtatgtcagttggagaagctgttttgggacat

SEQ ID NO: 85422 - DNA, 582 bp, Oryza sativa
gttacttattgaatgatcaaaagaacaaaaagttttagtacaagaaagtagaagcataagcatctcttacaatcaccaagttacttattgaatgtcgttttgcccgcgcggtttggtctttaatccagtttgcttcgaatattagtttacctaatagtacaactcatatgtttgggcattggataagaagacaaccacacaatttgagatctttggtcttattaggggcaactaccactatttggtctatttggctttgcagaaatgatgtggtttttgaaaggaaaaacatatcttcccctttgcaggttatcttttttattacacattggctctgctcatgggctatccttcagaaggtcaatttgcggggtactatcattgcggcttgtcaacacttggagctagtggccatggagttttctaccccggcgcatgggtggcgttctaggctacggttagagggctcctgaagttctttttgtccctgctattttggatgatgagtttatcttttgtttctttcttgttggctgtgtgcactctttgggtgcagaagccagaggtgctctcagaataatt

SEQ ID NO: 85423 - DNA, 514 bp, Oryza sativa
gtgctgtggccgagtgaagctgccccacttctactgctgtagcggagaaaaagggaaccccggcgactcaagctcataaacctgttctgtttctccccaagttcagtctgcactcagcacatcaagcaatgtctgaacactattccaccatgaacgttttcagatctcattttgtgttcggccgctgttctgttttcaagctttttaatcagtgtacacactttaaacccagcttggatttcaaaactccccttgtcaaaaactcaaatgccactcgtgacatgaatggatgcattctgtctgagacaagaaccaaatgtgtgcatgtgccttgctagaagaaagaaataaagggcctcatcttttttttgcttatgcttatgtttatcagctaaaatttaaattttcaaccttaaatttggagttgattttggggttttttaatcaaagtttatttttcagcccttgtttttagatagctaagaacacgtatataaaacaattaaagttgtat

SEQ ID NO: 85424 - DNA, 606 bp, Oryza sativa
gcctgcaggtcgactctagaggatccccaggagccatttcatgttacataggactacaacaccacatggggctgatgccttattatccggcaaaatccattggattgaaattcattgaattacaggcgtcattatttgagatctactaccattgtctgcataaaaacatacactgaacctttacaccttttctgaacataggaaaacctgcacttgcactatggaatttatcctttgcgacgtcacaacaaatactcgaatgaattgagaaataacctatgttaacactgaaacaagtctgaagccaatatcataagagcatgaaaatagagctcttatggattgaccttgattgttgcccacactcttattacaaccttagagcaaactggcccatttagttgaatacattctctcatctggtactgaagatactatggcactaaatagacaatgcatcaagagcatgaacacctacatgcttttgttactgtcagcatccaatggaagtctggagagagctatgattgaatgccttttcactaccccgccataggtagacctcccaagcctaaccatcttgttttgcacctcgagccgattgcc

SEQ ID NO: 85425 - DNA, 597 bp, Oryza sativa
actatagggcgaattcgagctcggtaccctggaaggtcaccgagcgtgttagggcagccgggttcccctgcatgaatggcaagctgctgatcgctgtgtgagttgatgcctttgcctcatcctttgactcaaaaacctttgcaagcttgcatcctctgccatgatctgctcccaccttgtcacccttgatcccaataagcgaccagatagagctcctggccacctcgtcgacatcgtcgatccgaaccgtcttcggcacccacaccttgccattacccttgctatccagttcctcatcaccatctctagggtgctttcctaatctgaagcagttggtcattgtggatactggagaagcagcacttgatgatgaaaccgattgggattgggactgcggtggccatggagcgttccaagctcctggaaccatgcagccccagtatgcagcaacagcagctgctgcagctggatagaatggaattgcaatgcttgaagtgtaataagcaggtggtggtgccacgccaaatggccacatggctcctccgttcatgcatgggtgttgtgcaacatttggagatctatctgctgaaactttct

SEQ ID NO: 85426 - DNA, 686 bp, Oryza sativa
ccgtacgcggaattctcatataacaacagttatcaagctagtatgcaaatggctccgtatgaagcattatatggccgaaagtgccgtacgccgctcctttgggatcaaaccggtgaacgtcaagtttttgggacggacatattgcgagaggcagaagaaaaagtgaagattatccaagaaggttgcgcgttgctcagtcacgtcagaagagctatgccgacaatcgtcgcagagatttggctttcgaagaaggagattatgtataccttcgggttacgccgttacgaggtgttcatcgtttccagaccaaagagaaattggcaccgcgtttcgtgggaccttttaagattgtgagtcgaagaggtgaggtagcttatcagttggaattgcctccgtcaatggcgggaatacatgacgtgttccacgtgtctcagttgaagaaatgtttacgtgtacctacggaggaagcagatcctgatcgtatagagcttcaagaagatttaacttatgttgagaagccagtcagaatcttggaagtaagcgagaggaataccaggaatcgtgttatacggttctgcaaggttcagtggagcaatcattcagaagaagaagccacttgggagcgagaagatgaattgaagtcagctcatcctcatctcttcgccagttcttctgaatctcgagga

SEQ ID NO: 85427 - DNA, 5984 bp, Oryza sativa
tggttttatctgaatcttgatgctgttatggtctctgtacttagggagtgtttgaagagaaggggattgaggagattgggaagatacgcaaaacgaggtaagccattagctcatgattaattgagtattaactattttaaatttcaaaaatggattaatatgattttttaaagcaactttcctattgaaattttttgcaaaaaacgcaccgtttagtagtttgaaaagcgtgcgcgcggaaaacgagggacaatctctcctatctccacctaacgaacactcccttaatcatggctctgaagatttgatcttgtgacacaatcctactactactactacctgaggatactgatatgcagatatggacggcattgaccaggagttttgagtagaaattagagacagaattgagaattactagcagctaccgagcttactgagttgggacattttggattgtaggtgatccagtagttgatgaaaatgtgctggtatccatttatttggataactgaacagatgttggaatctcaacgactgcatttgtggtagtagtatcaagtggtgatcggttttagtttctgatgttaagtaccaggagtgctactgctaacacactcccttttgttcttggtcactggggctatgatttctgttagtagtgcccactgggttttttgcgttgattatccatgttaatgagtgggattaagggatctgccctaaaaagaagtgccctcccatctatgacaccaagtgcaaccaacactttatgctattttttcctcttttccttttctctctttctgtgcatcctttcacttggccaaaaaaattctctctctctctccctccaactgtacttactttaaagaaattggaggatgacgacaacttaacccaccaatcaggaataattctaaagcctaaactttctcgctgccttggtggaatcagtgaggaaaaaaaagagaggatagttagggagggtaaaaaggaaaagagaggcaaaatgcatcagccaaccagagaaagagagacgacgaagaagaaagaatatgattctctcgtgtcaatgtgaagaaaaattgaaactgcggcttaaaaagaataagaacatggcaacagtatatgaaccgtgtcactgtcctggcttgagctagatcaactctctgattagagttttatttgaccccgtctcagcttgtgccgcacacgattccaacgtgttccttttttacacggctagctatctaccacttgaaacaagcacaatcaacattattcttttatacaaatgcatgggagtcttttataagcctccgtaagaatcatcaccaccgttttctttgaattttccacactccacccaagcccttctactgaggccacatttaaatcgattatttattgagaaattccatgttagctgtggaagggcaaagaaccggatatataagaaaggctcttacctccttgactagcttttagggtgggaaataatatttacgatcctatgataagtaccagatcgagcctgtcaagttcaatatttttagctcgatgaacactagaatgtgaaggtctaatataccgtggatttggagagagaaacactggtgatagtacgattttgcccctgccatcgtttcgtttacagtggactaggggtgtgtttgaggattggggagattggggagattggggagattgggaagatacgcaaaacgaggtgagccattagcacatgattaattgagtattaactattttaaacttcaaaaatggattaatatgattttttaaagcaactttcctattgaaattttttgcaaaaaacgcaccgtttagtagtttgaaaagcgtgcgcgcggaaaacgagggacaatctccccaaacactcacaaacgaacggtgcctaggtctggttcaaaccaagatctccagtctcactcccatgaatccccttccgctctccccaaaccctagaaattggggcggcgctgtgaagtactagcggcgatgtggtcaacgatcggcgaccagcttcggtgagggcggcaacggattgaagccgcgcatcgctgaagttgtgagcccggcgtggcctcagcaatggctgggacgttgcccgctagggtgatgtcgcccaggaagaagacactggggaagaaggtggtggcgaagaggtcggtccatgtgatgagcaccgaatccccattcaagtccttcatctgccagctcagattcgccgctaccagcttcaaaccaccacgccgcagtcgccgccactgttattcctccgcggtcaaaatctagggtttgtgatggggggattgatttatgttgtggttggtttgaaccggacccagtcgtgttgaaataagcatgcccaagggcaaacttgtctttattggcatttctctctccaaattcaccggagtgtctaagagctaattacatgtttttttatgcccgatagcaaattctcgttcttacggtgtccactaactaattacacattttttcgatgccccgtagcaaattttgtctacatgatacatgcacatttggtagtagtaggagagaggtgtaatgtacgtgaggtgaggctaggcgagagcaacccatggatggggaagaaggagccacatgcgtgatggatcgtggatgagctggtgcggctgtgcccacccatggatgcatggatcgatacccgcggcgccctaaagctatttgtgcttgcttcacatggctaactaaccgctctccccccccccccccctctctcttgctcgccgctgttgcgatgtgatatatttctttctacacaagcatgttcaaggcccacacacacactcgatccatccaccatcatccgtgtaatcacgctagctgagagataagcagtagggagaaagagggagagacgatttgctcatttgcatgctgtgttagctgctgctggagtagtactactactaccaccattgcatgcagggggtccaatgattcgttcccacgcttagacaaaggctctctctctctctctctctctctctctctctctatctcgttgcaaattaaatgtcacttcaagtgaaggctaactactgggttggttgcttttcgttgatcgatccgtgcggaattggtgaacggtgaagtacaagagggctttctaggatggcaatggctccttaccgatcccttctccttcccttccagttgaagccacactttgggactcaatttattgcatccaagacacgcggttgtactaactgtctactcctcctagtaccattcttctccaccggagcatgtagaagttggagtattagctagtactctactaccgtattagccattttaatctgttcaaattatttacacacaacattaccaggaacatatactcctattgtctcaaaataattcaacttaggatattatgtaatatatcttaggacaatgaatttggataaacttttatccagatttattattctagaatatgttacatcatcatctatgttaaattattttaggatagagatagtatatgtgtacactatccattgacaagtggagtatcaactaatctgcaaatagtagtataaggtcttgtttagtttccaaaatttttttctcaaaaacgtcacatcgaatctttggacacatgtatagagcattaaatatagataaaatgaaaaattaattgtatagtttgcatggaaatcatgagacggatcttttgagtctaattagtccatgattagtaataaaatgctacaataacccgcatatgctaatgacggattaattaggcttaataaattcgtctcgcggtttccagtggagttataaaattagtttttttttcattcgtgttcgaaaaccacttccagcattcggtcaaacatctgacgtgacacccaatttttttttcgcgaactaataatggaaaagaaatgttggcttttcagtccggccgttattgatgtcaggattcaggttcgtgacaggttgaagtagtattagtagtagtggttggagtataatgctacgggggatgggtcactcgtagcagctggcgcccagcctccagccaaggcgattttggtcgcatgctgcgccgtgctggctggccgcgtacgtgatgattttcctcttcctcccccgcgcccatgtccaatctgccgcgccgccgtcgcgccgcgaacgaccgattcgcttctgctgctgctgctgcgtcccctttgcctcctccgcgtatggaccgccgtcaacaggggggtccaaccccaacacccgccccccccccccccctcccccccggcgacgcgatcggcggcggcgacgacgcggattgctactactactagttcgtctgtgggtggggttggttggtttggctgctgcgagctttgcgaggggctcggttcacaccgcgacggatgggtggatggatggatggatggatgggatggagctgatcaatcgtgcggtcacctccgatggggacgtcgcacccaaccatacatctcacgcccagtccagcccagccgcagcaaacgtacgtactccccatagtaggccatggtgacctggtatgtacaaaaacgtcaaaaaaaacgtagaatcgcccatacaaatacgtatacctacaaggctactactccctccgtcccataatagatgacgtttttgactttttattagcaacgtttgactattcgttttatttaaaaaattagtgcaaatataaaaaataataagtcatatgtaaagtacttttgataataaagcaaatgacaaacaaaataaataataattctaaaattttttgaataagacgaatgatcaaatattgacaaacaaaaacttacaaagataagtaatatgtaatataggacggaggaagtataattcaactgctgattagttgggtcgtacagtcgtacacccgtcaagtaacgaccgtaccacaggtgaaacactcatcgaaatacttctccataccgtaatactatatactagctgaaaaattcaggggatacagctataatttaggactaaggaaatgggtggcagagttaatggggcagttgtgttggttcctgaggtctgtttagtctcaaagttttttttttccaaacttgtaactttccatcgcatcaaacctttcacacgcacgactttttagtcacatcttttcaattttaaccaaacttaaaaactttaatgtgagctaaacacagcttgaattctttgatgtgcatagcatagcagcagcgctctgtagtactactactactagcagctgatgaggcgattaggcgtggtccatgcatttgcatttgcattgcgttgcacgcacgtcctgatgaaagcgcagagaaaacgagaacacaaggcgcatggtccgtccgactgacaatcaaaaggcgtaccgctgctgctgcctgctgctaccatcgctttgctgttttagggatcgccatgtttctgcccacctggctccccttctctcgttaatatactccctactaatcgcctcgtgactgcaagggtggtggttgcaggtagcagctgtagctaagcctaatattttcttggtttgacggcgacggctgtacgagcaagactacagttagggcctgttccaacccgatgaggatgtggattaagcgaaggcacatagcactagaaagtcgttaagatatgattaaagttttaggattagttagatagaactcaaacttttaaatttaaccttagaaattgggtctaaaattaatttatgaagctgcttaaaacccagctttacctatcctgtttattttatgaaagcgcttcagccatctccacttattttttaaggtgaagttgaatccgtttggttgtgctcatcctcttgaagctgtgtcaaacaaacacttaattgttataaacctgaaaaattaattactttcatactc

SEQ ID NO: 85428 - DNA, 2716 bp, Oryza sativa
acttttatattccaacagttatatgttgatttcgagtttaattatcttggttggtttgattacttaattacacctacccctacgtttagtgagtggtagactggtaggccggtgaatgaactggtagagattgcgaaaaggtttcagttttttctggtaaagcaatgtgtactccctccgttccaaaaaaatgcaaaccctggtttccatgtccaacatttgaccgtccgtcttatttaaaaaaattatgaaaaaaattaaaaagacaagtcacacataaaatgttaatcatgttttatcatctaataataataaaatatgaattataaaaaaaaattatataagacggaaaaacctaggttttgtctctttttttttttggggggggggggggggacggagggagtaggagtggcagtgttgaggcaggaggaccaggaactttttctgaccctttgtcacgagagatgcagtaggttttcccagctgcagtctgcactcgcgtcgcggttgttattgtcggtgtcatccgggatttaccgcagggtgaaatgctggcctttttacgaggcaggcagacagcgtcttcagtttggccctatggggatcttcttacagtctgcactgtgggagtactagcattgaattctttctgctagttgtactaggttttttttttcttccgtttaaggccgtgtttagttccatttcaaaaattctttcgaagtatacttacacatattttaagtattaaatatagactaataataaaacaaattacagatttcgcatataaactacgacatgaatctattaagcctaattaattcgtcattaataaatgtttactgtagcaccacattgttaaatcatgacgtaattaggctaaaagattcatctcgtaatttacatacaaacaatataattattttttttaacatcaatataaatatgggaaatgctaaaatgacttacgttgtgaaacggagggagtatctttttacagcttgagagttctatcgtttgctcggacgcatgcacaataaaactgcctgactataacactgtgttcggcagaagccgattgagaagaaaagttcctcgttttttacacacacgttttcaaagtactaaacattatgtgttttcaaaaaaatataatacaaaagttactttaaaaaacatattaatttaatttttaagtttgaaataactcaattaatcatacactactagttcaccttattctaagtatcttctaatcttcttcaatcctcttctcacaaaatggcaaaatgatgtgaagaaaagaaaattcaggttgcattttgattactacttcaggttcgcgcagcccatgcatgtcattaatctggccttattagaagattcagaagcccatatatagccatcgctaatcttcttcgagcaggcctaaaccctccattggcagcccataaatcactccaaaggcacataaatatagggcctgtttgacacagctctagctccagcttcacccctcttggagctggagctcagccaaacagttcagctccactaaaactgggagtggagttgggtggagctctctcataaaatgtattaaagttgtggagctagatttaggcagctcaacaactctactccagactcaacttctggagttaaatttaggagttgtagctgtaccaaataggccctactctctctgtcctaaaaaaatatgaatctactggatatgatatattttagtacaatgaatctatatagagatatatttagattcgtagtaacaggatatatcacattcaatactagattggttttttatgggatgagaaaagttgttctcacttgaagaagggaaaagacgaggcaaattccaggtcggcacgcactcgtacgtacggtacgtatcttggggcgtatcatcagcagccgcagacgtggacttggacggtcagtcagacggtctgaacacacgaggccaccgttcctcgccgtcgatggaacagcggcctgccgtgacggcgagccgacggcgaccaccggcagagggggagaagtaatgttggggttggcgtcatggcttgttcttttctcaagaatggattagcgcaacacgtgtttcgagtttcctttttctccttctttttatttagaacacggcataatgaagtcagtacaaacgtcttattgtcgacagatacgtcgtctaacactaaaagagtaattagccgtaaatccagataggctggttcttccacacaagaaacctaatcaattgagttacgctcacttcgccgtttttcgagtttctagacggtatgattttcgtaaaagaacatatctacacatgaatttcttaaatacggttatagatcatatttttttttaatttacagtagttaattattcgtttgtatcctcacatagcgataaaaaaatcgttcatgtatttttttaaaaaaaaaataattaaaggtcccccatatggaaaagctttcctgcaacttgaggatgaggggacgcaccaccgggagcaatgattctggcgtctccagcctcgcgtacggctgcgctcgcgtccatgcaaaaaagtggaggaaaatgccaaaagaagggggcttttcagtggaaactatcctctcttttcttttttggaatacagttagttctcaatatttaagatttgaggtaggctcgtttgaaa

SEQ ID NO: 85429 - DNA, 694 bp, Oryza sativa
ttcaggaacatgttgaaactgtaaaaaacaaaaacttactggatcatccatggtacttttttcttgcatagaatttcttagaatgaagaagtctatgtatattccagcactaagttcccagtcagcaatttcagacttgtgaacctccaaagagcttgtaatgtcccagatctcttgatgcttagctgaaaaatgggttaacagaacgtctggttgaaaactcataccatgatgacaaccatgcaatatttatcaacacaagcagaaaaaaaatctataagacaccttcatgaaacatatgaacaaaaaatatttaaacagaataacaaagatatctgtaagaagcttcatattattaggttttggggtcaatatagttgtacatttatgtacaggaaacaaggcgcaaaactgaattagagtatttagaaaacctatttgtttagagtaatgtatgaaaaacttacatgacagaaacaaagaatgagcaatggatgtcatgaaaattgtatgggctttcttccagttgccacacagaatataattctccagtgcgctttgctgatctccatagtattcattgtaaagagcctgtataaagataatcagttacacaaggttgaagtgcaatattttcctggtagtggcattcttaagaatttgcaatgctcatttcacttttaaagctacatgc

SEQ ID NO: 85430 - DNA, 1324 bp, Oryza sativa
ccttcccattattttggtgaaatgacatggctgaggtatctgacccttttgtttatgccagcttattgagagaattcttgatttctcacgacatcagatcattgattgtatggctgcaagtaacccaacctttcgagctctttacaaaccagctgaaaaagtcacaaatgatggtagtcctgaacttcttttttcaatgtttttgcattgttggtcttttactcttttgtgatctgtcagcaccttactcatttgtatttctatgcttagtgtatggatggatgtgttcattgtgcttttcatacttaatatttattactgagagacaactttgtattgtgggactaaaaatttattatttcctactggcctgtaggcagtaatttatttctgttaccgagctgactgtttaatggttgaaccttttatacatcacacagatttgcatttatatttttctttttctggttgggttcaggggatgaggatgaagaagtcatgggaaatggaccagctaacaaaaggaggcgtactgctaatttaagcatgagaaaatcttctacaaacaagtatcaaattttgctgttttagtttttctattttttgtgggtattcctgaatcactaatggagttcaattttccttttacatatcagagtttctgcctctatacattcagctgtacagaaactgtgcttgatattgggctttcttacggaactcctgacaacagtgcgcttatcagatagttgtattttgcaattagcaaaaacatgctttaccacattcctggtggacaatatgcaacttttacaattgaaagcaattggtgtcatttgcacggtattttcttttcctatttgctatatgttctgctctttcagttttcaaacaattttggttccttatctttcaagttcttacacaggttttttcatcatacacacaacacaggacatacttggttgatgaaacacttgttcttcttcgtaagctacagttttcaaaaaatgctattagaacttaccatctagcagatgaagaacatagccaaatccagatgataacagcattgttagttcacctggttcagttcagtgcaaatgttcctgatggtttaaagggaacggtgaactggagcactattgttgatgcatcgatagacgctagttatccaatcaaatgctatgaagcagcaacggaggcttgctgccttttttggaccaatgtgcttcaacgtttcactgctgctaaatctcaggatatgtcggaagccaaagggattatagataatcgtgtgcaggacttgctaactatactaaat

SEQ ID NO: 85431 - DNA, 3803 bp, Oryza sativa
atgtttccattcagattgtgtgggtgttgttagtcaggaaaacctacagtgtgattatgcctgtccattatgcttttgcaaacggcagctcagtgtgttacagtcatattatgagttgcaaaataaagagaatggcaaaagaaatgctgcctctcatcggaagaaatccactgtacctgatgaggtgacagctgtggatattgttcaacaaatacttttgacttatatccaggaaggtggtccacaagatgatggaaatttgtttacacgatggtatgttttgttgagtcttgctcttgtcttccaagcgtgaatggagattgactatcattttgtgtgcaggttctatctctgcatgtggtacaaagatgatccacattctcaagagaagatcatctactatcttgccagactgaaaactaaagacattctgcgggattctggcaatggtttggtattatccagagattgggctaagaaaatttgtttggcacttggccagaagaactcattttctagagggttcgataaaatcctttccctccttttggtatgtgattatgtggctgatttcttatatttctgatctcttttgagtttcatgttctggagttgatgctttataccctatctttttcaggctagcttgagagaaaattctcctgtaataagagcaaaggccttgcgtgcagtgagtatatggcttatgaaactatgccgccattcaccattttcatttaaacactagccttcattaccatgttcacaatttgtatgtaggtcagcagtatagtcgaagctgatcctgaggtgttgggtgacaaacgtgtccagtctgctgttgaaggaaggttttgtgactcagctatttctgtccgtgaagctgcgcttgagcttgtgggtagacacattgcttcacatcctgatgtcggcctgaaggtgagtagactgctgaagttaatctgtgccatattcttggatcgaaaaggtattaacgttggcactttgccctatgccgtaacagtatattgagaaagtggctgagcggataaaggacacaggagtaagtgttcgcaaacgtgcgatcaaaatcatccgcgatctgtgtgcttcaaatccaaacacggacactactcgtgcctttgtggagataatttctcgtgttaatgacgaggagtctagtgtacaggtaagttaatataaaaaaacgtttactggtgctcttgaaatcaaattaatgttgttatagcatatttcatattgtaccagaaatgtttggcatctctcattagtttcattccgcaatgttgtatttataggttgtggatctattgtgatgtgtatatggatttcatcattacattttgtacacaaatgtcgataacggtagctattagttactgttacttggcaaattgtctttcatgttaaaaaatcaaaaccataccgcctctttgagttagatagggtaagttgtggatacattaagaattaagactattttctctctttctttgcttttgcaaaatgttgaacctcctaatctaggttccttttattttcgccctttatgcatgtgaagtttgaacattgtgcttgaaggtccactggtggtcccttcattcatctaatattttttttcctgcttgatgtcttaaaagtgaagctaacaggttgaggcttatgatatatagcaattaacaaaatatgccatgtacatctttggaacagcaatattttgtcttttttttaacatccatgataattaattcaggtagatcttcatttccttctctgtaggatcttgtatgcaaaacattttatgagctatggtttgaagaaccaactgggagtcataagcacttggttgctgatggtagttcagttcctatggagattgcagtaaagaccgaacaaattgttgacatgttgagaaagatgcccaatcacctacccctcattaccattgtaaagcgcaacttggctcttgatttccttccacagtcagctaaggccacaggcattaactcatcatttatggcatctctaagaaagcgttgtgagttgatatgtaagcgcttgttggaaagaatactgcaggtaatttctgatggagtttgattaacaagatttcgcattatcgagattggttctcacacatttgttattatcaaggtggaagagggagctgctagtgagactgaagtccatgcacttccttatgttcttgccttgcaagcattttgcattgttgatcccaccctctgcactcctgcaactcaaccttttcagtttgttgaaacacttcaaccataccttaagaagcaggtcagcatgaatttccttctattgaactttatgttgccatgtgctcgtgtctgagtaacccacgtcaatctcatgaacttcctcatattaaaaaatcatttcataagcaaagattgaatgattagctagcattagtatgcatttataaatggtcatatccttgagtctacgacctacaagccaaccttttgcaatacattagcactgtatagatttctaacttagatcatgtaggtattctgttatgtgtagtaacctgtacgcctgtttggtgatgattaaagtttagcactttagctccccgttttgcctgtgctttttatgggcaattcgccaattcctactagttgtgactgcctggagtctagtgtcttgtggcttcacaatgtgagctctatgttgctgctgacagaacctaactctatggtaaagacttccagtgtcatgtttgataggtattgaactgttctaatagaagcagaacttgagttttgattatgcttattagaaagctgatgcaattggttaatgcacccagtgaattttgtacagcatgagttgttaatgtcttttcctgctgtacataagaatcttttttagtattttatttagcttgttagccaattgtactgtggagatatttatgttctgggtgttaatgtaagtacatttatttcatgtgaacaaactacaaattcctttgtttatcattttccctacagctagattttgcactgctcctgatcttgtatattgacaggttgacaataaatcaacagcccagttgcttgaaagtataatttttgtaattgatgctgttcttccactcatatggaagccaccacaatctgtggtaatagagctagagcaggatctgaagcagatgattgttcgacactcctttttgacagttgtgcatgcctgtatcaagtaatcatattccatccttctaccgtcagttttatttgatgatcatttgtccttatgtactacattttcacacactccatgttaggattgtttgctctttattttaaaagaaattttcatacaatatctcttgtatgggttcatctggtgactttctttattgactggaatactcgatgctagaaaactgtacatggcctatatgatttgcatagccatgggatcacatatggggtttttggtaaatatgatgcatatctggtgtgtaagataaatatccctacagctataaatagggcgatgctgcatatgttaatataatctgttaatagtttaatgttcataaaattgaaatgcaattataatttaaaacattttgtttatgaatcatcactatttgcatgtcacaattgcacacccttattttgttcaagcatcggtttattgaacttacagtcttatgtggattatcctaccttttatttattttaatcctttgctttaaacgctcttgttgaattatttcttcttgttcactttgatta

SEQ ID NO: 85432 - DNA, 638 bp, Oryza sativa
cctatgcatcagtgttggtgctgtacccaatttttctctgaaaaatggtgtgttatatttcaaggattgtatgtggattggtaccaatacagctggcaccagaaaaatttaacaaaccttcatactgctgcagtggggtgggcattcaggcattcatgttacttatcaaagagttaaacaattgtttgcttggcctcgacttcgctccacagtaactcaatttgtcaactcgtgtgatattggtcagcatgctaagtctgaacatgtcagatatcccggcatgttacagccacttccagttccagaacatgcttggcaaatggtatctcttgacttcattgaagggttacctcgctcagattctttcaactgcatattagtggtgggggacaaattctccaaatatagtcatttggtaccgtgggctcacccctttactgcccttgatgttgcagaggcttatatgcagtacattcataagtacatggtcttcctcagtctctcatttcagacagggatcggatttttactagcacattatggacttccctctttaaattggctggcacccaattaaggatgagttcctcttatcatccgcaaactgacgggcaaactgaacgtgtgaactagtgctt

SEQ ID NO: 85433 - DNA, 4432 bp, Oryza sativa
ggctttgtttggacctactataacaggcatacagctccatcacccggcgacggcggcgttggagctcatgccctgctagtggcgacgcaaaaaggtgcgagcgaaggcagtgaagtttcgagtcgtctgaatttaatgtttgtcttctggtgtatttaatatcgtatcatttatatacttatatcgatgtaccccaatactctcagaatatgatctatgtatatccccgtcgacagattaagctaaatattttattaatacaaatatcatagctacatattttattaagacaattactatataatttaagtagtcaaatttgttccttccatgttgaaaaccaaatacaaatttatagttactgggctaaatagtttattattattattattattattattattattattattattattattattattattattattattatttataatttaagttcccagtttgatcaaactaaaataaatttaaacagaccatgtgatattttggaaaaagaataatagaacgagtagagtcgagggaggataaatagaaaacacctaaaaataaaaaaaaaatagaaaaagcattgaaccattcgtgctaggctgctagcaccactttgtttactttaggagcctgcataaaatattttggacgagctctcgtgatgtgcaatttcattgcggacgttgtatctcagtgcccactttgatgtcattttttttaaaaaaaataatcagtttttgatatttatttttgaaataagttgtataaaatgattagattgtcaaaaattcgagaaggggacaatcgatcaacgcctgaattgtatcggtgtttccttttatcgtcgttttgtttggttgaaactacgagtactatacatgtaccaccggtggctgcgtgtacgtgcagaggtgcagccatatcgtaggaacgagagtttgtgaaacttctttatttaaaccgcatggtgttactataaagatacgtagcacaatttggaaaacgtactttaacttttaaaattaagttttcaaatcccttctttctatataaagttaagacccaaaactgctatctcctgcctccacgtcaccagctaattgaatccgttggatcaattcatatcagctactgccaagcgtaatattaagcaccatgatctctcttcagatgcactttggaggcccatttctcagtttaggcccaattgattgcgagctcagagcgcaagagaaccttcatctctttgttcgaggtgcctgtggctgcagcctagagcgacgacgcattgtcttctctcaaatcaatggcctcgctaattaagtccgttcaaatgcatggcactacactaatctacctcatcactacagttgttttgtgtgctcatacactgattcaataatccgaatagccattttttttctttttttccttaaaatgattcaattgaaagaaacttgcttttatagtttcattcataagttcacagggtctacagtataatgtttgtgatgtgcaataaactgacctaacaaaagaaaaaaagatgtcttcgtgcatgtctgggattgcatgcactttggcctgccaacacaatgcaataattatatatgcattttgtgaacgaatgttctatacatcctccccatctctcacaggtaatttggctatcttgatgacttactctaatggatcaacatgcaaatacaacttcaagttctttgtgtcatatcttattgatatcttattgctttctctttattattattattttttatttttacaaatatacttctttagtttaatcaagagaaaatttggcttcaatcaaatccgctctaattcctgtgccaacgtttagtgtccaaattgcctgcctctttcttcttctcttacgaaaccaaaacaacataaatttgtcttcagatgattcatctatattgtttcccttccttttcctctctcataaagttacatcaccttagttttgcttagttttgcttttagttgatcaatctataatttaaattgtcataaaccgtatcatctaaattgcttatagcttttttcaactatcaatcaaagatgcaaattttataaagtatataaaattatgttgtctagctactccctccggtttaattttaattgatgttttggacaatggcacggactacaaaatatatctttaaccttatttttctatcataatatatatattaaataaatacatgtttacttttgttatagtgctttgaaagacaaatctatatatatattgttctagtttctttaaactaaatatttttaaagttattaatggtcaaagttataaaaatttgtccctaatcttgtccaaaatgtcaattattataaaaccggagagagtacaaaacaaatcctaccattatcatgcaaaataaattctgcagcaacgtgcgggctttcatttaaattataaccgccatttgtaagctggagggcaaatgacggggagtcccctaaaaagatcaacaaccttgctacttgtacagtcaccgtcaggtgggccacgccactcgctcggatccagggccccacctgtcattagcactggccaatatccccaacttttcttcttttttttctttcccctttccctctcagaaaaaagaaagaaaaaggaaaaaagattcatctcttcctcctcgtcttgtccccttccctcgtcgaaaccctagctaggctcgccgccggcgacgcccgcctcgccgatgcgctcccccacctgaccgctccgcctcgctctcccgggtcgtcgttgcctcaccgctgtgcccgcccacccccacctgggcagcgggcgggatccagtcccagatcggcgccatgtccaaggccagggtctacaccgacgtcaacgtgctgcgccccaaggagtactgggactacgaggccctcaccgtccaatgggggtgagtgcctcccactcctacctcgctacctcgctcttgcttccaccctgtgttgtcgcctctgcatctgcgtgggtcagtttagattcagtgtcggatgttgcgtgctgatacgtatgataaagctttttagttacccgtttcatgactttgcaatcgccggtgttatcatcaagttattaggattgtaaatagaattgtttgtgaatcaactgctgctcttgttgttattggagttccattgtttcaggttgcatgttagattagtgatcttgtgcggagagctgtcaaattgtttagtttagatagaactcggtcttatttattgttacagtcgatttcaattaattatttgttatactccaacaatacaagccaaggattatgcaatatacagagctaaattgaagaatacgacttagtgtacactggtaaaccatgtcaatgaaatgaccgtgtagattataataaacttctcctacatcaaataatcataaattggatctatgctaatatgtattctatcactggatcaaggaaaccgcctgattagcttggaatggttttattggtactgtattcttgtattggtgaaagatgatataattaagtgtaacaacctgatatgagctgggctccatggcctttgtctagtatatgactaacagctatcctgattgattgtgatgcaatatgctgtatgtctagagtgcaacagtatattaccctctcaagtgtttgttatggtactagtgtttactgcttgttcttcatcttcctaagaaacgacaggaagatcatgttctgtaaaagcggccaaacaaggtcctgggactacgaggccctcaccatccgatgggggtgagtgtgtcctacgtcgcaattgcttcgcgcccacccacccacccatgtgggcagcaggccctcccgcatttgttgctgcctgtgtatctgcatgcggtgaattcatccattcagttagattcagggttggatgctgcatctggagtgtgtgctgttggaattctagacgtcggtgatccagggaaggtattgttgggtgcgagcttgattgagtcgtgcgattttttttattcgcatatattatattgggaaaatggatatactccctgaaatcattgggacaattgattacttactaataatttctgttcactagtggctacttaaattacccattttttgacttgcgattacggtgtcatctacaagtttgcatcgtaaatacatttctctaaaccacgtacatggaggcaacaataacacataaactgctgtcgttctcattgaattcccattgtttcagattgcatgttagattagcgatgttgcgcagagggcatgttttttagttagtttcaatctgtcgaatgatttagtttagatagaattgggctcatcatttggtgttacaatttaatttactttgtaataggaatccaaggcatgca

SEQ ID NO: 85434 - DNA, 1398 bp, Oryza sativa
aacacactttttgataaaatttgctactctaaactcccaaatgacaaatgccaaattgctaacttttgctactagtgtttagatccattttagcaaaaagtgttttcaaacagtaaacttttgctatttttaaggaactaaccagggccttattagagggcgtatatttttttttaatgataagaccaaggggtgggtgtaggtggtggtggtggtttctttgactgcatgtgcatgctcaagtattactgtaattgggtggatctgtataccaaagcgttacacgcatgtatgaagacctaacatagaagggcacatttggaagaatcactgcagggaaacccatctttaatgtcggttgggaaccctctgttgtcccggttatgtaaccgggacggtgaatccgggactaaagatagtcccggttaaaataaccgggacaaaagaaacatcctctagaacggataccctcatctcaatcgggcatggcgtctgtcacaggctagaagtcactgatgtgaagagctatttcaatcggtcaaacggccgtcacggatgattctatctcaatcgggccctaagtaaagcccgtcaccaatagttttgacccagacgaccagtcaaactatagcccgtcaaagatgacctatctcaatcgggccacaactagcacccgtcacagatgacccttatctgtgacgggcattaactatagcccgtcacagatgagggcattaattatagcccgtcacagatgagtataatccaaaaataaataaattttattttttggctagccctcactcgtgtgcacccacgcgggaagttcaaacttctcggtcggtcacccatcccgaaatttactcatccaaaaataaataaattttatttttggttagccctcactcgtgtgcacccacgcagaaagttcaaacttcctggtcggtcacctatcccaaaattgctccagaccaagcacacttaacgtcaaagttctttggagattggcttccggaaaagtagttgtaacatgttggtatgagtattctattaatcatattatgcactaggccaggatgtcaaattaggtttattaaatgatttcaaatggaaaagtcaccaaaaccaaagttgtagaactcatcgaggtgcaaaatttttattttggtcatttctccatctgactctatttaaacaattcgaaatttgaaattcaaagtttgaaaagttcaaatagaattttagatcagtgaacgacttcaactgaaaaagtcatcaacaacaaagttgtataactcatcaaaatctataacttttattttggtcatttttctatataatattttttgaaccgtttgaatttgaatttgaaaatatgacaacttcaaacatcatttt

SEQ ID NO: 85435 - DNA, 994 bp, Oryza sativa
gtgcagggtgcagcattcatgcacagatattccctccacttctccaggtgttcaagcctttgctgacagaaggaaaggtttattatttggattcatatcgtgtgaaaacatccaacaaaagctataggccagtggccaatccactaatgatgactttcactaagtggacatctgttgagcaatgccttgatgtgcctttcaatttccctactgttgtatacactctgactcctttgaacgaggtgtcaaactttgtggacaagaatgagtcctttgttggtaagacctcctggggttatttgttttattagctatttagactaatcaacttagattgtgttaatatgttatatccttgtgtagatgtcatcgggttcattactgaaatatctacacctacgatgctacgtcctaagtcaagggatgctagcagcttgaaaaggataattcagatatgtgatgcaaagtaatgtttcctatatagctcaattcttagttcatgtttacttaattttgttaactactaatgtctaacgaaaaaagttatcaaacaaggctaacatccactctaataaagtttacctatcttcttaacatatctgccacattatctccttctatcttttacacaaatagcaattctaccttgaatgtatctctgtgggctgaacaagcactggcatttgatgctgagagtatacacaaagctggacaaagtgagcctcaaattgttctgtttgttgggacccttgcaaagaactatcctggcataggtaaaaaatataactacagatgtatctttgcttatgtagagcactgcaactaactattttaacaatacagggttagctctgtcgagaggctctgcatgcaagtggtacattaacataaatgtacctgagatggttgatctaaagaataggttggtactagatactaaatgtactataaccatctatatggtcaaatttatttaaatgttctctgatacatg

SEQ ID NO: 85436 - DNA, 688 bp, Oryza sativa
tatctctataatttatattcgaactaaacattgcaccggtggcaagttcgccctgcgtgtatgtacctacaacggagcggccagtataggttcaccagagagcagccgccggccaatctcataggacacgtatgcgtcgatgcaggcgtagttgacctgctcccacgtcagcgtcggcttttttatctgctcttcgtaatgtttttctccttctccatgtgggcgcccatcaccgtgagcgccagtctcttcagccccgccctcgcaagctccggctgaccgagcacggccgccgcagcatatctcagatccaccgcacaggcgaccctcaggttgcaatcattggccagacgttgcatgtcgttgttgactgcaacgccgacgaagcgaacgctcgggtcggcgaggaactccgcgagctcatgtgggaccatgttgccggcttggtagatctggaacaagaggcatcggcggccgacacagagctggagcaccgcgaccttgtaacatgttttgccgttgggcagatggtcagtgcgccactccgtgtcgatgccgacgatgagccccccctggggacgttcgcgggctatctcgttgataaattgggcagcgagggagtgcgacgacgtgatggtggtgtggatcggtatggtgtcgccatccatgaagacgtcgagcggttctc

SEQ ID NO: 85437 - DNA, 4746 bp, Oryza sativa
tgatggccatgaactaactgaagagcagcgtgaaatcttgggtcagattagaaagaagaaggcattgctcatccaggagcatagaatgaagaagagaactgcagaaagtcgtcctattgttcctagaaagtttgacaaagacaggacattcacaactgatagaatgggtcgccaactttcatccatgggttttgatcctagtgcagctatggaccgagcccgcagccggtctagaggtcgcaagcgtgagaggtcactgagcagagctgccagtgatggtgatgatatggatatagatggccagcagtccagcaagaaattgcgcgcgttgtcgaggtccaggtctaggtcgaaatcaagaccacctgaggaggttgttccaggagaaggattcaaggactctgctcagaagaagaaggcaattaagaaagctaaggattctgtgaggaacaggaacaaggaggctcgtcgcggagaggcggaccgtgtcattccaactttgaaaccaaagcatctgttctctggaaaaagttctataggcaagacgagcaggcgataagtgattcagcacagctgctggtcatcactggtttcaggtaggtggatgtggagcactacttataaacacataatttgtgacatgaactcaattatttctgggcttataactcatgttctacttgctcattttgtaggaagtgcagcatcattgcagcatggtgtgggaaattaggcgaaggaaggcctgattatccaatctgctggacttgttgtgctctgtttattcatactgtctgatggattgctgtgtatcccgtctcatcctctgccgagacataattttgttagcttatgttgtagctttacgctacattaatatggtttcgctagtattagttcgttacatggtactatgaaatactactcctgtaatggtgactttgttattatacttgaattccagtcctattcgttataattaattctttataataagatatcacatgattatgttttgacgaaaggaaaatatgtttcaaatcgttaaaacacgtttcatatgtgataacgatatgttttaatatatgttctcactgtatttcacaaattttttaaatgtttcatcatgtactactagggcccgttcgaatccaattaaaagggtggatggaattttgaattaaagtggcacgtttttcaaactgctaaacggtgtgttttgtgcgaaaactttctatatgaaagttgttctaaaatatcagattaatctattttttaagtttgtaataactacgtgaaacacttaatctttatcttcatcttcaggagattcaaacaccacctagaacatttgatcgcctgatattattttagaaaaatcgagcactgatattattttagaaaatcggacgctcgatttgtagagggttcacagcaatagatgtaatgttctgaaccaaattggataactgtatatagcccgttatcattcgcagaaataactaggactgcagatgagaaaagaaaaacaattactacttacaacgccgaccgaggtgaataggactgatgaatattactccctccattccaaaatactataaggcataatcacccataacccaaaaaccaagaaaataattattatcatcttgtagtttggatcatcctaataaatataatgtatgcatccaataaaattagagaacatgagagtgatgtatttaaaaaagtaataatttaatggagaagaggtcatatttaatagcctatatgcatgtatgccttatattatggaacatctaacaaaatgattgtaatggagggagtaataagaaagaaacatctgatccaagtccaagtgcaagtacagtatttggagcccatgatcgggcgggcatatacaaagaaagcccaaaactaccttagtttagctgctgggccgagtgctattgggccggacgaacacgcagacgcaacggagatatgtatctggagtcgaagcgaggccaacacgtagtggcgacggtgggaagctatggtggcgtggacgctacgacctgcggcggcgggcagggccatccggcgagccgcgtaccactccgacggcgcccctcctccccgcaagctccggggcccccgcttcagctctttcaataggaacaaccatgaggtgtgtgtgtgtgtatccatctcccttgataataacctagttcgttcttaggtttcgatctagagtttcccctcccaaattgaatagaaatatatccttttttttaagcctactgcctctgtgctaatacctgtttcatcatcgcgtttggttgttccccaactaggttaaaaaaagatggatttatttttgcttttcttatttcgaaattatgcccgtaatcccatatgttgagtatttaataaactactaaagatatatatgctcccgcgaaaaacacacacacaaattcttcaactaactagattcaggtttttcagattatgctgcctgtaccagtacgactgttatctgtttattgtgaggggaggagatggtattattccgtaatatgacagatcattctgcagttgtagatgatgcattattatgttcactaatgctcttgtgcttaaccatctcaacactttgctctagaattttgactgttagcactgttaaatttcattatgccgcataagagtgcaatccccctaagatgacaggtcattgtgcacacttgtttgtattgattattgaatgagttcgtatacgtatcattgcgtttcataatttcatagggttttagctgttatgatgttgctcatttgctgtagcatcttgacactacgcactagaattactcttgctgttaccatcgattaattaaagcttgtcttttgttcaagccttcatctctaatgttttagttttataacttcttttttagttttcccttccttttttattttaatttatttgtttggcaaaaccctccatgctctgaaaataatcctgtgttgttcagtattactcttgtctcccctgctagcttgaggggaaagaaagagagtgacatttttctgttcttacaaaactgtacctgttctcccgtatacttggggtttaactactctcaattcccaaacatttggttgaagcaccaatgccaaacctcactaaaagttatattcagtttttttttatcatgctgtactgttaaattatatgccaattgaagtgcactcctcttgatgaaaagtaggcacagccaagaaaaatggtgcttgctttccttcaactatgtcccttagagttcacattccccaggatgatataacatggatgagtttgtacaattaagtttgtttgggtcatgttccctaagtttgggttgcagaactcgtagggaatcgagtaatgcttctttgcttatgtagcatttgaatatcatactttataattttcaattctgaacagtgtgcttttagctgattaaaagcttggctcttgtaccagccttcacatccaatgttttttattcatctaacttcaactccttaccatagagattgtattaagaaccattaacaccagaaagaaaggcttggttgggcacagtgcacttgtgtaaaaggatatagattgccatcattcatattttgttttaattgaacagtgacatagagcgtgtggaattttaaggagaaactgaagttaaatatctgagtctttttgtacaagtctgatagtggatgtggattacaacagtacgcatgttgatatgcagatcgatgcgttgcttgaggaagtcaagaatacaccggttaacatgatcaccgatgacctaatgatccgaaccgtgcggcagtatgtaattctgtgaattgcagcttgtgtttttttggttctctatctggctgaccatcctatttactactgctcttccttgtctgcatgtgtagttcttttctggctcgtcaggagattctgtatcaaaatgttctgcgatcatgggtggttgtggcagcggtactcacagggtatagctgggggtacaacaaatttgctgaaagttctactgtcggatctgaaccaccaaaagaacatgaggggaagtagaagacttgacgattgtttttgctctttacggaagactgagtgtttgggataaaatgcagtgaattgtgcctcagaaactcgcttgtaaattggtcaatttctgttaactgactatcctgtaagacagggcttgggcgaccaatcttgctccgccttttacaatctccagctggtttggggtgtttcatgctctagataggctgctgctggtcgataatcaacggatgctctttctttttatagttaactcacaaggcagcttggtattacaactaaacaagtatatactgacagtgagaagaattaatttaaaaaattcagtaccagtaatgagtaaaataagcaaatttaaggcactacactaaaataaccaaagttataagtgtagcatacaactagctagtaagacagatacagtatgatgatatacaataatccatccatcttcagtggttgctctagcttgcttaatttgtattttaatgtatgacgccgttgactttttgtcaacgtttgaccatttgttttattcaaaaattttgtgcaaatatgaaaatatttatgtcatgcttaaagaacatttgatgatgaatcaagtgcacaataaaataaatgataattacataaatttt

SEQ ID NO: 85438 - DNA, 540 bp, Oryza sativa
ctgtcttgatgttgggtaggtatgcacttcagttctccttgtttgtgccttgttatgtcataatttgtcccttctcctgtttttgtcgaagcgtcgtgcctcattttttaattcatgattcagctgattaatctggtcatatagtttctaaacgcatttcatgaatcatgaataacaaaatgatcccgattccgataattttgctttataagtacattttactgattagtgatctaatactagtatattttttcttgtagtaccgaatggctgggttggctgctattgagattgcccagaaagtttccaaagcatggcgctttctgagaaaaattccaaagaacaatgcaagcaagtagttaggagaagggataagcttaacgcgtgccagaacaggggagggtattgcagcacaagtactttgtctggatcaccaacatccagtccaaatgaagacaggatttctctgaatttctctctctggcatgatgtctattactatgctgtaaatggagacaaattctgaaccttgtgacccag

SEQ ID NO: 85439 - DNA, 518 bp, Oryza sativa
attactcgggccgccataaatgcgggtaggtgggcacctggaggcggacacttaacccaccgtacatggtgacctaaagaggatgtcgggggagcccgacccctagtcatgggagggggcgcccgccgcccgacctcgggcccgatcccccctcggggaaggccatgtggcgcctggggcaaccttctccctttagtctcggccagggagtggccgccgccccaccttgggcctgactcccctcaggggagggccacgtggcatcggggggcagcctcctccatctaatctctaggaaggagtggccgccaccccacctcgggcttgattcccccccccgggggagggccacgtggcctcggagggcagccttcttcgactagtctttgggaaggagtgggcgccaccccacctcgggcctaacttcccttcgggaagggccacgtggcatcggggggcagccttctccgactagtctttgggaaggagtggccagcaccccaccttgggccttgact

SEQ ID NO: 85440 - DNA, 2444 bp, Oryza sativa
  unsure (1)..(2444): unsure at all n locations
catctacgagacacaagccatgccattattctatggcgcaaccggtacatcatcctccctgtgcgacaagcggcgtctcgtgcaccatgtgctccggctccgccatctgctgctcatgattctgcaccggctcctcctcatgctccgccagcaccgtctccacctcaggctccagcatcgactcctcctcaggatcctgcaccgactcctcctcgtgctcctacacctactcccccgcaagctcctcttccggcaccttcaaagtcaagggcccccccagctgcaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcttatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaacaggagatcgagccgttggttaccgggaaagaaatgacgatagaagaatttattactgacaccgatctaactacggatcaattgataggagtcgcaccaatcgaaaaggcggaagtgaaatacatgtacgaactcggtaaaccgcttgtcaagcttgagctgctgcagtccctacccacacaaatgtacaagttccatcagctgtacatggagatgagcgccgccggtagagagatgatcggagcgaggatcagggacacggacttcttgcaaggagatgacattctctggatcaatttcaagggaatctacgaactataccagctggacgccctcgacgtctctattatgagttgctggattttgtaagtatatcgttcggttagatttctactatacngtctcctttataaataggtcccttgtatataagtagactatagaaataatatctcccttttatcgttgtagaatgnagatcaaaggggcccgacgncggagggttttcgatactggattcatcgaccctcggagagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaactttctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatatctttaaactccatgtagggcttggtatcggttccgtcatttggtccgcggcaactaaagagaaagacttaggcggaggttcaaatttcctgtgagtacacatgctctacatttatatttctccgattcaaattaatacatacaactgtatattaattagatctcacgccgttaatttgtcatttatttgtagtgcgcaaagcaaaagcagggaactaacttgtgcggctactacgtgtgtgagtattgccactgccttgcagaccaaatcatctccacaagagagctcgatgtacgtacaaataaattcaaaatttcattacgtaacgatttcttgtttaattactaatcaatttcatacattcatataatttattcgcatgagggataacctgaccacacacaagaaatttatcgcagcggttcaagaacaactcatgggattcatcaacgaagaaatccttgatcccaagggtgaattctactacgacggaaacacaattcaccggtccttagcttctgagctagcagcgactactactacgtcgaaatcgtagctagctaggacatataatggattgtaattaatacatgactacatatgtttctatatgcatgtgtacacattttctataatgtaaatatattttggtcatatatatatctatatacatatgcatttgcataacatatatatgtataaatacatatatattatgcatgtatatacatataatataatataatatatatatatacatatatatatatatgtatgcatatatatgtattcaaacatatatatgcatggtttatatatatatatatatatatatatatatatatatatatataaaccatgcagcaacagggccatgcaaaaaaaaaaaaaaaggtcagctcgatctttagtcccggattggtactcccggtttggaaac

SEQ ID NO: 85441 - DNA, 9075 bp, Oryza sativa
tacactctgtccaggtttctcccttccccgtctctcctctactgctactgctaacctgcgtctccctcgctccccctgcagcgtatggaatggagtatccgacgaccaccaaggtgaggaggttggagcaccaccgcagtgtcagcgactcactcaggccgccgccatctttccagatacaagacctccctgaggtaaaactctaaattggggcgccgggggagacgatctggcacaggcgtggtgtccgtcagggggatcctatctcccctatgatcttcatcctcgccatggattctctgagctccctctttgttaaggtagaagagttggggctcctccagccgctggggatccctcactgggtctccctctatgctgatgacgtggtcgctttcgtcaggccgacggttgccgatttggaggccgccacaacagtgccgcgcatctttggcgaagcttccggtctccacacgaacttcaacaaatgttcggcgcttccgatcaggtgctcggatgatgacctctccttgattcaatcggcgcttccatgtccgctagcttcgtttccttgcacatacctcggcctgcctctttccatcttccgcctcaagaaggaggacctgcagccgtttgtcgacaagatcgctcgctggctcccgcactagcaatatgatcttatgtctccaaccggtcgcatcaccatggtcaattcggtcttaagctcgattccaatctatttgctgattgcccttgatgcacccaagtgggtaattaaaggaattgacaagataaggaggggttttctttgggccggcaaagtcagtacccatggtggcaagtgtcgggtcgcatggggtggtgtttgtgctccaaaatgctacggcgggttgggggtaccggatttggatcgcatgggcatcgccttaagatcgagatgggtctggttgcagcgcacttcgccggataagccatggcacggcctcaacatcccggtttccttgaacgagcgaaactttgcgacggcttcaacagtctgcgttctgggcaatggggagtccattcttttttgggaagacatttggctagagggttcctccattcgctgcattgctccggctgtttgggcggctgtcccggcacgtcttcgccgtcgcaggacggtcgccgaggcccttcaagacaggagatggattagagactgcacaggggcgctgggtttgcaggctattcttgagtaccttcagctctggagcatcctgaggtcctctgtgcggctctctgaccaccccgactcttttatttggaagtgggaagcatcgggagtctactcttcgcgttcggcataccgggcactctttctaggtagggttcctttccaatccgaacccatctggaagaccttcgccccccctccccgagatgccggttctttgcctggttggtcacaaaaaggcgctactagacggcggaccgcctgcgttctagggggttgcctcacccggatagatgtgtcctttgtgatcaacatgaagagactattgatcacatcttggtcgcttgcccagagtctcgccaactttgatgggctgtcctttccagcattggtctaccgcagtgtctccccctgaatgaagactccttttatctctggctttgcaactcccgccttaaagtgggagcggctagcagaaggggatttgacacaattgcaactctaactgcatggacaatctggaaagagagaaacaatagggttttcaactctcagcaaaggccctggtcagagatagcccgagctatggcggcggaagcaactctctggcggttgacacatgcggtgctaccggtgctaatcatttaggtcttggtttaggtcgtttccatatgctggcgtgagaataggcttaagatctttgggtccttctcctatcttcccgtccccctcttattttcttgtttgggttcgtgtaaatactctttatttctcttaatacaaagatgcgcatcttgcgtattcccaaaaaaaactctaaatttccctgacttctctctatccggggtaaaaaaaaaagttcattttttcccctatcatctatcaacacctgccatgccttgcctgcctgtgtgatttttcacatagatgaaacattgggccttattgcacggatgagttctattattatagaatcaaagcacctacaaattgattgagcatgccttcgtttgttttctcttgtaatgacaggatattcagcagcttatagtatcttttatgccactcagagatgcggctagagcgagccttgtgtcaagaaactggagaatgctctggacatgccaccctaatctgtgctttgatggcaccaagcaggagcctactgatgagggtactctcaaaattgaccgatggtacttctctaagacagtaaatcatgttgtccgacgccacaagggaatagggttaaataagttcagcatcaactgtgacctcaacaaggatgaattcaaacatatcgatggcaaaggttatagatgttaacctacaatctcggcacagaaacagatggccaacacggaaacatctgctagaagatgtttaccacttctcacttgatgctttggatgctaagcatgaccctgctcttgagtctttgttcctagctgttgtattaatagaggtacatccaaatatttctggttttaccatgctcaaaaggctcgcgctgcagtatgtaaaaatagtgggggatcttccagacttgctgtcacgatgttctcttcttgaggacttggatatcagtgtgtgcactggcgtgggtgatttggtaataccatgccaacttgacaagcttcaacatctgcggatttggggtacggaggtgcagatgattgaatttcatgtttcctgtcttacgcgttttgggtatagaggggaggcaatctcaatcatgcttcatggttgcccaaaatcagtgaaggcaacaatcgtatttcttgaacttaatcaacttgaccatgtgttcactgtgcttccaagtgctttacctgtcaaggagcttagcttggatttacatatgtacgactatgacctaggacaggtttgtccctttgttccaaggaattcatcttttggtttgcctttttgtatatttgtttgcttgcttggtagactgccttaccatttgtttggttgtctttcaggttcatacattgacaagaccactgtggagattatgggtatcccatatctacacggcgatggtattcgaactgggtacaggatacctaatgtagatagaatatcttatctgtatctcgggtttgtttcttaacttgtgtatcaaggaaacaccctgagacttagtcggttacgactgtattttacctttatcttcatattccgttaggaatatagattatcttttgtaatccggactccttccaagatataaggggggtccgggcgcctctaggggcatatgctgatgttcccgaatcatacaatcaataatacactcggcggattcatccccggacaggagtagggattacttcttttataagaaggcctgaacctgtataaatcctttgtctccaaacccatacactttccaagcttgatagccacccccttttattattgtcgaaatctagtttcgacagttggcgcgccaggtaggggtagcgtcaagcttttcgccgatcagtgcaatgggttccgtcaccggcatcgacgacctcgtcttcccacccgggcagacgtttcggttcggcagcctcgacttcgtcaccaacaacttcggcaagatttctctccttgactcggaatcagaccagtcgggagagaatcgacttccagttccgtttggattcccaaacgcggcagaaagttgcttcaagaccatctcgatcgagtcggcttcaaaccactcggccgagatcgcatctactccaacaacgccagatcaagacgatgagccttacccatcgatcttgatgcagctccctgacgattcggcagccgtctccaccaccacgccgtctccatcccgtaggcctaggcggaagtcggtcttaacaccgatttcgcctagcttcagggaagtcggcgtcatcctccaaccactcggcacggtttcaacggaccaactggatggctactacagctctcccaccgtcgactcacgtcccaccgaaatcgtggaatacgatgagttcggttctcgctactacgacgacgtggatcttgacgacttcgacggaagcctagaagacaactacactcctcttttcttcggcgtctttatggccgacaatgaaacggaggagcagcgccaagcccgggaagccgaagcacgttgcgagaccgagcgccgccgactggagcaggagcgccaagcacaagagcaagagcgactacgccgggagcagcaggagcatgagcggaacgcgaaggaggctgaagaccgacggcagcgaaccttggaagctgggcgccgagcgcgtgatctcatcggccagcaagatgttgaagggataccggttttccgtacccctcagcagaatgcggttgccgcgatcaccctcctcgacaccctcctcaaggaaaacgagcacaaccaatctgatcatgtcgtcaacatcctgaaccagaccaagaccatgattgcggcctcggttccagttaactccgaaagcgtccacacgccgactggtagccgagttccacacttccgatctcaggactaccgtcatccaagcctcagcatcaccggcgcaggatccaatcgcaggagcaggggtcacgacgagcggtccgcgcactcgcctcccgactaccgtggggagcgccgagtagaacggccacgttcaccgcctcgtcgccgccccatcgatcttcgcgacacaatcatgcagcgccgagcagctcgaggccgtcaccactcgccagaccgctacgacgacgaccttgatggggtagcagccttcaccgacgacctgcgtcgagtggattggccagccggcttcaaaccgactggaatagagaagtacgacggtaccactaacccagaatcgtggcttaccgtctacggtctcgcaatccgcgcagcaggaggtgacaacaaggccatggcgaactatttaccagtggctttagcggattccgcccgatcttggctccatggattgccccgtggtacaattggatcttgggccgaactacgcgaccacttcatcgccaacttccaaggcaccttcgagcgtcccggcacgcaatatgatctttacaacgtcattcagaagtccggagaatcccttcgagattacatccggcgattttctgaacaacgtaacaagatctccgacatcaccgacgacgtcatcatcgccgcattcaccaaagggattcgccacgaagaattggtcggcaaatttgggcgcaaacctcccagaacagtcaagctcatgtttgaaaaagccaacgagtacgccaaagccgaagacgccgtcaccgcatcgaagcagtcgggtcccagttggaagccgaaaaatacgccggctacgggaggaggtggaagtaacaatcataaggaccgcaagcgtaagcctgaggaacttgttgcaaccgccgctcactcttctcgacagcgttcgcgcgtcaacaccttcgacaagattatgaactcccaatgcccgcatcatccaaactccaaccacgtggccaaagagtgcttcatctacaagcagttcgcggagcagtacaccaagtctactcggaagaactccgacgaggaacaaagcacgtcaaggaagaaggacgacggcgacaccccggctggatttcaagaccaccgcaaagagctcaaccatattttcggcggccccatggcttatgagtctaaacggaagcagaagttgactgaacgggagatcaacgctgttcagcccgacacgccccaatatcttcgatggtcagagattgcaatcaagtttgaccgctcggatcatcctgaccgagtggtccacccggggcggtaccccctggtactagacccagtagtccgcaacgtcaagcttcgcagaaccctcattgatggcggcagtgcgctcaatatcctcttcgccaagactttggatgatatgcagatccctcgctccgagttaaaatcaagcaatgcgccttttcatggagtaattccaggattatccgcaactccactcggccagatcactcttccggtcacttttggcactcgggaaaacttccgcacagagaatatcagctttgaagttgccgatttcgagacagcataccatgccatactcggacgcccggcgttagccaagttcatggccgtcccgcactacacgtacatgatgatgaagatgcctggtccccgaggagtcctaaccctacggagcgacatcaagcaagctgtcacatgcgacaaggagagttgcgacatggcccaaacccgcgagatagtgtctgcccgagaggaaatccgactggctgcaaccacggtgagcgaaggagaagtgcccgctgccaagatttcaaaaagtggggaagccgaagccgagactaaaaagattcccttagatccttctgatcctactaaaactgctgtaataggcgccgagttagattgtaaataggaaagcgcgctcatcacctttcttcaaaataataaagatatctttgcgtggaaaccttcggatatgcccggtattcccagagaggtgattgagcactccttacatgtcaaagaagatgccaagcctatcaaacaacgactccgccgattcgcacaagacaggaaggacgcgatcaaggaggaattaaccaagctgttagcagcaggcttcatcaaagaagtccttcatcctgactggctggcaaacccggttctagttcggaagaaaacagggcaatggcgcatgtgtgtcgattataccgacctcaacaagttttgtcccaaagatccttttgggttgcctcgcattgaccaggtagtcgactcgaccgccggctgtgagcttctcagttttttggattgctactcggggtatcatcagatccgactgaaggaatccgactgcttgaagacttcattcatcacgccctttggggcatactgctacgtcaccatgccgttcggattaaaaaacgcaggagcaacttatcaacgcatgatccagagatgcttttcaacacagatcggccgcaacgttgaagcctatgtggatgatgtagtcgtcaagaccaagcaaaaggatgatttaattttggatctagaagaaaccttcgcgagcatccgcgctttcaggatgaaattaaaccctgaaaagtgcaccttcggagtaccgtcagggaagctgcttggttttatggtgtctcgtaggggcatccaggccaacccggagaaagttactgctatcctcaacatgaaaccgccaagtacccagaaagatgttcagaagctgactggatgcatggcggcgctcagccgatttgtttcaagacttggcgagcgggggatgcccttctttaagctgctgaagaaaacagataacttccagtggggacccgaagcacagaaggccttcgaagatttcaaacaactcctcaccaagccaccggtcttagcttcaccacacccgcaggagccgttgttgctgtatgtatcaccaccccccaggttgtgagcacagtcttggtcgtcgagcgtgaggaagaaggccatgtccagaaagttcagcgaccaatctacttcgtcagcgaggtcctgaccgattccaaaacgaggtaccctcaggttcagaagctgttatatggtattttaattactaccaggaagctgtctcattactttcaaggtcactcggtaacggtggtcacatcatttccactcggcgatgttctgcacaatcgcgaagcaaatgggcggattgctaagtgggctttggagttgatgtctttggacatatcattcaagccccgcacttcaatcaagtctcaagcgttagctgattttgttgccgagtggaccgagtgccaagaggatacccccgtggagaaaatagagcactggaccatgcattttgacgggtcaaaaagactttcgggcactggagctggagtggttttaatttccccgactggagaaagactaagttatgtgctttggatacatttttcggcgtctcacaacgtcgccgagtatgaggcgctccttcatgggctacggattgcaatttccctagggataaagcgtctaatagttcgaggcgattcgcagctggttgtcaaccaagttatgaaagagtggtcctgccttgatgacaatatgatggcatatcgacaagaggtacgcaagttggaagacaagttcgatggactcgagctcagtcacgttcttcgacacaacaatgaagccgccgacagacttgccaactttggatccaagcgtgaggcggcgccctctgatgttttcgtcgaacacctttatacgccgacggtacctcacaaagataccactcaagttgcgggcactcatgatgtcgctacggttgaagccgactggcgagagcccttcatacgatttttaacttctcaagagctccctcaagataaagatgaagccgagcggatttcaaggcggagcaaactttatgttatgcatgaagctgaattatacaagaaaagcccttcaggaattctgcaacgctgcgtatctttagaggaagggagacaattgctgaaagacatacattctgggatatgcggaaaccatgctgctgcgcgcaccattgtcggcaaagcttaccggcagggttttttctggcctactgcagtgtctgacgccgacagaattgtgcgcacatgtgaaggttgccaatttttcgccagacaaattcacttaccagctcaagagttgcaaactatcccgctgtcttggccgtttgcggtttgggggctcgacatggttggcccgtttaaaaaggcagtcggcggttacacgcacctcttcgtggccattgacaaattttccaagtggatcgaagcta

SEQ ID NO: 85442 - DNA, 885 bp, Oryza sativa
agcgtgaggtggtctttgttctttacctgaagacccagctatcgagtcgttaccagcttctggtccttgcgaagtcgtcgtctgcgcttctacctcggggatctcttgatcagggcctgcgtccgactggtttccagtcgggggctcttgagttgttgccgtttcagttgttgccgactggtttccagtcggcggcaggtcactcggattggccctatcgcccgaagcatgggcgccagtcggctggctttcagcggtcggctggttttcagcagtcggctcggggtccttggatatattttgctctgtcatggcaggatcggggtcttttccagatggatctatatcagatggtttcctgcagagtgttctttcagtatttggcattatcttcatcggaaaacatgccgaagcggaaatcataccgagagatctaatacctggaagatgttctgatctttggcattgcacggccagccaattttttcctgggcatggtgcgctttgggggtttattaggcaagcccttatccccagatttatcatcgtcgccttcatcatcatcgagtaccagctttctcttgcgaggacctgtttgaccagtcaatttggaggtctgaggttgcggatctggtctgatcgttggccctccacctccctgcgcggtgtgttggcgaggagaccggcgctgagtgactggtggatctgacttcatcaatgcatatccctgaacaagatgcttccatagttagtcaactcagcatgaagataaaattatgttctgatcacggtttgagggtttccgatgtatacctgtggaggcggattgaatgcattatatggcacaactggcaattgatgagagtagctgactacaattgcatt

SEQ ID NO: 85443 - DNA, 794 bp, Oryza sativa
aaacactcgaaagcaaggagtgcgttatccgttatcagtcttcctggcacgaaggcactttgattaaccgagatcaactcatccaaaatcgaccgaagtctgtttaccaagcatttagagacgattttatatagaacgttgcataagctgatagggcgaaagtctttcagctccacaggctgatcaatttttgggatcaacacaatagcagtttcatttgccccttctggcatgattcctgaatgaaaaaattccttcactgccgccaccacatcagacttgatagtagcccagttcctttggtagaatctcactgggaatccgtcaggcccaggggccttcaatgggccaatctggaagagggcatcggctatctcttcatctgtaaattccttgcataagttctcattcatcgctgcagtaaccttcttctgaaacaactgggacacacttgcctgatcgagatttgggtctgctttgtaaatctccttgaagtaatcagtagccaacttttccatagttgttgccgtattatgaatagtaccatcactagccctgagcctagagatcctattcttttttgccctccacaccgctttactatgaaagaactttgtgttgcgatccccctctttcaaccaactaatccttgatctttgcagccaaagcatctcctctctatacaacagttcattcatgcggtctaaggcctgacggatctctctactgtcagcatttcattccattaacattgccagatgtttccttgccttttctagctctctaccaatggt

SEQ ID NO: 85444 - DNA, 1086 bp, Oryza sativa
ttgaaggaagtcgaaggtaacgccagctaacaatctgagcttctctccttataacgcaacagatgctcatcataaatgtgttttgcagatcgcaagatcaaatctcaagctcagtttgacgtcctggttggtaagatcaagaggcttgaaggagcaagggataacgtcgccaatgccgctgcaccaattatccaagctatgttcttcaataatggtggtccgagtgcactcgacgcaaccgaaatatttgacaagctgagtgttgctccggaagtatatttcaagaatatcaagaaagctggaagtatgggagctggcatggccttggcgatgacaaaatccttgtacccgagaattgaagtcgacaccattgatggatttgcagacgggacaagtgaagaagctgcccttgatcttatcagcagtgcgcaaaatgcggctgataaaattgcgagtgatgttgtagagcaatttcgcaatgacgacctccaaccgagtaatgaagactctgatgatgaaaggactgattctgactgagtttgaatgtaatacatggaggctcaatttgtacaatactggtgtatttatgctgtgcttgatgattcttgcgaagtttttgatttcttaaaagtttttgctaagctttgttgagcctaaaacccaaaggagctattaaaaactttcagtcctcgcaaactaagtagaaaaaccaaacaaggcaatgataaaccaagtaagcaaactgaattgataaaaaatcacactccattattatgatgatagcccccgactgacaacttcaaggagaaaacttgatgtttgacagtcaaaatagggaaatacaatgagaaagttaagcgtagaaacgacgaagatgttcaatgttccaagagttgtcgacgagagtgccgtcttcgcgcttgagtcgatatgaacctggccgggtaacttcagagataataaatggcccttcccatagaggagataacttgtgccgatctcgtgtggtttgaattttccgtaaaaccaggtcgccgactagaaaggcacgagatcgaacattgcgattatgataacgtcgcaacc

SEQ ID NO: 85445 - DNA, 2360 bp, Oryza sativa
gggatcgaaatacgaaattttttcatagccaggcagtatggagagcaaagaagaataaaatctccaaactacgggatgcaaatggaactgttcacagttcgacaatgaagttggagagcatggcaactgaatattttcaggatgtgtacactgctgatccaaatcttaatcctgaaaccgttactcgtcttatccaggaaaaggttacggatatcatgaatgagaagctttgtgaggattttacggaggatgaaatttctcaggcaattttccaaattgggcccctgaaatcacctggtccagatggctttccagccaggttctatcagcgcaactggggcacaattaaagctgatataatcggtgcagttcgccgtttcttccaaactggactgatgcctgaaggggtcaatgatacggccattgttcttatccctaagaaggaacaaccagtagatttgcgagactttcggccgataagcttatgtaatgttgtctacaaagtggtatccaaatgcctggttaacagattgagaccgatcctagatgatcttgtttctgtggaacaaagtgcctttgtgcagggaagaatgataactgacaacgctctcttagcctttgaatgtttccatgctatgcaaaagaacaagaaggcaaaccacgcagctgtgcatataaactggatctatcaaaagcctacgacagggtggattggcgtttcttggagatggcaatgaataagttgggttttgctcgccgatgggttaactggattatgaagtgtgttacctcggtgagatacatggtaaaattcaatggaaccctacttcaatcattcgctccaactagaggtttaaggcaaggagatcctctctcgcccttcctatttttgttcgtggcagatggactgtcattgctgctgaaggaaaaggtggcccagaattctttgaccccttttaaagtctgcagagctgcccctggaatttcccacttactctttgctgatgataccctcttattctttaaagcacaccaaagagaggcggaagtggtaaaagaagtgctctcatcctatgccatgggcactggacaattaattaacccagccaaatgttctatcctcatgggaggagcctcgaccccggctgtcagtgaggctatatcagaaattttacaagtggaaagagacaggtttgaagatagatatctgggatttcctaccccggagggacggatgcacaaaggacgttttcagagtctgcaagctaagatttggaaaagagtgatccaatggggtgagaaccatctctccacgggtggaaaagaagtgttgatcaaggctgtgattcaagccatcccagtatatgtgatggggatttttaaattacctgaatctgttattgatgatctaacgaaactaacaaataacttttggtgggattccatgaacggccagagaaaaatgcattggaaagcctgggattcgttaacgaaaccaaaaagcttgggtggccttggtttcagagactatcggcttttcaaccaggcacttctggcccggcaagcatggaggttgataacatacccagatagcctgtgtgctagagttcttaaagcaaaatatttcccccatggttccctgattgacacttcctttgggagtaactcgtccccagcatggagaagcattgagtatggcctagatttgttaaaaaagggcattatttggagagtgggtaatggaaattcaattcggatctggcgggatccatggctgccaagagatcactcaagaagaccaatcactgggaaagcaaactgcagactaaagtgggtgtctgacctaattacagaagatggatcctgggatgtgccgaaaatccatcagtatttccataatttggatgcagaggttatactgaacatctgcatttcttcaagatcggaggaagacttcattgcctggcaccctaataagaacggtatgttctcagttcgaagcgcttacagattggcagctcagttagtgaatatagaagaaagttctagctctgggacaaataatattaacaaagcatgggagatgatttggaaatgcaaggttcctcaaaaggtcaaaatctttgcttggagggtggcctccaactgcctggcgaccatggtaaataaaaagaagagaaaattggaacaatctgatatgtgccaaatctgcgacagggaaaatgaagacgatgctcatgctctctgcaggtgcattcaagctagccagctttggtcatgtatgcataaatcgggaagtgtttcagtagatataaaggcctctgttttaggaaggttttggctgtttgattgccttgaaa

SEQ ID NO: 85446 - DNA, 614 bp, Oryza sativa
tgcccgtgcatcacgttcggccggagcgcggaatcgtgtcgaggggggagaggacgtgctgcgcggcgggcgtgatgtgcgtgctgctcggcttcttcgcccactgccactgcctctactcctgctgctaccgcggcaagatgcgcgacagcttccacctccccgaggacccatgctgcgactgctgcgtccacgccctctgcctgcagtgcgcgctgtgccaggagtacaggcacctcaagagcctcggctacaaaccctcgcttggctggctcggaaacaaccagcacgtcccgcccaagcacaacccgccgatgcgacgctaatagtacgggtggtctacttaagatgagtgcctcgtcgagtctgttcttcagcccatttcttatatatctgttgtatttgcttcaaattagctgccggccggccacatatgtttaataaacttggttttgaatgactgttttgaagtaagtgaacttaaaatatgccggccccatcgacttcctgagctcctgcctcctgatgagctcccgtcctcgccgtcgccttcctgagccctcgccgcggtcgccaaattgggcttctagtctccgctctattcgtatatacac

SEQ ID NO: 85447 - DNA, 5019 bp, Oryza sativa
accccctcggggggactaagaggagggcgaacgcatcaccctcgggcccgacgtccctcgggggtaccaggccacgtgtgcgattgtgtctgcctcaaacctctagtcatgatactcctgatcccatgtcaccgacactagtatttgctaaactgattgaaaggttctttagcggttgacaaggtattctgaggccttcttgcaggtatatgaacctcaactctgttgttctgtaacaaaatcaaatcattcaattgcgactgtagtttatgatagagtatctgcagagttttccactgatactgaacaatggcactgcataaattgtttccttattgttctttcgaaagttcgcaagttatttcctcgttaatttcagtattttgatatttgaatggctgagttatcagattagtatctgatccgatgtgttcaatttgcattgttgtatttaagcccaaatagaccccctcgctgctggagcaaacgactgccggcaggaagatgtggcaatatctggcttgctagatggaactggggagtacactttggtttacgaggattatgaaggtgacagggtgcttgttggagatgtgccgttgggggtgtgttttccgttctaccttttattttcagagtagtagacaaagttactacatttataggatactgattacgcaaatagcaatgcttaaaaatgatatgcagtctattgccttaaattttttttcagttttattgattatcaaactgggaaaaaagaattctaccatcaaactggaccatgcctcctatctgatagtctgatactccaattcatgtaggatgtttgtttctttagttaagagactgagagtactgaagacatctgacctatcttcatctgtcagtacctttttccaccttccttctgttacatcaaactcacggtaatctccgcattattctgaaatttgatcatgccatgtaatccatgcagcttataacttctggacggaaaagaacagcagctgagtgttgaccttctttttttgatctgctttgacactttcagtgacgctgttcagaagaatatgatcttctgagcttgtatcatcgtctctttctctcaatgtcttgctgtgctgagcttggaatagagtcctcgatcctgatgagattagggcaaaaggagctccatcgaagagacgaaggccatgccgtgagacattgtacacaaataaccaataaggttacttggctcacaaactttgtatcttttgtattaatggcatagttttttttattggattaatggcagcaatagctattatatgtagtgtgcaaacaggaggatttttaaccttccccaatatttttttttcggatcagctctgaaaatacatataggccacttgagcactgtatcatgtctcttatcaagccatgctatgatttacagaagtttgaagtgacttttagaagcactgtatgaaaagggggaaatgttgcactgcgcgggtgagcaagcagtgacggtgcgtgggcaagcacacggcacactacactggacgggctagcgtcgcaggcgcacggggcaggcagaggcagctcaagatggtgatatcaggccaaggagcagtggcgaatttaggaggaaatttgctacaaacacctcttcccatatacatatagaaaaaaaaggtaaaatttgctatggaacactcaaaaatttttttgtggtttttgctagtaaaaatctcgaaaacataaatttgtccaataaccttttaaaaatatggtaatttaccgtatgacactaaggtcattaaaatattattttcattagagctagagagagaaacaaactaaaattactttgctgccatgtcttctttctccatccattcctccattggtattgctgaaatcggagaatataaagcgctgcggactggggcgatggaggcgtgggccacgtcactctttttttttcgcccgccggattaggtatggatgtctgagattgaggcgcggagtgaaaatttttcaaaagagtcatccagttttcgtataattcgatatagatccctcatgaacagttccttgctccctgttattttacatgtaggccctttataaagccaaatatttcatgcaatggcaagataaaacgtgaattaggaccgcgctctaaaatgtggaagacgaggggctttttagcaaaatgacacccactaacccattcacactccaaaccctagccgccgctcacatctcctcctatctctcgtatcacgctctccctctcgtgccgccaccgcctccaccgttgccgagcgcctttccctcgcggcatgccgtcgccgtcgccgagcgcaccacctccgcctccgcctcgcgtcgctgctgtcgaccgccgacgtctggatccggcctccatgtgctcgggggacgtggatctgactgcccacgtcccctcctccctctcgcctcacagtctcactcttcctctggccaccccagtccagatcccacttcgccgccgcactccctgctcctgccgccgccgctcctggtgctgcagatcgagggacgactcaagacggcgagcttcatggtggcacacatgggcggcggcttgcgcagaccacatccatgacggcaagggctactggtggcggcaaacgagctctagatctggcagtggcggagtattccttgtggcggcggcgactacatattcccgacggtgacggcgtctttcggcgacaacgggtagccagagagaggcgcggcagcggttggccggccggtgtgaccggcgacggaggtggctgatgaggcgcggccagggacggtggaggtcggcggcgacggaggcggccgcggtgcgaggaggcttggccgccggaggcggaggccggcgttgtgctagtagaggctagcgcaggcgaggttggcgaggcgtgtgccggtgcggcacgacgaggctggccggcgtggcgcgaggaggtgcggccgacagaggaggaggccggtctactgggcgaaagcccagcctcggttctctttgagacctcgacagacggctgcggcggtgctttcgtcgtttctcttcttgtagacgacgtctagtcatcccccttaacgaaacctccgaagcattcggtgcaagctcgctctagattcttaatctcttgtgtcggcgtcctagcttctgcaaggtggccacgtcggagggcctagggggtgagcggttccattattctctctcaccctctctccctcaattccaaagatgtggatagagcgggtttttgtgtaggctgtaagggtcgggttttgggcgacctcggttatagttctattgttggcctagcgatgctacccttctcttaggtctatgtgttggtgctatcggtatgtgggtggtagtatattttttttgttttcctggttaggatctctcagggctataatcttgtaattttttttctgctatatcaatatgaacttcaagtcattaaaaaaaagaagagaaaggagaggaacttaaagtggacttattccttgcccggttgagaagtagtagtagttatttagcccatttaaacagaaagcacgtaaatggactggagtagggagtgaagggacaattttttttggcaacaattaattatttactattcgctgtatttgatatgtgggccggtccagtggcaaataattttagcacgactgttaagagtggaaaatagtaaattattgcgggagggaaacctgtcaggtctactgatgataacttgactcaggagaggctggacatcggcaagcaggagctggggaacatcgacaacgagctagaaggtgtacaggatggaggcgtactgaaggaaggcgctggctcacaaggaaagcgtgttcgtattgctaatagaaagtatgtgggctctgaatgggccgtgtaatgcgtgagttgtaatgggcttgcccagctgagaggggttggtgaggagagagagaaaacggtatatgagacactgttgcgtgttcgaacggcatcgaactggaacttggaggcgatggcggcggaagctccgatcctgttggatcgagagagttactaaagttccagataatttcgtgtgtgttcttgattggtgcttgctgtgagttagggttctaacaatctggtatcagagctcgtttccgatccactaatctcttgattcggccgtagaattactgattggggattggattccgcccttgggtggaaaccgcgaaaaggcaacttgcctcaaccgggttggctgaatttggagcggattgggagctgtgatcctggagaaaccacgctatatcaccaagcaggcagcgcagattatggcgcaggaagggaaattggatctgctgctcaagacaatggaggagaatgagaagaagagggcggaagcggaggagcggagtcggctggatctgaaggacctcaaggcggcggtagaagcaagacttccacaagtggagaagcaggtggtggatctccatgcatctctgggtaacctcagtgcgaaggtggagcagatggagagttctctgttgaagcagagccgcggagacaaggggattggagaagtgaaggaggatccgtttactacatcaccctcaccgtctccttcattgattcatggtaagagagacctaacactcaacaccagttcgccttttgcgtttgagaattcgactgctcagtttgataacatgatgggaccgggaatggtggctggaagtattcctagtatgacttgtccgcagtttagtggggagaatccacagatgtggcgtgctaactgtgaagtttattttgatgtgtatggaattcctcctgggcagtgggtgaaggttgcgacactgaattttgtgggaaatgcagcatactggttgcaatttgttagaaatcaattgattggggtgactgggttcgatctatgtgatagggtgtgtgctctatttaccaaagataggcaggagaccctg

SEQ ID NO: 85448 - DNA, 2332 bp, Oryza sativa
atcctaaattaagttgtttcgggctcgtcagctggaacgcaaaaatttcacacgacaatgttttatttcgatgacatttgaaatcgagaaattttcatgcgttccaaaatggatgcaggatcttggaagcaaagagttccaaaatataggtggaacatgagaagataactggaagctttagcttggtgtcttaaatgtgtgctatcttatggttgtaagataccctttttaatgtttctcgagtctaagcgctttgtggtgaacgatttttgtgttgatgtgagtctaaatattctgtatcgttttgacggtgtacgtctggttggatgcagatgctggcttttagaaatcaatcatatataaaaaaaaggcatcgtgaaatcaattatatattaaaaaaaaaggcattgtgaggatattgctagtgtgttcggatcactgtgttttatcactcactgtctctttaaaagttgacacaaaggcggaaccacttcccaacatttcggcgttagaggcagcgagcgaaatcggttactgaacacatacacacatacacgccgtcttctcgccgtcgctgtccatggcgataaaggcgatcgactgatccatcggctgaatgaatcaagagctttctgttgcgatttgatggagatgtgggtacttgaattccaaagacaattcaggaaagaactctaattcgtttcgttagtggtaataacagcaatggagatatcagaacatgaaacagctttagtagacaaggcacggtacgagtactagcaggttgccactgtaactgtccggctgctggtagttgagtcacttgagtgcaaggggaaccggagtaacttgcctgtccttggatccagcaggcttgacgaccgagctgcagaaatgcacaaagtgctagtggtgatccttgccttgttcatgatcactggtagctggtgtgactagtgcattacttaattcaatcagttgggagtaggatttatcaacccgttttgatggggttaccgccacaccatgatttggtggttaccgtgaaaactacacggttatcgcgaggtatatcgtggtttaaaaactgagaaggttaccgcacgtggtaaccgtgcagttttataaaccatggttgggagagatgaagttttttgtctccaatccaacattgatcccaggaagcgcttctatagggttctattccctttgttccatattaaagtcatttttagttctatcctaagttaaacttcagtaagttttttaccgagtatatggaaaaattcaccaatgtttaaacatcaaactaattttgttaaattcaccataatatatgtcttgatggtacatttatatattattgtagatattggtgtatttgctttttataaaattggttaaagttagagaaatttgacttaggataaaattaaaatgacttgcaatatgaaacaaagggtagtacttgtttgtttaggagtaggggtgttagttatgctaacaagtactagtagtactagactactagtatgccgtgttatctgattcaggaccagaaaggtagtgagaatcattatggttcttgtgcccacgcaagactggccagatctgggttaagtgatgactactcagctagcctgtttcccttcctgaaaactcagttcataattcaggttattttgcaggtaataaagattcagaagaaaaaatacagttggatgtctatttcttttctggtcttctaagtaatgtttcacatgatagtatggagcttgtagttcttacttttgatcacaaatatccaatgccagcgaggcaattcagtaatccacaaattcatggtgtcaaagataaaaaaaataaagcaaaagagaagtcatacatgtgcttcagagaagcacctaaacagatacacttttcacagttcatggcattcccaaatgggaaaaaaatgggaaaattgctgaacatattaagagtatatatcagacataattcgagtaatcctgagaaaaaatggatttctagattctacaagtatactgctgttatctactttagtatgtttttcatttttgtgatgtgcagaacgaaggaaggactgaacctgaaagaatcttctacggttaagccactgactgcgcatctgaagaaccaacaccctgattatctttctcacttggtctccgcttcatcgatttcctgacttcttcttcctttttatcaacaaactgcatgagttctttgaagctaccaagacgctttggcctcctccgctgcatttcagcaacggcttcagctgcaatctcggcggtgccagcactatcgt

SEQ ID NO: 85449 - DNA, 2360 bp, Oryza sativa
aagctgttggactgtgagaatcgacgtcagactagcagtataacttgaattgatgatcagcacgacaaacagccatatgatcagcacaaaccgcccaagcgcacttacagtgttctgtcctgaagagagttggatgatatataagtccattgaaatgggaaaacatggaatagtttaacacgatgtcataaaatgcatcaaatggacttactgtgtgcaaaaaacattgttgagaaactaaacctgaaaaggaagaaaaaaaataatctgttactttcttactattaatatttacacaaattaacaagataaaaatattaaactatttgttgctcacgaataaaaaaaaagtaataaaggtgtttttttttttgcctccattgaataaggtttcacaaatgctcccagtctgagttctggttccagaaagatatgctgacctatgatataaccaaattcttttctttttaacaaaaaatagacatatccttaagaggagcaacggaaacgtaccaaaatattgttatcatctgccgtcttggagagcctcgaaactcctcattggtccgatgttcaagaatccaaacaactattccgacaaaaataaaaagaacacctgttacacaccacatttctaatgtgaagggtttaaggaaagcccaggcacttgaacttgcttctttcaccggcactactatcacaagccctgactcaatataaggctgtgagaattctgcaatctttgtcctgtttctcacaatagcaaagtcgcctacagcagcatcaagggactacaagaaaataaatacaaatcagaggaataaaatcaaacttttagaagaagaaagagcaaagaccaaggacatacattggcagcaaccatgttaataatgtcatcatagttaggattctttaaaccatccccaattactatgaattggcaaggaactggatacgggagaagtttaattgctgcgttgaatatctcaatgcagtacccagtcacattatcagggccagtatcacgtgacattaactccttaaagcttggtttatttggaacaccaactctcagaggctgcccattgtttggaaaaacccagcccttaggcttagaagcagagtgacccggccataccacatttttaagccgctgcgcactcgtagatgtatttggttgcttctcatatagaatttcaggagcagcaacagaaagtccagaataattagaccaatagccaatcaaatggggcacagaaccaccgatattaaggatatcatatgctgggcgtaccaaattgcggtctgaatcaaactggagctggcctgttaggcctgtaaagtttgtgaggagaagttgctgtagcaactgctcaccactatcaaataacttgagggctgagagacgcagtgtgctgttcattgaatcatgcaaccttggatctgcagagaaatttatctcctccccattatcgagaagttgatcgatagcacgggcaacaatccaaaccgagtcataagcataaaaaccatatgagttcaagccagaagcaatgctcctattacgagctacattgttccatttagatatgaactccctcttggtttcagaatcagggaagtgctgacgaagaacaattaatccttgcatatagctcatggttttaagatctccagacatggaggagtccatgacagcagctagccaatcggttactatccagacatagccactgtccatcatccggagcttgttagctatagaaaatattctcatccctgcgtcaggattgacgtgcacaacaaacactcttgattccatcatgtttgctctaaacagtacatcattgattgtagctgcatttgaatttggaggaaccgctgctttgtatgaaattcttgcccgacttaatgcaagcgcatcactaagggctgccaccgcacctctcccataatcatcatcaacaaaaatagcagtgacctctttccattgatagtagtcaacgatgctagcaacggcatgcatttggaagtagtcactcatggtactccttaaaaagtacggatactctgatgcagaaagtgttggatcagttgctgcgaacgataaaagaggaacatgtagctcattaacaacatgtgaaataacatggcctattccagaggattgtggaccaatgacagcaaccacgtttttctccattaactgcaatgctgtaacaaaataatgctttatgaatcagttcatggacaattcaagtgattaccggctataataattgacaaattgaagctgaatttgtatgtaaagaaagaaccggcaacagtttcattctgctcagatagtataagatactact

SEQ ID NO: 85450 - DNA, 963 bp, Oryza sativa
  unsure (1)..(963): unsure at all n locations
tgtgtttatcgccccgcgaagaaaaaaccccccgcagagggagggtattttgttaatcccgaatatttttaaaaaaactttttaccaaagggagaagggcatacccttttaaaaaaataacccccaagaggtggtgtgtgccgtgtgaaaaaatccttattaaagagtgggtccccgcgcagagggaaaacctttttaaagggagtggccccccggtgaaccccccccctataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattcagggtgggcaaatgttgggaaaggggatcgggggggggccttttgttattccccaaactgcgaaaaggggatttcctcaaagccaataatttgggtaaccacaaggttttccccgtccccgcgttgttaaaccgcgggcagtgaatttgaatacgactcactttagggcgaattnnnnnnnnnnnnnnnnnnnnnnnnnnnnnnnnnnnnnnnnnnnnnnngaaaactgcaaaccagtgtaggggcaaaaatggctgcctgctgacaagttctagttcacagtcaataaagccattcaccttggaagtgactccctattctgatcagcagtcatacacaaattcatgcagtgtatgatcttggtctccatgcatgaactctgctaccccacattctgaagattaactgatgcttagatatgtgcatggcaaagtaatacactagttcgtgagtatttccttcaggacacttatgttctttctttgtttggagtactgaggcacctcaccaatgga

SEQ ID NO: 85451 - DNA, 1298 bp, Oryza sativa
  unsure (1)..(1298): unsure at all n locations
cgcgtaaactgaatgcacttcnattcgaccnnnnnnnnnnnnnnnnnnnnnnnnnnnnnnnnnnnnnnnnnnnnnnattgatgccgtggcacaggcagatgggcgccgtgctcaccagcgacttgaacccctcgcagcaggtgcccggcggcgtctgcgcagaatcaggctttgtttagttccttcaaacttccaacttttccgtcacatcaaatgtttggacacatgcatgtaacattaaatgtggacaaaaaaaaaccaattgcacagtttgcatgcaaattgcgagacaaatcttttgaacctaattacaccataatttaataatgtagtgctacagtaaacatttagtaataacatattaattaagcttaatatatttgtctcgcaatttacaggcggaatctgtaattagttttgtttatagtttacgtttaatactttaaatatgtgtcgtatacatttttttttttttccaaaacaactgatcacagcctcactacaaaagtttatatttaaatatctaaaattatttaattgacagctggattagccgagctccgtacgggtgcctacctaaccggtggaatacccgcctgtcgagaaggcagcgcgtggacggcgacaagcaccgagcccgcgacaggaggaccacgttgcaatacgattatatgggcataaataccttctttgattntcagtattggatggcgtcgaaatttaaatatacgttntactttttattattttaaatttgtnnaaataaatccangaatatatangtttgcctagaatattctcaatggtaaaccgtccccattcatacaggattaattaatantaatattattttaataagaccaattattataatatttttaagnaagatgatggtttgntccgctggaattgtaatggggtccgatatttagagaggaggaggaaaaggggagccaatttaactttgaataataaaacctaggtaaattttttaacttnnacttggggngggatctccaatctaggttaaaaaaacaaattccgcgaattttgcttggtggaaaggaaaacggcaaatatttccacaaccttaaaaaattttttaatataaaataatggaggataatacgcgggatttcccccaacccttaaactctgctgacaagaggggtattttttttttggggaaaattttcgcgccaccaccaaaatgtctccggtgctccaaaaaaaccgtccacttgtgacacaatctctgtggggggaaatacacgggcgcctcgtattttcccgttttt

SEQ ID NO: 85452 - DNA, 888 bp, Oryza sativa
ccggctaactacggggagtctactcgagctactaccgaaagctagggggaggagatggagcgaggaggaagaacggagggaggcatcaccgagatgaggaggggcgctgtgacgagaggccgacggcgcgggagtaatctctccggcttcgggccggggaagaggaaggagagggtgcggccgaagtccccttccgcgtccttgctcgtgccgactccttcgacacgcgcaacaacgaacggcgacggtgaacagagcacgggggcggcagctatggtgaggaggcgaaaacgagggagattggaggggaaggagctggggtttaaagggggcggcaatgtcggtttgggaaccgacttagggtggtcaaggcgcgagctggcgctcggcggtcgcggccaaagcggcgacagggaggatgacgccggcgggggaaaaaggggaaaaaggagggggagaaaggggcttgcccttttgccgattcgggaaaaaggaggaggggagcgggggcgacgcggcagagggaggaggggcgctgcctccgtcccttggcggcttgcgcgcggagtggcgggggccgggcggtgacgacggcaatgacggcggggcggtttggagcggcgcgacgacacgagcgacaggcgcggcaggcgctgacgacggcggcgaccaggcggtcggccactcggcacgcacgcgcggctcgcaacgggagggcgcggcggatggagcggcgcggctcggcacacgcgctggctgcggggccgagcggctgcaggcgcggcagggcagcggggccgggcggcgaccacgcggtgcgggcgaggaccacgcgggcgcgcgcgcgaacaacagcgcgcgggggccggctttgcgagcggggagctc

SEQ ID NO: 85453 - DNA, 696 bp, Oryza sativa
tacaacatccagaaggagtctaccctccaccttgtgctcaggctcaggggaggcatgcagatcttcgtcaagaccttgactggcaagaccatcacccttgaggtcgagtcgtctgacaccattgacaatgtcaaggccaagatccaggacaaggagggcatccccccagaccagcagcgtctcatcttcgccggcaagcagctggaggatggccgcacccttgctgactacaacatccagaaggagtccaccctccaccttgtgctcaggctcaggggaggtatgcagatcttcgtcaagaccctgaccggcaagaccatcaccctcgaggtcgagtcctcggacacgatcgacaacgtgaaggccaagatccaggacaaggagggcatccccccggaccagcagcgtctcatcttcgccggcaagcagctggaggacggccgcacccttgccgactacaacatccagaaggaatccaccctccaccttgtgcttaggctcaggggaggtatgcagatcttcgtcaagaccctgactggcaagaccatcacacttgaggtcgagtcctcggacacgatcgacaatgtgaaggccaagatccaggacaaggagggcatccccccggaccagcagcgtctcatcttcgctggcaagcagctggaggacggccgcacccttgccgactacaacatccag

SEQ ID NO: 85454 - DNA, 672 bp, Oryza sativa
cagaaagcctttctgagacaggcactttcgatgatgatatagaatccatgatcatggatatagtgtactccaaaagagccatctcccaacctctggatcttaatggctgaagaaaagacatagttttcagtctttgcataaggatccgatagttgcagaattttcagagacatataagtcaccttagtgtaaccttgaatgacatgatccgtcactttgcttgggtcataccatgcattgcggacagccaatataccaaacttatccatgatcaatcttacctatgtcaccaaagtccaatcaagaaaagaattcaacctgactattttcaattcataaagaaatgtttgtgaactggaaaagtctgctattcagttagtcagtgagagttgataattcaagtttagctaatttttacttacttttgttgacacatttactaaagtatccattgaagaggctatcagctaaaacactagaattaaaaaaaacttaccagcatcacgccaactgatgatcgaagaacagcaacaacagatttataatacaaagatcgaacaacaccacctattgccctaatcatattcataagaaaccctgcaatccacaagcatagctcgaggaattttccccaaatcctattgagtggatttgtaggcaagggctgcagga

SEQ ID NO: 85455 - DNA, 667 bp, Oryza sativa
gtggattccttctggatgttgtagtcggcaagggtgcggccgtcctccagctgcttgccggcgaagatgagacgctgctggtccggggggatgccctccttgtcctggatcttggccttcacgttgtcgatcgtgtccgaggactcgacctcgagggtgatggtcttgccggtcagggtcttgacgaagatctgcatacctcccctgagcctgagcacaaggtggagggtggactccttctggatgttgtagtcagcaagggtgcggccatcctccagctgcttgccggcgaagatgagacgctgctggtctggggggatgccctccttgtcctggatcttggccttgacattgtcaatggtgtcagacgactcgacctcaagggtgatggtcttgccagtcaaggtcttgacgaagatctgcatgcctcccctgagcctgagcacaaggtggagggtagactccttctggatgttgtagtcggccagggtgcggccatcctcaagctgcttgccagcgaagatgagacgctgctggtccggggggatgccctccttgtcctggatcttggccttgacattgtcaatggtgtcagacgactcgacctcaagggtgatggtcttgccagtcaaggtcttgacgaagatctgcatgcctcccctgagcc

SEQ ID NO: 85456 - DNA, 3942 bp, Oryza sativa
caggtaaatcgtgtcgggacaagctatcagtcgaatccaccagtatactcaaaaacggtaatttcctttgggcctgaagatgcagaaggaatatttttccctcatcaagatcctttagtggtctcagtggaaatagcacaatgcgaagtgcaaagagtgttaatcgatggaggaagttcagcggatgtgctgttttacgatgctttcaagaaaatacaaataccagaagataggttaacaaacgcaggagtacctttacaaggttttggtggacaacaagtacatgcaattggaaaaatatctttacaagtggtctttggaaaaggcactaatgtgagaaaagaagagatagtatttgatgtggtcgatatgccatatcagtacaatgcaattcttggaaggtcaacaatcaatatttttgaggccataatacaccacaactacatatgtatgaagctcccaggaccaaggggagtaataacggtccgaggagaacagcttgcagcaagaaagtatgagcttcaaggaacaccaagtgtgaaaggagtacatgtggttgaccaaaaacagggagaatacataaaaatacaaaagccaattcctgaagggaaaacaaagaaagtacagttggatgaacatgaccctggaaagttcattctgataggagaaaacttggaaaaacatattgaggaagaaatcttaaaggtagtaaaagaaaacatggctgtatttgcatggtcaccagatgagttgcagggagttgatagaagtctaattgagcacaacctagcgattaagtcaggatacaagcccaaaaaacaaaaattgagaagaatgtctacagatagacaacaagctgcaaaaattgaacttgaaaagttgttgaagacgaaagtcataagagaagtgatgcacccagaatggctggcaaatccagtgttagtaaagaaggcaaatggcaagtggagaatgtgcattgactttacagacctcaacaaggcatgcccaaaagatgattttcctttgccacggatagaccagttggtagatgccacagctagatgcgaactaatgagtttcttagacgcatactctggctatcatcaagtttttatggtgaaggaggatgaggaaaagacatcatttataacaccatttggaacttattgttttatcagaatgccatttggtttgaagaatgcaggagcgacttttgccaggctcataggaaaagtcttggctaagcagttaggacggaatgtcgaggcatacgtagatgacattgtggtaaagagtaaacaagcatttacccatggcaaagatttgcaagaaacatttgaaaacctgagaaaatgctcagttaagcttaatccagaaaagtgtgtttttggcgttagagcaggaaagttacttggtttcttggtgtccaaaagaggaatagaggcaaatcctgacaaaatcgcagcaatccatcaaatggagccgccaaaaaacacaagagaagtgcagaggttgacaggccgaatggcatctttgagtagatttctatctaaatcagcagaaaagggattacccttcttcaagactttgaggggggcaaacaccttcgagtggactgctgaatgccaacaagctttcgatgacttgaagaaatacttgcatgaaatgccaacattagcaagtccgccaaaaggtcaacctcagttaatgtatgtggcagcaactccagcgacagttagcgcagttttggtacaagaagaagaaaataggcaagtgccggtatactttgtctcagaagcattacaaggaccaaaaacacgatactcagaagtagaaaagttgatttatgcaattgtgatggcttcaagaaagttgaggcattattttctgtcgcatgacataacaataccatcggcatacccgataggagaagtgttaacaaacaaggaagtcgcggggagaatagcaaaatgggcaatggaactcttaccttttgacctgaaatacatatcaagaacagccataaagtcacaagtactagcagattttgtggcagaatggactcccaatgaggtagaacaacaggaagaagtcgaaaaaccatggatagtattctccgatggagcatgcaatgccgccggagcatgagccgctgcagttgtgaaaacaccaatgaagcaaacgttgaagtattctgttcaattagcttttccttccacaaacaacacagcagagtatgaaggcgttttgttggctatgagaaaggcaagagcgctaggggctcggcggttaatagtcaaaactgactcaaagttggtagcaggtcacttttccaaatcttttgaagcaaaggaggaaactatggctaaatatctggaagaagcaaggctgaatgagaaacatttcttgggaataacggtaaaagccataacaaaggaagaaaatggagaagctgatgagctagctaaggcagccgcaacaggtcaaccattggaaaattcatttttcgatataatcacccagccaagttacgaaaagaaagaagtagcatgcatacagagagaaggagattggagagaaccgatcttgaaataccttgtcagtgcacaacttccagaaaaggaagaagaagcaaagagaatacaactaacgtccaagaaatacaaagtggtagagggacagttgtataaaagtggagttactgctcctttgttaaagtgtgtaacaagggaagaaggcatgaagatggtggtagaaatacatgaaggcttgtgtggagctcatcaagcaccacggtcagtggcttcaaaagtcataagacaaggaatctattggccaacaattatgaaagatacagagaaatacataaagacgtgcaaagcatgtcagaagttcggtccaatgacaaaagcaccacccaaagaactgcaaccaattccgctggtttggccttttacagatggggaatagatatagtaggtcctcttccaagagcgaagggagatctgcgctttgtcgttgttgcaattgaatacttttcaagatggattgaggcagaagcagtggcaagaataacttctgcagcagtacaaaagtttgtttggaagaacataatatgtcgatttggagtcccaaaggaaatagtatgtgacaatggaaagcaattcgaatctggaaaatttcaagacatgtgtaaaggccttaatttgcaaatcaactttgcctctgtaggccatcctcagacaaatggagctgtggaaagggcaaatggtaaaatcatggaagctatcaagaagaggttagaaggatcagcaaaaggaaaatggcctgaggacttgctatcagtgctttgggcactaagaactacggtagtaaggtcgactggcatgacccctttcagattggtttatggcgatgaagcaatgactccaagcgaagtaggggcacattctccaagaatgatatttgaccaaaaagatgaagaaggaagagagataactcttgaaatgctagatgaaataagggttgaagctttggagaagatggcatcatacacagaaggaacaaagagctattacaaccaaaaagtaaagacaaggccgattgaagaaggagatttagtcttgaagaaagtgctcaatgaggtagctgttggaaaactcgagtcaaagtgggaaggaccattcatagtcaaaaagaagacagaaacgggagcattcaagttagcatatcttgatggtgaggagttaaagcatacttggaatgctatttctttaaagaaattttatgcctgaaaaaaaaagaagagaaaaaaaaagaaaaaaaagagagagagaaagagaaaaaggagaacacgggagctcgagtttgtagtatactcactcagatgtaaatacgaatgatatccaagttaatgtatataaacaggacgtagggttttta

SEQ ID NO: 85457 - DNA, 4304 bp, Oryza sativa
tgaaattcatagtgtggtaggaaggggagaaattgggagatgtctgcatgttaggggagggacaagggtgctgatcgcccaaggcgatcactcgcccattaggctggccctgttgttcaagcttattttgaagaggtaaaagtagcaactgtactgtatgtctgtacataagtgtgatctgatcaagtatttttggcgtgaattatattgccaaactcttgttcaaccacgctatatatcttgtaattaagtatatggcgtcgattagatgcaatcaggagtttaggactccctgtagtatttattttgtggaaattgctattcatacgatccaactgtccgactcacatacgactaaatttaatcaatagttgtaaacggctgtaatatatataaacatggttttttaatcgatttatgattatatgtctctagttatacataagttctacgactagatcgtaagtatagcaatcctctcttatttcgttggcatgaaacttgaagcacaagtgatgacccttcaagaagcaataactaaaactaaaggcatgaagtgtaacttgttgggcatggtccaatcagttcgctttcctttaattatcaaagtgtgaggttttttgtcgggcttggattggatctttctttgaaatggtcacaaaaaggaaaaaaaggttaataatatccgaaaagataagccatgggacaaagcataccactgaaagaaaaacatataggagtagctagctagcacaagcgagaaattaatcaacaaattaatcttgattagttcaagcgtcgttgaatgatctggaccgacaagcgtgtaaagatatggtcaaatcattcgctgtcgacaatattaatacacttgtctcttttgattggtcacataggaatgaccactgtagagctaaggtcatcatgattgttgtggacttgtgctttcgtttggtgatgcttagtttttgcttagtcgtcgtttggttagaataaatctttagttgggggggtttgatttcttaattgatcaaggtgggaatggaattgatgaaacatgcaatggatcccccacagctctcaaaatatagctctaattatgtcacatagaatgattgaatggaattgatgagacatgcaatggatcccccacatctctcaaaatatagctctaattatgtcacatagaatggtttcaatcaaatatttgttagttttgacaataggtataccaaacaagtacctactctatgggatgcatgaatttaacaccaatttaatatttcttatatatttatatgaactatgtatacattttctttggtatatatacctctaactgagcatatatatagtacctacttaattagtgatcgatctcttgtcagtgtccaattaagacgacttaactatgtttttatctgggccagatatattaacaataagatttgtgggtcctaacacatttggtggttaagcttaagagggatcacaataagtagtttagtactaagctgacatcatggctacaagactccaagattgcaaagcaacagatcctgcttaaaatcgttgtctcgtccaactcggaatcttgctgtctggactctggagagctttgcttttggtacaccaaccatggtagttgcttaaatgttcacacaattgagccaataaacctgggtgccatgtacttaatttaagttgctcgctgtaagtagctaattccaaaggataagagaagcataaaagatagtatatgtaacttgtagccttgtaggtacgtagtatagaacataaaagatgaacaacaggatatacgcaactctcagagcttctttggaatatactatttgaaaaacataggaatagagaaaacactaaaatagtttattaatatacgtggagaacagagaatttaaaaatatagaataaaataacttgtgatgtttggaatagtttattatgaattaatgcattcatatcaaatagacacacttacttatgatattctaaaattatagctatttgaagcgttgtacatttgcctcacacttagcaaggaaaaaaagagaggttccagttgatgtttaattcctaattttttttccaatgaaatttgtgcaaaggaaaatatccctcaactttggacctgttcgtttctgattctggatttcagatttcatttgagcgcttcacaagctcttaaaaagtatgcatgtttcgtacgaacatttatatttttctccccggaatactattccaaagccaatttttaactttgtagtaatagtcaatttattcatttatgctctcaaatacctctaaaaaactcagataatccatcagttataaaaaaaatctcaaacggggcctttgcctgtgtctcaatccaaaatgagttaatccttcacttttcctctaaaaacccatcgaaccataataggccttagacttatttcgaacaggggaattttgattgacactaccctccatcttctaggggaatttttattcacactaccctccatcttctggggccctgtttagatctcacctcaaaaattttcatccagtcacatcaaatattcgaacacctatataaagtattaaatataagcttaaaaaaataactaattgcacagattgcgactaatttgcaagatgaatctttaaacctaattgctccatgatttaacaatgtggtgctacagaaaacatttgctaatgacggattaattaggcttaataaattcgtctcgcggtttactgacggattctgtaattagttttttattagtgcccgaacaccatgtgcgacactctatataatatctgatgtgacacgttaaaattttacacccctggatctaaataccccctgaattctaaggaggacataaaaaaaagatattaggatccagaaaataggttgatcaggataatcatccaccagatccatccatagctaggttttgttcaggggagaattattgtttgcttctgcataaacagtactaggtgacagatggccactttattcacactaccctccatcttctagtagttcatgtggtacatcagaaatgatggatgcttggattatggatcagcagggagggaatattgcaagatctcccccaacccaaccaagccagccagctccaaagcaaacaaagcatggccctgcactaccgcatgtgtgtgttcagaagcacacacaacaaccaatggacagcagaggccaagtgatggggcaattggccatgtgctaaggcctgcacgcatgaatgcctccaatggaatcaagattggccaagctgtcctccccctcctattcttcacccagctaattaagctaagcctctgctgtaatacatacatttcatgtactaagtgccactgatacgtgggctgggatttaatccctctgtcctagaatatagcaacgtcctagaatcggatataacgtatcatagtactacgaatctggacagccgatacgttctatccgattgtaggttgctagtatattctaggatgaagggagtagatgtcagtgacacctctactacaggtacagtacaacagacgatttgcattctttgtcccagctaagctagtgatgctgtgatagtgtaacgtcatgttcgttttacacacgcatggaggacaccatcaagcttagctcttccccactctcagctggtggattggatgctaataatttgaccaccggaaagcacggggcactgccgcgacaaaagagaaggattggctcctcgccgtatgatcacctcgggttacaatctctctcagttactgtgtcgtccaggctaagcctgagcataacccggctggtccgggctggcccggtaagagaacccggttcggcttgattgggctgagattccatgccaaagcctggcccgattacaagggcagcatggctggctctttttgggccgggtttgggttcgggcttgggtgtgggctcatccagttgaatataactttagagagtgaaaaggaaaaagtacaccgaaggtccctcaacttgtagtctagttacaaaatcacccccaactgtaatatatatatatatgatatcctttaacttacaaaaccattcatttgaggtcccttggtggttttgacttcggttttatccgatgtggcggctgagttggcatgggactcacgtgggccccatatgtcaggacgccacatcattatttcttctcttttttatcttttcttttatttcttctcttctcctctcttctcaacgcagtcgacgcaag

SEQ ID NO: 85458 - DNA, 543 bp, Oryza sativa
acagatcgagagaatgtcaacgatgacattgcggcgaggggaagatgatccatcacatgacggcacatgcgctcgccgccgggtactcctcgtacacgaacttgccctcctgaacgagccggcaacccttgcaccctctgcacgacgacggcccagggcagcacatcgcctgcatcggcgccgccgccggccacccgccgccgcggcaggtgccgcacccaccgcagtacgaggggcctccgcatggccacttcggcgccggaacgccgccccatggcgggagctggtggtggtggtggccagggacgaacgctggcaacgccgccgccggggcttcgcactgcggccactgcgggtggacgacgccggcgccccagtgggtggggtcgctgcacggcccgggtagcagatgccgcacatgttggtgaactgcaggttcaccgtcgtcgacgacggcgccggcgtggccttggtctcctccttcacctttggcttctcctccttcttctcttccttcttgccttcgccggtttcttctcgtcg

SEQ ID NO: 85459 - DNA, 702 bp, Oryza sativa
cgagtacatcgcgaagaacgggcccgagttcgaggtcgtgatccgcgacaagcagcacgacaacccggactacgccttcatcttcggcggcgagggccacgcctactacaggtacaagctctgggtctcgccgcggccgccggtggcgccgtaccctcccgggtcgatgcacatgatgccgccgccgctgggtccgatgatgcgtgggccgccgatgcaccagccgggttacccaccgttctacgaccagcaccagcatttcggtgctcacggccatggggagtatgatgccgcgccgcagcaatccttcaagggcctctccgggccgcttccggtggatgtcgcagctgagctgcacgacgtgcttaccaatctcaatggcaccaaggagtcgatcaagggtgccaagacatggttcatgcaaaggtcgccgttcgcgccggctttggctgaagctctgaaggatagagtgtttgctttagaggattcggagaggcagctccacattatcttcctggttaacgatattcttttcgaaaggtatagcttcgatcggcatctgcttttggtatagaattgctatcctctgctgatgtgaaatgaaggcacgctgtctgatctgattgactgaacaaatcacatgatacgatgaagaaagccagaaaacattcctgctgcaaagatatctatttgcctaatggg

SEQ ID NO: 85460 - DNA, 655 bp, Oryza sativa
tctatatgagaagacaaccctttttttagtctttacatgctattaacacattaaagggggtgcaggtcgcaagctcgttttgagaggttcgctgatttgcttgcttcagataccttgaagccgtgtagcaaggatcagggttctagtgctgctaaggaagatccatataatgcttatgaaatgagtccaagtgatcaacggcagaatcatgaaacaactagaaaaagatccgttgccctctcaactagcgaagaaggaaggaatggtaagctaactagatgacatgtttggagatatctatttaatagtcgaatggtttgtccgtattaacgctgccaactagatattagacacatccatgattttcctctgtggtaaataaacaaatgattgacatcctgttactctcacctgtggcttcttcagggaagaaaaggagagagagttatgacaacagggatcctatgtcagagaaatatagaccagaagatgctctagaaccttttcagagcagcaagggaactgaggcaaaagaactattatctgtgaagaagaatttgggggatggtgacaacaatgagaaaggaaatgttgtttcttctgcaaatgtttttacagatagggtgagatgctttcttgcttattctctttatat

SEQ ID NO: 85461 - DNA, 1577 bp, Oryza sativa
tctagcaataagaagggggctaacaagatgaatgatcaaaacaagtacataagcatgtctggcaaaaaatagttagcacccagaataggtgtacagatcattgcattggtaatgaatactagtaaacacatgcaactgcaatatacaagcaggttatgatcttggcggtgggaacctggaaatttcaagtgcttgaactatgtctttagtctagatcaagcaggggaacatttatagaatttgtgttttgagcagctccaacagttatagttcacacaatgaagtcagaaagtttacacaaaacagagggcaccacaaactttatgtttaatagattcgaagagttttttagtctagactctagaagctgatattgcacttaccacgtagtacaatgcaaaattgtccttgtccagcatataagttgacctcagtttgaaccgaatcatgtagatgacaaagagagtagctgctagtgtagctgtatcaagtatggtatggatgtcatactccataacaaaactgcagtacagcctaacagccagaaatagtgctgttaaatcctgagacttgagtgagagtcctgcagtaatttagaaggtttaaacaaattagagcatgagttacataaatgtaggaattaaatgaagagagtaacaaaagggacaattaaaaaggtcccagagttgggggagggggtatgaggggtgagaggaaattcatcttgcaattgtaattttcaacatgcgattctataccagtctactccctgtcattcaagcagttaattcatcttattttattttttgagaaagggaggcacctccgttttcattaacgaaaacaccaacattacagaagtccttaaactgcatgcagttaattcattttgatgcatattaaataaaataattggtctatcctcaataaaaactgggaagtgaatgcagcatccactatctaaaaaaattacctgattaccatacaatttccactttcaaacaagtgattttacagcttgctaatgcatgcagataaacagctgtactgatgtagtgaaaaccagttcggttaaaaacttagaatacaatagaccaattgggattttgctattctctttccactcaagaagcaagaacaaccaagttgccacagagcaatcataaattccaagcaattatgcttttggaaagcaatggaattatgagatggaccatatcttggtaagttaattgcctaatattttaatgtcagaatcaccatctttatacccccttctaaattcttcatttgcacaaccaagcactcagacataatatgttttcagaaagtaaagcacgaaaggagatggaaaacaacaagttccatgacagagaaaggcgttctagtagggactgaagcagcaccaccaatctaaacaccataatctatgcgccgtccaccaggagatgacatactccctccaacaaacacttcaatcagctacctgacagaccagtactgctcaaaacaaactctgctagtgctaccctacaacacatctacatatagaatgtccacctcattactagaaaacc

SEQ ID NO: 85462 - DNA, 515 bp, Oryza sativa
  unsure (1)..(515): unsure at all n locations
gggccattggtgaacctcctcgacgagagggaagccgacgtcagccgggaggcggccgccgcgctcaccaagttcgcctgcacggagaactacctccatgtcgaccactccaaggcgatcatccaccatggcggcgccaagcacctcgtccagctcgtctannnnnnnnnnnnnnnnnnnnnnnnnnnnnnnntcctcctcgtgtgctacattgcgcacaacgtccccgacaacgaggagctcgcgcaagcggagatcctcaccttgctcgagtgggcatcaaagcaagcggccatggtgcaagatccattgatcgagaacttgttgctggaggccaagattagaatggagctctaccaatccagaggggcaaaaggttactactgagatgcacggttttgatgcagaaagaggcacatgtaggatgatactaccaagatgatggaccggcttcttcttcttcgtcgtcgtcttcgttgcatcaaccagctgactactgtatatatattcaggtg

SEQ ID NO: 85463 - DNA, 1105 bp, Oryza sativa
ccgtctccgagctcgccaccaaccaccccaaatgccaggacgccttcctccagagcaacgtcatccgcctcctcgtctcccacctcgccttcgagaccgtccaggagcactccaagtacgccgtcgcctccaagatgtccatacacaccgtcctcatggacaagaagaacaacggctccacctcctcctcgcaccaccacgacgcgctagacgccgtcgaccacgccgccgccaccaccaccaccaccaccgccatggcggccaagcccaccggaggcggcgccgccagctcgagcggcgcaggcgcaggatcagcaggaaccgggacgacctcgagcagcagcgtcagcgtcggcggcaccgtcgccgggacgaagcagcacaacgcgtcgctgtccgggacgagcaccaaggcgcgggagttcgaggacccggagacgaaagcctacctcaaggccaacgccgccaaggcgctgtggcagctcgccatgggcaacgcggccgtgtgcaagaacatcaccgagtccagggcgctgctctgcctctccgtcctcctcgagaaaggcgtcgacgacgtgcggtacaactcggccatggcgctcatggagatctgcctggtcgccgagcagaacgccgacctccggcgatcggcattcaagccgacatcccccgccgcccgcgccgtcgtcgaccagctcctccgcgtcgtccacaaggccgactacgacgagctcctcatcccatgcatcatttcgctcggctgcctttccagaaccttccgggcgaccgagacccggatcatcgggccattggtgaacctcctcgacgagagggaagccgacgtcagccgggaggcggccgccgcgctcaccaagttcgcctgcacggagaactacctccatgtcgaccactccaaggcgatcatccaccatggcggcgccaagcacctcgtccagctcgtctacttcgccgagcaagccgtccagatcgccgcgctcctcctcgtgtgctacattgcgcacaacgtccccgacaacgaggagctcgcgcaagcggagatcctcaccttgctcgagtgggcatcaaagcaagcggccatggtgca

SEQ ID NO: 85464 - DNA, 652 bp, Oryza sativa
acatttattgcggtttggacgagcgcgtcacgccgcatgtaacgcagtgcagcgcgctcgtttatccggtcagtgaccagtcacagaccgatcagatcgtgggttaggtggcgacaggcggtctgacgcacgcctcgccccatcccgtcaggatgagagcctccaagcactcgtccctagccggagccggcgtgttagctcctggagatggcacgttggtcccggtcagatatataccaggcttcatcctaaccattacaaacaagacattgtatgaagaggggcgaacatgcagattgataaactgacgcgtggtggacaagaatgaccgatttgtgaccggtctgacactggtcatgtcgtcagcagacagccatgttcccacgtcgcgcctgcttccggcggaagtggaggtaggtatgggccgtcccatcagaaggtcattcggacggcaaccatacaagtctccgtctgtttatgaaaagataggataagtccccacaaaaaagatagagatggtgcatgtggtatccccttgaggtataaaaggaggaccttgcccacttagaaggggaaattttcggatccagaacgatcagagagggagagagtaagagctctctggttctccagctcttttgtagcttcttca

SEQ ID NO: 85465 - DNA, 3009 bp, Oryza sativa
agagcataccgttatgttcttcaagagtgcataggtaacatcaatagctctatacgaccttggatgccattttccttcagaccaatcaacatgtgtcactgaccaattagagattccaccaggatctaccatctgaagatgaaagtgaaagcatatgaaagaaaagcaagggaccaagaagaaagctaaatatcaattcaaaatattatttactgacattgaagagggttggcaaataatgctcatcagcaatacagttgcgtccctctgctggctgcagaacacaaaaaagcagaaaaaaattggtgtattaaataacattatgtatatatacattatttcaacgatatgaaacacgtgcttcacgatttttttttcttgacgagttaacacccttttgatttcctgtagcatatggctaaagcagttaaaacttagaaccaagtggcacaagtcttaaattcagttcatctccaaattatcatctctactaaagctttacaattgccaatagcagttccaaatttcatatctcaactaacatcctagctttgatcttcattctgacagtatcaccagggtatcattttccctctttgggataaatcctggtaccctggtacctactgtgatgcctgttactggctggttcccaatgaacaccatgaagatgcatttattttcatttatctactagatacactatagtaataggatttgtgtttagatgctaccaaaataacttagtaatcactgtacacgtgaaatgaactatagcatgatgggcatcaacaattaacaatcaatgaaggaggaacataccttgcaatacagctcgaacttattgtagtaaaggtggtctgctaaaatcagtaaagcatgccttcgtgttacagcaaaccactacaacacatacgaaaaccaacttagaaaagcataaaaagatggaagtgatatatcatcattctcacaaacaaatgtcctagtttctgaagatgttgacttaaaagaatgcctctaaaccaagaatatatgaagcgcctaacaaactttggggtagtaaacattctgaagaataataaagtagtaatgtaaaaatatgaacctgggcacccttcctgaagtccctctgttctatttcagggagcatttccacagaataccttccgcttccatgtggtccaggatcaaggaagctgatagagtgaaaaaacacaatgaaaaacgcacacaaacatgtgtgactaggggagatagaaaattgtgcggtgatcatagctctgtgttaatgcattccattctttaagtcaaaacacaccaacgttttctacaccattcttgtgatgtaacaagggtattcctttgtaaagaaatataagccaaaagattgatctagaataaaatgcatgatgaaatattcctgattttcatattcccagttattctctaggtcacagatgaaattaaagtagaaatgttataatcaatataccaaagaacttttttaaagcagaattacatgctctgaaagtagctatttcctgcacttgtatgtactatattttcctcttgtcaaatggatcaaaatatgagttcagcgctcttaccaatcaatgaagctgacgtttgttcccatcaaaaaattatatatgtaatcaaatgtatgtagtggaacacagctgtcaaacaaataaaaaggatcttaacaaagtgcaacaaaaacattttctttttgcaggcaaagttttttaaaaacaaaacctgtccgatagcaagacgaaaaattgattatcaacatcttccaatgcatttgctagcagcctcttctccgcatcaaccattgaaatcctcccccatacaacctgcacatacaaagacaatgcaatgctttagttctgcaaaacaaattataaaatactatgttggatgtaaaagaaatcacaggaatcactgatagcaaaaatttcaaaagacaaatcacagtccttttgcttatttgctgcaaaatgtactactaaaaagtaagaacttcttaggagaaccaacatggaatttcctaaacacaggaagtacaagccagattaaaaaaaaaagtgaactaagcctagctcatctgatgggtgtgggttgtgtacactaccaccacctaggctcaaatcttcttctttttgaatttagatatttctttttctttattttaacaacatagagtttctttgttaaaagcttgccttatatgcaggtcattggttgcaaatgtaatctcacttatagtcatcgaaaactaatccaagcaataacacaattttcttctttcttagtataaacaaaaggaacagttgtcaatgcataacaacatttcttattgttcataacaccttgctaagcagatgagttaagataaagcaagaaaagaaacaaacaagtacacagtgtgggggtgaacattagtaccttttcactatgaatctctcggccaacaaacaaagaactagaatgtacaggtctttcacgcgatgcatggatataaatggaatatcgatcctcatgaccctgcacacagaagttcaagcaaataaattttacaaactagatgttgatgcatctatacatagtacaaactccatcctcattacagaaagaagcacatgatgggtatatctgcgccacacctgtagaaatttctcccatagtttctcaaagggcaatgaacctggtgttaagaacatcaaggcaatctttggattcttcgagacaggcatgggcattgcaaggagatccctcataacaacagacgagacgatctcttcgtctgttcgctcccgtcgggtcacagtagggagccaatccttgaaaggagtgcagacgctcgaagcgaagaagtagcacgcggagtagcggcgcggagggtacgcgtaggccccgatgagcgcgacgcacaccagcgacagcagcacgattatccacatgggcttcttggcggcgcctcgttggcgcggagggggcatg

SEQ ID NO: 85466 - DNA, 1886 bp, Oryza sativa
ttcgcccctcttcatacaatatcttgcctgtaatggttaggatgaagcctggcatatatctgaccggaaccaacgtgccatctccaggagctaacacgccggttccggctagggacgagtgcttggaggctctcatcctgacgggatggggcgaggcgtgcgtcagaccgcctgtcgccacctaacccacgatctgatcggtctgtgactggtcacagaccggataaacgagtgcgctgcactgcgttacatgcggcgtgacgcgctcgtccaaaccgcaataaatgtggttaggtgagccccgctatgctcaccttccccatatacgcggcgcaaaacccataaggggtcggggcgcctcggccctcggggccgagacgggagcggtccgacccctcggggagacaaagagaagggcggccgtatcaccctcgggcctgacccccccgagggggttaggccacgtgggtgatcgtgtctgcctcaagtctctaagtcatgatactcccggtcccatgtcaccgacagtagcccccggcgttatgccagggcgatcgccctccccgagggaagcggtcgggcgtgacgccacttctaaggcctggtgacaggtggggccggttcctacaggtgccgttgaactacatcacccagagggcggtgtgaggcagctgcgatgagctcgagctggcctcggggacagagacgagctcgggagctggggtccactccaccacaaagtcggcgagggcctggctcttgatcgcgtggcttggttcaaagcgcaaatcgaattcagagagttcgattgcccatttcaccacccgtccagtaccctctcggttatacaagatttggccgaggggataagacgtaaccaccgtgacccgatgcgcctggaaataatggcgcaacttcctcgaagttatcaggatagcgtaaagcatcttctgggcctgaaggtatcgggtctcagcgtcccggagggcctcgctaacgaagtagacgggccgctgcacctttcggcggggccgatcttcttcgtcaggggccacatctccagggcgctctccatccgagaggccacgcggggcgcactcggcttctgtgccgacgacctcggggtcagagggcgacaggcgcggccttcccgcagtggcctcggggccatcctgggggtcgtgggcgcctggcaccgtcggacaagcaggcggagggccagctccggccgtcgggggccttgggccgccgttcggctcgggggcctctcctccctgctctctctctcttcgggcagaatcccggcggtcgcaaatcgcgcgcatcagcaagggaaaaccgaccgacaataatgagcggcccctcggcttcgcgtttgcctttaactccgacaaggagtgcggtgacgacggtgcggacgacagcgacggcgaggccggctacccgggcacgtcggagtgagcccccaggcctccgccaatcttaatagcttttccttcttcttccgaggccttcgggcccccttcttgttataggctgatttaatctgcaatcaaataaagaggaaatttttgtgtcaatttcatttgttctgtgtatgagacgaggatggtctgtgccacggtccttctgtgtcttggcttgaacaagggctcgtgcccaggtcccagcctcaaacggcgcgggtcaaggctagtgcctggggagatccacatgtcgagactggccaggccgggagcgtggtgaccgagggttatgggtgacccgattgtgggtttttgccgattcccccccggagttcaccacgtcccggggcacggctcggttctgggccccttttggcgattttagccgacccgagcccccgagggtaggattgagcacaa

SEQ ID NO: 85467 - DNA, 676 bp, Oryza sativa
actgaggggaacaatgcatcaagtacacgctgggatcgtttaaaagtatataagaattagattagttgagtagaaaaaagagggggaaaacagtactttgagcatttagtggttcaacacagaaaccttaataaaaatggggaggaaaagcacatattattatgagtgagaaccatggtaggttctgtacaaacctgtcctgtaagaagaggtgtatctgcagcaagtttttccataacaggccttggtgaacgcacaggccatgtctgtagtgcagtacaacagattaaactaatgctttaatcctcagacatgttatcttcataaaagatggaacttgtttacctggagcatggtaaattcctttttgataccctgaaattccaattctagcactgtatcctgcatttatagcaaaagcagggttccatacaaggttaagcaaagttagaatgcatgcagatcaataggacatgggataaagtgatactgatagcatccactaacctgcaggctatattgaccagctggggcgatgtaacttattttccccatagcgccaggtggaagagcaaccttgtgttgcatcaaagtattttcattgacaatctgccatatagtcagaaaactttagcaaaggcacatgattaatgatgacagatctcaagctactatc

SEQ ID NO: 85468 - DNA, 12380 bp, Oryza sativa
acttatatattggccgaagttatgttgttttggtatgtatcctggtcaggttttgtgactatttacttttctttcattgtagaaatcttagcaacaacaatattggtggaactataccagaagatctacctgttacactgcagcatttgtatgtgctattcttcctcttctggaatttttttagctcttgtgattgagtgatgagatgccttatgttccttgctggtgcagttttatgtctgataaccagctcactggaagcattcggacgtcactatcaatgcttcagagtttaacagacatgtatgactattgtcctatttctgttcctaagcagagaggttgctgtactattttttttctgatctgtctttttgtaggtctctaaatgataatcatctcgacgggaaactgccagatgcttttggttcccttactggccttgtaaatttgtaagatacctcattttcctctccttttcattttgcttattcttactcttcatgtgcacttgctcatgcacctgagagtatatcatatcttcattttccccaagacccgagagggttggcaggcaaggggtgaactgttaactcgttcataacatctagcatttgaccacagtgatatttcatccaataacttcagtggttcattaccaccttctctgggaagcctgtcatcattgactacattgtaagtctacaagtattttcttatatagttttttccctatcatttttacttattttcatgccttgttattttacaggcacatgcaagacaacaaactatccggaacccttgatgtcttgcaggatctccccctcaaagatttgtattcccacactctctattgtgtcatcatattactgattcacttttattagtacaccattatgtataaattggacaatcagcaattgtattctcagttatgtgttgatttataaaattgatctgcttaacagacattttcttctggtctactttagagatgtcatagtataaattatgattatcctgcactttgtcattattttgaagtaacatgcaacaatatgttagcagacacaaagttctctattattcaacagtcacattgaatttgataaggttgtagaaacttgacatcctttcacaaagtacatggcagtcatacatttgtttgcagaagtataatgtaccatgtagtcatgaccagaaccgggacttttaggttttaacaaagctgtactagttagaaaaaagaacaggtgatgtaagtgatttagcttttatcttatcatagacattcacaagtcaaacagtaatttaaatccaatttgttatgtatgtctaatccagatcatcctttttcttagaatgctgttatgcatacaaatatgaaatatctacacttgtttctgataatatatttacctgaaacagaaatatagagaataatttgttttctggaccggttcctccaaagttgctgaatgtgccaaacttcaagtgagaatcctttttcttacatatttcaaatttattgatgcaattcacatagtacttggtattcctacataaaaattctctctactatatacttttgccatatgtaattatatgtaaggtaacttattgagtaattcattgtttttgtctacagaaaggatgggaacccatttaataccagcatagctccttctgcatcaccctcttcaacacctacaggctctacaccaacacaaacaccatcgtcaccttcatcttctggaactccttcgccatctagttcgccctctaattcttctggtggatctactgctcgagacagcagctctccatcatctaggaaacataagtcttcaaccctcaggattgttggatatgttcttctagctattgtcctgtttatagttacagtgctgctggtaatattttgcctgtccaagtaccaagagagacagtcaagacgtgattatacaacaagtcaggtggggagggttcatcagagggttgaagagcggaaagttaagcaagcttcagtgcagtcaaggaatgatgccaaaaaaggtcaacaattaatttatatattctgtaatatatttctgattatattttatttgttttatatcacagcatattgatgttctattaacaggatcaacagaggttcctgaacggaggcaggttcgtgaaataaatttggcggtaccaggtatagatgcttgtaaatctgatctatcaggtcttttagtactgtaatactattcacatttttaagttcagatgtataaaataactattcaattgctggcagctgctctcgagaagcctcctgaaaagagaaaagaacatgtaattaacttgcagcgatcagaaacagaaatttttgcttctacacctccgccgccgccgcctccaccaccaccacctcctcctcctcctccgacaccaccaccgccaccgccgcggccgccgccgccgccgccaccaccaccacctgttgaaaaagtgattgtaaatcccattgttaagccagagaaaagagttagtactccacctaggacaggtccctcgacatctgcaacatccttttctgttgcatcacttcagcaatatacaaatagttttgaagagggaaatttgataagagagagtaggttgggaaaagtatatctggcagaacttcctgaaggcagggtatgtttacaaaatactgcttcatttaaatggaattttatgattattgaaatgctatactaatcttcctttatcctatgcagtccttggaagttatgaagattgataacccccatgatagaatacccgtagatgaatttctagaactggttgcaagtgtatcagatattaggcatcccaacatcctcgagcttgttggatactgtgcagaatatggtccgaggttactggtttataatcatttcagtagaaaaacactgcatgatgtactacatgaagggaaggaattggatggtgcactatcatggaatgctggcctccaagttgctcttggtgcagcaaaggccttagagtaagttaccaagctgtatcggggttcaatataattaccatgaacttgtgcttatttaatttagtttttcatggggtagctttggtacttatattcttctttcagctatctacatgagagctgtgaacctccagtagtgcaccagaattttgagccagccaatgtgctccttggtaatggattctcagtaggtgtcgctgaatgtggacgggcagaattgacgctgtcaggttctgttacacaggtaacatctagggttgtacaccaacctggtggttgtgatacttgggcttttccgtcgcaagcagttctgatacatttcctaaaattcctgaagtccaattaagaagagtaaatttcagaaaactacatatactttgatcaaactatcacaaaactatagatttaaggcggtgcatcacaaaactacagatttaggaccgaatttatcaaagaactagagatttaagatggaagaccaccaaactacatatttagtaataaaatatcacaaactacatgttttgtagcaagttaagtactacctccgtttcaggttataagactttttagcattacccatattcatatagatgttaatgaatctaggcacacatatatgtctagattcattaacatatatatgaatgtgggcaatgttagaaagtcttataatatgaaacggaggaagtacaaaactataacatttataactcttaacatgatagtagtggtagggatttaaattgtaaaatatgtagtttcgtgataactctagtattaaagctgtagttttgtgatatttggccttaaatctgtagttttgtgataaaccgtgtgttaaatacttaaatctgtagttttgtgatacaacaccttaaatatgtagttttgtgataatttaattaaagtacctgactatctgtagtgttgtgaatactactctttataatttgactgcatacgagtaacaatccagtattcaagcacctaagcagctctcagggcatgacagctactaggtccagtgctacaacttccttccaaactagagcagccttatccacatatttactatcgcaggaaagactattgaaagaagggggttaaaattttatttatcttaagttttagattagttatgttgggccttccagctaccagcctaccatgcacatccaccacagcagtagaactcgcctcaggcctgaaattgatggttgttccctcgatttgttcataaggtgttgtcttttggttaggattattttcagttaagaagcttttagctgatgtttttaggagctggttcatttaagggctttaacaaatatcagttaagcaagcaaagaaacaagcaagttcgttcacatctctggtctggttgccccattgcatctcctaatgaagccattgctgcaaggatgtcctctctgtggttttaacttagaatggtgttcttttattccagttgtcaggtcgcatgagggcactgctgaattatgaagctcctgaaatccatgaagctgggacttttacctaccgaagtgatgtttacagttttggcgtggtaatgctagaacttctcactggccgtaaaccatatgacaggtcagtgattcaccgtaatatgcatttcttaattttagtttcataattgtgttagatcaattgtctccaaatgttgtctgaactttctagtttgcttgcttattttccgttacaatatgcagttctggtcctcgtgctgaacaacatcttgttagatgggctgattctcaatttcatgacattgagtccatatcaaagatggttgatccttctattcaaggagagtgttctgagaaagtactgtcacgttttgcagacatcatcagccgttgtattcgggtaatcaaatacttccattatcttttgagctaaactgtagtttctagtttctagcataatataagatagtacatgtgtcacttccttaagcatctctatcaggattttatgccagaattttctatagagagctgtttaattaggctaaaagcatcaactatctaaatttcctattagcccattgcataattttacttcattattgaggtcaaatgcattctgcaattttatatccaagttattatatcacaaattaatttgtttagtcattttgatacttaaatcacattcaggtaatatacttgtttatctgttcactatgctctgctctgcttgtgttgtttttcttttctgagaacagccatatgagatggatttaaaaatcatgtgattgatgaatgatctgaaatttcttatgcagccggaaccagaattcagaccatcaatgtcagagattgtccaagacctagctaggattataagtgttaccagtgaggaatcagagtaacgaagagatcaaggtggggccgtacatctaggaagccagctctcgcagctatcaaaaatattcagaggaaacacaatcatttctgtggagcatcctttcagtatttataatggacagcattgtcctttagtgtacatgttgattctggagccgcatttacctgttgaaaggtggtagtggtacagccaggggaacatgggccttctcattatgggccaagtagattcctgtacttcctagacattatcaaattgcatgtatatcttataatccattctaattttgattattttattacattaaaattagcgatgttcatatggtgttagcatatctgattgctgtatctctctcaaagctcgttcagaaatcgtttattttgtttgattaactccatgtggtttttgtgattttagaaagtatactggtgtagaggtgttgttcagaggcggatgaaccctctcgacattcatatgctttcttctgtgaaactggacatgcacattctcctcctgcagggaaaaggatctcatttaggtatgtctcatgtgttcgatttactcatattttctattgtctttcctttataatactttctatcattgcccacattcatatatatgttaataaatctatatgtatgtgtgtgtctagattcattagcatctatatgaatgtaagtaatgctagaaagtcttataagctgaaacggaggtagtattaccatatagtatttgaatggattatgggtttatggttttggttacccttaagtggtgagtgctagtaatagagacaaacgggtggaaatatattgcttaaaagatactccctccgtcccattttaagtgtagccatgattttccgtgcccaactttaatcgtccgtcttatttgattttttttttgaaaaatttaaaagcataagttacgcataaagtactattcatgttttatcatctcataacaagaaaaatactaattataaaaaaagttcaaataagacggatgatcaaagttgggcacgaaaacttatagttgcacttaaaatgggatggagggagtagatggtaaacagcagctgattactaccttgtctgttctgtgactggcagtctgtagtaacattaaatttgcttttgtagtgttagattagcactctatgcggaataatttggttatacaagagaaacagtactgtaggatgttttgcatgctgaaatttgctcttctttcaaagctagtactgatagctccaaccatctactatttcacttgcttccgtatgtgcttgagttagaaacgttttgtatcctttttcaccttttggaacagagaaaactttactgtgtcaacactggaagcatagatcccacctatgcttttggataacttcttgccgactaaaaaaaaatatttgccttttttttctagagtataacatgatcatctgctttgattggagtaatgcgctcctatactttgttgctttcacctacttttctgggatgcctactgttttgaaggggaaaaaaatctagataagtagatgcactcatcaaatcattaaaacctctacttatttagaaccataggaattgcaatttgcagaactccccatttaggacagtgacacgtacacaggtgcccggccacaagaaggttagttgccttgcacaggcacattgagctagggaacctgcacctggtttcagaaagcagttttgccgtgccatattgccatgtgggtggtgccaagttgcacagtaccgatattatgaggctggcaagagttgccgtagcagggggctctctcctctgccaagtgccttagcccctctcgctttctcccccacaaatgtcactcggataaacgagtgtctattaccattgccaaggcctcaatcttgtagtggtccatctgtgtaaggatggttatataggttagctggtccacatcaatggatcaaccgcactgtcctgtggttgccgttgatatgatgatccatggtacattgaacttttatttcatcgatgattttttattttctttcagctgtgaagactccatagtttatatagttattaccaaatatcagtgagatcaactgcattcctgaccgatgaaatgcagatcagatgtgcaggtttcatgaatggttttgggtctccccggttttcttttcttaacctgaacagaattagaattgtagtggttcatattagctctcatctcactgtcacactcatgcatatctttgccttgccaattgcagttggttgctgaatagtgggatctttactgatcctgcagaatcatggcgggcagatcatgcgtgacatcgcaggaagcaactcccaagttataacgggttgaatttgaaccaaacgtgtactctctttggcctgaaagcaacatggaagtaaccgaatgtactatgcgagtgagcttcaagtcgcagcggcacaagtggcgcatccctggttttgccatgctacagacacgcgtgcggttttctcatcgcacgcgtgacttcatcgtgcatgaatctcgtcgagacttgtcgttgttggcttgttgctggaggaaggtgacccgatgcatcgaaccggaaggacggatggatggcatctcccgtttttgtggctggtctcggttttccgggtcgtgtgggcccgtcctatcagaacagccgggtttggcattttgcagagcttctcttgctacctccgtcctaaaataagcgcaactatgagtttttgcgtccaactttaatcgaccgttttatttgaaattttttttataattagcatttttgttgctgagataataaaacataaaaattactttactcttgacttatgtttttaatttttttttaaaaaaaattcaaacaagacgaacggttaaagttgggtgcggaaaatcggttaaagttgggtgcggaaaatcatgtatgcacacggagggagtacgtttttgaccgcacgtcttcgttttgactgccgggtgccggcacgctagaaatacgctaggtggcatgtattcatcgcaattcgcaaaggtgaaagaagaaaagaagcatgccaatttgtagaattttaacaaaaaaatgagcggttattggagcgaacaatgaaaacttcaagggaattcggaggagcatgatgcctaccggaaaatcttgagaaaaattcacatccagatccagtgaaagcggatgtttccttctggtgttccttctagagaaaattccgcgtgcactaatcgaagccttaaagaaaccaccaacatgtgaaccatacgcctatctgatgtgtttatgatcgaccggaagaccgaagatggggttttctcaagcgattaataccaaaagtatccatcaattcatgtagctagttgttgatgaaatcattatcaggcctatggcaccacgattaaattgccaagaacttggtggtggagaagctaagcacggttgtccgatccagcttacggaagtgaacctttttgggtcggatccaagctctagccaaggtgttctccaaaaaaaaaaaaaactgaactgtacacaaaaaaattgagaacctttttggtttgagcagttgtttataaactgtagtaaattctaaattgtactagaacttacttttagaattgtttgttttctgcatttagctttggcactcggatcgcgagtacaagagtaagcaattgcaacataattttttttaggggcaattgtaaatttaccactagtttgaatcgttattgcaagaatgtcactaaaaaattataaaaataccaccagaactatcgttcaagtggcatactggcatatttcaaattaaaaaaaccaacggcaaatttgtaaatcttacataagtcaaaacaaacttagggcgataggagtgaaggtattgcacttgttgggcctcggttgccacctaggcccaagcccctctaaggatacacactcattgtatttgtagtgggtcccaccaataactcctctcccacttttcatccccctctctcctctctgtctttctccatcggcggaggaagctgaggtgctgggcgaagaaagcgaggtgtcgggcggagtgaccagatctagccaagcatagaagaagggaacaatgtgcttgggggcggatttggcgaccgtgccgagcagagcgatgacggcgccgggtggagcactacctctccttgtcggggtggccgccgcgggagatgacggtgctgctatgctcgccgaatccgacttggggctcatcggatccggccttgggtagcgtcagctgctcataggatccgacaccaccttaccccctttcctctcgacgcgacgttcgacaccacctcaagggacaacgaggacaagaatggcagtgatgctactcacccccctcccccctcatcccttctctttcgcggccacagtgtcaccctctttccttggctgacaagcccatcggcgtgaagcacgggtatgatgacgagggcctctcctcctgccagtcctctctatcccttccctagtgatatgggacagagagtatgagcctatatttgtaaattatgacgaggaacctgtagcttaatttggctcccggttctttgtgggggcaacaaaatagaccagataacatggagccgaatatctgagatagtcggttcgtgctaaataataactccgtgcaccgtgaaagccttcgtaacgagggagtaaagaaaaacgctaattcctttcagaagaagcgatcatcatagctccagcgtgatgacagaaacagaattcgccaaaaatgatagaagtatccgctgaatggtggtgggaggctgggagcaggtgcagatgcatcgcagcctctcttatctcggtcccaagaacacgtacagtacccaccaccgcaccgccttcctgaacgggacatatgtacggccaggggcaggtggcctactctactcgcctaggcatagggtggggactgactcccatccgacgcgcctgcaggccgtggaactggcgacagcaaagccggcctccacctggcgaaccccatccatccatccatctgctccgtctcgccctcgtcggatcgatcgagtgactgatacgcaaggctgcacgtaagtaccatactactgctgttctcaaaaaaaagtatatactactgctgcatccgttccaaaatataacaacttttagtctttaggatttatcccataatacttcctccgtttcacaatataagtcattctaatatttcttagacatataacatcaatataaatgtggaaaatactaaaatgacttacattgtgaaacgaggggagtaacttctccaccagcattctctttccaaccaatcacaaccctatgtcattcacttttcccaactatctccattactcatccaatcacaacccttcaccattcagggcctctttgaatcataggaatgaaaaaacagaggaataggaaaaacataggattctgataggaatgcaagtgtaaaacagatgattgcaaaacacaggaaaaacataggaatgactgtttaattgggccacaggaaaaatacaggaatttgaggagagataaagactcaaaggattcttttcatgaggttctacctcatgttaaatttcctccaaaacttacatgggaagagtcatttcataggaatttcataggatttcataggatccattcctttgattcaaagggctatataagaaaaattactataggaatgaaattctctaaaatacctatgaatttcctttgaatcaatggggccctcacttttacctattttcttaataacagtgtccaactctaaaacttcttatatcctgggacggagggagtacgatggatgaatggacggacggacggatcggggtcggtttgcgtgacgtgctcgatcgggtagggagccagatactcactctgttgcataaaaaaccaaacctaataccgaatataacatattatatattgtaactccagtaatgctttaaaccaataatatcgaaatatgacacattctagtattatcaatctttatatatagaaacatactctctctataaaaaaacgagtctagtcctggatgtgacatattcttatacagcgaatctagtactggatgtgacatattttagctggtcatttattagtactaggatgtgtcacatccaatactatattggttttttataagatgaaggaagtatctagattcgtagtactaaaatatatgttatattcggttctagattagttttttacgggacctagggctacaaagccaccagctgctgctgtgttcgacacggtgagtgtgtgcgtgcggttgcggccgtccatacacagtcgaccgaaccgaccggggacgtgcgcgttttttttttcccttctttctgttgttggatgagatagctgcacgtacgcagcagcagcagctactaccgtggatgcgatcggagccagggttaaaaaacgactaaccaaaatcggactttctttttactagtattagcaaatgggattttaataacaaaaagaggcaacaaactaatttatgtctggtacggtgacaatcatccatcaagttactcctactatacttttccccgcttatatactccttccattccaaaatataataaattagaagtagatgagacatatcatagtattattgacggagcgtggggctcctcaccgggagaccgcgcaggcccccctttgccggttcggccgggggccctaggtgagattctaagctcctagtctgtgtgtggaaggttcgcgagaatggaaaaaacacaagacacgggcgatgtatacaggttcgggccgctgagaagcgtaataccctactcctgtgttttggtggatctgtgtatgaagaagttacaaag

SEQ ID NO: 85469 - DNA, 678 bp, Oryza sativa
attgtgaaatatattataaaatcttgatgatgaaggcatttccctccccaactatattttcaatggttgctatccagttagatttttggtaacattggcttatctatatgtttaatttcctgttgctttggtcatttggactgctatatgtattttatggaccttaagttcatcaccaatgatctcattgtaaacaaaatcttatatgactttgccccccaggaattacgatagctgagtattaccgtgacatgggttacaatgtcagcatgatggctgattccacctcacgatgggctgaggcattgcgtgaaatttctgggcgtttggtacgttgtttttcttctgccatacttgccctcatttcctttttgtatttctcatcctagtgtactttaacttgcacaaagctctgtcctattctcattggaaagacaatcagcttccgatttcttaaacggtgtgccgacatatttacactagcagttattctttcattgtgttttcactagtagttatgatagcctatttacactaaagtagttatagaatcaatttacatcatttactgcaatattaccatgtatggctaaaaattgctaactgctaatatagcctttggaaatagaatacttaaaagttaagattgttataactcattcgtgttgattttttgaa

SEQ ID NO: 85470 - DNA, 754 bp, Oryza sativa
agtagttggcactgctgacaccatatgagtgtcaaccaggttacaccaggatcaccagctgaacatgcaagatttcgtcctggggatgtggtcgttgaatttgatggtaaactggttgagagcatcaaagagggtaactaagctaactaggtgtatcacttacagtattcctttaggaacctagtaattatattgtcctgtcttcaatccaagagccaagagcatgttaacccatatttataaataaaatatttattccagatcattgatatcatgggggacaaggttggagtgccatttaaagttcttgttaaaagggcgaacaatgtacctgtgtctttgacagtaataccagagaaagcagattctagcagatgactcacaattaatcttgcttgaaaggttgagcaaagagtagtattttccagcacaactcatgtatcctatataatttagtttatactccctccgtttcacaatataagtcattctagcatttcccacattcatattgatgtaatgaatctagacatatatatctatctagattcattaacatcaatatgaatgtgggaaatgctagaatgacttacattgtgaaacggagggagtatgccctatgaacgctttgttgagtttttctaaccaggggctacagatgctctcctttccagaagaggaaaacaaggtgcgagcgaattatagtacgatatggagttggagcaacaagtcaattttgccagtggcatatgat

SEQ ID NO: 85471 - DNA, 613 bp, Oryza sativa
atcctctggcaagttttttcatcccgtcacatcgaacgtttgaacatctatatgaagtattaaatattagctaaaaaataactaattgcacagattgcgactaatttgcgacgaatcttttaagcctaattgctccatgatttgataatgtggtattacattaaacattttctaacgatggattaattagtcttaataaattcgtcttgcagtttacagtcgaatgttgtaatttgttttattattagacaacatttaatactttaaatgtatgtccgtatatacgatatgacatggcaaaaattttcacccttagaactaaacatagccttactctcacgggaacattttgtctttttttttgttgctccctaaatataatgaatttgaagataacataattagtaatttttctagaatttttgttgaaatttactagttggtgttaatacgggaaagtttatgtgcactttgccatggtgttttctgttacagagcaactttatcatagttaggaacttgggtgtggctctagccgctcccagtcgaatgtttctaaattaaaaatccaaacaaaaatcactgaggtttacttgggacacaatctttacac

SEQ ID NO: 85472 - DNA, 772 bp, Oryza sativa
ctccacgaatataaagcgaataataagcacgaaggagaagaagttcacaaatctaaagtctcatgactgtcacgtgttgatgacacagctgctaccagttgtaataaggggtatcctcccagacaatgtccgggcaacaataacaaagctatgtgctttcatgaacgcaatttcgcagaaggtcatcgatcctgatagattaaaagccctgcagaatgatgtggtgcaatgtcttgtcagctttgagttgatatttccaccttcatttttcaatataatgacgcatctgctttgtcaccttgtcaaagagatcggtattctcggtcctttgtacctacacaacatgtttcctttcgagaggtacatgggcgttctgaagaagtatgttcgtaaccgtgctagtccagaggcaagcatcgctaaggggtatggaacagaggaggtcattgaattctgcgtagaatttattgaagaccttcgcccaatcggggtacctgaatcacgccatgaagggagactacggggaaaggggactctcggaaggaaagcaataatgacggtagacaacaatttattccgtaaagcccatttcacggttctgcaacaatcttcattggtggctccttacatcgaggagcacttggctctagttcgcgcaagaaacatcggtaagtctgatgcatggattactaggcatcacattgatactttctccacgtggctgcgacaacatctcatgggtaacgagacgattaaccaacaactggccttc

SEQ ID NO: 85473 - DNA, 610 bp, Oryza sativa
gacatttatagctgatgtgagagcagacccacatttcctaagttgcagtgacctggtaatcttgcaatgaagatggttcagagtgatagacatacagtttttcctttggtttatcggctcattgaattggctttgattttgccggtggcaacagcaacagttgaaagggctttttcagctatgaatatcatcaaaactgagttgcggaataaaatggctgatgaatggctcaatcatcgcgtggtctgctatattgagagagacatatttgcaagcattgataatgataagatattaactcattttcaagaattgagaaccagaaagatgaagctacctctccctagtggtatgtcttattcttgttctgaaatttgtgtactgttaactttgattctcattttctcaatccatggatgtaatatgtgattctttttccaataggatcaagatctggagctacaattgaagaattcaatgaggatgatatagactccgaggaagataacacgtagcaaggtatttgaaaatgtatttgtacttctttttcgcaccgcaactaaatttgtaccatacattttgatcgtgcattagtattagtagcaaacta

SEQ ID NO: 85474 - DNA, 549 bp, Oryza sativa
gtaaaagtgccatgaaacatgagggcagataattgttgttaaataatgatacattaagcttaaggtggcataagtgtgcctctaatatagcttccccttagaagtgaacagttcatttcgatgtccactgatcttaggacaaaatatatatgatcaagtgtcacagaccattctcatatgtcaggaaagttgaataatcatgacatgattaaggcatgcattgagttttgcattatttggcatgacatgatagctgagattgccttttgaagcagtgttattaccatatgaagtataaagtgccaaaccaattcatagctgtaaagatctaaatgcataaaatcaatgaagtaaaggactaaccctgaagaatccatgattggatgtacgtcctgctatactgttgaaatatcttaaggcacacttgatccaatcgatattttcctgagtcagaagaccataagtgacaacgtcggttgaacaaactaattgcacgatacaaaataccatgacaataatgatattgagccattgccggtacttttttta

SEQ ID NO: 85475 - DNA, 658 bp, Oryza sativa
ggtctgatcactcacttccatcatcatccataccatcgaagaacttggaaccttggttttcctgaggaaaactcagagggagctgtgtcagatcataccaaccagatatgatttcggatggatgtgccgacaattccaattacctcagataggcggatggaagtgctcggcgtagcgaagagagcgccctcatccatggaaggagaagagagcccccgttcatcctgctccaagccagagggatgcatggattgaggagtatgatctgtgtatcatatcattgcagaatgcttaattctctactaaatcatgatacagaggttgaaacttagaaacgatgaactgttcttgcttgcttcctacctacaatggcgtcgcggctgctcatccactcatcgactatgcgcttccaacctctgcattcgattcgcaaacaaacatgtcaacgaatgcaactggctaagaaaaacaaattcgatttgaatatgaacaatccaagacgagatgggaacacatggccatactcgatgagcaatcgaacaaggtgacgaatctgcttggagttgtgcttccggtagctgctcaccgccttcccaatctcggtaacctgcaaagacgaatccccatgaacacactagtcaacacatgagcttggttt

SEQ ID NO: 85476 - DNA, 681 bp, Oryza sativa
atcgagcaagcatggcggctgcaaagctcgctcacacctcgcttccctggtcatggacgccgtcgtcgtcgtcccggtgcgcccgcttcttcctgccgtgcagcgacacgccgaacagcttcaccgtgtcgccgccgtcggttgctggagtcttgggcggcggcggcgtcggcgagtgatcgggggagtcgagctccatcagcctgcaggaggcggcggctggaaggtggtgttgcgccgccgccatggccgtcgacgagggggtggtggtggtggtggtgaccggcgcgacgtggttctggaggaagtagatgatgtcgttgtagagcttcttcatgtgcgccagctccgacagcagcagcgagttgcgccgccgcagctgccggttgtcctccgacagcgccgccaggaagtccccgccttcgccgccgtctccggcgacagtacagtgcgccgtcgtggcgggctcttcttggattagatggtggtggtggtacgccggcggcggcggcggcagcgagaagggattgaggtggtggtggtggtggtagggttggtgcggcatcggcggcggcggcggctgcgacgacttccgccggtgaatctcggcgaggaggtgcttggctcccttcttgaagaactcgttggcgaactcccacctgtcagctactatcttcctga

SEQ ID NO: 85477 - DNA, 646 bp, Oryza sativa
aattgcaaagtggattccgcgaggccgtactcttttcattgcttcaaatgaaaggacaccaggcttcttttcacctctatcagacaggtaatcaacacattgtgtcagctgctcttcttgactcaccagcattaggatctcaggcacgatttacatttgcatttggtttctgcaatcaatttagatgtgactttagcgattcgtgttctcatggatttaccacggcacatggtttgtcttcttctgttatcaattacttcctccgtttcacaatgtaagtcattctagcatttcccacattcatattgatgttaataaacctagatagatatatatgtttagattcattaacatcaatatgaatgtggaaaatgctagaataacttacattgtgaaacggagggaatacttcaaaaacatccccattcttaagaaactctactagttgctgcagtactaatgcactttgtcattctggaatatttattttggttgggataatccatttttttatttatcacaccatggcttacccatagaaaaaaaccaataatatgtacatgaccagcagtgcaatgtcataccattgaatgcttataatttcatgacacaagctggctaagatttctattcgttttctttggcg

SEQ ID NO: 85478 - DNA, 719 bp, Oryza sativa
aataatgctgttaactgtggcagtgtggtattctttcctcctccgaaaggatgtagtcattcaaaggaagttgcatgtacttttcatgactactgatcacctaagcacttcatcaacatgcgcaaagagcagcattatttgagggtaatgtcatatatgactccttcaagatttgagatggttgttcttgtcccatccacctctttgacatgcattccatgtttttcagcttccttgagcactagaacatccatgctggtaatcaatgagagcagcgtgtcttagttaagcgaacacacaagttatttttaaatgatctatcaacacttgaagtagtacaaaatcaattaaagttagatggagagtaaaataacccaaaaaaaaaacatgggatgacttattgagagttgggattgctccagattttactggaatttgttacgagaagctccaaaaggtcccaactaagtgaaagggacaacactaaatagcttaattattttttaccacctttctgtattgcagttttttaaacagtacaatctggacataccaagtattatgctggcagtatgtgcaagatgtcagtacagtaatcacattctggcagtaccaagtaaaatatccacagtatgctgctacctgttctagcccagttaattgtaatcaaactactgcaagccaacctgtatattctatttgctcatgaatgcaactgg

SEQ ID NO: 85479 - DNA, 1095 bp, Oryza sativa
aggaccggtcttcgggcctctgttgcaaagactaccgtacttccacatgtctagtggtaaggcttagtttgtggctcagtctagtcataaacaaaagtacacggattggagatggatgaagtcgggggtcgatggacattctccagggcaaatgaaggctacacgagctgcggcccggtagtcgagatgtcatggcacagggccggtgtcctgctgctaggggctcagtcctgcctgcctgtcccgggtgttccggccgtaggcgggattgggtcggtactcttgtctatggctaggatgggttggaaactatgtcacgtcttccgtctgtataccgtggtggtatgtggcactgtggcacgtggttacacgtgaggaagaggtgtcttgtgggtaaagatgtacacctctgatcagagtataatctattcgaatagccgcgccctcggttatgggcaagccgagcaatgtacccaagttagtgttttaattcttaaaacttgcttaacaactaaaatgtggaatggttggcctgggttggcttaggacgagctgggacccagggtcgggttgccagttcggtctgaatcatcataggccttgggttaaggcaggttcgtgtgggttcacggccttgattaataatattggatagttctaggatcgtgtttacaaaatggccttgagcaactaaatgtctttaaatgctgtttactgcaaccctaacccctttttggtataattcccttgtactcccttgcatttattctgcatttgtgggtgtgtcttgttgagtacggtggttgtactcagtcttgctcaattttccccaagcccagatgaggagttcctggaagatgaaggctttggtgtctagctcgtgcctgccgtcaagcgcctgtggtcgtcgccctagtcttccgctgtttctcgtttgtctttgtgtgttgggccttcgctgcccgtgtaataattttatatacgcttccgcttgttaaactctgaattgtatcaactttggtgtaccttgcctcctgggacaaggataatgcacgcacgtcaggaacgcccgtcgggttatttccggtcgtgaca

SEQ ID NO: 85480 - DNA, 1796 bp, Oryza sativa
tgtgttcatctgtgttgttgttgttgttgtttcaggaaggatggtgtgatagccagggaacattggaggatgtgagagtgaagcttcacaagcgtcaggaaggggcgatcaagcgtgaacgagctatcgcgtatgcgtattcgcagcagatcgaaggcgctacgaaatgcaatgtatgactgaattcttgcagaaattctgtggcagtagatgtgatctgaatttttgctttgaactgcattctattgcagcagttgtgtactgaatttttgttttgaactgcattctattgcagtagttatgatctgaatctgtgttatttcaactgcagttttggactgaatgtgtaatctttcttgtctttgctcagcagcaaccgaagcctacttcttatggtcggctgaaccagtctggaatgttgcttaagcaccaacatttcgacaagagcaatggcaactggagctggctggagaggtggatggcggcgaggccttgggagaacaggctgatggaggagcacaaccagaccaactccagctcgccggacctcctgtcctccaagaactgcgaggattcattcggcattcttggggacttctccgaaccaaattcagtgaaagtgcgcaagaacaatgtcagcaagagggtctgcgcgaaaccgccggtagtatcacaccaccagcgcatcaaagctcagtcgatctcgtctctgagcactgaattgcacaatgatgagagctcggcatcgtcatcgtcgtgctttgcttcgacaccaatatcgttctccacctttgtcacgacggagaagaccgaggacagcatcagggcaaggccaaactacatgaacatgacggagtcgatcaaggcgaagcgaaaggcgtgtaatgctcaaagaacgacagcagggaaactgatggaggataggaaggcctcaggtgtcgagttgaaggtcgctcaagtttgaatttgcaatgttcttggagctgtaagctgagatgaagccaacttctacctctctagggtgtttgttaggtggattgctccatccacaggtttttcgatgtcttgctgctgcattcttgagttgtgtctgtgtcgccaatctcatgttcaacatcttgttgtcgagtcatcccatttttggggatgtcctcattgtcagtggcagtgtctttgtaagatagctctttgattgggaaaaaaatggtgtggatttgttgcagattgtgaatttcagagaaagggtgtcattacccatctcacatgatcctttagcacttctaccatactgtactactcctatactgtggtctcaagcaagtttccaacttccaaagctgaaaaccaatgtgctattacaatgcagtggttcttaatcattgaccattaggcatggagttttcttgttatttagggtccattctctaaaatgaccaattaggttgtgagaaactatgtttatattttctcttgccgacagacacacctagctgaacatgtaggcttacatgcctactacagcttagggtcaaatgactagagacaaatgattctaaacttgaacacctgatgctaaacttaagtactagtatagacaacagaaatcccagatcacttaaacaatggtcgaaaggcattacatttcagcttagcgattgccaagaccaagaacggggcagcatgagactgcagcagatgctcggtaacaacgtgcagatcgcacgctttgagaactaatctatgtcctgtgtgcacttttaacaggtataaactaatggttgggcatttaatggcct

SEQ ID NO: 85481 - DNA, 774 bp, Oryza sativa
actttctagttttctcaaaaacttttctcaaatcggctatgtgattctcaatttcttttgacttaaccaccacgtcatctatataaacttcaaccaaccagccgatcagatcatggaatatataattcatggccctttgatatgtagccccagcactcttcaagccaaaagtcattacaacccactcaaacaagccgattgcaccaggacatctaaaagctgtcatatgaatatcttcctctgccataaagatttgattgtaaccagcattaccatccataaaactcaatatctcatgtcctgaggcagcattaaccaactgatcggcaaccggcattgggtactcatcctttcgagtagccttgtttaagtctcggaaatcaatgcacactctgactttgccatttttcttgataaccggaactatgttggaaacccactcagcatatcggtatggatgaataaacccagcatcatacaaacgtttaacctctgccttgacaggttcgagcatataggctttgcatctcctcggcggctgctgatatggtctaacccccggtttgacagggagccgacattcaacaatcgatcggctgagtcctggcatctcgtaatactcctaagcgaagcaatctccaaattcttttaacaactctaacatggttctaaattccggagataaattcttactgatgaatgtcggtcttggtctatcgcctggacctatatcaatttcttccaaatcatcaatcgacataaaaccttgtcctt

SEQ ID NO: 85482 - DNA, 733 bp, Oryza sativa
tttaggcttttagaaaatatacaaaaatcctccaagcctcatttgacttttatctttgcacattttaattgttggaggctttctcatgaattttaattattctttgcacaatttcgaggatgaattttagagtcgatttgggacgcgacaaacctaccccccttaaacggaatctcgaccccgagattcggaagaactggcgaagagatcgggatgggctgccttcagctcgtcttcacgctcccaagtagcttcttcttcggcgtggttgctccactggaccttgcaaaaacggattactcggttcctggtcctgcgctccatggtgtccaggattttcactggcctctccacataggtcaagtcttcgcgaatttcaatttgctctgagtcggcctgctcggatggcactcgaagacatttcttgagttgcgacacatggaacacatcatgcacgttgcccaaggaggcgggcagctccagctggtaagcgacttctccgcgccgagcaatgatacggaaaggacccacataccgaggtgcgagcttcccttttgtctgaaacctgtgtacacctcgcaatggcgtgacccgaagatacacaaagtcatccactgcgaattccaggtcgcggcgacggttattgcataacttttctgccgggactgtgccacctttagattttcccgaatgaatctgacataagcttaagtttctctcagcatatcagtcc

SEQ ID NO: 85483 - DNA, 641 bp, Oryza sativa
cactttgtccttcaccaaccatcagtccatcatcagtgacctaacagagaagacctcggcccaccatcatttaaagataaagggatattcagagactagaatgttaaacacaaacttttacagttttactacactggtaattgcttactggggcctactgaaggacaaccaaagactgatacaacagcagcagcaaagaagcatggagattataagcgtgagggctgtaaacatgagtgtttggcattgattcagattttattggtatgggcaaacctctgaatttgatcaatgacaaactaaatagcacatctgagatgtatatcaatataagatacactattatgatgatgaatagatacactacatatatcaatataagatacaacaacagcagaaacgattactgtgtaatgttcctttactttcttcaggatggcctagttcatgtcagctttgttctcagcgtcatcgccctttaagaagcgcgagaaccaccgggccgatgctttgggatgccgggaaagcccatttttgtaatcaacataaacaatgccaaacctcttggtgtatcccatagcccactcgaagttgtccaggaacgaccatgcgaagtacccacgaacatcagcaccatccct

SEQ ID NO: 85484 - DNA, 741 bp, Oryza sativa
tgggaactcaattgcactagacagtgatgatgaggatctcataagaggtagccataaaaggagaaagagagatcggaagagaaagcgacggagatatgattctgacgaggacgatcttgatcagctgcttgaacttggtacctccaataggaggggcattgaatcgcaccatggatgttggtatctttcaactgatggcttttctgcttcatgggacattgtatgctatcttcttttttattaacacttttcattcagtgaagtcactaaattaacaccgtctattttattcggtatacttatgattgtcttgctactactgcaggcagacataccagatcacctttcctctcattatctaaaaacatggctaaagtttgcttgctttagatgatcctcacaacatgagttcaacaacccaccagttttcgggtgaattcatggggtcatggagatgtatgtacaggcttcgctctgttttccaacctcagatgcgcatctttaggccatgaattctgagagtaagttagtcacttcctgtaccccccacttgttaatcctttatttctttagtgaagttccatagtttgataagtacatgtaatataacttggttttgctttttgttttctattggcagtctctccacattcatctttatcattttaataaccgtgaatcaataatgcttcaacattattttgcttttattgccaagttttgatgacacttggggatcct

SEQ ID NO: 85485 - DNA, 1068 bp, Oryza sativa
atggaaaataaaatatggaattttctcagttctaaagaagtaggaattctagaccaaaattaaatctcttcctgtcagtctagcacttacaatataattgcaagatttattgtagcatctaacacaaacagacacagtacaaaagctgatgtttctcacaagctcaccagagaagcagagagcaaaagaaagcactgccccagaattgattggcagctgtgtcactgcaagcgtaccaaaaagaaattatgcttgttggttggcttttgacagctcatccatttccaattccttgactggtgctataaggcttcgagtagtgcctttaaggcataatccaccatcttccatttccttcaggagattctcagcagttctccagtccaaagccttgagacaaagtgactggataagtttgttgtactcatccatatttggctccatcccatcttccttcatctcctttaggcactccaaggccttctcaaactcctccatcttgcagtaaccacgaataagtgtgtgatatgtaaccctgcttagtcttggatgaatcctcttagcatcacgaagtagtgcatgggcttcatccatcatgcctcctttggcgtagccactcatgatcacactgtatgtataaatgtcggggcagatcccttggttctccatcactctcatcaaaccctttgcatcctccatttctccatttttagacaatgccgtgatgacaaagttaaacactgcgctaccaggagctgggcctagatttaccatcctcatcagcactttctttgcatcttccacgttgtttgtattacacaaaccatgtataaccgcagcataggactggccagcatccttaagagattccccctggtactcttccagcagctcaagagctgtattaatggtctcgtcattcctcgccaaagcgctaacaaggaaagttaaggccgaggtcggagcctgcaccttcttttcctttgcagttatgtatactgaatgtgcctcctcacggtcgtcttcccgcaaaagtacatcacaatgtcacagacgttctcgccatcg

SEQ ID NO: 85486 - DNA, 1365 bp, Oryza sativa
  unsure (1)..(1365): unsure at all n locations
gaatttttttttagattttatagtctttttcaatcttcaggctggacaatcaacaagaatgtgtgaaaatattttattcaaagagttctaactcatgttggacggtaaactttagttagaaaatagtgatggactcgtatttcctgccaaaatcactatatagaaaccatatgtcaaaatctgtcaaaactaggaactacatgcttcacattgttatcaacataatgaatgagcaagcaagatgtcaatctcaaactgaatgaatgacacaagcaagcgatcaaacttcatctagcgagtaaagagcccaaggcagctccagttcagaataaatgcaggcaagaccagcagatttgactgcccattgctaaaaaggaataacataaacaaagacaagtgaagaggcaggcagaacacaattatatcaatatccaaacggcagcttctcacataaataagataactgatagctcaaggttgagaatcaaaaaccgaaagaaataggttctttgagcagagtgcagaacataaacaaaaatgcctgttgcaaatgccaagactacagggtaaacttaaatgccatatgaagtttgtttggcagcataaaatgaaactactgtgataaggctactctctcactagtcatcttcttcntcgtcatcatcatcagcacaagcggaggagttgagagcattcaatctttcgacgagactggccttcctctgctcgtaggtcagcttctgaaggttgtatctgcaccatagagatggcaagttagttacatcatacatggcattcacaaatatcctttacgaaaatcatcagccagcttcatatacctcctgtgggtcgccggttccttcttggttgattggcccatggtaggatcagcacggatggcagcatggaccttcttgtacagtgattccatgccatcagcatcaattcccttcttgaggtactcactaaagtgggcttggatttctcaggttcctcctcagccatagactgcaacaagtacataagaagaaatttttatctgatgacaatcaaaataaagcagactgagctaaacagtaacaaataatccaaactttatataatgctttagtcaacgttataaacatcaaggcagctacataactcctaatacaacccatagcacgaacaattgatctaatagtgccagctcaccctcatgtagtcagccacgtgcccaccgtagatgtacttgcggtgaatatcagaatcaagctgcttctcgtccttcttgaacccagcaaacctcttgtcactgtgaggaatgtcaagaccaccatccatagctccctgcagaagaaaagagaagtatatccacatgagcta

SEQ ID NO: 85487 - DNA, 583 bp, Oryza sativa
gtgagtactatgaccagatggaattggaagggaaaggcaaactgcgggagtttggtgacagggattcgattttgcgtaattactcaactgtgctttatttcattctgaggctccgccagctctgcaatgacatagcactatgcccattagacctgaaatcatggcttcctggcagtggcagctcccttgaaggtatggcattttttcctgtttgtaattctggatttattttgtgatgatataatatggccataatacactcatcaaaattaaactgtgctgtttagattgaaccatcttgttgccaaagagatttcgcacactaagcattgtatgatagtagtatttcttttgatttttcttagaactgttccatcttactgtagagtgtcaaactagcaagttgagtgtaattggtttatctatttgaatcgacaaattgcatcagtacattggtgcttgccagcttaactttacaaacttgctacctatccgtcattttctccaatgggtcaactgctctgttgattatatcaatataacttagtaaaccgcagaaatcgctgcatagccagtgaaatca

SEQ ID NO: 85488 - DNA, 692 bp, Oryza sativa
gatcattattccatcagttcttgtagttgaagaacattttattttcctgacagttttacattatacaaaaataggctgtgcaaggtggtgaagtaggcttggttgtcgattgtgaatgggcagagccattttcagagaaaacagaagatcaggttgctgcagaacgaaggcttgactttcagctaggatggtataatttctgctcatattacttgcgtcacagtttcccacattagctacctttggcacagtgttatgctgcaatattgtttctgaaacaagggaaagcttctaccatttttttcttcaaggcaaaaaatgttttttcatggtataatgttatgctttgcacagtattgtcctgcatcttttttttttcatgaaacatggggaaaatgctgaattttctcccacaaggcataaatgctttgtgtatacaccgagagaaattgtaacatgtttttttttcatggtacaatgctcccacatcttttggctcagggaggcttaggatattgcgtgtcatagtcttacataggtgctacttttccttaaaggtacctggacccaatatatttcggtgattacccagaaagtatgcgtcagcgactgggcgatgatcttccaaccttctcggagaaagataaaggatttatcaggaaccccaattgtgtatgttttaagggattcct

SEQ ID NO: 85489 - DNA, 2073 bp, Oryza sativa
ggtttgtatcttcgattggatcttgaatttcctggttctttgaaaataattcgaagtgataatggtggtgaatttaaaaatgctttatttgaacaattttgcaacggaagaggtcttgaacatgaattttcttctcgtgttccgcaacaaatggtgttgttgaaagaaagaattctgttttggttgagatggctagaacgatgttggatgagtatcacactcctagaaaattttgggctgaggcggttaacactgcatgctatatttcaaatcgggttttcttgaggtcaaaacttggaaaagcttcttatgagctttcacatttgcgtgattttggttgcaaatgttttgtcttcaaatatggaaatttggataagtttgaggcacgctctactaatggaatgtttcttggttaccccgcacattcacgtggctatcgtgtacttgttttggaaactaacaaaattattgagactcgtgaagtttcttttgatgaggctagtccaggtattagagccaaaattgcaggtacaatgtcacaggttcagagggaggatggtcgtatttttgaagacgagagcgatgacgatgacgacgaggtcggctcggccggtcaaaccgggcgccaggctggtcagaccgccggcacactattggtatttcttaacgacattattagaaatatatttcacagcaatgtcgcataaatactcttggtatattatggttacagagttcatccgcaagcgcacggatataacattttagcattgcacccgagagtattccaagggtatcgtatttattttatcccgtgggaagatcgtgtagagagaacttgactaataatttatatgttacttgtgataatcatattctaaacatgggttaagataaaccaagcgtagaatgacacacaagcatttgctactcattcccataatatatgatgtaagccaagtggaaagaaaagagagagagataatctattcctatacttctagtatacatagtatacatatattctagttaactgatatactagctaataccctctatccgatgccctcctggtacttcgagaagccacccctgactgccgagttccttacgacagcccgtcatgaccatacaaccggggctaaaacggaggaataccctccccaggaaattaacttaggactatatacaggcgcggaggaatacccgtactgagctgtcaccatcagcggcccacctatcatccgcagcatataaccccaaataatgatatcccgtaatctagacaccctgtctaaactaccagatactactctaatatcatcgtcatgacatagagtaattgcatatgcaaacattatacccgcaccaaagcatctcccagataagctagcagcatattcagtataacatgaacataatgtaaagtaggcattcgtatactcgaaaaatatttcaataccataaatgtatatagaagagtattctaataaaagtacaaagcttacaaaagaggaaaggaaagctactagagccatacccgaactcttccgaagacttccggactcctgatttctactatattcctattccaccagctagatactactaaactaaacttgagagagtatgagaaagcttgcttgaggtgtgtgagtgaagtgagaaagtgaagtccttatatagaggtagttatgacggttgtggaaggggaattgtccgaagtgccctccaaccatcattgggatgcaatcctggacgtccacgccgaaccctgcatccaacggcgccatgatgggttcggccgaaccatgggctgggccatcccggcccatcttcggctggcggcctcctctattgcttcactttgtagacttgtgaattttggcccaatttatcgtgtcaattccaaattcctggcccattcatgcataagtctgattctcaacatcattcgattgatttatcgtctgtgttgatgtcgattctcctccactttatggttactccccgcaaaaggttagtataccaaatactagtggaatattattattgtaacatttatatgcattg

SEQ ID NO: 85490 - DNA, 1291 bp, Oryza sativa
ctcaaagctattttgtaaacacgattctagaactatgcaatgttttcagcccagcccaagaaggaaacaggcccgcaggtatctttccagggtataaaagtgcaaattcccctccggaaaccctaatccattcatttttctccttcctccccctttgtggcggctggtagactgagctgcgacgtgcaagcagccggcgccggcgcatgggagcagcatgaccccgtcgtcctctgctttcccaacacgatcttctccctccatcttctcccttagtccccaattcgcattccctttcccttgctgatggtctcgtgcaatcaaatctgcagtggacggtggccgtgtgcggaacaatggcgccggtgctaaaaggtaacaaagccggcagccggatcatggataggggcaacacaactgcctagtccccagatgcacccattaacattggttatgccatgctcaacggtgcaatgcatttgttcttcgctgatgcttggatagttggatgtgccaatattgtattctccttgtgtgttgatcctcgtatgattgcctattcatttttttctgttttatctattggttgttaacaaattgcctcaaattttctaatgatggttcaaattttgcaacaaattcggccaaattttgtccgaaaattccgaaatttccgaatttcgcccatttcggtaaggcccgaaattttctgcaattgaatcccagaaccttggtggaggcggcaatgaaccgcaagaacgtgtaggcgctcccgcaggaggagacggtggagggcgggcccggagtacgcgtgggtgcccgaccatgagaccggcgtgttcgtccccgccgacgagggcgccatctccggcaccgaaaaccacgaccactcggataacctgttctttgatgaatcttgttgtgtttttatcggatggaatttgctgggattgcttcgaattcgttgacgacgccgtcgatctcgatgaggctgcagccggggaccttgtcgatctcgttcctcctcatctgcctcctcaccttcaccgcctcgccgtgccggccattcgacgcgtaagtgttcgacatcagcacgtagtcgccggcgtccgcatcggcgtcggtggtgcgccgccgcatcacccgctcggcgcgctcaactttgccatgcgcgcggcatgcggcgagcagcgagccccagatgagcgcgtcagggtgtattggcattgccgcgacgagctcctctgcctcgtctagtctcccggcgcggctgagcatgtcgacgacgcag

SEQ ID NO: 85491 - DNA, 1244 bp, Oryza sativa
ccccatgccatgtagtaaggataaggataacccggcggcggcattgggtaaggcccccatgacatgtcaagtgaatgatgatatggaggtgattgcgaccgtcttgatgagtgaccaaatcgctccctaggaggtaatcttggtcttttccctttattgcgagctctctcaccaccttgcttctcatacttctccaaaagcatatcgaaggtcaccttagtcttcttaggagctttagaagttgagacttcgctcctattctctttccacacaccaaagactggattctttggcaccatcatctttggcctagttcaccaatgatcactcattttcccttagtagattcggcttgctccggccgaatcaacaccttcttatcattgaaattaattgtattcaccagaaaaggatcatgattaagcttcatcttggaaccatcggtgaacttcaatcgtccttcatctatggccgattgaacctatcatcgaaacacattgcaatcattagtagaatgagagtgagaatcatgccatttacaataagcacgatgttggtatttaatacggtcacagataaaatccgcaagcgcacggatataccaatgtagcacttcccctacggagtattccaagggtatcgaatccaagggaacgtgtgtggtcaaatcttcctccagttcatccaaggataccaagcaaaagataggttaggatagagaggatttactagtgagaaggagaaacagtatctagggaaagcttaactttaatcctaatgcaatacttcaggcactggcaacccgctgttcccagatgtcactctactacgtatccagacagggaggacttaagtgatctcgagggctgtcaccacctctacacccacctaaaacgtactgtgggatacacagcaattacgggataacaattacctaaacaccacgtctaagcaattaatatttacttcagtgtttataactcaccaaagcaatcactatattttagttgattatagtgaacaataatcacgtatgctatttaggaattaaccaagagataattctcacaagataaatctaaattactcaagaagaatattatattaaattcagagtaataaatagaataaaagaaataggagaaaattaccgacaactccggaattcttctgactccttttactctactctcttcctattctagtatacaatatagtacaatagagcctcttataatttatct

SEQ ID NO: 85492 - DNA, 2918 bp, Oryza sativa
atctttaaatgctctttactgcaaccctaaccctttatagtataactcctttgtactcccttgcatttactctgcacttgtgggtgtgtcttgttgagtacggtggctgtactcagtcttgctcaatttttcccaaaccccacgaagaggagtttctagatgatgaaggctttggtgtctagctcgtgcctgccgtcaagcgcctgtggtcgtcgccctagtcttccgctgcttctcgtttgtctttgtgtgtgctggaccttcgtcgcctatgtaataaattaactatttacgcttccgcttgttaaactctgaattgtatcaacttttggtgtaccttgcctcctgggacaaggattaatgcacgcacgtcaggaacgcccgttgggttatttccggtcgtgacaggtttaaaatcaagcaccgactcttctaataccagaaataatcccttcttcacattatagcaagatgcttgttgtgacaaatcatttgctctagaattatcatgcctagcaatatatctaatagcaaaattatcaaaattggcaataatatccaagcatgagtcaagatacctatttagtgatccgtcctagcatttgtagactctggcaacttgttgcaccaccaattctgaatcaccaaaaacttccacgtgcttatctccaaccaactccatcacttgtaagccgaataataaagcatcgtattcgggttgattatttgtacaataatacttcaaacggaccgatgcctcataacacatgccattaggtgaaaacaaaactacccctatgccttaaccatctttgcaagaagaaccatcaaaataaatctttcaaggtataacttcaactaagcaaacctcctcctcataagcaatatccacatgatggtctactaaaaaatcacatacaatttggcctctcatagattttaatggttcataagccaaatcatattcaatcaaagcatatgcccacttgccaattctcccacttagaattggcctttgtaacatgtgtttaataacatcggcttgacaagcaactatgcatgcactagataacaaataatgcctcaatttggtacaagcatagtataagcataaataaaatctctttataaagacataccttgtttcggcatccaaaagacggcggctcaaatatgtaatgatatattccttgccatcttcctcttgcgtcaaaacggcaccaatgactttgtctttggaggcaatacataaccgaaaaggctttacggttttaggcgcccgcacaacgggtgaagtagacaaatacttcttcaaccctttaaatgcctcttgttgttttgccccccaagtaaaatcggcttattttttcaagcgaagtatagggacaaaagcatcgattttacccgctaggttagaaataaatcttctcaaataattcgccttacctagcaacttttgaacttccttcttgcgtgtcagtgctttgaaatcacgaatcttctctatcttcttaggatcaatctcgactcatctctcatgcaccatgatcctaagaacctcaccgccgacacaccaaaagcacatttaagtgggttcatcttcaaaccagaccggcgcatcctttcaaaagctaacctcaaatcggctatatgtccctccataccattcgatttgacaacaatatcatcaatatagatttctaagataatacctaacaaatcatggaagatcaaattcattgccctttgatatgttgcaccgacgttcttcgatccaaaagtcatgacaacccactcaagcaaaccaacaaatcctgggcacctaaaagccgtcttgtacatatcctcctccgccataaagatttgattgtagccggcattaccatccaaaaagctaatcaccttatgacccgagacaccattgatcatcatgtcggctataggcataggatattcatctttgggagtagctttatttaaatctctaaagtctttgcaaactctaatcttacaactcccctttttctccaccgggactatgctagaaacccattccgcataacaacgtggcctaataaacccatccttcaacaaccgatcaatctcctctttgactcggtcatatagcaaaggattaaaacgacgaggtggttgtttataaggcctaaaacctggtttgattggaagccgatgctcaacaagctcacggctaagacccgggatctcatgatactcccatgcaaagcaatccacatactccttaagtagctcgattattttaaccttataatcggctctcaaatttttatttataaatgtcggccttggcttaattccatcacctatgtctacttcctccaatggattggccgatgtaaaccctttaccaagcttctccacttcatcaaaatcttcaatagtttcaccaatatcgttctttgtagaccgatattcttgcaccctcttttgcaacaactctaaattagcttctttactcattatacaaattgatatggcctagccgtgctatacaagccggctttacagagatgcaagaatagctagagagatccatccccgacaagcattgaatattcccatgacgccactcaaaagtagcatcggtcattgcaacctcggccgatgtatccgcttgaacaatctcaacatcattgtcgtctcattgaattaaacattgatgcaaggtagaaggaacacaacaattggcatggatccaacaacgacccaaaataacattgtagttacctttcacatcaacaatgaagaaagcggttggtagcgtcttgtttcccacggtaaactccgccgaaaagatacccttcgcctccgttggttcaccattgaagccattgagaatcatgttagtcttcttcaactcatcatcttcacgccccaac

SEQ ID NO: 85493 - DNA, 716 bp, Oryza sativa
tggacatgatcggagttgtcgatgtagagaaagaagaacatgacgtagaggatatacctgctcgtgcaggttcttaagtggacgaagttccggagacctgctcgttctcagtacctgtgcacgcaggaacttagaaccggggattgatagaagctgtgtaggaacagagaagaggggggattctaccataggaggagaaccagtggaagctgatcagaagaggggatcttctgtctatcccagaggataagattgaacacctgagaggaacgttacgagattgatagcgcattattctctagtccgttactagagtaacgtgaccattcatacctgtcggttacacctttcctcatagggtctagcccatttaattctaacaatctccacaaaatttcagagctcataggaaacattgtcatttttgcacctatttgttataccagtgtttcggtggagactgttaagttgaattttcacctagaaaagaagctatatttgaccacaaccgaacaatgggcccacgggaattatcaatcctgtactgtcagtctttactcaattacttaactgatactgggctgtcgttagcacctaatttgtttggagcatataagtcgtactaggcttttgcataagtatctagagatcacccaaatctcatggactgtgactagctgtcggagcgtgagctcttcgattaggggtccgtgagg

SEQ ID NO: 85494 - DNA, 3882 bp, Oryza sativa
atttgtgaattgtaatggagattattgttgttcatatatgtgattggtgatggattggatttgggactgcttgaattgggattattgttgttcatctgcttgattcgtgatttgtgaaagcatgcttgaatagggattattgatgtgcatcggctcggcttggagccgacttccttttttttttgaattcggtagagcacaaaggtgtcggttctatgaccggcaccaataacctagtgtcattggtgccggctggcaaaccggcaccaattgccggttgggaaccgacaccaataggggttttttacttgtggttgcttgtttatgcctattcacttgtctggggatgatacggagtgggaatgttgtgctgagccctaagttcttgcaaaaagtttcggaaggtcttatcgatgaaatgagaccctccgtcacttatcaccatccgcggagttccaaaacaagggaagataatctcatggaacatccggcaggcgtgcttggcctctgtggccctgcatggcattccttctacccacttcgacacatagtcaacggccatcaggatatactcgcagtcataggactttgggaaaggtccaatgaagtcgatgccccatacatcaaatagcttgacttgcaggttgtatgtcagtggcatcgtatcccaagcagtgatccctccatgcttctggtaccttgtgcatcttcgaacgaattcctttgtgtcatcacacattgttggccaaaagaatccattctgccagatctttgcgtgtgtcctgaatgctccatagtgacctccatatggggtagcatgacacacttctcaatgatcttcatgccttcatctactggaacgcatctccgtagtagaccgtctgaacagactttgtaaaggtaaggtgcatcccacaagtgcctgcggctcttgtagatcaacctcttcttattctctcccggtggcacatgcccccgaccatggagttgatgatgattgcataccacgggtcagaatctgtgactttcaacagcatgtcatctcacagatagtcatttatcggtagctcctgcatgttagtgatttgcatacgcgacaaatgatctgcaacaaaattctctaccccttttcatccttaatttgtatgtcaaattcttggagtagaagaatccacctaattagccgaggttttgcatctttttagtgagtaggtattttagtgcaacatggttagtacaaactattaccttagctcccactaaatatgacctaaatttatcaatggcaaacactatggctaggagctctttttccgttgtggcataattaagctgagctctagtaaaaattttactagcatatgtgatagcaaggtgctttttatccttagtttgcccaagaacagcgctgacagcaaaatcactagcatcacacatgatttcaatcggcagcaaccaatcagggggttggatgattggtgctgagatgagtgattttaaaggattttagacactcatcatcaaagtcaaacggggcatccttagctagcaaggtagttaggggtctagtgattttagagaaatcttttatgaaacgcctatagaaccccgcaagactcaagaagctatggactcccttgacattggcaggaggtggtaactatcgaattactacgatttttgctctgtccacctgaactccccttacggagatttgatatcctagtactattccttcacgaaccatgaagtgtcactttttccaattaagtaccaagtcgttttcctgacatctttgcaagaccctatctaagttctccagacaatgatcgaaagttttatcatagtaaaatcgtcgatcatgtcaaagaaaatagacaacatgcatctttgaaatgacgctggtgcactacacaacccaaacgacattcttcggtatgcatacattctgtatgggcacgtgaacgtgatcttactttgatcatcgggatggatggggatttggtgataaccagaatacccatcaaggaaacaaaagaaggaatggttcgctagccgctcaagcattacatcaattaaaggcagcgggaagtgatctttcttagtagccttgttgagtttcctatagtcaatacacatcctccatcacgtgacggtttgttgtgggcaactcgttgttcgagttttcaagaccatcatgcctcccttcttaggcactacttggacagggctaactgttggtatttcttacgatcacaaatagaatccgcaagcgcacggatatactgatgtagtacttcccctacggagtattccaagggtaccgaatcgaagggaacatgtgtgattaatttttcctctggttcatccaaggacaccaagcaaatgataggctaagatagagaggatttactggtgagaaatagtgtctagggaaatcttaactttaatcctagcacgatacttcaggcattggcaacccgctattcctagatgtcgctctactacgtacccggacagggacgacataagtgctcttgagggctgtcaccacctctacacctacctcaaatgtactgtgggatacacagcaattactggataaaattacctaaacaccacgtctaagcaattaatatatactttagtgtttataactcaccaaagcaatcactatattttagttgattatagtgaacaataatcccgtgtgataattaggaactaaccaagagataattctcacaaaataagtctaaattactcaggaagataattctattgatattagagtaatgaacagaagaaaagaaacaagagaagattatcgacagctccggaattcttccgacttcttctactctactctcttcgtaattctagtatacaaatagtacaatagagccttttataattcagctcaagcttgtaagcgtgtgaagaagtgaaggagtgaagctcttaaataggcaggtatgacggttgtaactactgcgaaatatctgaagtaccccacaactgctatcaggagaagatctggagtgttccagcacaacaagggattggcttttcaatgatgacaaaaatcatcactataactatatttttatcaaagttgctaccttgtgacgaacttatgattcgttgctatgtcatcactgaaattggcgtcacaaataacatagtgatgattttttttcaccacaaatactaattgtatttgtgaccaaaagtcttgtaactaatgatcataacaatagtgatagttaaatacgagatgtactagtgaccgcaacgacatcacaggtgtactcactccttccaaaactctaaaacctatttcattctttggtttttccaaaagtctaagtcctatttgtagtcattatgtgctaaattaaattgttgataggaacccaagaagccattttaatgcttattggtttggtcacatggtgaaagaattaattgctttttggtcttggtgcaaaaagaaataggactcacatttttggaaggagggagtacaagattgtgatggattatttcctcacgttttgttagtaattagtgagaatcatggtcacagttgtatgattcaataatgataaattttcatcacatattattgatatactgaaaacaatttctcacaagttaatttgttatagtgacgagattatataacgctatgaggaaattttaacttcaacaatacatctattgtgaggaaactgcattttattgtggcaatcttttcaccagataatattagcatattgcattagttttttggcaaaatttgctacaggacacttgaaaaacgtgtaattagctgagagacaccgcaaaaacgagacacggctgatgaacactacaaaa

SEQ ID NO: 85495 - DNA, 717 bp, Oryza sativa
attaccgatcatgtgtaatcaagtattaaatcagcacaaatttgatactttgtaatgtgtaacatgatacgttagttgctaattgccatcaatgctatgctacctcaagagattaagattctttgttttattgttcaggtattggtttgcttaaagtgggtggaaggattgtttactcaacatgttcaatgaatcctgttgaaaatgaagcagttgtcgcggaggtattttttgttgcttgatttaactttacttcctttgcccctctctaatattaatgtagtaatgtttgattgatcaaattatttttgttgcctttttctttgtcatacacttatacttgatgagaccctaaaatgttttcagtgtgtcaaatctaccatgggagtaacttttgttgagattagaccatctaggaatgttcatttttcaagtgtagcacttgttttcatgtcctgtgtaccttgttgtgacattgaccatatttttcataactaaatagattctacggagatgtggggattctgttgaacttcttgatgtttctaatgagctacctgaattagtcaggcgtcctggacttagcacctggaaggtcagtgtacatttctctgaatcatgcatatttccttgtatattttgtacactttgcaattttgcataattagctgcgactgtgatcttctgtggccttagagccaaaaaagaaaaaaaaaa

SEQ ID NO: 85496 - DNA, 674 bp, Oryza sativa
aagattggtggctaaaggttttaaacagagatatggtaggtgaggatgaggacacgtttagtcctgttgttaaaatagctactgtccgtcttattttatctcttgcagtttcaaaaggatggagtatacgctagttagatgttaagaacgcgtttcttcacggtgttctggaagaggaagtatatatgaagcaacctcctggatatgagaacaaaaatttatctgattatgtgtgcaagttggataaagcattatacgggttaaaacaggcgcctagagcatggtattctcgactttatcagaaattgctacaattggggtttgttgcatcaaaagcagacacttcattatttttcttcagaagaggagacgtcacaatatattttctagtatatgttgatgatatcatagtagtcagttcctcagataaggcagtgtcaactttacttcaagatcttcgtagtgattttgctcttaaagatctcggaaagctgcactattttttggggatagaagtgacttcgatttcagaaggtctgatcttgtcacagaagaaatatgcaaatgaattgttaaaccgtgcaggtttgaaagagtgtaaacctgtcaatacaccgctctctatatcagaaaagttctcagcatcttcagggaaattgttgagtgataaagat

SEQ ID NO: 85497 - DNA, 1477 bp, Oryza sativa
caccgttggcacattgctggacatcccgagtaaaacgaaggatggattgaagtcacgtaacgaccttgtagatttgtccatacggcatgaccttcacccagtagtgctgccaaatgggaagaccgagattcctcctgcttgttactcgttgacacttgaagagaaaaaagccttctgtaaatgtttacaaggggttagagtgcctactggtttcgcatcgaacatcaggaagctagtatcaatgaaggatttgtccatttcgggatacaatgcgtatgactgtcataggttgctaacggtgttcctaccaattgctataagggcagtcaaaccagtccatacaaaggtggttataacaaagttgtgctactttttcaatcgaatttcacagaaggtatttgatcctttggaattaggtccgcttcagacatttgccgtcgagactgtatgccagcttgagatgtatttcgcaccatcatttttagatatgatggagcatttgatcgttcacatcgtccctcagattattgaacttggtccattatacttacatcagatgtgggcctatgagcgttacatgtcgatcctcaaaggctatgtacgcaatcgcgctcacccggaaggatcaatgatagagggatacacaactgaagaggcagtcgagtgttgtatggactacataaaggatgctaatgccattggcattcctgttcatcgacatgaaggtagattgtctggaaggggtactgttggtaggaagcagttcttcgataatgattacaaaaaggtgtccgcggcacacaacagcgttcttcaacagctcgctatcgttgagccattcattgagcgacacctagaagaaatcaaagcctgcttcccagggcggtccaatgattggatatcaagagagcacaagcgtcgctttcctctgtggttgaaagatctaaacctgccagttggtgattctgtggaggaacttactttacaaagactggcatgtgggccttcaagtattgtcaattcatggcaaggttacgacatcaatggatttaccttgagtacgactacgaaggacatgaaaagcaccgcacaaaatagtgggatccgtgtcgaagcgattgacacgagtggagaaaagaggtcgtattatgggaccattcaagaaatatgggaactggactatggcctaaacatccagatccctgtgctccgttgtgaatgggttaaagacacaataggggtttccgttgatgactacgggctaacgatagtcgatcacagtaaaacaggccacaaggatgatccatgggttttagcagagcgtatggctcaagtgttttatgtgaaggacccttcagatgaaagaaaaactattgtcatatccggaaagcaacagatcgtcggcatcgacaacatcgaagaccccaatgattacaacaagttggacgatgtaccattggttactgatctttctatg

SEQ ID NO: 85498 - DNA, 605 bp, Oryza sativa
tgcaccccgatatttttcaaagatgaagctacaataagaagtatagtatctttctatggtatcaaggatacatttccgcttgagggtcaccttgtgactaggaatcctgatgctggccatgttaaaagaatatactacgtgtcaaaatcagtgcaagaagttttggagctcaatgtaaaagttggtgagcggcttaagattacctcacttggcctaaagatatttgtaagtgtctcctttaatttatgttttcttttatcaattttagcttttatcagtggggcaaatggcacgacactaagctgtgattcttgcaatatctttcaggaaagacagtcatcaaaggatggctcaccatgcacatttaggttgtcttcagagggtttaccactgctgctttcatacatcaccaaacagattctctacgcttctgcaattgacttccagcaccttttacaatacagaactattaaatttcctgattttgtggatgcaaaatttcgggaaaaagcttcagctttggtggctggttgctgtgttgtaagactttgggaaggtaacatcacatcccacttataagctttatagagaaacaccacaacttg

SEQ ID NO: 85499 - DNA, 589 bp, Oryza sativa
ttatcatattttgaacatttctttcttcttgatggtggttgaaatccagtatggcaatattactttttagttgatttgtttcatgtaacgttcctatttgagtttagtgtgtaggacagatagcgtttttcaaaaaaaaaaaaaaatctcagtcatgttaattgacctttgcttgtctactttattagctttaaaattctccatcataagtttggcatttctatcagaggaattattccgtaaacatttatgagcttgcatgctagcaactatttttttttattgtgctttaattagtggaaaaggtaatggcaagcaggaaatatgcaattaatatttgaatattgaaagcacttagaccaaaaacttctcacattgtttggagaactctgatgtttatgtcaaataacaaatttctcaccagatgcaaaggattggattgcaaccatcaaagtttacatatgatggttttatcaaggctgtcatggttgggaaaggagttgcatatgccatcaaagtggtatgctacttatagcctgctgtcaattatgatgtatccagttctctcaaaggatatagcggtaaactg

SEQ ID NO: 85500 - DNA, 751 bp, Oryza sativa
ctcagggtgcagatggtgcttggaggcgtattctacacggcacgtcgccgttactcacaagtatggcacagtgaaagtccgtaacgttgccaacttagcagcaacatcactaatatcctgggtatgcgtttgagaggttagaactcaatacgaactgactagatttgcaaatgttataggagtaaatcatttccccttacctcattaattgtttgtgatcgctttacatccatacaactactaatcttgcaaatggcattggagtaatcattttcaccataactcactaattgtttatcaattattcatatcaactaccccttaaatggcatacccatataactctacttgtgttgctatgttagatgaggtgacaaaaaatgtggaaactgcattggaggttgtggagcacgccgcggaggtgacagataagttagctgctaatgtggccaatgctctaccagagaatggtaccctgcataaatgggccgaggaggttgagtacattgctgagatagcggataaggatgcacagaaggttgaaatcatcataaagaaggtatgtatgtcaattgttgagtatatatatcatcatgtcaaggatatatatattattaatgagaatgttatgtccacggtacatgattagcatgctttctgtttacatgtagtagaagttacagctagaaacatcatatgcaattacatgtttctgaccatttcagactattgaattggcgttcgactaaag

SEQ ID NO: 85501 - DNA, 569 bp, Oryza sativa
acctgtttttcttgtatgtaatttgctatgcatatatgctgcatttttttttgttatttctatgcttcattaaaactgtacaaccttaaagaaatcttctctatgacttccagggcttgcctgcttctggtgttctttatgggtatcgtgttggtggccctcaaggatgggaccaaggccatagatttgatagcagcactgttcttctggacccttatgcaaaattagtttctggtcgaaagtactttggggttgctgaagagaagtcaagccagcattttggaacatatgattttgatagctctccttttgattggggtgatgactacaggcttccgaatttgcctgaggtactattatcatttggtaggattgacaagatgttccaaacatgaagttctcaattttttgtttctttaatctaggcagatctagtcatatatgaaatgaacgtccgtgctttcaccgcggatgagtcaagtggccttgattcgacttctcgtggaagctatcttggtctcattgataaagtaagtaccattttttgtttgtttatgaacacaactatt

SEQ ID NO: 85502 - DNA, 694 bp, Oryza sativa
ttcctgcaccccagattagggagttgaagtttgtgtttggcgcccccaaacattgggcatgataagccgaggaagctgtatagtggccgctgcttgtgaatttccaaacaatctgatccggctcctcgctgtctaagtgcacattccgtaccgcctcccataggcggactagctgatcgaggaggttgattgtgatagatgaacccgcatcgagggtcaggtcatgcacccaggagtcgtcttctttcccttgccgtagggatttcttcctatttttggagatctcatagaccaacggcattaggtcttttggtcttcggccgttaatccatgcggagtcccagaagcgcgtcgtattcccatcgcccacagttatctttgttgaggcggcgaagaggtccctatccacaccatcacaaggcgtttccaaacccacccaaggcttgcttggatctctccattcgttccacaaccatcgcaatctcagagctcttgtaaatttgtccaagcttaggacaccaaggcccccttggctggtcggcaagcatgtctttgcccagttgaccttgcatttccccccggtgatatcccccgtaccagcccaaaggaagcgacgtctctgcttgtcaagctgctccagggattccttcatcaccttcaaggcagtgaggagataaattggctgtgctgaaag

SEQ ID NO: 85503 - DNA, 528 bp, Oryza sativa
cttttaaaaatgctcaaatttgagaggaacagtactgaaataatattcctgatttggccaaaacgttggctttgtgatgctaacttgtttatctccactaaaaggaagaagtgctgaatggtaatcttggctagttcattgcctcacttctaggatgctttcacctctgtttgtttgagtgcctgactcaatatttttgtccatctattatatagtagtcatggaaggaataatcttcacctgtttttcttgtatgtaatttgctatgcatatatgctgcatttttttttgttatttctatgcttcattaaaactgtacaaccttaaagaaatcttctctatgacttccagggcttgcctgcttctggtgttctttatgggtatcgtgttggtggccctcaaggatgggaccaaggccatagatttgatagcagcactgttcttctggacccttatgcaaaattagtttctggtcgaaagtactttggggttgctgaagagaagtcaagccagcattttggaacatat

SEQ ID NO: 85504 - DNA, 509 bp, Oryza sativa
tttgaatgagcctgatctaaattcgattgacatggaggtagacaatgacaatgtagaatgcaagtacgggaatgcaggcgattctactagtcctgaaaatggcaaacatattgaagatcagattattgattgcagaatgactgctttgaaagatcatgagatcaataccgatgtcaggataagagatgtcaacctcaattcatgtttagatgcaatgtctcctcctgtttctggtgcaaattatgaaacatctaatgccatagatgacaataatagatcatccatcattgcccaatgctttggtgctaattctgccgatgacaatgcttgtaaggaggaaaattttgtaaacaaccagagcagtgtatccaaggctgaaagcttcaaccagaacaatgacatgatatatcaacctaatttgaccatggatcctatctctcctgctcaaattaatgtggattgttttacttcttgttcaatgacatctgaaattaagaacaatagcaaca

SEQ ID NO: 85505 - DNA, 571 bp, Oryza sativa
cggcgttcgtcggcgagatccacatcctggtgacgacgccggccgtgctgacttcgcgtaccgggcgctggcgaaaacgagcgaggcagcgtacgacgccatgttcggcgtgaacgcgcgcggcaccttcctgtgctgccgcgaggccgcgaaccggctggcgcgcgacggcccgggggcgcatcgtgacgttctcgtcgtcgggcgtcgggtcgctccggccggggtacgcggcgtacgcggcgagcaagccggcggtgaaggtgatgaccaagatcctggcgcgcgagctgcgcggcacggggatcacggcgaacgcagtggcgcccgggtccacgggcacgccgatgatgtacaccggcaagacagaggaggacatggcgcggtacatcgccgaggcgccgctgggccgcctcggcatgcccgacgacatcgcgccgctcgtcggcttcctcgccagcgacgccggcggctggatcaacgcccaggtcatccgctgcaacggcggcactatctagctaccctggcctgcgcgccaaaataaatgatttctccgttctaaaatataaca

SEQ ID NO: 85506 - DNA, 559 bp, Oryza sativa
caatgagggcagccccccgctcctcctacacttgcttggcgatctccgccagcaccttcttacaggtctcaagctccgagacgtgccggcggtgagccttacggcccacctccaccatggcctccaccgagcgtcgcccctcttcgacatgcgcccacgcggcgtcgagctccgcccgctctgcctgcaggacctccacctgggcacttaacccatccaacaccgtggtgtttgcggcggccaaggcctgcagaaggggctctgcgttcagtggggcgatagaaggcgtggggaagagccgccttggagaggatgccacgcggctcgggccgctgatggaagtgccggactcggggatgtcccccggacccggttggtcctgagcgtcgcccgagggagtgggcccaagcgacgcgcccgcagcctcgttgccagctgccccagaagttgtcgcctgagcgtcgcccgagggagtgggcccaagcgacgcgcccgcggcctcgtcgcgagctgcctcggaagtcgccatcgcctcgtcctggcgaaatccgacttcctc

SEQ ID NO: 85507 - DNA, 570 bp, Oryza sativa
ctcttgcgcccccgcgccgccgccgccgccgccggagaggaccgcgtcgaaccccttggtggcccagcgccgcgcgagcgtcgtcgccgacgacgaccgcgacatgaagtccgggggcacgatggcgaactccgagagcacgggatctatggcgcggtagtcggagccctggagccccacggcgtaggtggcgtccggcgtgctcacgcggaggtgggtggacaccgcggcggacagagccaccggcgacggcgaggcggcgttcctcgccgtgaactccgtcgccagcgcctccgggtgcagcgtcacgacgcacctcgcctcgacgccgctcgcctccggcggcgcggcggaggccagctcgacctcgatggagcccgtggggctccccctgacgtcgcggagcgaccatgcgccgctcggcgaccacggcggcatcccgtcaccgcctccgccggcggcgccgccgcagcggaggtccagcgacacgccgccgcggatgacggcgcggccgccgaggccctcggcgacggtggtgtggatcacctcggtgggggcgccgtgccacat

SEQ ID NO: 85508 - DNA, 697 bp, Oryza sativa
cacaaaagaagagggaattccgtgcgctccatcagggcaacaggactgtgacagagtacctccatgagttcaatcgcctcgcgcgatatgcaccagaggatgtccgcaccgacgccgagaagcaggagaagttcatggcgggtctggatgatgagctgaccaaccaactgatatctggggactacgccgactttgagaggctggttgacaaggcaatccgccaggaggatcagcgcaacaaaatggacaggaaaagaaaggcggcgcagttccggtccaaccaaggcagtcagcaccgaccgcgcttcactcccggacagcagggtggacctaccaccatgatcgtccgccagcaccgcccgttcaactccagcaacttccaccagggcactagtggcagtcagaaccaccagggaggccagcccaaccgcggtgcagctccacgcccaccaatggcaccggcacagtcagcccagcccgcgcaagccaagaaggagacgggagcaaaaccagggtcctgcttcaactgtggcgagcttggccacttcgctgacaaatgcccgaagcccaggcgtgccgggccaaggtttatccaggctcgtgtcaaccacgcgtctgcggaggaggcacaagcagcaccagaggtcgtactgggtacgttccctgttaactcaatccctgcaacagtactttttga

SEQ ID NO: 85509 - DNA, 809 bp, Oryza sativa
aaaaaaaactgaagagttaattgcagatattgatgaatgcttactgccaaactactgcaatgggacatgtcaaaatcttcctggaaattttacatgcactagttgcccccgcagaaaggagtttaatccaattacaagacagtgtgttgcatcagctaagcaacacaatcttattataggtaagtcatagctgacagattagtcaatcttattgcattaagataatgcaaagtggcttcacggcacaaaaataatgaatggctgtaggtattacaactggtattactgtggcattggtttcataattattgcattaggtgcaattattctagccaataagtggaagaaaagcatccaaaagagaattagaagagcatactccaagaaaaatcagggcctactcttggaacagctaatctcagatgaaagcgccacaaattaaacaaggatattttccttggaggaactagaagaggcaaccaacacctttgatgctactcgtgttcttggtcgtgaaggacatggcacagtttataaagggattctatctgaccagagtgtggtggccattaaaaaatcaaaaattgtggaacaaactgagatagatcagtttatcaatgaggttgctattttatctcaaattatccatcgcaatgtggtgaagctttttggttgctgtctcgaatctgaggtgcccttactggtatatgagttcataccaaatggtacattgcatgatcgtcttcatactgatgttagtgttaaatcctcattatcatgggatgatcgaattaggattgcttcagaag

SEQ ID NO: 85510 - DNA, 580 bp, Oryza sativa
ccatgtgtcccaattaaagaagtgtttaagggtacctgaagaacaggctaattcggaacacattgatatccaagaggacctaacatatgtggagaagccggttcgcatacttgacactagcgaaaggagaaccagaaacaaggtcaccaggttttgccgtgttcagtggagtcatcattcagaagaggaagcaacctgggaaagggaagatgagttgaaggccgcccatccgtacctcttcaccagctccaccgaatctcggggccgagattccgtttaaggggggtaggtttgtcacaccccgaagttttcctcccaagtcaaaattgtaatttataattgaccctaagaaaatgctggtgaaatcaggagaaaaccctaagaaagtaatgcaaataataatcggatctgacatgtggaatttttcttgaattctacatgtcgaaattcattaacaggatttttagtggaattttcagagctctagaaataattttaaccaattaaaaatcactaaagtgcaattgttaattccagggaaaatcctttttccttttctttttctttttcctctcttttt

SEQ ID NO: 85511 - DNA, 1271 bp, Oryza sativa
ccacccaagagggagattgaattccggattgacttggcaccgggaaccgctccaatttacaagagaccatacaggatggcggccaacgaattagcagaggtcaagaagcaagttgatgagcagctgcagaaagggtacatacgaccaagcacttcaccttggggcgctccggtcatttttgtggagaaaaaggataagacgaagaggatgtgcgtcgattatcgcgcacttaacgaggtcacaatcaagaataaatatcccttaccgcgaatcgacgatttatttgatcaactgaaaggagctaaagtgttctctaagatagacctgcgatcaggctaccaccagctgagaatccgggaagaggatattccgaagacggccttcaccactcggtacgggctatatgagtgcacggttatgtctttcggacttaccaacgcacccgcattcttcatgaatctgatgaacaaagtgttcatgaaatttctggacaagtttgttgtggtattcatcgacgacattcttatctattcaaagtccgaggaagaacatgaacaacatctccgtctggtactcgagaagttgaaggagcaccagctatacgccaagttcagcaagtgtgacttctggttgacggaagtcaaatttctgggccatgtcattacagcccagggtgtagcagttgatccatcgaacgtggagtcagttacaaaatggaccccaccaaagaccgtgtcgcagattcggagttttctaggactggcaggttattaccgccgattcatcgaaaacttctccagaatcgcccgacccatgactcagttgcttaagaaggatgagaagtttaaatggacagctgagtgcgataagagctttgaggagctcaaaaagaaattagtatccgcaccagtattgattctgcccgacccgacgaaagacttccaagtctattgtaatgcatcccgtcacggacttggatgtgtcctaatgcaagagggcagagtggttgcgtatgcctcgcggcagttgcgtccacacgaaggaaattatccaactcatgacttggaattggcagcagtggttcatgctttgaagatctggaggcattatctgattggaaaccgctgcgaagtatatacggaccataagagtctgaaatacatcttcacccaaccggatctaaaccttcgacaacgaagatggttggaactaatcaaagactatgacatgagtattcactaccacccgggtaaagccaatgtggtggcaga

SEQ ID NO: 85512 - DNA, 688 bp, Oryza sativa
tcgtaaaattgaagtacatagaagccaaagccatgtcatattccattgctgttatctgggttgtactattggcaacaagaggtttgggagttttggtggcggtgttgcaggtaagctcgaagccgtcccgaaagcagcctcccccaatcccgaaggggtaggagatgccatcgacttccccgcagctagaggggcagtgagcgagggagtcattagaagggacaatcaagagccctccaccaactccatagactgaagccaatactcgtggcgtagctgccgagcacaccagcacaaaagaagtggcacaaactgccagaaagctcgagctcatctttgcgccagccggcttgcccttcctggtgtacgtaggccggtgcctgttaactaccgatcaatttatattcagaggcagccatctctttgtgctcacgctttcgtggactttataagtatagatgccagattaataccagccactccccaagcgctatgtataaaacatatatggaggaattgattggcttatactcgatcggcagaaaacaattttatcgcaataatttgccattgatcgacgaagtccaggggcactagtcgcatcagatatcccggtcgttgctggagccaacgactcgtccaactgccggtcgctgctcgcttctacgtccgattttctcctcgcgtc

SEQ ID NO: 85513 - DNA, 516 bp, Oryza sativa
ccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaaaatggctgacaaccgttctgtagtcgaacaggctcaagagatacaaaccatggctaaggaactcgaactccttaagtgtgtcttacccgacaaatttgtggccgggtgcattattgcaaaactacctccatcttggaggagtttcggtactgcactcaaacacaagagacaggaatactccgttgaggggttgattgcgtctcttgatgttgaggagaaagcctcggaaaaagatgccgcgtctaagggcgatggtgggcagtccagtgccaatgttgtgcacaaggcccagaacaagagcaaggggaaatacaaagctcagcagaccaccaacttcaagaagcaga

SEQ ID NO: 85514 - DNA, 2337 bp, Oryza sativa
ccgtggatgagggggaggaggcacggcggcctcggacagctagccgagggcgtggcagatgactgcatctggccggcgcagcagcgtttggaggaagggtcggagaccggcttggcgcagagaggcgcagccaatggcagcggaggccggctcggcgcgagaagcgcggccggcggtggaggaggcgaccttggtgagtggaggagctgccagtgggtgtggcgcggtcttcggcgcacgaaggctagccggcggagggcgccggtgcaggggtcccacatgtcgacagaggttgattggcagtggagcatcggtgtgtcagccgtggtttcgcaggtggtgagcggcaggtgaaaacccagcccggccttggccggaccgacaacaatggttaattccccctcctgagggcgttgtcgtgctgtctcgcccctcaagggtggttgccgggcgaaagcccagtcctggctcctttgatccttgacggacggcggcggcggttttccgtcgcttctcttcttgaaaacgtcgttttggcaccctcttgcttgacgatctcgtctgtgttcctttgttggtctagcggcggtcggtcacgcttagcggcggccggtatggtgctagccttctcccggacttgtgtttaggcgttgtcggtgtgtgggtggtggtttattttttctttttcctggttacgaccctccagggttgcaatcttataattttttcctgctctatcaatagaacttcgcaccgtctgtgcgagtcattcaaaaaaaattcccaaaaaaaataaaaaacatggatagacgcccttctaagtatatgtcaatttctaatacatagttcgcaaaagcgaacaacttttgaaataaaaccacaaccttagtatagttttaaatcacaatcttacaagctgcaattacccatagctgaagtccaaattttgtggttcaaatacagtaattgagagaatggaatttacagtggaaaagatgctcccaaatttggggatcagtggttcacacttatgatctatgaacggcatcttttcacccagatatcttccgttcagcgtttttcatcattatcacaaattcatcgtagttcacctgcccgtcgccatcggtatccgcctcccttatcatctgctcaacctcctcgtctgtcatcttctccccaagattggtcatcactgtcctcagctgcacacatgaacaagaacatggtcagaaatgatggataacagcttgaaaattaatggtctgaactgcttgaggtactaaaccacctcagttggggagataaaaccattctgatccttgtctaggacctcgaaagcttctttcagctcttcgtcgccatccccatcctgcgatacgcatggaatgcaattgcagagacagatattggaaatctagtttggcaaaggggaaacagatactgtagatcatcaaattaaagtatccatcaaagttcaagcttcaccttcatcttcctggcaatgaggctcaggaactcctgaaaatctatgatcccattgccatctgtatcaacttccctcatcatgtcgttgagctcctgatcggtcggctcaaggccaagagaacgagtcaccgcagccagctcttccaaggtgatgcatcctacatatatgacaaaggttccaatatcaaatgtcaattaggatatcatagacgcatagacctgaaggctgtaaatattagcaggatttcattgttgtgtaactgaagataatagccgtgaaaacatgcctccaatgctattgctatttgcttactagcacatagtaggtttttgtgcatatccaaaacgaagaccaagaccacaccatgtgcaaaacacggtcagaatcattgaccaagatagagacgtcaagggccaatgaatggtttaactactatttaataataactatgtgtatatcatagagttaatggcaagtagtggtagcacaaatatcagaaaagcagttttggaggacatattacggattacttaaggaacttgaccactagataagcatgtctcaacaactttttctaaacaaattaggtaggttacacattgcaaagattaaagggccctcactagtcaagaaaacgagtgagccaataacaagcacctttctgtcacaaactgaatgattctttgaccaaaggaagctctcaaactagtcgtgcagcaagcaaatccctgtcattgggcagcgtagaaacttcagggaaacgtttcctaagaacacagaaattccaattccatctacagctccagcacacaaattaaaacaagatgtaatacatatatataaaaaat

SEQ ID NO: 85515 - DNA, 523 bp, Oryza sativa
tatagggcgaattcgagctcggtacccaacagttatctgaagaatgccaaccttaagcatatagatagatcgtcgtgagaacgttacaacgcaatcccctgccttaatgttagagaaagacccgagagtagtcttcagaggaaccaatggagatagcctctcataatattggacctgcatagagacatacagccagcaaatcggaatatttgacgacatgatgcgtgtatcagtactaacaccaaaataaacattagacagctcaacaaattctattgagaagaaacagtttctcgagttcacttggaatattatctgcaaatacaaaacatcagctaatcaccaacaaaagacagatatatatgacatcatgcctgcacattactttctcagatggaggtccagaagtagtgttactatccaggggtgcaatctaaattgttggacgggacctcaaattggtgtggctaaggataagttgagtaacagaggttacaggattgctgatgctatccaccaatga

SEQ ID NO: 85516 - DNA, 1797 bp, Oryza sativa
actgaagataattgatagaacatgaatgaattgcatacttaacaattaacccttggtatttcaactctaaaacttgcataattgatcaatggctggccggaaaccacaagcttttgtagtgtgatccatatgcaacgaagtgtcgagtaatgcaggctgcaacaaccctcaagttcttttttgcttcaaatagtttctattgctaattttgatagtattaacttcatgtatgaatggaagatttagagctccctgttttcttgattctgatgaccttctgtttgttgtgccatcattaattactgtaaatgatctatgcagtatgtcgacaagcttcttattgccaaagataccaatcaaattaccattgatatattggaggctgtaaggacgaatgatgtgagggcagcatatcgcattcttgtgttggctgatgtgagccctaacatgatatatgatgagttaaacaatgatgttcatcatgatccttcagtaacagatgggaagttatttgatccagcatcttgtgatgtaaaggatgattctgggaaaccagaaggttgtctacaaggctgttccctgttgcacattgcttgccaatatggccattctataatggcagagcttctgcttctttttggtgcggatattaataagcaagacttccatggacggacaccgttgcaccattgtgtccgaaggaaaaatgatgcacttaccaagcatctgctaaagaggtaggattgaatttctagcagtatggaatatagataattacagctatccttccactgttgccaagctgaagtatcgaactctttacataaaggctattttttttttgtttcattcagcataaaagtacagaatgagacactgaggcatatatgatatgttctggggtcctgacaatgtctttagtatcttatcaatatacccaaaattgtataaaatcaattggatgacttgttcgccaaacacttggattcatactagtcatctcatcccatgtctaaggtccactggtctatggaggtttgtctcattttcagtctcatcatacctatagcgcctatcaggtggcattcagttggttggcataccacttgtgctgtgagttgtgccttttcgagatcatcaatgatgcatttcaacagtttagtaggaacagagagggaaacagcaacaaaaaagcattttcctttcctcaggctattattacaatccctttaatcctgtgtttgtcctcccattttcctcaggacaacaaaaaaaaccaattagtcactgttaatttttgtttgactacatggataatgttaaatggatttctgttccataggggtgcaagaacaaccattaaagatggtggagggttgactgctttagagagaagaatggaacttggagcaataactgatgaagatttgttcattttatttgtaaggtatgatcaagattagtaaaattgcttttcacaatattatcttggcaattactagcaaatgccagtttttcatttccttttcaacgcttgaaaccttctcttgttttcaaaatatgatattgtcttcatgtctgagaaataaaagtacatctcatatgctaaatatttgatcaagcataccctaagtaaaactttttaggagatatcgatctttgcagtttcctgaaatttcatgaagtagcttgtttatgcctgtttcttgaagccttatgttatttctagtcatgaagaattttgttacttagtggtgtaataggaatacttgttaagaaaaagggtctcatttgggg

SEQ ID NO: 85517 - DNA, 537 bp, Oryza sativa
tcgaattatagagtgaccatgcctgcttgaaatatctcaaatgggcatccatcactgcacttattgattccaagaactcatacttcttctttgcttcaatatttgaaagtgcgtgcacctgaattccttacaaccaaggagaattattggcttggcaaaatcaataaaattagcaacactatataaaaaaatgttcatacatactaggttaaagcggcatcgttcgaaagctgacttggcattgtgtagatcctgcaaatttggaattagagatgttgtatagaaattaaataaatgatcacttacggaaaaaaaaacaagttgtccctgttcacctcctcaagtcctgtcactacttctgctctagtccctttccgtactgatacaaatttttcacgtgcctgacaagcaagatagcaacatatattcttatagggcaccacatgccaaaatgaagaaatatgcaaattgaaaactaggtaatcacatagctagagtgcaagatatcacctgatcataccccactgtagccctatc

SEQ ID NO: 85518 - DNA, 653 bp, Oryza sativa
taagatcggtatgaaggtggtcatgcagtgtgccattcgatatgaattcataaaccagcagtggcacctcagattcaagacaacatccaaaaatctttaccacattgcgggggataatttgtgataagataacaaccttgttgatgaattgatctatctcagtttgctcaacgatttttgattttttaatggccaccacacgctggtcagatagaatgcctttgtaaactgtgccatgtgctccacgtccaagaacacgagttccatcaaagttgttggttgcctcctctagttcttccaaggaaaatatcttcgttttgtttgtggcgctttcatttgagattagttgctccaagagtaggccttgatttttcttgaaatatgctctccgtattctcttttggatgcctttcctccacttattggcaagtatcattgcccccaacacgataactatggagccaagaccacaaccaattccaattgcaatacctgcatcaattcattttgtcataataaaatcattttgcatgttggctattacttcttacggtcttacctaaaagaagattgcgttgctttgctgatgtaacacacttctttttgattggatcaaactcttttctatgcgggcagcttgtgcatgtataatt

SEQ ID NO: 85519 - DNA, 628 bp, Oryza sativa
tcacacaactcacttgatggccccataccggacgcccgcacacacgccgtcgctgctatagcacctgccgccacccctccggcccccgctcgccgccgccacgaccgatttggcccccgttccccgcgtacatccgtaggggaatagaaaggaggatagaaagggagggaagggagataaagggaggaggaagaagggaaggagagaggatgacatgtgggcttcacatataagtgggtcctacaatattttttttggatgaaaaatgggtcccacatattttttttaattctactgccacataagtgccacatcaacgccacgtggaacgaagcccaagtcaacaccgccacgtacgcatcacgtcagcgaaaccgtccttcaaaaccatcgagggaatcaattgcaccggttttaatagtcgggggttgagatatccggtattgtggtttagggatagggatggcagttttgcccatgggttcgggtatccgcggatacccgacccaatgggcacgggcatgggtgtaaaattttacccgtgggcttgtccgcccaagacccgtagacatcgtgggcaacagccgggcttcattttttacctgtgggtaacccatgcctgacccga

SEQ ID NO: 85520 - DNA, 674 bp, Oryza sativa
gtggatcaagtcagagccgctcaagtaaatgatccggaaatagcagaattgaaaaagaacatgagagtcggaaaggctcgggatttccttgaggatgagcatggcacaatctggatggaagaaagattgtgcgtaccggacgacaaggaattgaaggatctgatactcaccgaagctcatcagacccagtactccattcatccaggcagcactaaaatgtatcaagacctcaaagaaaagttttggtgggtcagcatgaggagagaaatagctgaattcgtcgcactctgcgatgtttgccaacgagtgaaagcagagcaccaaagaccagcaggtttactccaacctctccaaatcccggaatggaaatgggaggagattggaatggactttatcacaggactgccccggacatcatcgggacatgattcaatctgggtagtcgtggatcgactcaccaaggtggctcactttataccagtacataccacctatacgggaaagagattggcagaattgtacctcgcaaggatcatgtgtttgcatggggtacccaagaagatagtctccgaccgaggtagtcagttcacctcaaagttctggcagaagctgcaggaagaaatggggacccgtttaaatttcagcacggcctatcacccgcaaactgatggtca

SEQ ID NO: 85521 - DNA, 582 bp, Oryza sativa
attttcaagcaaaaacatatttcaaagggaaaaattggaagtaacatcctaacctcctttacttccccatatgttccaaaaatctggcgaacttcttcattggaaactgagggatccaagttaaaaataaccagagttccctggtttaaatctttatctgatggattctcctacaaaatcaacatggcaaactgctaagtactttatggtaaagggactaagcatttgaaagtgaaccataacataataaaccttcgggatggagaaatgaatgtccaactttctcctcctcagaggcttgttctgcaatccacgcatcgcaccacgtgcagctcggatatcaaaataagatatcatcacaaaacctctatgtttcgttgcagtataaagtgttcggatatccccatattgctgaaatacaataatggatattgtaaagatcaactgagatacattataagagaagtgcagacataacactgactatgagttgattagacagcacataaagttgttcagttgcaaggtatacctactgataagtaacactaacaaatcaatctcagatggcaataattatat

SEQ ID NO: 85522 - DNA, 1193 bp, Oryza sativa
gcccggccgagagagaaaagcggggaacggagggggagaaagaaagctcgcgctatgccggtttagggaggaaaaagaatgggagcgggaggcgctgcctccggtttttggacggatgcgggcggcgcggctcgggccgcgtgctggcttgcggggcaaggcgcggcgcaggcggcgcatcgcggcagggcgcggggccggacggcgcaagcacgggcagcaggcggctgacgacggcgacaaccgcgcgggcgcacgggcgtgaagtaacggcgcccggggagcttgccggggatggaacggggaaagagtgcgggagaaccaaagagagagggagagctcggctcggcgtcggctcacaagcatgggcacgcgcacgcggcgcacgggcaaaacgaggggagaggttaggaagagagagagagatgggccgagaggaatcggcccaccgaacctgagggaggcaaaatagacttttgcggaggaatttgatttgggaaggatttggattcgggatttgaatttgacgatagatcggggattcgagatcagggattggcacggagactgacaacaagcaaagaaacagatttcgcaattagggttttaaatttaaattttcccgctaggcgccacgacggaacgggcgctacagtgtgggacccaccccttggagatcgatttcctcggtctaggtctcggtctacaggggatgcggatgccggccaccccgacggcagcagggatattgtttgatggtgcttccacgctagcgccggctgaggatgagtttatggcaaacgtgggcgacatctcgttcgccggtagcaactagtagcaaaaacaaataagtgatttatcgtttctagaccgatcctgaatcaaggatatactcctttctgtcaaaaaaaaaatcaaccttgctagtattggatgggacataaactatacaacgagcttgtctagattcgttgccctaggtcatccaatattagatcttttattcaatattagatcttttattggacggagggagtctttcatagtatcatttcgtttatcatttcaattcgtttcatttcgtgtttcaatcatagctagctagaatgctagaaaaattgtcatagttcattttcatgttttatcagaaccgaggctggcttgcatgccagcagagtatgtctcgtccattt

SEQ ID NO: 85523 - DNA, 607 bp, Oryza sativa
atggcggcgccgttgaatcgatcttggtgcaggcctttcatggcttcgggttcgaccgtcgaggtcctccagctcctccattgcttgtctgttgcctctaaaaagctcaccaacggctaccacggggcctgtttccacctctgtgcccatcactgcggggcccgcctgcgcccaacccgtcgccggccgccctttcctgcctcgcccctccagctgacccacacgaggggtgcggggaggccggcgagctcgtgccgctctgagcccgtgtgtcgccacctggggaagctaagatccccgggagccaccgtcgccagccgcaccaccctttagccgcgcgcgccaccgtgggcgccaaccctagtgccatgcctgtgtgaaagcagagagcgagagggaggaaggaaggagaaacatagaaagtgaagaggggaaagagagtaggtgctgacatggacacaccgacatgtggggtccacgtgggttccatgctggctcagctaccatatcggataaaaccgggatcaaacccatagaaggatctaaagttgacggttttgtaagttaagggatgtcgtatatctagttttgtggttaggacacaatt

SEQ ID NO: 85524 - DNA, 808 bp, Oryza sativa
tcccatcccgacgagtgtgtgcacacgcgttgggagagtaggcctccgaaaccacgcgttgctgcgacgtttgcacagacgggcgggcgatcaggtttttggggagcgcaaggcgcgactactcactgttcgtcaacatctacttcatcttcaccaacatgtcgaacactggagacaaggagaaggagactcccgtcaacaccaacggaggcaatactgcctcaaactccagcggaggaccattcttggggtataaccttattacattatttcaattagaagttttactgttaatgttcatcgcaatgtcaacattgtgtcattatgtgattgttgatgcttattcaacgttaagcatgctcatgttgattacattcaccactatcactggatcaaatcctattgtaaatatcatgtttattatcttgttattttggattaaaatatgccgaattatgaccaaatttccaacacctgcttcttttttcttcggctcaccgactcaccaccctcaccccttgcctccaaaacactggattgctgcccacccttgaaccgtatgaagtgatgaagatcagctaaagtagtttccttcaaggtttaccaaaccgtttaggatagagttaccaccaacccactgttatatagtttggggttacggccaccccacggtttgacagttaccatgaggtataccttggtttcaaaaactaaaaccacacatggtatcgcgtgataaccacacagttttgtagccctagtttcctcccaattggtgtattaatagccattgcattgagaaacactg

SEQ ID NO: 85525 - DNA, 563 bp, Oryza sativa
atctatccatgcatctatctatggttagtctctttagataggagagggcacttgggcacagaggaaggctattgcagtgccattgctagagttgccatcaagtgcaaagtaggcggatcaggcgtgtgtcatgcctgtggatttgtagtctatgtatgtgtcagctgctgagctccggtgtcgcagccttggtccctgtcgtgttatttccatcgtttttttccctccgccattgttcggtttaggtgttgtcatggtcggcgtccgtgtggacgacgtgtcttgtgcggtttgtctgtcattgagttggctccgtccgttgcttgctgttgtaaaacgcttgtggtgttcatggcggaataactaaacgtcgaatggaatgacaacttttttgcgtagtagttgggttggtctctgaatttgggaactgatgaatttccgtctccgcttacatttgttgctgggatgttttcttgcttgctttctttcccaagattgtccggcttggaaacggaagagcccatccacacaaaaagcgtgtggtgtacagcattgcagaatca

SEQ ID NO: 85526 - DNA, 638 bp, Oryza sativa
tttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaa

SEQ ID NO: 85527 - DNA, 506 bp, Oryza sativa
cacataaagtataggtgccagaaaatcactcattccctggaagaaagagcgctcgctgcatgagcaaacaaacaaagaaacctagacaacgaaatttcatgctttataggtctaaatatttagtgtagcatgattaaccctgtcacttgtaataatatggctacaaaacaaatgaatattctgcagtgccttgtgattcagcatgtatacattccttatatttaacaagaatcagggttatgtgatctagtggaagctttctagcaaatgcagtgtttttcacttaaatgacttaaactggcaggcagttttcttcatcagctgatgttggataattgcgggtgaagggtaatagaacgtgcaaacttacttggcaatagccaaggtcgaaattatagaaggaatacgtcaacaggatatcccgtagcacaagaacattttgattgtcatctccttcataatatggaactgatctatctgtcctcaccttgatatccaaaaaacag

SEQ ID NO: 85528 - DNA, 663 bp, Oryza sativa
gaaagctgctgtaagactaaacataagccaatgatataaccattatggaccatatgatgtggtggcgtggggaaaagatcaacttttttcttttaaattttgttcaaacctgttttaaacagaaaatagaaaagcataaggcattgtccagccaaactgaacagatgagcgtccatatctatctatctattatattattaaaacagctttgaaaggagacaccacgttcgctgtgagggttagaaattcccacattaatcggaaaaaaaagaaaaaaaaaagaaaaagaagagtccaagtagaagtacaatttaaaaatagctgaaattcggaattaaaaataagcaatattgaaagaagtttccatataagaacccaatacgagattaatcaaaattcgaaataccaataaaataaaaatccaaaattaaaaaaggaaatgagagtccaagtagaaatacaatttaaaaataactgaaattcggaattaaaaataaggaatattgaaataaattttcatataagaacccaatacaagattaatcaaaaattgaaataaaaataaattaaaatccaaaattagaaaaggaaatgagagtccaagtaggaatacaatttaaaaatagctgaaattcgaaattaaaaataaggaatattaaaaga

SEQ ID NO: 85529 - DNA, 564 bp, Oryza sativa
tgatgaggaggacgatgactccgaaaggcggaaccaatcaattgggaaaaagctatggtctttcttcactacatgacaattgcagagggctactgaataggttatttctagcgtttctgttttcgattcatgacatgccattcttggaactctaggttgtgtgcttggtgatgatgatgatgtactagtagattttcccacttcaattatgttctccccctgtaattgaaatatatttgtagtagacatagctttgatgggcgctcacagaagttagcttttgagaatgtacaatggcgcgatgcctgtaactgtcaagggttgaggcttgtaattgttgttcattttgttccaggatcagtttacgtggttgaccaccttgcgaagtttgtggcatttgtcaacgcgggaagcttttttttttctcgtccagacgaccagattgtcttccatgtctttgtgcatcttgaattataggactttgttgactggcagttcttcagcttgtgaaatagggggctcaacagtggcatccaggatcagggtaccgagctcgaattcgcc

SEQ ID NO: 85530 - DNA, 730 bp, Oryza sativa
acaatcaacaaataagttaatacttaaggatactttatgaatattcaacatcagaattggataacatacctaaggtccagttgcagcacagggtattttgacttcggatttgatataataaaaacattatcctggatttgcaattgtgtcaattcaggacagtaaatcagaagataagaactggcacgttgtgcacaagtggtagctttaaagtcaaataaatccttcaaccaattgcagtgcttgtaccttccgatcaatcaatgtgggaacatcctcttgctctggccgatccaagaaaacttccttaaatgggaatgacctagggggttaagatcatagatttggggggtttaataaagagtaagataaataatataggataaaatcacttaaacaaggaatatcacaaagtcaaattttgatcaataacatacttattgtctttggtctcattcttctttgttactcttctggccacagtttccaggactccctggtaggataaagaacaagatgagcacttctacagagacacatgtgcgatgtatacagtatagccaacaatatttcacaaaaagtaatgaagacattgaaattcagaagaggaatataactagtttaatacaaggaacttcagaagaagaatataactagtttaagtttagtaagatttttcaagcaagtaaatacattaacctaggtacaccataaactaatattagttgtg

SEQ ID NO: 85531 - DNA, 670 bp, Oryza sativa
tttgttctatacttcaaagaatggacattatcacattaatacctttttttctgtgtgattgtatcatgtttctgatttgaaactttttttttcaaaaaaaaaaagaactctagtaagagtgatgatcatgagcacagagtgatcatttgtgacatgtgagagttgagagcaagaagaagaagagattataagaatgcgggttgagcttacgggcggaggaagttctcgaacatccaggccttgagcacggcgacggacttctccggcaagccgcgctgcggccgccacgactgctggtcacctcgccggagctgctgcatcgcccagtgcttctggatgaacgacgactcccagctccgctccttctcctccagcgccgccgccgccgccgacgacgacgacctcgccgtcgccgccgccaccagctgtcccatcacccgcctcctcaccctcctgtacgccgccgccaccgcccgccccgcgaacgccgccgtcagcccgccgccgccgccgccggtggagcgcaccatgctgttgaacctcgccgccgtgctctgcatctcctcgacgcattggttgcacttctcgtccacctgcatctcatcgccattggttcgcaccaagaaacggtttcttaggtgttcgacgaggaactgagccaagaactcac

SEQ ID NO: 85532 - DNA, 744 bp, Oryza sativa
actataggaatcttttccaaagttatctggttcagtcttgaccttaaagactcagatgacaatgcatgaacagttacaactcgaccatcatagctgttgagagttacttttctgttggcacagtctatcacacctttatgtctggctaaccagtccatccctaggatgacatcaaggtctttggattctaacaagataagattggccagaaatggtactcccttaatttctattctgaccgaggggctatgttgcaaagaaagtgcttgattacttggggtactaaccatcaaaggacgtctaagatcttctacttccatcccatgatttcccgcaaaactcatagataagaatgaatgtgtagcaccagaatcgaaaagtactgttgcaggaactgagttaacaaggaacgtacccaaaatcacatctggagcatctgagcttctgcagcagcgacatgatttacacgagccttggatgctggtacagcagagttattctgggcagggacaaccttcacgcgacggggcttcggacacttgtcagcataatgtcctgggtctccacagttgaaacacaccacgggcttgctgccttgctccctcttggcaggttgttgctgtgctggagctgcaacaggacgtggagcttgattacggatgttgttgccagcattgttgttgaagaactgacgttgcggacgaacaacagacgaagaacctccctgtggcatgggctggggtc

SEQ ID NO: 85533 - DNA, 685 bp, Oryza sativa
cggcgtcgggcgagaagtgcgcctgtgacaactgatccagcaagaggaaagccgggaccggccgatcacgactcgcgaaccaggtgtgcagcgcgagatgtgccacgatgtggtagcccacatggttttcgccgctgccgatctcgcgcatggggaccggccgctcgggcgtgtccgcaacgatggtcagggcgcggggatccaggcgcagcggggagtccgagtactccaaatcgatctgcttggcatagtccgagaggtgccggttaacattggacaggcaggactccatcttcgcctggatggtgtcggtgctgacctccgcgttgagctccgactcgcgcgtttgcagttccttcaaccggccttgctgctcgctaacatccggcatctgcgggatgttctccatgtacaggctgatgcgcccgaggaccatggcgcgccgcgcttcggtgtccgtggccaactgcaggcgctggttggcacgtttgacggccgtgagcatgatgcggttgtcgtcgattcgacgtcgcacgtcggcgagtttcgtttcgacatcctggattgcggtcgtgatgcgaggcgtggccgaatccatcgcgccgctgcgctcgccgatgtagtcctgcgcggcccgcaagtcgccgatggagggcacctgcgatgcctccggggctgcaggaat

SEQ ID NO: 85534 - DNA, 807 bp, Oryza sativa
tctatccggattgatgaccttctgcgaaattgcgttcatgaatgcatatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatctagatggtacctttatgctctccaagcattcaaacatactttccttctctgccttgctaagagtgtagctggctggactcaagtaatggcttcctttctcctttagttctgggtgaaggtcgccgcgttgttccatatgctttagatcattacgtgcttccagtgtatctttcgactttccatatacacctaggaagccaagaaggtttacgcaaaggttcttagtgaggtgcatcacatcgattgcgtggcagacgtccaagaattcccaatagggtaactccacaaatatagagttctttttccacatcaccgcgtgaccatcttcgctctctgtaggctggcttccaggcccctttccgaacactactttaaaatctttaaccatagcaaacactgttttcccactacgatatttaggcttcgtacagtggtccgccttatgttcaaagtgcttgcctttcttccgtaccgggtgggttgcagcaaggaatcgacaatgacccatgtacacaaccttcctacaatgcttaagatacgtactttctgtttcatccatacagtgagtgcaagccttataccccttgttggactgaccggaaag

SEQ ID NO: 85535 - DNA, 572 bp, Oryza sativa
tccaagatacggatcggtttctccacataggtcaaatcctcttggacttctatctattcaagattagcttcttcggtaggtacccttaaacacttcttcaattgcgacacatggaacacattatggactcctgccaaagattgaggtaactctaactgataagcaacctctcctcttctactgacaatcttataaggtcccacaaaacgcggtgccaattttcctttggtctgaaaacgatgaactcctcgtagaggcgtgacacgaagatacacataatctccttcttcaaaactcaaatctctgcggcgattgtcggcataactcttatgacgagattgagccactcgcaatctttcctgaatgatctttaccttttcttctgcttcccttaggatatctgtcccgaaaacctgacgttctcccgtttgatcccacaaaagcggagtgcggcacttccgaccatacagtgcttcgtaaggagccatctgtagactagcttgataactgttgttgtacgaaaattctgcatagggtagattcttatcccaacttccaccgaaatctaaagc

SEQ ID NO: 85536 - DNA, 2712 bp, Oryza sativa
tgagccgctccttcaaatgtttgctgagtatcatttacagtgagaacagaatatagcttaaaaagaaatgaagcgtataggtgcataccagactgagtgcagtggttccaagaagaagcagataaagtttgccctgaagaaaagcaattcagctatcagatgaaagtacacgcacctcagtgctcacaagacaacatatattatcataacagaacagttaaactattgactactccaaaagcaagctagagcaaaattagtcagaagctagctagaactgagtgtaaccatgagagtataaaacaacattgacaggcaggaagctttggagcaacacatgataggaacaaaatatggagaaataacctcaatcagatggatgcttgaagcacggcttagaagaacaaaagcaaactctcctatttgtgcaagagacatgccaacctacaaggaaaataacatgagatcagtgtaactgcatgagcaataacagaagggagcacatgtaaagcaatcaagacttacaagaagagatgttttgttgctatagccaaaccctttaacgacaacagcaacaataaacgtctttacagttatcaccaaaatcacagctgcaaggagtatatcgacatggttccaaaggaaatggacattaattagcatcccaatgctggcaaggaaaagagcagcgaagaagtttcgaataggttcaatctgcagaaacaacaaacctgaaataagagaacatataatgaatcattaactacatgaatctagctaaaactttgactaaagcagtaaaagaaacataaaacaaaaaaaaagtgcattgtcattcaaattgtcacagaactgacaaacttcacccaaaaaaaaaagcatataatttcacggcaaggaattacttgttcaagtgtgtgttgtgcaagatcagttgttgatatcattactccagctgcgaacgaacccaactcaagactcaagcccaacttatcactgcactgcatcatagaaggccgcacatgagtaaacataagttttaggataccgatagaagagagcaaatagaactgttaaaaggataaacataactacattttcttgcaagaaaactgtgcatgagccataacagtaaagaaagagttgctgaaaactgaagagcaaaacttacaaagattagtgcagaaacttggaacagaagaaagatagaggcaaagcactagagtctgcactacacattcactataatacatgctataaatcaatctagaatagtgtaaaagatcaagtttagcaaaattgttactttcacaatttttctttgaataaatttaatgtttagcatcctttaccggatccagttagagtgtcacaacttttggccaggtttagtacatgtaacagttatctgcactactccagtcatccagtgtttaaagaaaaatagtttcccattactgaacaattgcattcgatactaacatacgagcagttaaagaaactcacccaagcaaacaacaagcagaatgcaacagctgccaactggtacagttcatttgtctgcaagaaatgcagaaatgttaatgtaggataacatgatgatctgaaccagaactaaattaaatgcaaattaaatgctcaacaaaactattcatgtagtgcctgtcgattatattcacctgagatgaaagacttatcatcagcttaagaaaccaaggcacaccagttcgggagaggatggaaaggattgtaaggaatgttatcaataccaccaacctgagaatgtcagaaattgtgacaaaagaatttaatccaacacctgattatattatggaacaacttcacagacaataggaagttcaaatatacataggacaacatgatgtcattatgaagatataaggcaaataaacttttgtgctgtcatgatgtaaaggcagggtagcactgctattttaagtaccaccatttagaccttgatgtggcatgaatttactgcaggagacatgattctagtgtacagattattgtagtggtaaaaaattatatgtaaataaaagtttcaagccaaaaacacactacacttacgacttggccattgatgcaactccttgaagaagaccagaagcgccactcagaattggaagaagtgcaaaaagaagaccaacagcacagtcctgagacaaaggaatgtcaaatcaccaatacaaggaaagtagtgaagctcagataaagaaagaataatcagtccactcgttcgattcttaagaagaagcaagcaaaacgtgcaactttacgaattcatctccccaaacaactcaacaaatttagaagatggtatccatttctttcatacctgcaatatgagtgtgccaaccgtaacttggccatgaagggcattgatgctatttctttccatcagaaatttcaaaacctacatagaaaatattttcccagaaaagttaagcaaaaggagatggaaatgggatttacaacacgaacataaccatattgcaagttatacgacattcaggaaacagttggcacatgagtcaagcaccatctacgaggtaacaacgtgctaaattgaaaaccatttggcatctatcgtctatgaaaggggtaatggttccactacgaaccaagacgaacagttgatttacaacaaaagctgcttgagaggatgtgtagcaaaacactaaaagataagag

SEQ ID NO: 85537 - DNA, 685 bp, Oryza sativa
tgacctgctcataagtataagtgtgtaagttactgcaaacattttttaaaaatgttctgtggccttctctattgaaagcaacttactgtagttttaccttgagatcttgcaggtcaatttgtccctcctgtggccatgaacttggagccctattctctggtataatggctggaggctctggtggaaggtgcatatactgctttattctctcaactgaaataatatagttttccatgtaggagtagaactttgtcaggaaaacctgaactgctgtcagcgacaaagcaaaggagaggctgagacccgcaaagcctggaaaagttaacattggaagtgttatacatccttgttggatgtagaggccgggttttaattaatccattatctaaaaaaaaaaactggaagcgttcattgttcagcatactgaaaataccattgtaagatgaacatgttaaggtgtaatggcttatgtacatacatacctggtgagactgctcctggaggagccaaaacaaggagcagtgctgctgttagtagtgtcaggctctgcagtgcttctactcttatgagaacccactcttgcgccgcaactgtgtggaagaacaatgtcgcgtcggtatcgataagaagtaggttattgcggatgaacctgtctgtttccccaaaagacctgatggtcaccaca

SEQ ID NO: 85538 - DNA, 753 bp, Oryza sativa
taattatataatatatagtgtatataacataaaattgagcataagtgcacacattgatagaattgatcatcacgtgaaattgtttaacatatagaaatactaattgataaacatatcaaagtgccaacatatggaatataaaaatgatagaaaatgataaattgggaagaaatcttacaatttagagattaacttttcgacgcttgatattttgaaaataatcgatgatgtccttgtccttagcttgcaaaaagaattccctttcaatgaatgtaaccaaacaatcattcaagtatttctgtcccatcttggttctcaacttgtttttgatgtagttcattgaagaaaagaccctctcaacaccagcagttgcaacagggagaactagaaccaatttgagaagtctataaacaagttcataccgacgaaccctctctgttttgacaagcatcatggatagttctgctagacctttcaaattagtgaatttctcatctttggtcacatcactaatatagcggttgagttgaaaagaaagctggttcatttcttcgaaatcaaaatcatgaggataaaactcagcaagcttaactaagctctcaacattaaaagctgaaaatcctttggatggattgaatgatgccatacatctaaggagttctgtgtttacctcatcaaacctgttattcaactcttgaagttgtctatcaatgacacccaaaaacatatcagcatgaaaccgatggtaattaa

SEQ ID NO: 85539 - DNA, 801 bp, Oryza sativa
cacttgttctagtaaaataacacggcatcgcatgccgagatgttgaggttcacaaagacgtcgtggttggtgaagtagcaaaacttgcgaagtagcagcaatagagtttgccggtgccgaagataataaagatgaagtcgctccaccatgatgacaaagttgcattgccgtgatgaagtgaacacgagttggcggcaacaaaagcaaaccggtagcgaagacgcgcagctgtgaagataaaagcaccagtcggcggcggcataaccagtcgacgatagaagacgatgatgtccatcagtagtggtagcggtataaaccagacgtagaggcgagggcactagtcagcagcagacgagacgaccggcgatgaagacgataagtccaatcaacactggcagaatcatgcagccatcgaagtgaagaaaccagtcggcagcagacgtagacagcttgcgttgaaggtgatgacgcctatttgtagtggcggcaacgtggccagccgtgaagacgatagcaccagctggcgtcatacgaggcggccgatcggtgaagatgtagatgtccaacaacggcggcataataagccagccgtgcaggcggagacacggcggcataataggccagccgtgcaggcggagacaccagtcggcagcggcggaggcaagccagcggtgaagacgtagacgcccaacaacggcggcataataggccagccgtgcaggcggagacaccagtcggcggcagcggaggcaagccggtcggtgaagatgtagacgcccaacaacggcggcataataggcc

SEQ ID NO: 85540 - DNA, 764 bp, Oryza sativa
tgtgttaatatggagaattttagtcctttggttcgtggagagatattatgcgaaaatgagccagttgttaaaagtaaaaaaaaaaagggaaacttataaaactcggagctataactgggatcacatatttccgtcaaatctatgtatgctgcgatcatgaactgtaatgtttaaataaaaagagaattctgggggacttgaacattccactaaagatcaaggtctttacgtggtttcttcacaagaaagtaattctaacgaaagataacctggctaaaagaatctctccgggatacaacattgttctttctactatgcgcaagagacaatccaacatcttttttttagtgtcatgtcgctcagttgtttggagatgtgtgtttttttgcttttaatatccctccaccccgtaacgccaaaaacattttcggtaattagcttagaggggtatctaggtccattaagaagatgattataattggagctagtgttgtatgttagtcaatttggcgttgtcgtaatgataaagtttttaatgataaacaattatctaaccccatgcagattatcttcatgtctccacttctggtctatgatgctaccataggaggagcaggatactatgcacaatgatgctacactcttggaatcggtagccaaggatctcttattccactatgggtggcgtagtttcattagaaatgctagctatttttttttgtgtagtttaaagctagtcaataataaaggaggagttggggatt

SEQ ID NO: 85541 - DNA, 645 bp, Oryza sativa
taacagataaggcgctcggtgaagaaaacaaagacgcccatcagtagaggcataataagccaaccgtgaaagcgaagacaccatgggcggtggcagaggcaagccagtggtgaaaacatagatgctcatcaatggcaatggcgaaatccatcaatcatgaagatgaagaaaatagtcagcgatgacaaacgcatccgatggtaatgatgattagcggcaatagagatagccggctatgatgacgaagttgcccattaatagcagtagagtgggctatgttgaagagatttgacaggatgttgatgaagatgacgatgtcggtgatccaggcaatagcgatgtagcaaccgatgataatgacgaagacgctcatcagtgtttgcatagtaggtcaaccgtgaagacgaaataacaagtcgacgatgaaagttggtgacgacaaaagcaaccgaagacgtagtcaccccttagcaacggcggagacgtcagggccgatgaagtaggggtgttgatgatgatgtcagtgacaataatccttcaaattgttgagaagatggcgaagctcaaatagttttcttgatgttagcgtgtgcataattgagattaatgcaacgcctcttgatttatgacgatagcagtagaact

SEQ ID NO: 85542 - DNA, 615 bp, Oryza sativa
gatcagtctcggtgagaaattcaacctggtgagtcacaagaactacagtcttctctgaaagtgctgtcattacacaatccagcaagaacattgccactgattagaacttttttttcatcagggagtgcatccatggatgcaggtcaaggagcacctcttacatagaacagaaccgcagcggtgtgcgcatcgaccgcgctgaaaggatcatctaggaggtacacatctgcatcactgtacacggctctggccagctgaatcctctgcttctgaccaccgctcatgttgattcctctctggccgatctctgtcaggtctccatggtcgaagttctcgaagggcttcccgaagaggatgttgtcgcgaacagtgccactctatccatgagttctgggaaacatacgccactgtgccatacaactccacctgaaaattgattgtagttttgtcatgttcatattttagaaaacatagatttgtcattgtcatttttttttttgtatatgaacatgacaagacaatcttgtgttttctcctttcatggtaaaatgaaaagaaaggagataaatatagagtcgaagattatcttgagtcttttttcaggggaaagtagaa

SEQ ID NO: 85543 - DNA, 511 bp, Oryza sativa
aaatttcgtgaccgggtttttcttggcgcggttgcagcctgcagatttgatagattggcagacaggtgtggattacgagggggaatcgagcgaggaggaagatgtcgttcaggagcctgatccaggagatgagggacgagttcgggagcatctcgcggcacagcctgcggtcgcggtcccaccgcggcggcggcggcgcgccccgggtgaccgcggtggggccggcgtaggcagccgcgatgcagcagagctgctgggcgcagctgccgcccgagctgctccgggaggtgctggtgaggatcgaggagtcggaggtgtggtggccgtcgcggaggaacgtggtggcgtgcgccggcgtctgccggagctggagggggatcaccaaggagatcgtccgcgtcccggaggcgtccggcaagctcaccttccccatctcgctcaagcaggttcgcgctctcgtttcattctgaaattaccggttacgatgtcgaactgttagtaatttgattgg

SEQ ID NO: 85544 - DNA, 523 bp, Oryza sativa
gatccaaatgaagaaatgggagtttgatggtttccctcaaagcatctaaagtctgtccagctcgagcaagcctatagatatggagaatagcttcaagctgtctcagtacagtttgttgctcagatatgaggtccttgtcttgaacactgtaagaacgtttccaataaattgatcaaaacacagctttaaaaagcataaaggattaatgctcaacttgtgaaaaaacagaagaggataataacctggcttccgaatatctggcagtttccataatttcattaccagaatgaattagagcagcagcacgactttcaccatctaacatactgcgtgccatggcacatattgcatccgacaggcacttatttattgtctgaagtgccatggcaaaagctccaactcttttatgaatttccactgactgagctcatgcagagcgtaaagtgatattagacggatatagaacaactcaacaaagagagtaagaacaaagtgcagaaaacatagacatcttcaaattcat

SEQ ID NO: 85545 - DNA, 556 bp, Oryza sativa
ttgcactgcatttttctgctttgccctctgcaatatcttctcttctattggatctttgcatataattctatacaccgttacctacaataccaatttgaaagaaaatacaaggaaatgagctaccacatatttcattccaaaattcaaatgatagtgttatataatttataaatatagataatggacaatgcgctaaaaagagttgagctattttgtgacgtgccagtgctatttaatactcctttcgtttccaaatgtttgacgttggttagttcagttttgagctaaccaacgtcaaaccaaaaaaaaaaaggaggggcatcactaaaaagagttgccataaaaggcagaaaaatgctccaaaagaaatacgtagctgaggagcacactataagctatagtactatgattagataaagtatttataactgaagcttcagttacctcctttgtctgaccaagtctgtgtgttctatccattgcttgctggtcttgtggtgggttccaatcaatttcataaaaaataactgtatcagcagcagtcaaattaatacct

SEQ ID NO: 85546 - DNA, 543 bp, Oryza sativa
tcattcgatttataaggcatatgatgaggtgagacttatacctacgaaaataggtaagagattaatctggttgacataacttggcaagaatctaaaaagagaatctggcttgaaactaaaacttcaaagaatggaagtgttttccattataacaagaaatgctatgagaaaaaaaaaaacagtgatggaactggcgttcagactaacagaacctcatttaatcatgagaatagtatcatgatgaggcatctcaatgttcaattactcggggcatagatagaaatagaagagccgaataggtgatcaaagtatgagtgataattgtgacgtacctgatccaacagatcatgagcttctttaaggattttagatctaaggcaagatataagctcctgccttcgccaacctataaaaatgcgttccccaacaatgcatctccttatttttgctttactgcgagctgaccatcttttatatgcttctactttgaagaactgtccataatatgaggaaagctcatccccaacagtcttactacctaca

SEQ ID NO: 85547 - DNA, 571 bp, Oryza sativa
tgcaccacctactctgtacatcttcccaaacaccggggtatcctcgttccatactcccaaactgcaactcttctatcgctcgcagaatgccagcgtgcctatcatgtatcaggcacacatttggcctcataccaacaacttttgttttaaccaatttcaggaaccagtaccagctgtcggtattctcactctcaacaaaagcaaatgccaagggcaatatctgattgttcccatctacccctattgctgttagtatctggccccgatactttcctgtcaagaatgtcccatcaatgcagagaacaggacgacagttcacgaatgccatcttgcatgcatgtagagctaagaacgccctttgcagcacactcttgctaggatgttcaattgaggggaatttcttcacttcgtaagagctcccagggtttctttcctcgataacaccaagcaggcgtggcaaattgttatacgaggcttcgtaagttccaaatctcatctctattattttctgtttggccctccaggccttggcatagctaatagtatacttgtatgtctcttcgatgtgtcg

SEQ ID NO: 85548 - DNA, 642 bp, Oryza sativa
gctggcccgcctggctctccgccgtcgtcggcgaggccatctacggttggacccctcgccgcgccgactccttcgagaagatcgacaaggtacgagctccccccgccctcgcgctcgccattgtcgcgagctgagctcatcaacagcgcgcggtgttgtcggtggcgcagatcgggcaggggacgtacagcaacgtgtacaaggcgcgggacacggcgacgggcaagatcgtggcgctcaagaaggtgcggttcgacaacctggagcccgagagcgtccgcttcatggcccgcgagatcctcatcctccgccgcctccaccaccccaacgtcgtcaagctcgagggcctcgtcacctcccgcatgtcctgcagcctctacctcgtcttcgagtacatggagccagacctcgccggcctcgccgccagccccgacatcagcttcaccgagccacaggtctccccccgccaagatctttgtgcagcctcatgttccagcacgcaatgtcgtgcaattaattgaggttttccatggcatgctgacatgcggttaagtgctacatgccccagctgctgtccgggctggagcattgccacaacaatggagtgctgcaccgcgacatcaaggggtcgggctgcaggaa

SEQ ID NO: 85549 - DNA, 529 bp, Oryza sativa
caacatcagatgcttgcatcattccatatgaagggatacgaggttgctgaatcatagctggcatgatagaatcttttcatcataaaaaggaaacaatcaaggaaagaaagtactcctggcatattaatacctttggcatgagggaacatatagcgttttcctttctttcctgctgcaagtacaagacaggcatgacctgccgcagctcctatacaaagtgtatggatctgcaaatcaaaaggtaacttcattatcagaaaatgaaaaccagtaaaccacatgaacaaactcatgttcaacaacacaccctaattttctgaaaagataaacaacaggttttgacagttcaaccaaaccagtgctcaaacacatggcaagtttgaagttacagtcatttttttattgaataaatccataaagaaactagggcaagactattatctttgaaagatttcatccagcaaacaagcaaatagcatccaccaataactcctaacaaacataggaataagggcacctctgttcaggg

SEQ ID NO: 85550 - DNA, 627 bp, Oryza sativa
  unsure (1)..(627): unsure at all n locations
tttctgagctgactgaatttgggatgcattgcaaatttgcaatagagttggagggaaggataacttcttccactgcgaaaaatgtggtgagtcagtgtgatcctacatctctcgatactcggtactgaaatcccaagctattactatttactggtgagatggttgaatctgaatctctcaattccacttttaaatatctgttgaaacacaggatcatgctactcggtcagcctgcgcgacaagcactgctgcatcgagaactccatgaagaacaactgccccatctgttacgaggtgtgtgttctaatgtnnnnnnnnnnnnnnnnnnnnnnnncgctaccttctgcatactgttcatttaaaaaaaatgcagtctcttatgtacgaaactgtcgatcgtcatcacaaatgcagtatctgtttgactctctaagggagacgtccgtgctcagatgtgggcacacgatgcacctgcaatgcttccacgagatgctgaagcacgacaagtaatcgcccatgctgtgttgatctgtttccatgtggctctttctttctttgtttgtttctttactttgtgtgctagattagtcatctctttcgtgtgatcttgttcttcttgatgcctga

SEQ ID NO: 85551 - DNA, 731 bp, Oryza sativa
gaacgttagccaagcaatgtccttctctgcgcccggcatgagcttaatgtcatcttgcagaatactgaatttctgcctccctatgaccccgcagatagatctaaatcggctcaatattttccttggagatgtcggcaaccctacggcgtccaccgctgttatgtggaaccgttccttagggattttgttccctgtcctaggagtacgtgcccttgaggacccactagttgtcgtcgacatgagcctgcgcgtacgacgcttgatcgggcctaattcttttccttccgattgtgccaacacctgataaccttccctcgtgacgagacgctggaactccgataggatcggcatcggacatgtagattatggttgtattcttcttcatcgacgacgttgtcaactcctacaattcggcgctttccatccctcacgatgtgcatcttcttgtttgaagggtcttttatgtagaatatctactcgacctgtttcacaagtacaaatggttcatcggcgtatcccccttagatagatcaactaaagtgaaaccttccttctcggctttgacaccagtgcgtagattcacccaacggcagcagaacaaaggaaccttgaacttgacgtaatttaactcccagatctcctcaatgcggccgtagtatgtgtttgacccaacttgatcctggaatgcatctatacggacgccgctgttttgcactgtgcttttgtcatct

SEQ ID NO: 85552 - DNA, 4311 bp, Oryza sativa
cttggggttgaaaccacacaccccttgccactgtactatcaagcattatgaaaaaaaaaaaacataatgctaacctttacttctcatttcaacatacaagggtaactctcctgcttgctgatggttgataattccttatagctgacatgcttcttccttttatatattctttcactagttttagttactaacttgtggctcttgcattatcattgagatgtacaggtgctttattgttgttgacgacatatgggataagaaatcatgggaactgataaaatgtgcactgcaagatagtaattgtggaagtatagttgtcgcaactactcgtatttccgaagttgccatgcatgtcggtcatgtttacaaaatggagccactttctcttgatgactccaaaaaattgttgtatgcaagattagctggtgctcaaggcaagtgtctgaatataccaccagctgtggcatgtgaaaaaattttgaacaaatgtcatagtgtgccattagccataactacaatagctagtttgctggtgaacaaaccagaagaggattggtctgaggtgtacaattctattggttttggtcatgaaggcaataatgatgtagagaatactagaaggatattgtcttttagctactatgatctgccttcacatctaaaggcttgcctattgtatctaagcatattttctgaagatgttgagatcgataaaaatattttgatatggaaatggatagctgaaggttttgttcaagacgaacaagcagcaggggtagagttatttgagcttggagagggttgtttcaacgagctgataaacagaaacatgatcatgccagtggaggtacaatatcaagggtatcaatctaaggcacgctataatgaagggtatgtatatggttgccgtgtccacgatatgatgcttgatttgatctgttcattgtcgaaggaaaaaaattttgttaccctggtggacagctatgagcaagtggaacttccgctgagccatgctcgcaggttagccatgcagagtatgagtattaaagagataaaccgtcttcagctgcctaatatgggcatggagcaagtgaggtcctttttggctaatcgttgttatggtattagtttggcattctcagactttcgagtgttacgtatattagctctagaatattgtcagggcaaaattaatttgtcgcatttcaggagtttatatcacctgaggtacctggggctagtcaatgcggaaattacagagctccccaaggaagtgggagatctgatgtttctccagacattggatctacgagaaacttctatactggagctgccagaatctgtgggtctgctgacacaactgttatgcctatatgttgatcatcgtacatgggcgccagttgatctgatcgggaagctgacgtccctgcaagagctgtgcataaggcctgcttatgcgtacgacaggttctacgatgacaaggccaatggtatgagacagtttgtgaaggcgttgggcaggctgggagaattgagggtgctccagactcagattgatatattggatgatagcatggagaaagatttgctagagtctctagacaatctgcagaagatacggtccttggaaattttgggggcatcacgagggttgaacgtcgaatggactagaacaggattcatttcccctaggcatctccagcgcctgtatttggaatgccttgagttttctggactgcctgcatggattaactcgtcacttcttccaaacctctcctatctaaatatgacaatggaggttgtgcaagagcaggacatggaaacccttgggatgtttcctatactctgttacctaaaattatattcgcgttgtacaaagctagtaagctttaagcatacaagcaatgcaggctacttccagaagttgaaatccttcaagattgttggttcatcagtcaggtttgatctgagtggctgcgacatagaatcttctttcatgccaagccttgaaacctttgagactgatgtccatgtacgcttcctaaaagatgcgaacatgcttggtttcgacaagcttggcttggagaacctccctagttcgctaaagagaatcattgttgtaatctgctgtcgagatgccagtggtgcagaggttgaggaagcacaggcggcattggagcatgcaactgacagccatgccaacagtcctaaacttacaattatgagatatggagtacaaattaaacggcccttgtgaggtatgctgatgatatccctgattatgaggtatgtgttaatagcgtaatttggcttatggttaggtcattttagacaagccaaattatgtagaataacgggtgtaattgtctagaaatttgtttaagaaaatcaattcagtttatatgtgcagtaatatgtgatgcaccggaggtgtacgagttgctggggagctgcagcgtttggatcagcatggtgatgcatgtgctgcgctagctaccgtgctacgactgaggagttcctgctgtgcattctgtacatgctagactgatttgatcatatgaatgtggtattactctcttactccttcgcacgcacgggaggcttcattagaacggataccctcatctcaatcggacggtaagccccatctcaatcgggcacagcgtccgtcacagactagaagtcactgatgtgaagagttatctcaatcgggcaaatggccgtcacgaatgaatatatctcaatcgggccctaagtaaaacctgtcatcgatagctttgacccagacgaccaatcaaactatagcccgtcacagatgacctatctctattgggccacaactagcgcccgtcacagatgactactaacatttatcgggcctaaactagagctcgtcacagatgatactcatctcaatcgggcctaaactatagcccgtcacagatgactgatgacctcaatcgggcctaaaataaagcccgtcacagatgactactgacctcaatcgggcctaaactagagcccgtcacagatgactacctatgttacctagatacggggatacggatacggatacgcgatacgtcgatacggcattttttgaaaaacatggatacggggatacgtctatatatatatatataataaaaatataaatacttacttcaactcttgtaaatttggaaatatgcccatatacaaatacagacacacccacacatgtcaatgaaatgggataagtttgctgcctgcagcattaccagcctgcaactactacactaaaaaaaagaatgcacatgtactctatggaaagaaaagaaacaacagcaaaaagtatccggcagtatttgggctgtgtccagctgacaacggagacggaggcgctgggagctgcgtccatcagctgtggacgagcggcggcggcaccatacccgacggtggaggtgctatgtccactgacggccgcacaaccgacgacggagggggaagagccatgtccggcggcggcgccagcagcgccacgcccaacggcggaggagccgcagcgtccggcatcggcggcttttgaggtatggtgaataagattgagaagctcatacggtggttggcttggatctgtacttctcttgcgatttcaatggatcgaactgacatacgtgggattatggggatgcatcgaggcgtatccaggaagtatcggatttattttgattatttgaaaatcgcaaaaattatggatacgtacccgatacgtatccgtatctgacacggatacgcgagatttttgccgtatccaggtaacgctgataactactgaccacaatcggacttaaactagtgcccgtcacagatgaccttatctcaatcgggcatttagttatgacccgtcagagatatccaatatccccagctccccagcatcacccattcatatacatatgcattcacatacacagacatcaacatatttcacacaacgacacattcacagccagctcatatttcacatccattcaaatatttatcatatttcacctgcaaaaccgagttaatttgatcaaatatttatttagcaagccttaacataaacatatgaaatatatacataaatataaacatcacagttacatcatcacagttgcataataagtgttcatcattgcctaaacataaaagttcaacattgttcatcattttagtttaagcctaaacattcctttggggttaattatttcgcggaggatgaagctggctatctcctcgtgaacctcctcaaagctggtaggcagagacttggtgatagactactgt

SEQ ID NO: 85553 - DNA, 1499 bp, Oryza sativa
agctagagtaaagaaagtaaagaagaacgaagatatggcagtagaaatttttaaaaaccaagaaaccaagatagaacagataaagaggaaagagcaagataagcatggcaaagaagagcaaaatctttgtaaaattttaagtgaagaagagcaatgggcaaagaatgaaagattatttcttgaaagttatgaagaagaaattaatctaataaatgagatggagaacatagaaaatgaaatagacaatgcagaacaatataatgattttataaacacattagatgaagtagggttacataatcttgataatgcaatggaagctatggaagtggacttaggaacaggaaagagaaaaagatatggagaaggtactgtgaaaaacgaaggagaaagagaaagaccagctagggcagcaggaaaatggcccccttatagagaagaattttcatataactatataccaggtcaatataggcatatgggtacaaagagaagagactttgagaagcctgttaaatttcaaaaccagaggagtgatggtgctatattaaatttagccgcacatgaccctattgattggcctaatattattagtatttggaaaggtttaatagttcaaaaatatatacaaaaccagcacaatataggaagtaaagttgaagatatgataacttacttagaaacatttttgataacttacttagaaacattttaggtgaatctgctaaggtctatgggaacaatgggttgaaaaaattcctcttattattaaaaattggaaaaaactggtagccatccgcataattttgcaaatgttatatctaacattattatagctgaagatccggaattaggttatacaactttgcaaaatgaaaggttaaaagaaatagaaaaattaacgttaacaagttggaaaggcataaaagaattctcccaacattatttatataatgctacaactgctaaacaaggatataacaggggtatagttgaacgttatttcaataaattacctgacccactaggaagtatgatatttgaagaatataaaaaggaaactgaaggagctgaaatcaacatctctcaagccataacttttgtgtttaagcaactaagaaaaatatgcacgggtatccaagcccaaagatctatgaaacactcggattacaatttctgcaataaaatagttcaaatacccttatcatatggagaagacaagcctagaagtaaaaggatttataaacatcaaaatagaaaccataataatattagaacaaagaaaaggtatttcttaagaagatcagataatagagcacccttcttacataaaagaaatgtaagaagatataatccaaagaaaacctatgacaaaacatgcagatgttttatatgcaactcgccagatcatttaagtagaacatgcccaaataaaaatcaaaagagatattctagtaaatatgaagaacaagagagggttctaattatagatagcgtaa

SEQ ID NO: 85554 - DNA, 982 bp, Oryza sativa
ccctcaatgactacaaaacacctggtacatatatccacacaacaatgaaagggaatagagttagtaattaaaactagtggaagaacatgtaaaagcaagcagaacacaacaaccgcagaaaaccatcaaccatattacagtagcatgagattttgttatatatataaacagaagtagtaaggaggaacgacatgaatctgcatcaaactgtagcatgcaataatttggagaaagttaattgttattgcattctctaccaataggcgccaaaggtttggtgattatattcctacctctttttttggaggaattcctggagtttgttgatgagttgcctttcgtccagcagctttagatttaagtcattgtatgactgcttgtcaagatccatgagaatatccctaaaaactttcctaatattaggattctgaccgaccggaatgaaagccccagaatcaaaacttggtttaagcttgtcgtagactgctttggcaagagtggtcttgccaagtcctccaaacccaaagatggataccatcttcggttttctaacggacacatcgatttcgatcttcctcttcttggtcggcaaatcaatatccaacatcttcatgagctcatccatgggcccctcaattccaacaagctctgccaatgttttgtacatactcaagagacgaggatcgacagttgctgggcctgcaggattgatggcaatattgtcgattgtgtacctcgcatgcctggtagccacctcctggagcttctcatcgatttctttcattgcgacaccgatttcatggctagccttgatcttgttgaactggttggtcatcttctccaagaaccatttgaaccagtgaacttcacttgcctcatggccgtcgacgcgcacaaggaaggagtcgatgatgtcctccatgtcatacgacgcctccctaaggtcgtgcgcccaaagcctcaactcatcgtcaagatgctc

SEQ ID NO: 85555 - DNA, 585 bp, Oryza sativa
acatccttaacaagatgggttttccctgacccaggctgaccatacactgcaatcacagaaagagctccatctttcgtcatatctttactctttagcgattcaatcagttcttcctttctttcggcatatcgcttagtatctatgttgttgacatgaggaccaaacattgatgatgaagaagctaatgaggtttccttgtccacttgaacccatcgttttttcattttggaaagatgctccagctccacctcaatttctttcagctgagcagtgaagcgatgtgaggccagtataacctgtactctcttggtaagtcgatattgtttgctctgtacaatataaacaatatattcgtccattatttgttcaacaaggcattctaagttccgtgcttccccaatccaactttgaagtacttgcttggtatcatatcttggttctatttgagccaagaagcaaaggatcatgcgaagttcactttctattcgcctcaatctaccttgaagttctgcttgcctaagaactaatatatcattactattaataatctcagatattactctggtaagagatctaattagaaag

SEQ ID NO: 85556 - DNA, 7229 bp, Oryza sativa
ctgtgcacgtttgcgaactagtctttctgaaccatccgcacaaccagagactccttcacccaatcagccttctcacctttgcccagcctaatggcctaatccgatgtgcttgctatagttgggatcatcactggcagcacaccatcatcagtgagctcctctccttttggctccacttctcttctagctttctggggcctgtaaatactgtccacctactgaatagcgaatgtgtaacaaattcaaaatatatcaattcagaactaattaataagcttaaaaaagaaccaaacttgtcccatcaaccaccactgcaaaagtgcaaacaccaccaaattggataggggcaattgtgttcttatccctactttcatatgcaattgtgattttaccctttttttatagggtttgtgattttaccctcaccttttcaaaatgaaactctgatttacccctactctattaaaaccacctaacggtgtcaatgaaactaaaaaaagacaggtataaccctgtacacttgcccctacttttctattagaatctgtgtattttccaaaaaaatatgatcgcacttggacaaattttgaaagaacttcgatatcattgataggatttcacagaactttcaccaggtgcgaaagatccatcgcattcaccagtaaaaaatcaccaaacaaacaagctcctcacaaagtagcacaagatcggaaaaaagaaaaagaaaataagaggcggctgcagcacgaccggagccgccgccttctagtgcgatgccgctgctgcgggctcgcacgtgccgccgaagctgcctcctgcttgcggctgccgtcggaggctcggagccgccgcctattcactcgctccgccgaagccgcggcttgctcactgcgcctacaccccctactcgctttgctgatgtgggcatctgctgctgctcgctgggcatcacagccttgcccagccgccggcctatctcgcctgtgcacagccgccggcggtgccactagggttaggctaatcaagtaatcagaatggggatcgggtgggatgaaaaaggcaatgcagggtgttgttctttgcactggggtataatggtccattgtttttctcttagtaatttcatctatattttttacactcttattttgggtccaccaaacggtcatccaatgtaggggcaaacgacagcttcgttcgaaaaaaataagggcaaaatcacaaaccctagaaaagaggggtaaaatcacaattagatatgaaagtaggggtaagaacacaattgccccaattggataatatcccaatacaggttttaatgacattcaagagacttattacgacaaatccaaagcgtcttataatataaaatgaatggagtaaattgtcaactctcctcaccagactaaaatgtccttaaaaatgttcttaaaaaatgataaaaatcccatttttaaaagaataaatcatgatgtttcccgtccaaagctgagagtctactctagatgagctcggtgtcgaacttgaggcagatgcccatggagaagagctcctggtagaggatcttggcgccataaggcacgctcaccctcaccacctcctccgccgacctgcagaacctgcagtacggccccctcaccttccggccgccgccgccgtcggcggcgacggcgggcgacacgacgacggcggcgcgctggcatcggcggcagacgtggaggcgcgacacgtcgctgaggaggaagaggcgctcgtggaggttggcggcggcgccgtgggcgaggaggcagtcgcgctccatctcgccgaacttgacgccgccgtaccggcggcggtcctccaccggctgccgcgtcagcgggtgcaccgggccggtgttccggaacttgaccttgtcctcggccatgtggtggagccgctggtagaacgtcggtccggtgaacaccggcgacgccgcacgctcgccggtgcggccgttgatcacgctctcccctccccacctggagaacccagccctgttcaaagaaacaagaattccaaagtttttcatcacattttcagttgcatctggttactgttgtagtttcatgaagagaattcggtgaaagttgtttgtttgggaatctggctaagagtaagaggggataaaaattgtaatgtttctagttctatctactttcatgaagagaaaacaatcaagttattgagaatccagccctgtccaagagagagagagagagagagaggaattttgttccccatattttcagttaagtttcgtgcatctgattactattgtagtttcatgaagatatttcggtgaaagttgattgtttgggaatctggctcagatcaagatggaataaaattcataacgtttctagttctatctattttcatgaagagaaatcaatcaagttattgagaatccagccctgtccaacaaaaagatccattgttttccccatatcttcagttatatttgacataattcagtagttcaatctagtactagtttcatgaagttcagttcaatttcacatattttcagttagaaacaataattcaatcaagttcatcatttgagaatccagcagtaatcaagatggaacaaaatttaacatttctagtttatctccaccttggaaatccagccctgacaaaataaaatccaagttttttcaccacattttcagttatatttcttacatttgattacttcactctagctagtttcttaaagggaattcagttaagttcatcaaaatggaacgaaaattggaacatactttcattaagagaactcaaccgagttcataatttgagaacccagagctgatcaaaatgcaacaaaatttggaacatttcaagttctatctactttcatgaagagaaatcagtcaattttattgatcattttgagcagccctgacaaaaaaactacaactcttttccccacgttttcagttgaatctcattcattttgctagttcattctgactaatttcataaagaaaatggggtcaagttcattaaaatagaacaaaaattaaaacacttctagttctctctacttttatgaagagaaatcactcaagttcattatttgagaacccgattttgatcaaaatgcaataaaatttcacatatttccagttccgtctactttcatgaagagaaatcaatcaagttccttgtttgagaacccgatcaaaatgcaacaaaattttgcacatttctagttctgtctactttttaatggagagaaattaatcaaatttattgtttgagaacctggcctggattaaaatgcaacaacatttggaacatttctagttcttctactttcatgaagagaaaccaatcaaatttactgatcattttgggcagaatgaattgcttacttgtgcagctgctctgtgatcacttccacagatggacttgtgaacggtgtcgcataccgggtggcaccgccgagggcgattcctttgcctagtgcagcttcaagaagttggccgggagtctgacgagttggaaagccatggggattgatcacaatgtcaggaactatgccttggtgagtaaaagggaagttctcctgggaatccaagaagccaatgactcctttctggccatgcatgctggcaaacttgtctccaatgcgtggcgagcgagtctgcagaggtaatcagatcaaaaaatttactaactttaacaagtgttcatcagttatcagatttacaagtagatcttttggaacacggggaataacagtactaatgttcatcacttgggtgttatggcagagtagacatgagaagatgaaaatgattgatgtgttatggtatggacacaatgaactctaatagaatgtcgattagtgtagaaaaaatcagttggccattcaactattccaatagtgtgtcatagagaactccactatcttgcaaatttataaatggttagtgcagattaattttgtaaagattgcatattcacctgtcttagagtaacaaacgcagaatttgtcccatcatcagtagctgaaagaacaaccttctccactattcctttttcagtatgtagcagcttgatgctatgatcttcaccagagtctgagacctttccaatgataatgtcattactctgaagacttgctccaatatatggtaagccatcaatatctaaactgtcaaccaggcctttcttgctaggagtttttccaaaattgatattttccttgtgttttaatcgtttggtgatctctttgttttctatcagtgctttatagctcttaaaatgttgtgttcgaaacatgccacgctctaaagaggccctattcaataccaaagaatcctcttggttaaatccctgatggacactgattgagactattgcattttggccattgaaatactctggtctggcaaagtcatgtttgcttccagatgtatagtctctcttaccaagacaatcagcagctacagttttgaacagaggtctctgtggataatagagctgatgggaatgtgtatcaactctaaagagaggattcgtagtggagtagccaatagcctgttgcgatatcttttcagcttgcattagaattctcttagcagtatcatggttggcaaagggaatgatactgcaactcaatcctagcaagaaagaagggtcaagttcacaatgagtatagaatgagaaattcttttcttcgtcccctgcaaagagatgcctaattccataagcacaccggatatcctcctcttcttcaacaccaatcagctcaattatattttgatccataagttcctggaaggagtatgatccattctttcgattcatgatgtttcgtagattttcgacaataagaagaggtcttagaatccttcctggatcggaaaatatacgaacttctttgttttgcttgtcccttttgatctccacctaatcaaagttaaaaccaaaatacattgtcagtactatctagttgtattaacatactgttgcatatttcacagaagaaatggaaacatagtactctaacgtgataaatatgctgtcatgcttacaacaagatatgggccaactatggcattcatcaaatatacttcttggctcagattagttaattttactaagtaacttaaaaaggattacatagtggaaatgaagtatgagaacagtattttattggaatggaaagttcatattaacaagcaagaatacaattcccttttcctttaccaaacattgtaggattattcttttttttttggcaaaagcataaagtcataaactcaaacaagaatgacacaaaagcggtccattaggatttctggaaaaataaatcagtggtgacaatgcgaaaaccataccccaagaaatgattatgagacagattatgccaatcatggactgcttttaaaggcaccttgtttaagtgtgcagatgtcatggtcggaattgtctatcaaaggaggcgaaggccggatggcgccacggatgtgatcgacagcggcaagggcgcaacagccggatcagcgccgtgatcctctcccgtgccggacgggaacagtaatcagatatttagtgagtttgttagggagtctgttaggattagttcctttctatttgcaattgttagttttggtttgtaagcctataagaggcacttaaactcaggaattaagtaagcaagattaatctactcctcatcatctgtttctctgttttctcaccttcttctccgaagtgcccatcctggggcgccgatcaaccaaattacctaagccacggccacccacccatcactcatatcccatacgatccctagccacccataacagcagaacaatatcagaattatggagagcacaaacaatcatgatatgtaaaatctctcacagagatgcttcaaggttgaattgagcataatagcttagcaggaaattttcaatcatcataaatgaaagcaaagcataatcatggattagtacacaatgcttcaaagtaaaaaaaaaaatccgttccagtgtagcagaatctggaaaagaaagaaacctgtgcatcaatttgcttcctgcgtctcatgctccttaagtgcaaaacaaactcgactgagtctgcacaaactccaaccaagtttccattcaagaagattctgtctttcccgctgatctcttgtagaagcagttcatccagtttcttcatcccacaagaaacaagtgcgtcaaccgagggctccctgccaaacaactaacgatagcagtaatggcaagatttttcacaaatccacacttttcaccatcaggagtggacaagaaacatagctttccccaatatgatggattcctaggaaaggatttggtaagtcagtttgcattaggatattgaaaacaaaaaaataaattataacaggaatgaatgattctatgtcgaaaggtacttacggatatctagcatctccagcctttccagcatatgcaacccattgtcgtgtcttcctcatgtcagacatcatttgaagaggatttgttctcctaagggttgcaacaatccctgaacacctctctcttttattaaatggatggcaccaggaaccagtggagaaggcacggttgagaccattggtaacaattgatgcatggacataacactcaagaggttgtaggtcaccatcaccactcaaatgtctctgcatgaccttgaccatacgtttctgggcatgcataatatgtacccatagctctctctggagcaattcacatgccaaatccagcctcttgttgcggaaatcatccctattatcactcttccgattgccagaggaagccaatagaagacatctcaccatgtatcccaagaagagtgctttgctcctattcccactaacatcaggaaacatatgcctaccaatatactcatcaaaggatccttttggtggaaactttgtattcctgatcaacttatcaatatattcactggctctcccttctctctgaaagccttcgcactgctcatgagattcagttatagtagctgatattatgttggccatggaagcatcacattcttgtatgtcaataatatcaaaagcttctttgtctgatgatacacctagtgcaaaaaacattatccagattggtatagttgcacccaaaaagtacaggttaatgacttttctgaaaccatcattagactgaacaggttttatagagatcttttct

SEQ ID NO: 85557 - DNA, 771 bp, Oryza sativa
aaaccagatttcgattgtggggcttttgttccggtcggtcggaatcctgacatgaaaaaagttttaagggacattctgattgatcttgacaagcaaaactatatgcattcaaatacaacgacgacattggatgaaaggcagctcatcaacggaatcaaggatctagtcgagaaaaagaggtgctgatatataattatatattcagttattcaatcaggtcgcaaagattggtgtgattgttagttttggtagctttagtatgcttactttatgcctaactagtgttatgtacacttgtaataattctactccctccaagtaataattccacaggtaaccttgcaaaaataaaataaaataaaaatccatagatgaccttttgccaaaaatatgttatgctccttccctccgaatttacaatttatacttaatcttgcacaaagaccaaggaggtattgaaatttgaaatgaggataactacgtttattatttctaaatgctagtctaaatggatgtgcctataaaacacaaagtaagactgtttgagtatggaaggaataacacacctaaaacaccttggaatatgaaataaaccctctaaaacaaggttgaaaggatacacacattcactttataagggttagctagaaattatcacattgagagatgaaaaactaccacaccggtaatatctacgcacaacaaaaaaaaaaagattgaagttttgttttactaggaattcgtcatctactcaattttttcattgcattt

SEQ ID NO: 85558 - DNA, 613 bp, Oryza sativa
gaatagctctaaaccgaagtttaaattaacttgtacaaatactaatagacttggggacaagatgttgaggggaggatgctcgcttggtgcattcctcatcgaccggcaagactcgcctgctgatggcactggcacgctagagatgatctgccaggtgtgggcacagatgctgtgctgctgtggggaacaatgcagcacagattctcatgtcaagcagctcagcagtggcggtgagcttgttaccgtcactgcccttgtcgcaaaatacataggtcaagatgttgtcttggcactttcagatagattcacatagcgtttagcgaatggtaaatagtagggtaaaggtgcacacagcagcaaaattttgttgaagatatgtggacaccattaattatgttattggtgaagatggcatgattttaaatgctatttcaagacagctgaggtaatgcacatatgccttaggagtgtgcatacaggtcagtattccttaaactacagtatactgacttaccttatctatacttttttttttcatatgtgtttttaaactatggagggcaaaaagggaaatatttccaataaaacagtgtatttttttttttgttttcat

SEQ ID NO: 85559 - DNA, 558 bp, Oryza sativa
catttataataactaaatgctatcttaagcatctagtttgtacagttgaacttgtaacaatacatgaatgcataagagttcatatccaagcaccctcttcattgaaacatggtgttttggtgctatctgatattctgattattttcatgttatattgaattgtttataaccattaatgcatactatgaataataataataataatatgatctgacccgaggttatattctgattacaggttgttgatgctagtgcacgtgctctgagaatgatttatcaatcgaaactagctccaaagtttgatgtcaccaataatgagaaaaacatggaatttcttcttacccttttgaacagcgagaatgaaaatgtcacagagcttgctgccaatattatatctcactcttgtgatagcactacagaacaattagcactatgtgctgctggagttccgcagagacttgttaaccattttggaggctccatgaatctacgggatgcttgcttagattctttgactgcaatcataagaaataactgggaagttgcttcaagatttgc

SEQ ID NO: 85560 - DNA, 657 bp, Oryza sativa
ctgtgacgggtgtagtattatgaaccatcacaaaagagaccactcatctctaacgggtctttaactaacacacgtcacagataacgttatctctgacgggtggtagttatgacccgtcagtgatgagtgaaaattcaaatttttaaattttgcaaaaaaacctcggattgaaacatgtcttatataaaagttgtagctctcaatgatatccacaactttataactaacaacatttctattagagatcgtttacatccccgaacatgcattacaagtgatcagatctacttttaaaaacaaaattttgagttttttttcaaatgacatggatggatacatgccccgtatcaaagtcatagaactcaatcagatctacaacattataattgaaaatattttcatttcacaaaatttacatgtttataaagtgagatatattttgaaaaatgaaattttgaattcttcaaacaacatcggatgaagatattttctatgtaaaagttataaaacacgatgagatctataactatttagttgataatattttcatttgaagtcatttagggtgttaaatatatgttaaatgattcagaccagcatagactaaataataacattgggttagtagtcaatatgtgttgagtaagtgagtcggta

SEQ ID NO: 85561 - DNA, 704 bp, Oryza sativa
ccattgctcacatcatggatgaacaagaagatatcgagatcaagtactccaagtgctggaatctgattcggccacctactacactgctgacttcaaacggccaccgatctgcatacgacctccgttttcagcccgtgagtacttgatggaaagctctcggagcctctttccaacggatccagcctcatccccgaattccatctcgtgtggccggaatcacaggcacaaggtgctgcgtcacctataatgggcctatgggcttgtaacttcatttgggaccccagctcaggtggggcccatgtggggtgcgccccaaccaggtgaagcacgcccctaggcatccctaggtcatcctcccacccctatatatagctaggtaccccttcagggtttattgggttttgtttagatgaaagtttagccattgctacttccttgcagcgcgcgtgtcggctagaccatccgtctgcttgtattcgaaaccccaacttatcgtgtgtattcattcctatttgcaattcagattacttttatcttgttcttgcttgtttcttcgatttgcttacaggaataaggttgatctgcaccggcaagatcaacaacccacggagaggtgtatcgatcgcaaaggcgcaacacaacgtcttgtacggttgtagtcggatctcaacgtttctcccaaatcgtagttatctcaactcacc

SEQ ID NO: 85562 - DNA, 6304 bp, Oryza sativa
tcgtccgtctaaataaaaaaatagaagaaaaaacctaaaataaaaaagtccgattccccataagaaagtggcgaaaataaaaaaaactaccgtatccgattcccatctaattttgttcgttttcttttttttctgtttttttccgttttattttcttttcctgtttcttttttttctttcaccttttttccggttttctttgtccgttttcttttcctcctttttgcgtattttcttttcgccgttttttctttcaccaatttttctatttatttcttttaacgctatatttttttgcggttttttcatcggaacaaacccagtgccgccgccacgttgattttcctcctcatatgcttcctcctcctatttactgcaataaccgattctccactactctctcattatttttccccatgaattcccctttcgattcagctttaatttaccagattgaatctccttttaatcatggttattttttatcccaagttttgcagattgctttgattttgatgaaccatttaatcgtcgtcattttttatcccgagttttgctgattgctttaattttgataaaaaaagggaaaagggagatcaagtggataaaaatccctcaataattttggatatggagaaagattcgaccaaatttgatggagaggatcggcttcgttagtcatcgtacgggtacggaactatgtgagctcgagcggattaccgtatttgatgggaggatcggctccgtcatggtataagactatgggagctcgagtggattactggatttgatgggaggatcggctttgtaatggtacggacacgatactgttcgacttaggcctacaactccatttgtggactgagccaaagagaggtagaccgagcagagggagatagaggactgtactaggactagagctgaaaaggacggaaggaatgtgcgttcatttggtccaaaacgcacgggcattaaagggagtatagtgcgtaggataaaaaaatatttttacccgttgcaacgcacgggcattttttctagtaattacatatattcggctactgctcatcaccaaatttgtgccttttgttctcgcttatataaacttatatgtgccacttatgaatttactattccataatgtgaagaaatatttatggtactatgatatatgttgttagatatttatagaatttttaagacttacttacttgaatatatacaacagaaatgcactaattaccttgtaatgaattttcaattttcatataccaactcaaacacatgaacaattttgtggtatttaagaaggtatatattgtgaggtactacaattttaaatgttactttgtgtaactcctatgagatcaaaaaagtttgcactaaaatgcacggggtatctcctttaaaaaccatataaaatcaccaaacacgtatagtttatttataaaaattctgatcttacaagcacaaatacaattatttgtagccctttagctatcatgcattattttcagaagcattacaaataatccatcctctgtcacctttcaaggggtaagactataaagcttgttgtactcgtctcaagctccggtgtcgaatctggacaagttctcgaaaactcccatgtactattcgcaaaattcttgcgtttcagagaaattttggtggaatcagccccaacccatctttcaacattcagattcatatggtcgcacagttttctgtcgccactgtcgatccgcatttcttcaagaaccattgcattttgagcgaagaatttgacaagctggactccaaagcaatcgtccccgctccacttaaacttcaggctaacttttttcagacttctctgcaagcaggtgaacgatcgtcggctcaatgcagggatatcagggacctcatcgacatggcgatcaccatctccttttctactatcgatcgaggaaatcgccgtcgtcgtgttcgatttgcggcgcatgaagtgatcaacggaatcgtagaaatctggctggaatctgccacggtggtttggccaatatctatcagtgcacgttgtggcggagttgagcttcatggtgaactcactgagaaccgggcagcaacggaggagattggcgatcgccaccgccgatttcttggtgttcatcttggtgttcatcagctgcgccgcttcaagttcgacggagacgaggttcggcagcacgcagaggagcttcgatcggctcgccttgtcggcgacggcgagatgatcgaggttatccactttcagcttgagcgtcttggcgttggtgaagttgccgatgaaacgccaggagtggacacgtgctgtgtcttccttgagataatagtcggagttgaagtggaggctcaccgccgtcgtcgtcgtcgtcgtctccggcgccggcgacttgaggtggaatggccgggggaggcctttgtacctgaaggagcgcagcttcggcgcgtcgatggcgatgctgccgccgcagctgtcgtcgtcgtcgctgtatctgctgtgtgcgtagtagaacttgtagtcagtagagccgcaccattccagcgcgagcgaggtcgccgccgggcagcggaggctgatgctgctgcacgcgccggtgtcgcggtggttgtagctctggttgtcgttgttgtcgtcggtgttgaagacgacggactcgaggtgcgcggtggcgagccccggcgcggcgtcgatgaggcgctgcaggtgcgtcaccttcgcggcgcaccgccgcagccgcagcgtctgcagccgcgggaacgccgcggcggcggcggcggcggcgggcggtggcggcagggagaggttgttgcacccggcgatgtccagcacgcggagcttctcgaacggcaggaatgcgaggctgaggccgtagacacctaagtcggtactgggctcctcctccttgtcgcggcggcggcggtggacgccatagctgtcggactcggaggcgacgcggaggcagagctcttcgacgaggcgcgccgccgggtgggagaccacggtgtggagcacgtccatgcccgtgaagatgtcgtacgccgccgccgactcgtcgcagtccaggaaattcgtgatacagtagccgtcggggccgtccacgtcgacgctcagcctcgtgacgtggtcgcatgagatgtcgccgtcggcggccgtgagcgccgcgccggcggcgcggaggaaggcgtcgcggcggcgggccgaaggttcctccgccgtgacctcgtcgtcgtcctcctcgtcgcctaagtcgaagtcctcctcatcctcgacgtgttcgacgaggttgacgtcctcctcctcctcgtcctcgacgtgttcgacgaggttgacggcgccggaggaacgccagagcgagccccaccgccgggagagcaggctggtcgacgcggcctccctgaaggggacgaagtggaggatgcggcggaggaggtcgtcggggaggtcggacaggcggtcgtcctcgccgccggcggccatctcgtcgtgggcgcgcgccggcgaggctatgcgatgcgatctggctattagacgatggaacgagtaaacgatcggtggctttattcaggacttcgtggacgtgtcggtttggtatcataccagatatcacccgttccttttgtttttcaccttatatctgtcccgtcaaaattatgctatgagattcgtgcgtggcaaatatattacgaatagggtttcggaccacgatacgaaactgtttcgtctaaaatttccagaattgttcatgtgctttgaatttagcacggtttattcacatttttatcgaaatttgttaattcaaattatttcggaccagaatattatgaaattctgcaattttgaaattccggttctatctgcgccggtaaaagggataaaccgaaattttgaaccctgactataagttatattatgaccatggaaataaatatattatctaagtgcccggctatatatgcctaatattggtctcaaaattgttcatattgttgtagcagggggctaacaccatactccctattcggtcaaaacactaaagagaaggaggtcttgagatttctaagtgtttaaatggtaaaatactactcgaaaggtaaaacattattcgagtggaattaacgttctattcgagtggttttgtgctactgaagcaactcgtctcgtttgagtaggtttctgattagtgataggtaagttccgagagccaggcagatgagaaggagtattcaaactctcaatatggaaaagacaacccaagataaaaaagacaactcaagatggaaaagacactcaacctaatgactcaaggggaaaacactactcgaacaagaaagatggcaaaagattccatggggaccactctcaaccactcctcccagctggtaccaaaagaccataatgacctccaaaatataccaaaatgtggtgacttcgtcaatctctccaggatttgccggcctagtcttcaaagatgctcataggggtagggtttgcgtacgtgcgttcataggggtgagtgcgcgtgcgttgtgagtgtctgtgttgtactgtgtaattctcaaaaaaaaatacccctaaggttactgacatggcaagggtataattgtaaactcataaggacccatagggcaaaattgtaatatcacatgtacggctgtgggctatataagctggccaaaatcctgtagcaggacaagacataatttaatagaggaatatcaaccaccaaagttgcttttgtgttcgagctcatttatcaggataggctggaaaaaggaatttttccgtttatccccgaacttgtccggtcaagacacatacgtattcacgcatactgatactgaaagccttttgtagttctgttcaaaacaattttatataataactaatttagtttgattctgaaggggatgcccctcgcttttttacacgtctcctaaataacaaaaaaaattaaaagcatttgacaagaaaaatcaatgtgatacaacgcttaaaaataaaagtttaaatccagcctctacaaaatattaaaaataataaactgaaatgtgtattatatatggtaatatattattgaactgaatttaaattgcatgtttatgttgtagtacatattgataaatcttatcaaacttcctctaaaaagtcattactatttggataatatgaaaaacaaatgtaacgctccgcttttcgtgagtcgttaaaaactatttcggcaaaatccttattgcgaaaattttcgttctttgtgtgcgagtctaagttgtgccaaggatctcaattcaaatcccgttgttccctcccatcgccatcaaaatcgtccacctcaagattccaattccgactcaagtctccgaaattcaatcacatcccttgaatccccgccaaatacctatccacatttccgaaaatatcaaatccccatctcgaatcatttccttgagtctcccttgattcatccctaaaccctcgagtttgaatatcaaatttgaattcgaatccaaaccctaaatctctccacttctctccagatcaatctcctccgaaaaagtctattttgcctccctcggacttttgtgggccgttttctcctcggcccatctcctctcagccgctcctcctcctccccctcgcacgtgcattgcgcgtgtgcgctcactctctctctgtttctctcgctctctcgtctttttcctctctctctctcgtcgaactcctcacctcggcgccgattcccgccgccgccgtttgaattcgccggccgcccctcccgcgcgcgcctcgcctgcccgccgcccaaaacggaagggaaaggcttccctttccaccgtcctccctcacttttcccttctaaacccggcctctctcctctcgcccttgtcttcttgcgcgcggaggcagaggacgccgacaacgtcctgccgcgcctgtgccccaccttgaccgcgccagcctgcgctcccgtggttcgaaatcggccgtccgatccaccgccttcgccgcccaaagcatccacgccgtcgccgctttcgcatcgcccacgaaaccgcagctgccgctagccgagcgcttgaccgccaaggtcggttctcccccccccccccaaaccgacatcgcctcaccccgcgcctataaaacccaaagccgagctccccttcccatctcaatccctcccacttcacactcctactccaccgcgccattgtcgcccttcctctgctctcgccgtcgccgtccgccgccgagcaccgggagaccggtgcggggctgcaggaa

SEQ ID NO: 85563 - DNA, 510 bp, Oryza sativa
atattcttaagacatgaacatgctgcaacacggatatcaacagaagcatgcttcagtgcatcaaggattaaggtagatgcctgttacataattaatttgttagtcacaaatgtttgatcaactgacaatcataaaatccacctttttcatgctactacacgccaggagcccatggagtcagtatattttcttgtcacaagttgcttaacaataacagtagatgaactctacaaaattttactcaaagggcaaagagcagcaatgatcaatataccattcaaagtcctgcacgtacctgaactgacataagttgagatcttgattcttccaattttgagcaaagttcaactaaagcaagcaatatggtcactgcacgccttgactccaacgaatttgctataagatgggtggttaacttctgaacttcggttgttgagagtgcttgcttctgcaggtccacactgtctttgatcaagggtgtcaatgccaatggagcatcatctctacatg

SEQ ID NO: 85564 - DNA, 730 bp, Oryza sativa
ttaaattgattatcctttatttcctgggccaggcttatcttacaggatggaaagacgaggaacttttttattttatttttaataaaaaatttataaaaatgttttattttacatatttaaattgatcatgtgtgcttcctccattaggtcctgtttagctctaaccccaaatttttttcaccatgtcacatcgaacgtttaacactttaagaagtattaaatatatgcttaaaaaataactaattgcacatattacgactgatttgcaagacgaatcttttaagcctaattgctccatgatttaataatatggtgctacagtaaacatgtgttaatgatggattaattaggcttaataaattcgtctcgcggtttaccgacggattctgtaattagtttttttacagtgtccgaacaccttatgcaacaccatatataatacctgatgtgacacgccaaaactttacaccctggatctaaacaccccctaaataggaaaccctagccaccagagtgctagcaatgtagagtttaatccagcccaggatatacttgatggtgcaataaaaaggggggcctccgatgcaaaggtggattctcgatctcgaccgcacataagagatcgaacggatagtcaagcacgttgtatggccgattcgcaggggaataggggatacggcagatcaattcgtaaggagatcgactctgatcaaagccggtacatatcagt

SEQ ID NO: 85565 - DNA, 581 bp, Oryza sativa
gtctctcggcatcaaggctcccctgataagctagttactcagcaaggggtgttccattccacccatgtggtcgtacttgtcttatgtttggatgaaattccaaggaatcggtccttaagtgcgagagcgggaaaccgtacacccggtacgttccccggtccgcggttttggaaattcatttagttcgcaagcaccgacccaagtgtcgggttttccgagtcttttgtaaaactccagttttacccaagttgttactcagattttaagtttgaaggcgaccgtcgatactcgcacagagtgcacgagtatcaaggcgcaactgggtggttacaaggggacatggcatagcaattaacaatggaaggatcaaatgtgacaatttaggtaagtccgccaatctgcttcgcagacgggacaacagattaagtgtgatcctatcaatgcataatattttgcaagcaacatacttaaatttcaaatataggctcaagatgttcaaaggtggcttgccttgctcgagatctggagcttgatcctcgaaatcctcgcactgcgggtcttcgggctccgaaactacatgc

SEQ ID NO: 85566 - DNA, 5957 bp, Oryza sativa
ctttagctcatgtcttcatcacctccaccactattttcagctttacttgctccttcccgttcagtgcttgcggacattgctgtagaataaatgacagtttacatagagcgaccaccaagtgtccaagtgtgaaatttagactctaatctttcatagaatccttgtctttgagatagatgctatttgttctagagttcagattagtgttaaagaggagcgtaggtttatgactactgaaacagatgctatttccacattaaatcttgttagtgatgtcttgatgtacgaccagttattcccattatagtgctttcatactgttcaaactattttaacccctgtaaatactcattaacaaaatattattcctctgactaaaatatgcatcaaggaacaagtatagtataaataggaagagagtaccctagaaagaatatatataaaaaggaagagagtgcatatcagaagggaccatatacttgtgtgcatacatcatatctgtgagtggtgcgtagatatactcaagaatttgccaacttagctatgactgatacaaacaaaagcagagttacaaaagggggacagcccactgagatcaattgttgatttttgtagcagatccatgatttatgattttcttccaggctagataaacagagaagttctttgcattttatgcaaagatattccagccatcgattttatcagatggaatgagcagaactgtgaggacccaaatcagagcactccaggctcgagctgatgtatcatggcctgtactgggactcatgagtgccattatattccactgcaattccaggtatgtactgtgttgtactgtagtgctactcaaatttgcatcctgctcaagctgattaaactttgtaccagtcaatcaatcgttccactccactctagcactgttgccatgcccttatttggaaagtgatagccatttatgatatgaaattctgagaatgttatctccctcctatagcaatttttcatgtagttgtatttgtgaaaaaaattcagaagcacacttcagcgtgagttacctcaatatattgctgtactttcaattggaagattttattcattaagcagcatagacagctctctcagctaaagttcagtatatctcctgaatttaaaacatcaattctgcatgacttctataacgtatttatgttcttcttggtttcttcaattgaatcagcgtgtccatcttgattccgttacagtgatagtaaaagcaaactcactgctgtcacttaaaactctgtttgaatgtattctcatgtccaggtattgctaaatgaggaaatcagtgccaagatgaatctaatccatttattatgatgagcaaattgaatctttgtcccaacctttcctctgagtgctggattgaactccatccacagcctgtcacaggaaaagtcagaatgaattcaatacctgctattagaagacgaggacatgccctccttggcctggtcattgttctttagtgagaattatgacaagttcaatcacattgaagaagtagatgtttatagctggtgcttatattctttatcgtatctttattcagccatggtttatgtttatagttgttgattacttgcaggatatgagccaattgttggtcttgagttctgcaatccactcttcgtctcacaatgtaagtgttacaggtcaagaaatgtgtcatgtgctgtgcattatataagttttgtaaaagatatgaccaataggtcaaactttcatgacaaaacgtatccatacagtcctcaaccattattataattcaattgctttgcaatcatatgtagtttaacaatggcagacgatctgcataattcaagagaaaacctttgctagaggacattttttgagcaaatgcatatattcaagcaaactacaataaaaaccatgtttcttttcaaagtgcttaaggttatcataacctacaggaggaatcttgacttgaggagtacaaaaagttccacctctccaaattgctgtctcaaagcctcaaatttggctcaaagatgctaatgttaatttggatctgtagctgtggatcaactcatgttacacagcattcaaacagtagtaatgctttagtctaaaacttgcatcaactattagtctaaaggtctactagttgagtaaaaggctactcttgacatcctgtctgtaaatcctacagatagcacatgagcttttgaccaatgctaaacatgatatggtggtgttttcttcctaaatgcatcaggtgagtaccaataaacagaagtagaagctgaaatagtggttggtaataactgtagtgtgataatttcttaggattctaggttgcttcgtgctccttggagatagatgttaatgaggtatgaggagcgcctaaggcctaagcttaatacatacttaccaaatgcattttttcaatgtaaaaaatatgcttgcgttattatttgagcttttgaacaccaaattgttgaaaattagtacattactgaatgaaaagatatatagcgttaacgggtggtgatttaaatactttgataacggcgtagatagaaaacttgatccacccggtgaagaaccaagaaacaagtactcctgttctttaactttttcgctacatgtttataactatgctaatatgcataacttgctatggtgttcttagtttagtcagttaaattgttcatatctcaaaccccatgatttcttatgtacttattggtatgacagggtttaattcggctatgacatttgttactggggagcatggatgatatggtgagtagaagctattttgggccccaacctttttacattttcatttcgtaaagtgtcactaagatttatgttatgatttgactccatacggtgaactatatgcaactttgtactgtactatgaaatcagcaagaagaaatagatagtaatcacctcctcaactgtcaaagagaagaaatcagacggtgatgcttccattttgaagacaaggctcaccaattatttgacaatcttacatgcgctgcaagagcggggtgcacttctagttctaggcaggcaactggcagaaagggccatcagggtacaaacagtttgatcagatgggcatggatctcttactcaactctaaaatagggaactttacattgctaccagaaaaaaatttacaaaataaaaatgaggagtttactgccagtcatgcaatgggtgttattctatatgttctacgatacttaattcttttggaggaatagaagcttttaactggtgcttatggattagggtcaacttaaaaaattattgtgtatcgtatttcaccttatttgtttttataagcaagttactcactttgggtagtaagaagtgattaattgaggtaatgttgtgcacaggcagtcaggcatgacaatagtagttccttttttttaaagagaggatgataatagtagtacattaatagtataaactgaaaacatcgattgactgttctgtccatgacactgtttcaacttggaggtacgaattatgatcaaactccattgatgataatcatatgaccaaagcaaataacaaatttctgttatttacctttgtgtttctagtatctagttatctactatgacattgatatctgagcaaatatgatcaatatcctactcataatttgagcattttgttttgcagctgggccgaagatgcaccggttcagcttgtactggagaacctgttgtgccaaggtttgaactgggatgtctggctggctgggttgctacggaaagagagttctgtgtatctatctgactacacgctagttgaggttgcaggaaatccgtctccaacgttgcaactacatgctgctctcaaataaccaagattgaaagagcatcacatggcatgttttttaggctgctttagctagattgtttagtgtactggaaatgcatttggaaatgtctgggaaagattgaaatcatatttatcagagactctacatattccgaaaccaactactgtgactgttgccgtttgatgtgttttgtgttgtacgtgtatcttctaatccagtgcatgcttagtccttccaatcttcatctgatccgcaacttttgcacaataacttacgaaatgcaagagaagtgcataactttgatcctgacaacaaatttgtctgcagttcaaactctgcgcatgcaattgttgcagaacataattcttagaacacaacaggaacaattcaattacaaagcaagctgaacactatatgttcacacgaactcataattactcttgacgtgacgaatttggtcacataaagaatttcgtgttctcttgtacaatgtaaagaatttcacaactaatcttcactacaatttacagctcttcatcagatggtggtagtctttcagagacaccttcagccactgttggtcaatttgatcgtcgcccatgtccttcagaagcacacggtagcccccctgcgactgcttgtcacatccacctcttccgcgacgactgaaggagcgaacacatggcctcttagcatgctcgcaaaatcgtcctcgccctcgtcttcttcgttggtctcgaacggatccttgggaaaggtcaagatgggtggatgaggcggcggcggtggcgccatggcgggccaagatgccggtcgcggaggaggaggagtcgcacaccgcggtggattgtcattgccgtcctcttctcctcctccttgtagcgcgtcctccagttctttggcgagctcgtcgtattcatatagctgggaagggaggatgccgtcgactggtatactgtccaggaagctcataagctcgtccatttccatgccgatgtcagccggatcgggtacataagcagggccttgctctggcgtcgcagggacagacggctgagtcaccgaggcagctggcgccggtggctcgaacgggtccgtcgggtaggtctggaatggtggatgatgctgcgatggcgccacggcacaccggggtggcgccgcggacgccgtcacgctgctctgcggcgccattggttttgccgagacagcgcctttcatcttcttggtggcgcacggcggctcggcgaccggcgcggcgggcctcttctggggcggcgcctgctgctgcgtgatcacgggcacttgtcgtggcggcgcaggagcttgcggcgccgcctgtgctgcaggatacggcggcggcgcgagttcttggggcggcggcacgagttcttgaggcggcggcagggcggctgattcttggtgcgccaccgaatcaggagccgccctcggggagacgtaaatccggcagacgacgggctcgacgacaccaccggcttctttcccgcagaggtgatactcctccatcaaccaatccgtgttgttgccacctttcttgaagcggaagttcttgacctcgccgatcttgatgccctccctgttcttgagatccttgctggactgcgagacccaggtgccacccccggcggagcgggagaacttccctttgacccgcttgcaaccggtgaagaagaaccggtcgccattggggctcctcgccacgggcgcgtacttgccggcgaggtccctgggctcgtcggcgccgtagacgtcagcgcggtggatgtacccctcggtgtccttgggcgggtggccggcgatgagccgtggcaggtagtaggtgatgacctcctcctgagacgggttgaagcgaaaccctagcttgaggagaagatcgaggctggccatgtcgatgggagaaggcgatggatggagcgcgcgggaggaagaagcgagggaaggaagggggtgctctgcttttaaaggcagcggcgggacgggagctagggtgggtgcggatccgattcggactccgaatccaatcgggtcgacgctaattgtttggttttttttttttggattt

SEQ ID NO: 85567 - DNA, 815 bp, Oryza sativa
ctcggagtatttcgcccaaggggtactgtgaaggcactattactttgtgggcctggaagtagtgcttgagcttgcgcgaagccatcaccagggcgtaagcgagcttttccatttcgatgtatcttgccttcgccccttgcagtgcttcggagacaaaataaaccggtttctggccgaactctgtttcttggacgagggcagcactgactgccactggtgaagctgctaagtatagcagcagttcgcttcctagtgttgggcttatgagggctggtgggctttgcaagtattgctttagctcgtcgaatgctgcttggcattctggtgtccaactgaactttcccatgccccggagggtcttgaagaatggcagacctctttcggccacctttgggaggaaccggctaagtgccgtaattcggcctgcaagcttttgtacctcatgtacacttgacgggggcttcatttgctgaatggcgtcgattttctcggggttcgcttcgatgcctctttcggaaaccaggaaacccagcaacttgcccgcgcgaatgccgaagacacacttctcaggattcagttttatgcccgctgcgcgcaagttgtcgaaggtctcctacaggtcggacgcatgatcgaaagccttacggctttttacaacaatgtcgtcaatgtaagcttccacatttcgcccgaactggttgtaaagaccttgtacactagtctggcgaaggttgctccggcgttcctcaggccgaaaggcatcctgaggtgacagaaaatgcccaacagggtgatgaatgctgttttcgggatgt

SEQ ID NO: 85568 - DNA, 731 bp, Oryza sativa
tggatggcgaggtggttctatcacaccatccccttcgaaccgggctctgactcggcgaaagctcttcggtgccggcgcagggttatcgtgccgaatcggaaacgcaggatcgccgtggacggcgctatggaggcacggttcgccttgctgtgaaaagtttgttctcgccttagctgccgcgacctggtggaggaattctgcatgcttcgcgtctttcccctctcccaatcatggcaggttacagttgatccgagcgaagaggttgatggcttgcctaagctggtcctccttgagggaatgaacagtaagactgctcttttcgctatacactcccgtgtttttactattttgcctcgtttgactttcaacatgactccccctccttgcctttacagtgctaaccctcgaccaagctgaggccgaagcccgcaagatgatcggcgatgtgtcggtcgtcgagtacagccagttgctgacacggcaggcagttggtcgagcgaactaggtttacaatggcgagttgcctcctcgggcgaatccccacaagaccaatgacgaagcaggaccttcgcggaagcacacgcgcggtcaggtaaagcttgcccctaggaagcatagggctcctgcttcgtcggactctgatgctgatgacgaggaggatgctgaaggacgtgacggcgaagaggaagggggggaagaagaggaggtggagaccgtggttgaaaaggcca

SEQ ID NO: 85569 - DNA, 1197 bp, Oryza sativa
tcgctccgggggtttggcggagaggcagttcaagttcttggccaagcacttttgctgatagctttcggctcgggagaaaacagacgcgaagagcaagtactgttcgatgtcgtcgacatcccgtacaactacaatgccatcctcggccgtgcgaccctgaaccagttcgaagccatttcccaccacaactatctcaagctcaagatacccggcccagcgggagtgatagtggtcaaggggcttcagccttcggccacgtcaaaaggcgatctggccataatcaacagggctgtgcacaatgtcgaagccgaattgcacagccggccgaaacacgcgccaaaacccacccctcacagcaagatagtaaaagtgcagattgacgatgccgaccccgcaaagctcatatcgctgggggacggcatgggcgaacaagaagctgagggcatcctagcggtgctcaagaagaacattgatatcttcgcctggagccccgacgaagtgggggttgtttcaacagacctcatcatgcatcaactggcaatcaagccggatgccaagccaagaaagcagaagttgtgtaagatgtccgccgatcgtcaagaggcggcgaaagccgaagtccaaaaactactcagggctggggtcattcaagagattgaccacccagagtggctggcgaatccagtactggtgcggaagtcaaacggcaaatggcgcatgtgtgtagatttcacggacctgaacaaagcatgtccgaaagacgatttccctttgccgcggattgatcagctcgtggattcaacagctggctacgaactcatgagtttcctggacgcatattccagctatcaccagatccatatgaacccgcccgacatcccgaaaacagcattcatcaccctgttgggcattttctgtcacctcaggatgcctttcggcctgaggaacgccggagcaaccttcgccagactagtgtacaaggtcctttacaaccagttcgggcgaaatgtggaagcttacattgacgacattgttgtaaaaagccgtaaggctttcgatcatgcgtccgacctgtagagaccttcgacaacttgcgcgcagcgggcataaaactgaatcctgagaagtgtgtcttcggcattcgcgcgggcaagattgctggagattcctggtttccgaaagaggcatcgaagcgaa

SEQ ID NO: 85570 - DNA, 1967 bp, Oryza sativa
aagcactgcaaggggcgaaggcaagatacatcgaaatggaaaagctcgcttacgccctggtgaaggcttcgggcaagctcaagcactacttccaggcccacaaagtaatagtgccttcacagtaccccttgggcgaaatactccgaggcaaggaaatctcaggcaggcttagcaaatgggcggcagagctatccccgttcgacttgcattttgttgcacgcactgctgttaagtctcaagtgctaactgacttcgtagccgaatggacaccagtattcgcctctgaacccgagcccgtcgaacaaccctgggtaatgtgctccgacggttcgtggtcgcacaagggggcaggcattgcggcaatactcatttcgccgaatcgcatcccagtttggtacgccgcaaggctgcagtttaacacaaccaacaacgcagcagaatacgaagccattcttctaggcctaagaaaggcgaaagcactgggagttcagcgcttgctaatccgaaccgattctaagttggtggcaggccatgttgatagatcctttgaggcaaaagaagaaggaatgaaaaaaatatttagaggctgtccgaaccatggaaaagtacttcaccggcataactgttgaacacttgcctaggggccagaacgaggaagcaaacgccttggcgaaatctgctgcttgtggcggaccgcatttgcctggcatatttttcgaagtactgcacacaccaagtgtgcctgtggacagtttgacggtcttggcaatcgaccaagtgaagttgggagaagacccaaatgactcgcgaaccccgtttgttaaatatcttgaaactggttggcttccggacgacgaagcagaagcaaagcgcttgcaaatcagagccacgaggtataagttggggggaagacgtacccgaaccgccaggctttttatagcagagcacccctcatcgaactcattcagttcggtgaacaagcttagggcactggcaggcaatacaagattgcttaccccctccacaaaaggaaggaggtccgcctgtgtctcgaagtcgccaggggcgaagcggggtaccgcgagcgagtattccgaagcagatgtctcgacgaccgctctctttcccttcgcctcaatcagcggcgacgcaaccagctgacatagaggactgccgaatacttttgctgcggctgtcatgattctttccgcagaggccgaagccccagcggcagtactaccgcctgctccagcggcgccgagtggaggaacgggggcagccgaaagatccaagctgcggccagcgggcgaagtcggagtcccgtcagaggactcatcgccgctaaaaacacgagcgacatcaacgagtccttttttcttagccaccttcttgacaagacctcccttcgccgctttgcccgaagaaaacgcaaccagggccttcgccccgtctaagtatttttggcgaaggggggagctattcgactccaccccggtctcgttatggccaggactcggagtgggggtatagccgggagtcacagcgcggccctcaaccgcctcgcccttggccttttcaaccacggtctccacctcctcttcttcccccccttcctcttcgccgtcacgtccttcagcatcctcctcgtcatcagcatcagagtccgacgaagcaggagccctatgcttcctaggggcaagctttacctgaccgcgcgtgtgcttccgcgaaggtcctgcttcgtcattggtcttgtggggattcgcccgaggaggcaactcgccattgtaaacctagttcgctcgaccaactgcctgccgtgtcagcaactggctgtactcgacgaccgacacatcgccgatcatcttgcgggcttcggcctcagcttggtcgagggttagcactgtaaaggcaaggagggggagtcatgttgaaagtcaaacgaggcaaaatagtaaaaacacggg

SEQ ID NO: 85571 - DNA, 3616 bp, Oryza sativa
gcgggttcataccccagggaatagctccacttcggttcaattcagcccttctataacaatagaaattcaaagatcaccatttctagccaacctcattcttctcgaatccaaagacctagatgtcattcttgggatggattggctgaccaagtttaagggagtcatcgattgttcgaatcgcacagtcaccttgaccaacgagaagggagaaacagtagtgtacaaatcaccagactcaccaaagcaagggatctctttgaatcagattgaggcggaaatcccagtggacaccgtggagaagaatttgaggaaattggaagatatacccatagtctgcgagtatccagaaatgttccccgaagaccttactaccatgccacccaagagagagattgaattccggattgacttggcaccgggaatcgctccaatttacaagagaccgtacagaatggcggccaacgaactagcagaggtcaagaagcaggttgatgagcagctgcagaaaggttacattcgaccaagtacttcaccttggggtgctccggtcatttttgtggagaaaaaggataagacgaaggggatgtgcgttgattaccgcgcactaaacgaggtcacaatcaagaacaaatatcctttgccgtgaatcgatgatttgtttgatcaactgaaaggagctaaagtgttttctaagatagatctgcgatcaggctaccaccagttgagaattcgggaagaggatattccaaagacggccttcaccactcggtacgggctatatgagtgcacggttatgtctttcggacttaccaatgcacccgcattcttcatgaatctgatgaacaaagtgttcatggaatttctggacaagtttgttgtggtattcatcgacgacatacttatctattcaaagtccgaagaagaacatgagcaacatctccgtctggtactcgagaagttgaaggagcaccagctatacgccaagttcacttctggttaacagaggtcaaatttctgggccatgtcattacagctcagggtgtggcagttgatccatcgaacgtagagtcagttaccaaatggaccccaccgaagaccgtgtcgcagatttgaagttttcttggacttgcaggttattaccgccgattcatcgaaaacttctccaggatcgcccgacccatgactcagctgcttaagaaagatgagaagtttaaatggacagctgagtgcgataagagttttgaggagctcaagaagaaattagtatccgcactagttttgattctgcccgaccaaatgaaacacttccaagtctattgcgatgcatgtcgtcacggacttggatgtgtcctaatgcaagaaggcagagtggttgcgtatgtctcgcggcagttgcgtccacacgaagggaattatccaactcatgacctggaattggcagcagtggttcatgctttgaagatctggaggcactatctgattggcaaccgctgcgaagtatatacggaccataagagtctgaaatacatcttcacccaaccggacctaaatctccgacaacgaagatggttggaactaatcaaagactatgacatcagcattcactaccacccgggtaaagccaatgtggtggcagacgcattaagcaggaaaagttactgcactgccctatgcatcgagggcatgtgtgaggaattgcggcaggagtttgagcatctcaacgtgggaattgttgaacacgggttcgtagccgctctggaggcacggcctacgctcgtggatcaagtcagagcagctcaagtaaatgattctgaaatagcagagctgaaaaagaacatgagagtcggaaaagcccgggatttccacgaagatgaacacggcataatctggttgggagaaagattgtgtgtacctgacgacaaggaactgaaggatctgatactcaccgaggctcatcagacccagtactccattcatccaggcagcaccaaaatgtatcaagacctcaaagaaaagttttggtgggtcagcatgacgagagaaatagctgaattcgtcgcactctgcgatgtttgccaacgagtgaaggcagagcaccaaagaccagcaggtttgctccaacctcttcaaatcccggaatggaaataggaggagattggaatggactttataacaggactgctccggacatcatcgggtcaggattcaatctgggtagtcgtggatcgactcactaaggttgctcacttcataccagtacataccacgtatacgggcaaaaggttggcggagctctacctctcgagaatcatgtgtctacatggagtacccaaaaagattgtatctgatcgagggagtcagttcacctcaaaattctggcagaagctgcaggaagaattggggacccgtttaaatttcagcacggcctatcacccgcaaactgatggtcagaccgagcgagtcaatcaaatctgggaagatatgttgagagcttgcgctcttgattttggtggagcttgggacaaaaacttgccatatgcggaattctcgtacaacaacaactaccaggccagtctacagatggcaccgtttgaagctttatacggccggaagtgccacacacctctcttctgggatcagacaggcgagcgtcaactattcgggacagaggtattagcggaagcagaagagaaagtcagaatcatcagggaaaggttgaggattgcccagtctcgacagaagagctacgcggataacccccgaagggagctcacttttgaggcaggagattacgtgtatcttcatgtcactccactcgagtttcgtcgccggaattcgcatcccctcgcgctccggtgagttcaacccctaccgccaccttcggctatgaatgccggtcgccgtggttcatctccctctctctaatctctctctcttccttccttagggcaccccgaaacccgtccgccggttcccgtcgtcctcccgtggctagccgtcgccattcgccgtcgtcttcctccgcgccggccaccctcggtgaggtttcctctcccatccattcccctccctctccttcctagccgccgcttagtgccgccgccttcgcgtcgcctttgcgccgtcgcctccgccgccagatgccgtcgccggcaacgcgtttgcgcgcgcgcgccgtcatcatcgccgcggccggtaggccggccttgagccaagccgagccgggtcgccgccgcccatccgatcgaccccgagggcgatctgggccgtcggtccggtggaccggcggtggaccacccgcgtggtcccggtccgcggtgaaccgccctcccccttgagtcgctgaccggtgggccccgcatgtcggcgccgcgcctcctcccccgtgctgacgtcagccctgggatttattgcgcaatgaatgatttaaggtttttcttttatagtaataaaacacagtgaatcttctaaaattcataactaattcatccgagctccgtttaagcccattcaagtctcagtaaatcaagaaaaatgtgtagaatccattaaaaatggttttgttccctgttgcagtagtcttatagcctttttgcaatgtttgccttgtatgtcg

SEQ ID NO: 85572 - DNA, 4114 bp, Oryza sativa
tgaggtgtgctgtgcttggttagagggggttatgtgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatccttagaatctggatagtataggtggatggttgggcctgtcgcaacgtggtatagcgttggacagtggatgattaatattaattaattattacaactgtttaaatctttcaacttctgtttataaatgctcgctttatgcaaatgaaccactccagctctcctttggtaattccctgcatcatacccctattccggtatgacttgctgagtacagtgggtagtactcagtcttgctctatttttcccaaccccagagtacgagtatgtggcagatggaggtttctctgaggagtaggcttcgtccgtgccgtcgaggatgcctgtggagtggtgttcccactgcagttctagtcaagacttagctcctgttgtctttcgttttccgctgcatttatgtaagacttttatgatgtttgtaagacgtggatctgaatgtcaacattgtcgtttgtgtaccccggccggtcctggacggggattttaatgcacattctgcttggaattctattcgggaatttctgggcgtgacaagttggtatcagagccgaccttgaccataggacaagccaaatggaaaaacctaagagccctctgaatccttttcattgcatatgttctttgcaattggatttgttccgggaaaattgggatctgttcttgtggttcaaggggaaaaatcttggtcgctcgtttaagtgagatttgtcaaaacaagtcagtctagggttttagtaaaactattgagatttattcgtcagtcagttgggatttgatgggtgaaatgcattaggtcctagctcaggaacatgggttgcaaggtatttatgctcttactgttactattagtatgtatctaatttccccaatattttaccgttatgtaagtctgtcttatttattcgctctcatgcaaaatgatctatgcataaaatttcgctcttattcgattctcttatttgagtcctttattgctttatttaaatttggatttgagcatgcattgattctactcctttgtcttctctagatggccggccacccacccaaccaccgcggagaaggcatgattgactttgtggcagagttggcacgtatgacgctggtggtgggctaccccaacgcgccagagcacacgactgttccaccgctcagtggcgagcttcctcaccgtgttcgcctggaggtccacggctacgtgggtacctgcctagctaatatggtggttgaggcatccggaggcacagcagatcacgcctgtcaggaggcagcatacctgatgatggccagactacgggagcgccacaactacatcttccacgacacggcgtaccgatttcaccctcgtcgagctagcagtgatgatgtcagtactttccgtccgacagccagcgagaacgacactacctttggtcacatgtgtgctgtgatgaggggattggataggatgcactcggacttgcacaaggcgtccaaggccttgaatgatgggaagctcatgaggatcgtcgctctgaaggacgagatagcgcgcctgaagagggagaaggctcagttaaagggtcttcccgcgccagaaggagtccggatccgcactacgccccacaagacgacgactgcacccgtgcgcatccagcttgcgcccaggaacccacctccatcagcaactcccgcagcacctccagttctgcccgcagctccggtagttcctgcagctccagtaccagctccagctcccgttcacgtgtcagctcccgcgtccgctctctccttcgctccagcatcagccgccaggggtccagccagtggcaacggaggttggttgcctgctactcccagtggcagccacgatctcagcagcagtagctccagtggctcagagccgggcagcggcgagacttatctgccaggctccaggagtcgctcagagggacctggtgacgagcaggaggacgccctcgactccaccgaccgcaggagccattccgagcattaggctcgttttccattagtttatcgactgtctagcatttgtttgttagtttgtgtgtttaggttgcttgcttgtgggtcagtcgacggtcgatatcatgtgcctatgatatggctgtcttaataaggatttttgcttgctttttaagtgttttaattcagatcagaacaattgcagtttaaattcctatataataaagcttagttcttgagcctcttttttttttcttcttttccccgtctgcttttcctccagatggtctacaccaggaatggtagccgcgcaacaggcgagggcagcaacggcgaagagcgcactgagggtgtgcatcccaacagcaattccgacaatggtccgccaccacttcccgagaatccgacgctagcccaagtgatggcacatcagactcaaatgatggcagccatgatgcagcagatgcagcagcagcaccagcagatgcaccagcggatgctgcagcatgcggaacagcagcatcagcagtttggtccccctccccctcagtccaaattgccagagtttctacgtgtcaggccacctactttctccagcaccaccaaccctatggaggcgaatgactggctccatgccatagagaagaagctgaatctcctgcagtgcaatgatcaggagaaggttgctttcgccacacaccagcttcaaggtcctgcgtcagcttggtgggacaatcacatggccacccgcccgccaggcactgaagtcacttgggcagagttctgtcatagcttcaggaaggcgcaggtgccagatggggtcgtggcacaaaagaagagagaattccgagcactgcaccaaggcaacaggacggtgacggagtatctccatgagttcaatcacctcgcgcgatatgcaccggaggatgtccgtactgacgccgagaagcaggaaaaattcctagcaggtctggatgatgagctaaccaaccagttgatatctggagattacgccgatttcgaaaggctggtagacaagacaatccgtcaggaggatcaacgcaacaagatggacaggaagaggaaggccgctcagttcagggcacctcagggaagtcaccagaggccgcgcttcgctcccgagcagcagggtggacctaccaccatgatcgtccgccagtaccgcccgttcaaccctagcaactttccccagggcgcaagtggcagtcagaaccaccatggaggtcagcccaaccgcggtgcagctccgctcccaccaatggcaccggcacagtcaggcccgtccgcgcaagccaaggaggagactggagcaaaaccagggtcctgcttcaactgtggcgagcttggccacttcgctgacaaatgcccgaagcctaggcgtgccgggccaaggtttatccaggctcgtgtcaaccacgcatctgcgaaggaggcacaagcagcaccagaggttgtactgggtacgtttcctgttaactcaatccctgcaacagtactttttgattctggtgcaacgcattcgttcatttcaaagaagtttgtcgggatgcatgggttaataagagaggaacttagcacaccaatgcgggttcataccccagggaatagctccacttcggttcaattcagcccttctataacaatagaaattcaaagatcaccatttctagccaacctcattcttctcgaatccaaagacctagatgtcattcttgggatggattggctgaccaagtttaagggagtcatcgattgttcgaatcgcacagtcaccttgaccaacgagaagggagaaacagtagtgtacaaatcaccagactcaccaaagcaagggatctctttgaatcagattgaggcggaaatcccagtggacaccgtggagaagaatttgaggaaattggaagat

SEQ ID NO: 85573 - DNA, 1190 bp, Oryza sativa
gaacgttgcaacgacgtaatgacagagattatagaggaacttaacgtgccagtggactttgaccatttagacatatacacatcccttaatgatgagcagcgtgcaggatttgatgaaatcattgatcatgtaactaataagaagagctaggtattttttatcgacggcccaggtggcactggcaaaacatttatgtacaaggcgcttcttgctagagtgcggtccgagggattaatagccattgcaactgcgacgtctggtatagcagcgtcgattttgcccggaggacgtaccacgtactcgagattcaaaatccctattaagattgctcacaacagcatgtgcaacttcatgaagcaaagtgtcaccgcggaattgcttcgcatggcgtccttagttatttgggatgaagctgcaatgacgaagcgtcaagccgtagagacacttgataggtctcttcaagacattatgtgttgttcattgccatttggaggaaaggttattgtttttggcggtgatttcagacaggtacttcccgtggttacacgtgggacaagggcccagataactgatgcacattgcagagatcgtatttatgggaaaatattaggaagatcagattgtcgcgaaacatgagggctcaatctgatccatggttttcggaatatctccttagaattggaaatggcactgaaaacactatcagagatgattatgttcgcttgcctgatgaaattgtgattgcttatggggatagcgaggattcagtacacgaattgattaatcatatgtttccctcgcttgatgatgaaaagaatgcaagctctgcatcttatatgagcacacgtgccattctatccactaaaaatgattatgtggacaagctgaatgcgaatatgattgacagatttctagggcaggccaaggtttatcacagctttgactctgttgatgatgaccttcacaacagttatcctctggactaccttaactctatcactccaaatggtctctcaccacacgagctaatagtaaaaatcaattgtcccgtgaatcttcttcgcaaccttgatccaaataatggattgtgcaacgggactagactaatggttagagcttttcaagataatgcaattgatgctgaaattgttggtggacaacatgccaacaaaagggtgttcatcccacgg

SEQ ID NO: 85574 - DNA, 1995 bp, Oryza sativa
attcgagctcgttaccctatcatagtattgcactttacatgaaatatattttatgtacgatataaattgaattaaagttcatttttatagatcatataaatttttttttgctaacatgaaattttaaaaattattaaagacagatagaattgcaccgtagcgtttagcacgggcatattactagtaatattagttacttacctctttagtattattttgaacttttctcttcttcttccttggcaaatcaaattccatgtgtttaaatggacatgtgggaaatgtgtggtctgttctaccacaatgactacaatgatttgtctctttttcttcaatttgctcattaatagtcttgtttctttgtcttggccttccttttgaattttctatatcaggatcttccaaatattttcgtcattcattgtttgttcctccacatcaatattctcggaattttcattgacttctgcttttccattttgcaagatgttatcctcaacattgatattttgatgttcacactcttgaatcgttgaaatcattgatttcaatgtgctactaattttgtctgattcttccaacaagtattgatatgtttcaactgatttggaacctcttgatatattaatgttacattttttaatatattaatgttacattttttaaatactaaaattacatttttttctatgtaattcttatacaaattgactgtaaattgtatcgaaattattaaacatttcaaattgatgtttgtctttagacaatagtgataattttgaaagatagtattattgattattagaagcaaacatcaattttcttaacaattgttctcaattatattttttaagttctaaaatgacagggtttttttaatgtaatgatatttcaaattcaatgcaattttaattgaattttataagacagatcaaaatttacctattcttgattcctgtgtgttcactccactcatgctttccttcttttttttccgtaacttcactcatatcatgtttctcttttgttgcaactgaaacaatcaaaggaaattgtttatggacaatacatttaacttgaaaaaagaaattaaagtagtagtaatcacataaattttcatttacatgtttttagtactaaatttacagttttttttctatgtaattcttatacaaattgattgtaaattgtattgaaattattaaacagatcaatttagtacttctaaattcatttttgaatcatttcaatactaaaacaataccagaaattgtatttaatatagatagtaatgataattacaagtgaacagaaatttttgatcatttgattccagttacatgtttcaagttctcaaattacagtgcagattctatgtaattcttacacaaattgactgtaatttgtaattttagtcagttcatgtttttttggttgaatctgaaaggactgaagcaaaatcttgtttgtattatgactgcatagcacaatattcagagtagtgcagtatagtgcaacattcagtgttttcagatctaacattttttctaatttcagatccaacattttttctaattgaaacattccaataattgaaaattgaaatttataagtctagtttcagtttttatgttttgatacagtgtttttcactgtaatttgaatttaattttgtaaaacagatcttgatttacctgttcttgattcccatgcattcactccactgatgccttccttcttttttccttctacaattcctctatgttcactcaaatcctgtttctttttggttgaaaccgaaacaatcaaaggaaattgtgtttttttcttttaaaccataatacaaacattcaaagtacattagaaatgaactacatagaaagtgcattgtaattttgaaactaacgaatcaaatttttgtttcttttccgtcttgagcattttgctttagcgagaaaaaaaatttattattgaattaatcttgttagtacttct

SEQ ID NO: 85575 - DNA, 639 bp, Oryza sativa
ggttacgaacatacttcttcagaacgcccatgtacctctcgaaagaaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaccaagccaagaaggtttacgcaaaggttcttagtgaggtgcatcacgt

SEQ ID NO: 85576 - DNA, 528 bp, Oryza sativa
gttctagctcaaacttcggatcttgatgaggcgctggaaagtttcggcaacaagcaaaaaaaaaccggggaaacccttttggggaaaaggggtttggggaaacccaacctggggagaagaagcggaaagatcgtaaggctctgtcgctaatccaacttcatctatctaatgatattttgcaagaagtgttgcaggaaaagactgctgcagaactttggctcaaactggaatcgatctgcatgtctaaagatctaaccagtaagatgcatatcaagatgaaattgttctcgcacaagttgcaggagagtggttctgtgttgaaccacatatcggtcttcaaggagatcgttgccgacctagtgtcgatggaggtacagtttgatgatgaagatttaggtcttttactgttatgctcactgcctagttcatatgaaaattttcgtgacaccatacttttaagccgtgatgaactaaccctagcggaagtttatgaggcgctccaaaacagggagaagatgaaaggtatgg

SEQ ID NO: 85577 - DNA, 1097 bp, Oryza sativa
tacagtacttcatgatggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgggacgaggacaaacaggaggagtttaatctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcaccaaaccacccggtacggaagaaaggcaagcacttcgaacataaggccgaccaccgtacgaagcctaaacatcgcagcgggaaaatagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggatagattagaagcccttcagaatgaagtggtgcaatgtctcgtcagttttgagttgat

SEQ ID NO: 85578 - DNA, 5467 bp, Oryza sativa
tttatgatatctattgttgttgtgttataaatgagtttattccaccatgcttgcaaaacaaaggtcacatcaaaacaatctcccctaatgggataaagccgtaaaagatagccagagaattaggatacttactcaatcaatcaacctgcacagatggcaagccgacgtcgggcaacaaccagcaatgacgaaactcagacacccgacttaaccactctggccagagttatggccacccaaactcaacttctgcaagccatcgcaaacaaccaaggcaaccgcggcggatcgagctttggagaatttatgaggaccaagccacccacattcgccacagcggaagaacctatggatgctgaagattggttaagggtcattgagaagaagctaactcttgttcgagtacgggaggctgataaagtgatctttgcggcaaaccaattgggaggaccagccggagactggtgggacacataaaaagaagctcgagaagaagatgctggagaaccaaactgggaagaatttaccacagccttccgtgacaactttgtgcctgccgcagtgatgcggatgaagaagaatgagttcaggagactacggcaagggaataccacagtacaagagtacctgaaaccgttcactcagctggcacgctacgcgactggagatcttgccgacgaagaggaaaagatcgacaaattcattgaaggcttgaatgacgagttgcgtgggcccatgattagacaagaccccgatagtttccagagtttaatcaataaggtcgttaggctggaaaacgaccggaaggtcgtggagcacaatcgtaaaaggaggcttgccatgaaccgcccgcctcagaccgcaccccagcgtcctaaagggacaacctcctcggcatggagaccaacagtggtgacaacgcctccagcaatttccacaggccggttaccattcagaaccgagctcctgcaccaaatcaggccgccactggaccagtaaggccaggaagctgtttcaactgtggggagtatgggcatttcgccaacaaatgcccccatccaaacaagacacctattcgcaccggagctaatgcaacgactattcacggaactgctacccctgctgctggacgaggtctatttaggactccacagactaacaggaccgctaccggatttggacgcggacaagtgaaccacgttcgagctaaagaggcctaggaggaccaaggcgtactgatgggtatgttttcactcaacttcactccagttaaagttctcttcgattcaggagcatcgcattcatttatatctctgaaagcaagtcaacaacacaaattaaccagagttaaactaaggcaaccaatgttagtacattcacctgggggtgaaatagccgtggacacagcttgcattgatgtacctattcgccttagggatgtggtgtttccctccaaccttatggttttgataccacagacccttgatgtcatattgggtatggattggttagcaaagcatagaggagtaattgactgtagacgtagagaagttaccctgaccacaccctggggatcggatatgagagcaaccatggatcaagatcctaggctaaccgaacgtgccggaggtatatttaccatgctacccctaaagggaatgcccgtagtgcagctatttcctgatgtgttcccagaagatttacctggaatgccaccagatcgtgacatagagttcattattgacctgatacccggaactgcccctatatccaagagaccatatcggatgctggtcaatgagttagaagaacataaaaagcaaattagggagttgcaagaaaagggatttgtacgccccagttcgtcaccttggggagccccagtgctattcgtcaagaagaaggatggtagcatgagaatgtgtgtggactaccgctcactgaacgaagtaactatcaaaaacaagtatccactaccacggattgatgatctttttgatcaactcaaaggagctaaggtgttctctaagattgaccttcgattaggataccaccaattgaaaattaggaccggggatatacccaaaaccgcgttctcaacacgctatggattatatgagttcaccgtaatgtcgtttggtttaaccaacgccccggcatactttatgaatcttatgaacaaagtgttcatggactacttggaaaaatttgtggtggtattcatcgatgatattctaatctactccaaagatgaggaagaacatgcggaacacttgcgattggtactcgagaaacttcggaagcataagttatatgcaaaattcagcaagtgtgagttctggttaaaagaagtcgcttttctgggtcacgtaatctcagccggtggagtagcagtggaccctacaaaagtggaggccgttacggaatggaaagcacccaagtcggtgaccgaaattcagagttttctaggcttggctggatactaccgaaggtttatcgaggggttctctaagatagcccgacccatgacacaactactcaagaaggaaaagaagtttgtgtggtcagaacagtgtcaggaaagctttgagcagctcaaagaaaagctgacctcggcgcctattttagttcttcccaacatcaggaaagactttgttatatattgtgatgcatcaaggcaaggactaggaggagtactgatgcaggacggaaaggttgtggcctatgcgtcacgacaattgcgacacatgaggaaaattaccctacctatgacctaaaactcgcagctgtggttcatgcgctaaagatttggaaacattatctgatcggaaaccattgcgatatctacactgaccacaagagtctgaagtatatcttcacccattcagatctcaacttgaggcaaaagcgatggttagaattaatcaaggactatgatctagaggtgcactatcacctaggcaaagcaaacattgtggcagatgctctgagtcgtaagagccattgcaatcatttgagaatggaagggatggtcccttagcttagggaggaaatggcccaactaaacctatatatagtatctcgtggacaggtaaacaccctggacattcaacctcttttgagaacccagatagaggaagcccagaaggacaacggagagatccaggaggtgaaggaacgcatggccactggtcatgtgaaagaattctcaatggatgagaagaaaacactgtggtataaaaagagaatctacgtacctgaacagggtggactgaggggattaattttaaaggaagctcatgaatcggcatattcattgcaccccggaagtacgaagatgtaccaagatctgaaagaaggatactggtggcccaacatgaagagagatgtgaaggaatacgtagcactctgtgacgtgtgccaaaaggtaaaggctgagcatcagcgaccggcaggcttgctgcaaccccttaggattcccgagtggaaatggaatgagataggtatggattttattgttggattgcccaagaccgcaacaggatatgattccatttaggtgatcgtggatcgactcaccaagatggcgaggttcatccctgttaagacaaattacagcagtgccaagctagccgagttatacatgaccaggatagtatgtcttcatggtgtacctaagaggattatatctgatcgaggcacatagtttacctcgcatttctgggagaaagtccatgaagccctaggaagttaccttgcgtttagcacagcttatcatccacagacagatggccagacggagagaaccaaccaggtcctggaggacatgctgagagcttgtgcgttggactttagcaaagacggggagagatgtttgccctacgccgaattctcctacaacaacagctttcaagcaagcctaaagatgtcacccaatgaggcattgtttggtcgacgatgtcgtaccccgctaatgtggtccgagactggagaacgggcggtatttggagctgacattattcaagaagccgaacaaaaggtttgcttgatccgtgaccgtttaaaagtagcacaatcacgacaaaagagttacaccgacacccgacgaagaaacctggaatttaaggaaggagattacgtttatctaaaggtttctccgataaggggaataaaaaggtttaaggtcaaaggaaaactggcaccaagatatgtgggaccattccagatcatcgccagacaaggagaagttgcataccagttacagctaccagaaaatatcgccgatgtgcacccagtctttcatgtgtctcagttaaagaagtgcttgcgagtgccggaagaacaagctacgttggaagaaattcatattagcaatgatctcacgtatccagaacacccagtccggatattggatgaagctgaaaagaggactagaaccaaagtgtggcatatgtacaaggtacaatggagtaatcacactgaggatgaagccacttgggaaagcgaagaatttttgaggacggaatacccgcatctgttcgagaactggtaagaaatctcgggacgagatttatctaagggaggtaggtttgtaacaccctgaaaattcgaccgacaaaaatcaaaactctaaaaatgcggattttcaaaaactttttaaataaattgcatcatgccgattttattcgattattttattggagtttgggttcggagtttataaatcgcgaataatggataattggttaggaataaaccctaaaaagtaaatggacaaactaaataattaaagtgcaatttaaaataagatttggtgaggatagaaatgagtaaaatattattacgaccatatttatatccatcaaatttaaaagcaatggaatgagaattaactctaattaagttcaagtaaattacaataataatatataaaacatggaataaattaatctagaataaatccatggattggaatgccacaaatattgagtatacttcatttatgcaaaatttgggaattaaagaatcaaatttaaataataaatgggccaaaatcgggttaattagaaaacggcactgttcattgcacctaaagtgttcgacgaggttccctagccctagcccctcctttgccgcgttgccctcgcgccccgcgcgccgcgcgccgctccgcctcccctctgacgacgctgtcgccatcaccgcgcctggccgcccctaaccccacgccgccgtcgccgtcgtttccgtcgcgtcaccgcaccgccgttccatcgccttgcgccgcgcaccgccgctaccgccgtgccgtcacgcgtcgctcgccgccatcccgtcgcgccgtcccatcgcgccgcgcgccgtcccgtcgccactgccgagccgtcgccgtcgtcgcctcgcgccccgtgccgcgccgctcccccgagccccgtgccgccgctgctaccgcgccgcgccgcccgtt

SEQ ID NO: 85579 - DNA, 594 bp, Oryza sativa
cagctgtacatggacatgagcgccaccggtagagagatgatcgaagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagactatagaaaataatatactcccttttatcgttgtagaaaggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacatagagttagtttaattttacagtcttcctacataccaaatttcattcccgtacgaacttgctaagtgtttcatatgtaatgcatcccacgcacattgcagattccactgggtgcttttactcttcgacctggaggcctgcaccgtcaa

SEQ ID NO: 85580 - DNA, 2690 bp, Oryza sativa
ttctccttttaatgcggctagctccttctccaaacgatccaccttgtcctccagcttgcaaatctttccgcgattccggtcttcacgatcttgagctgctatcacaattttagcgcgggtctcatccatggcccacagcatctcaaccaaatgccttgtggtagcatcattctcaatccctgcaggttcaaggtaactgccacggtcacttccctggggttgacgaggatggtagcggtactcggtgtcggccaaccgatcattgtagctttcgcggagctctcctatggcgatccttgccacctcctaacaagcatgattgtagcttccctctccagcctcgaacatcaccgatgggatatcttcacgattactgttcaaggtgactttgacacgacacttctcttcatcacgatcatgaggaatctgggcatacaaaggggcagtctcaaatcctatgaggaaggacatcgtacgcaactcctgaacaaatcaacatgctaagtttattccattgcagcaagattaaataaaacaatgtggtaacaacttttgttggtaaatgggccattagcacagaatagatgtacagtactaacaacaccggaataataaataaattttgaattagaacaattaaaaagatcatgaactgcatgtgccattaggttggtttaatttaaagagaaagagaggagaacagttctacttttccaatatttttagagggcttctaggggtaaccatttggcataacctagggtcaaggaggctctgataccaacttgtcacgcccggaatttctgtccaaaattccaaacgcttacatgtgtgtaaaccctcatccaagaatcagccgaggcacacaataacaaattgataatagagtacaattattactctaattaataagcgaataaaatgtcattacagaggtagatagttcctttcaatcaataaagttctaagcagcggaaaataaaggaaacagcgcagacgactccactccataggcagcttgaccagggctacgcctaatcatccacaccatcagcatcactgtaaactcctcctctgatgaatgattgtaaggtgagtatatgacatactcagcaagcctcgcagcaaatatgcaagtgcacaggataacaaaggatggcatagtatagtctcatttgcataaacagcatttaataaatatttcagaatttaataaaacagtagaatattaattaaacagtattaatccaacgctatacaacataccctgttgcataggcccaaccattctgaacaaccaatcccggctgcacagttctatctccaaaccaggaatatactattccaaaccaggagctatcaagttattaacagcatcatttaatatggtgagaagtgtgaaactaaacatgaaagacattgttagacccgcccataaccgcgggcacagctattcgaatagtttgaactctggccagaggtgtaccactgtacccacaagacacaacctcaacatcatgtcaaccatgcgttgcgatacttgacaagtacctgaatagagattgtaacaataccctctatataatacaattcacagcagtgcaccgttcccggatcataatcacccccttgtaaacaaggtatggactccccagtgactcccgtgggcttatctccaccacttcacagtctggtgctctactaagaaccatactatacagaaagtaaagccgttgcccacgctggcttgtggttggcacggtaaatgtttcacaaccgaaaatcgtgaaccggtccttaattttcatgagcacaaccatcaaaaccatatgtcacaacccaccattatcaggttttagttggcaaattaattaattaaccaatcatgattaaccatcatgaggtatcattaagccatcattaaataatagtgaagcacaagttatcccagtagtgtgctaatgttactaagcatggctaagaaattatatctaatatccagctgaacccatatataaagctcaactagtcaagttataataaccctaggtatcaaggaatagagtaatcaagaacaaaagggctataacaaggcaataggttaattccacccaatgacattcgaaaataaatgcagtagttgaatagaaacaatagctttaaacgggatcaacatgcttaaagggttgtttgggatctgtgtgacttgccttgctggccttgaaattcctcaaaatattctcctgcaaattcggactctccgggaacgttggaatctaaagagaaaagaacaaaatcaccaaaacagcacataaacaagcatgaacaatacatgtggatatttttaacatgtagatctcaattttagaaaaatttagagacttgaaccaactaaatccgagctaagatgaattagttatgaatttttaaagattaaatcgcattaaatcatttatatagattttaatggaattatgacgcaataatgaattattttttaaaaggaaaaggagattattgcgtcagcgggctcggctcacggtggaccgggtgcacagcggcggttcacggaaacgaatggccgagatcgatctatccaaaacggacggccaagatctaacggtctacgaccggtctacggcggacggcgtcgatgacgtcagcggtgatgtcatcaccgacgacggctc

SEQ ID NO: 85581 - DNA, 839 bp, Oryza sativa
aattgaagcacactccgggcttgctgccttgcttccttttggctagctgattctatgtcaaagctgcaacaggacgtggagcttggttgcggttgttgttgccagcattgttgttgaagaactgacgctgcggacgaacaacagactaagaacctccctctagcattgactgaggtcccatagcaagacgctgtctctgactattcccctgctgagccttgaagtgagcattcggcgtttcttctgctccatgcagttgtacttgtcctcctggcgaatagccttatccactaacttctggaaatcatgataatccccagtcattaatgggtaagaaagctcatcattcagaccttcgaagaacttctcctgacgctcttcatcagtgcgcacatcttctggagcacaacgggccagacgattgaattcatgcaagtattcggtgacagagcgagatccctgaatgagcgccctgaactccttcttcttgagagacaccactcccgatggtatgtgcgtcttccggaaagcagcggtgaactcaagccaagagataggttcagcagtagtcctgttgagacggaagtgatcccaccactcagaggcagggccatgcagctggtgtgaagcaaaagaaaccttctcttgatctgtgcactgaagcaggtccaacttcttctctatggcgtgcaggcaatcaccagcttcaacaggatgggtggtgctagagaaagtaggcggcctcacgcgaagaaattctgccagcttattcgggggaggtgcatggctggttccctggttctgctggttctggagttgctgcatcatcagattcataa

SEQ ID NO: 85582 - DNA, 757 bp, Oryza sativa
cttctgaccacttgtacttcacatctttctgaagcagtcgcgtcatgggcttggcaatcttggaaaaattctctatgaacctccggtaataacctgcgagacccagaaaactacaatctctgaaactgtcttcggttgtttccagttggttacggattccacattactaggatcaacggcaactcctccggctgagatgatgtgaccaaggaacttcacttcagacaaccaaaattcacatttgctaaatttggcatacaactgatgttctcgcagcttctctagtgcaagacgaagatgttcttcatgctcttcattggttcgggaatagatgagaatatcatcaataaagacgaccacgaacttgtctaggtattctataaacaccttgttcatcaagttcatgaagaaagcgggggcattggtaagtccaaaagacataacagtacattcaaacaacccatacttagtggtaaaagccgtcttaggtatatcctcctctttaatcctcaactgatgataccctgatcgaagatcgatcttggagaaaacggtggcacctttaagctgatcaaataaatcatcaattctgggcagcgggtacttattcttgatagtgacatcatttagtgcacgatagtccacacacatcctctgggtatgatctttcttttccacaaagatgactggagctccccatggagacgaactcggtctgatgtatcctttctgaagcaaatcatctacttgcctcttg

SEQ ID NO: 85583 - DNA, 550 bp, Oryza sativa
cggcatggatttcatcactggtctacccagaacatcatcgggccatcactctatttgggtgatagtcgacaaacttaccaaaatggctcatttcatcctggtgaggacaacatattctggaagccgtttggcggaattgtatatggcaaggattgtgtgtttgcatggtgttcctaagaaaatagtatccgatcgaagtagccagtttacttcaaagttttggaagaaactttaggaagagatgggttccaagttgaacttcagtaccgcttaccatccgcagacagacggacaaactgaaagggtaaatcagattttggaagacatgttgagagcttgtgctttagacttcggtggatgttgggataagaatctgctttacgcggaattctcgtacaacaacagttatcaagctagtcttcaaatggctccttatgaagcactgtatggtcggaagtgccgcactccgcttttgtgggatcaaatgggagaacgtcaggtttttgggactgatatcctaagggaagcataagagaaggtaaagatcatt

SEQ ID NO: 85584 - DNA, 750 bp, Oryza sativa
acaaagtcaaaagactagaaatatactaaaagacccgccgcttgatctctgtttgctctatccctatcatcctcttctacaaattctaacacttcaacaattgttgggaacatatctaccaaaattttgagagttttgtaaggagaactccaacgagtatctcatggcctttgaagacattgctcttggttcaacccttttccactttgaagtagcccacaacctaatgctttgctcacatgctcatcattgatgtctctaaccatgtcctgtctcttagctgaaccaccaaccacatttaacaaggtagaaatcatactcacaatagccacaactactaactgaagttggtgggcgaagcaatggacataataagctgaagtactctctcatgactagtgattgtagcccattatattcacctcgcatattactagccccatcatatccttggcctcttacttgactcaagcttagattaaaatctgccattagagcatcaatagaagccttgaggtatgaggccgttgtttccctcacatgaacaacagcaacaaacctttctttcacaattccacatttatcaacgtacctcaacaccacggccatttgctctttacaaaactatctattgactcatcaattagcaagcaaaacacatcatggccaagttcttccaaaatggaatgtaatatttctttggcaaagcagtcaacaatatccttttgaatctcaggagctatcataaga

SEQ ID NO: 85585 - DNA, 2153 bp, Oryza sativa
tacaccatgaaaaacaactaagggcgacataacaatatcggccattgtacatcggcaaaccacaaccgattacaccatgaaaaacaactaagggcgatataacaatattggccattgtacatcggcaaaccacaaccgattacaccatgaaaaacaactaagggcgacataacaatatcggccattgtacatcggcaaatcacaaccgattacaccatgaaaaacaactaagggcgatataacaatattggccattgtatatcggcaaaccacaaccgattacaccatgaaaaacaactaagggcgacataacaatatcggccattgtacatcggcaaaccacaaccgattacaccatgaaaaacaactaagggcgatataacaatattggccattgtacatcggcaaaccacaaccgattacaccatgaaaaacaactaagggcgacataacaatgtcggccattgtacatcggcaaaccacaaccgattacaccatgaaaaacaactaaagacgatacaacagtatcggccatcttaaggtgatgtaaacacatcggcttgtatgcattcgcaatagtagccgatcattgcgttacccaaacacttgggtaatatttcttcaaatatttgccattgagcgctcgctcataaacttcaccgtcatgtccttgcaacatatatgctcccttagacacaaccttatgaatttggaacggtccttcccaattcggcgaccacttgccgaatttactatcacgagtaccaatcggcaaaatcagcttccatacaagttctccttccgaaaaatctttaggtaccactttcttattataatgccgagcaacacgttccttatccctagtaaccttcgcaagggctcgcaatcgtgactgaaccaaatcctccctttcgtcagccataagattgtaatactcattggctgttaaatcgttttgcaactccgtttgtcgagagccgattctaacttcccatggcaaaacagcctcatgaccataaacaagtttgtaagggggaacttgaatctatccatgataagccatcctataagcccataatgcttcggcaaatcgagtatgccattgctgaggataatcagaaattttctgctcgatcaacttaataaaactcttattagacgcctcggcttgcccattagcttgtgcataataaggtgaagaattcaacaacttgatacccactctatcagcaaactgaacaaactcatcggacacgaagattgaaccttgatctgtagtaatagtttgaggaagaccaaatcggtagattatgtgtttctgaacaaattgaatagcatccccagaatcaactttcttcaaaggaatcgcttttacccacttggtgaaataatcagttgccaccaatataaatttatgcccttcactcgatgttgggttaatcattccgatcatatcaattccccaacctttgaacggccacggattaataatatggttcatagctgacgccggtgctcgctgaattgctccgaacttctgacatctttgacatccctgcaaatatctaaaacaatcctctagcattgtcggccaaaagtaccctgcacgccgaagcaaccacttcatcttgtgagccgattgatgagtaccatagatcccttcgtgaacttcgccgattgcaaccttagcctgatcggcactcaagcacttaagtaataccccatcaatcgtccgataataaagctcatcattcaatagtgtatactttaatgccttatatcttaatttcctagaagccgattgagatggattacttaaatactgatgcacatcatacctccaatcatcggctgacactgctgcaatttcaactttaacatctttgatcatcggcttataccccgatgccccttgggccaaatcattagcttcaagatattgttctcgagatacatgcttcaaagtaaccagtcgaaaccctttcattagttccaggcacttctcattataaaccatcaatgtatcgttcttgcattcatattcccctgccaattggctgattactagcaaggaatcccccatgatttcaatggtatcggctacaacttccttgagtaattgcaaccccttgagcactgcttcatactcagcc

SEQ ID NO: 85586 - DNA, 776 bp, Oryza sativa
atcaattgctctctatttttttcatagatatcatgatagttttcggcaaagtaataaattatgttatagattaaagtggctaaggcatcagaaatgttaccggttggattcccattaccatctctatcgggcaatggccttccttgatcatcccttttaactgcgcaaagaatctcctgtctttgagtttcatttaaataattattccaccatccttttaattgaccagaaaacccaatgacaatcatattggcagcttttctttctttgtttccattagctatgcaggcattagcatacataatcatttgatgacataaagtaaagatttgatattcagtaaagccatctaagttccattctacaatttctttgccattgtagtaagtcatattttgaatctgaggaatttcctcaaactgtaggtctgcataagttggttgagggtaataattcctagttgtggaagtaagagtagaaggtttaaaaatcttgttgaccatatcatatttttcattatcagaaatctcattgatatttttatttacttttaaattatttagttttaaggctagctcactgactagttcttcagaaattgtgggtccaaaagccttttattttccaagtttgatgttaggatcaattgttgggacaaacataggactaacagactgagaactagaagactgagaattagagcgaatatttatctttacctcaggtcttcctgttttgtagccttccataaggattgtctctattcgatctgtttg

SEQ ID NO: 85587 - DNA, 954 bp, Oryza sativa
aatgaagaccagcatcccaagattataccatccaaagcatgctgaataaattgtagaaatatatcgatgtaattcaaatgttttacagatgatacccagtcaatctcaattcatttccaacttcctttagaatatttctattatcaagcaatgaaggttatttactcaaattacagaaagaagttatagaatatgttagtttcctacaacaaagactacgagagatgcacaacttgattgcctatgatcagttgactcttactttgaatgaactgtaggaaaggtgtgcagaagataaatgttcagacacaggttaatgtaaagaaagaggcagcccaacagggaaaaatcagatgccctatccaaactgaataaatcgaaacactgtccgagcagatcgaaaagacctaattccaagagaagaaaatcaatgttcacaaagctaatctatattatgcccccaaatgttagcatcggttgaattgagaatattcgaaataaagactaagtatagtaaaagtttaaaccggagagttacagtcttacagccccaatctaagccaaatgcaaaataacacatcagacaaacaaatctaggtaagatcaaaccaaacccccaaaaaaaaaaacaccagctattcctgccactctcttgctgtacacagccatcacggtaataaatcaaaataaatccccaaagcaaacccaccaaagcacgtctcctaacatccaaaaccggaacagaactccccaacacttcaatccaatccaatccaatccagtcgccacgaaacaatccaagcgcaaccaaagcagctacaaaaacttgaaaaacggcggcgaggtgagagaccttgggagaggaggcggctgaccgcctcgtcggggtccatgccgcagtcccgcagcgccgcgtagatctccgcgtcgggccggttcacgatctccttcagc

SEQ ID NO: 85588 - DNA, 3343 bp, Oryza sativa
  unsure (1)..(3343): unsure at all n locations
cgcgatgcgaggaggttcagtcggcggcaacagtggttgcagctatcgagaggagtgtgccattccggtgcagcgaccagcacaacgaggtgacatggcgcagccagtggtggcatgcggaggctgcccggcacggggcaccggtgtagtggtgcccacacgctggcggaggttcagatggcagtggagcatcggtgtgtcaacagtggataggcaggcggtggatggcgggtgaaaacccagcccgtccttggccgagccagcaacgatggcagtcgagcgtcactccctcctgagggcgttgtcatgctgtctcaccccctctagtgggtgaaagcgcagtcaaggttcttgagacctcgcggacagcggcggcgatgtttgttgtttctctctatcgataatatgggcccggggggtacctaggctaggaggaagagaagcctttcctccgcaacgtgcgcggtggacccagcccccctcggggggtcgtgcggtcggccgaagagcgaccgcccgtttcgcctcccgggggctcggngtaccttgtcgcgcccctcgggcccgaggggctaaaccgccccgaggccctcgctcgggcgccacgtggccgccacatgggggcttgagcggggaggagcgcaggttgccaggcgcatttatgggcagtgctccaaccgctccgtcgcatttaatgcaacgtggcaggacgtgcgccgcccactgatgggtgtgcgccaggcgaccggcttttgaccggtctgtgacccggcgatggatggatgggacaggcggcagagcacccacgtctcactccgtgtcacacggcgtgggggctggtatgccccgtcccatcgtgtgcaatgaaaggacgtgcaggtcaccgcctcccacgcgtgtgagcccatgaagtcgccaagaatttattagggaatgacgggggatgtcccccatgtcaaataaaggacttatgtgggggccacccacgggcggccgttcggatcgctgaccgcccatggcatgggacactttttaatgtaggccatgggggtccttctccccaactgggagggcagggaccctgcctgtggcatgccctttacctataaaaggatgacctcatgtcgcaagcatggggaggacggctggatgaaccgaatgctgggtataagctagtaaagccctaacttgcgctgacaggatccgaactctttgtaacctcaaaaagatcatcatacacacaggagtagggtattacgctccatagcggcccgaacctgtataatccccctctctcttttcctcacagttgacccttcaagcacaattcccaccgacatgggcacgagaacgcgctcttcagacttgcacccggtcccctggccgaactcacaaagggggggtctcacggcctcccgctagagagggtcacccctcgacactctccctggagacgctgtctaggtagcacccttgccggaaccacctaaacttttgttgcatgcttgctctagagtcacgtcgtcttgtatcggcgccctagtttatacaagttggacacatcggagggccttaggggggagcggttcattcttctctctcactccctctccctagatcccttagatgtggatagagtagtgctttgtgtcggttgtaggggttggtttctgggcgatcccagttgtagctcctttgttggtctagcggcggtcggtcacgcttagcggtggctggtccggtgctagccttctcttgggtttgcggttggcgctgtcggtgtgtgggtggtggtatctttttttttcctttcctggttatggcctactagggttgtgattttgtaattttttctactttatcaatttgaacttcgccctgtctcgtccgagtcgttaaaaaaaagaagaagagaggtattcatatttggttatgtaatgtttcgatcttatttgatatttttttatatataactattttccgatatatataagcctatgttaaacttattcttcatgctcacatactaaaaaccaacatttataaatcatgttttatacatacacaaagtaaccaacggtttagatattaagcacgccaaacggcgcgcgtattttctagtatgggttatagctcaggtgggtaagtcccgctatttggtttaatccttttgtttccgatatagcaggacaggtttggcctattgttgaatgttcctttatacatcgatgatgagtattgcagggaggaacatggcacaaattcgaagtgcagacatggcatgtgaccaaaaaggaggactgcatgggaaggaactgacaccggaaggagatttcttggttgccttcctgaggtttggttgttgtactttttactagttcattgatacttagattttctgttaatttagtcatgcatgtctaaataatagtactatttttttgttaggaggatgagcaatgcgacactttgatttgggtagatccagagtggcatccaaaagtacaaaaggcattcgagcagctttggcacttgctagaacgtaccaatccaggtcggaggcgctctgagtggacctgttatgttgaaaaaaaaacaaaggcagaagagggaatgaagctagagctggaaatggctcaccgtctttcagatatggaaatttcattcgagaagaagttgtccaaacagaaaactgatgacattagaaattggttcataagaacaatagatgtagttgtgttccttctcatgaaattatttgataatatgtactatgcttgccgttgttgattttctacatgtaaattagctatgttaaggcaacagacgtagtttgtcatctgatttgtagtaaaagaaatggggtctcaggccgttgattgtcatctcatttttctagctgtgcattgttcatttgggttgatgagtaccggatggatggttgcaagttcaggtgtactgagacaaattttccagaaaattattcatatggaaccatcacttcgacactattttgggaggctcactggaaatcagtatgttggaacttaaatctgacagtccgcaacctggcatactgccggtggaatattagctgattgcaacagcctgttgagcttggtaactgagaaattgcagacaccaatgtccttaaccagcccatctgtcacaattctctacatttcacaatacgcagctgggtctatatatcagacgaacttggaaagcttagcaatatgcaaacttagtgttatatcagtgcaggtcccattaaatagctttcagaaaagaatagaggttcaagccaagtgtcagtgagcagtactgtaccgtactgcagagg

SEQ ID NO: 85589 - DNA, 1451 bp, Oryza sativa
tggaccacatggttcaaacgtgtgttagccagcaagagggttcactgggatgaaattggaatcggccaagcacttgaccttactatagcaaactcagccaaggatgaacccctaatggcagctgcttcttacttctggtcaaacactactaatgccttcctgttcaatcaagggcctatgactccaaccctcatagatatcagtatgatcacaggtctggatgtcacctcatcagccaaccctatgagtttgaacacaaagaaccaatatgacttcaaaaccaaaagcgtaggaggttggtcaggctatgtggcagcatacatgggccagggttcggtcactcctcgagaacatgtggcctttctattaatgtggctagaaaaatttcttttctgtggatcaagttgcggccccacaaccaactggcaatttctggctgaagctctagaaacaaagagacaattccccttgggcaaaattctcctcggctatctataccatatgttgagcaatgcatcggctaagatagcagttggctcagtagttggagcaggtggaccctggtggctgctacaaacctggttaaacctgatagtcatgaaggttgtcaatcggccatccgtactagaagccgagttcccaagactagagccgattgtaggggatgatggagaagagcgtactcatcggagatgcacatcatacggagaatacgcttgtacaccaactgatgccggggcaaaactatcggctgaactgctcaaggattggttttgtagcttctatgaaggctttcaaaaagatgctagaatctggttcctttatgaagactctgcacaacttgagcacccagtggatttcagattcgaagacatcaaccatgaagtataccaatcatccagggaaatcttctcggctgcaatcagtccatgcatccttcctgttggcattcatcaaggaagaaacatccaagcttcctatgaattctatcatccaatgagctcagctagacaactcggaatgggccaactcccaatcggcttattctttgctgacaagatccaatgccgaggagggatttcatcaaccctaatgatcgattggctacttagccttcaaggaccccctctgggcagtattgacaacatagaactggcaacattcagaagcaaaagctttgacaggtggtggggtaaatggaaactgcatttattccatcaaccagcttcaatgtatatgacatacctctttccagatgttgtccctcaagtaagtcttcaactttgctcaactctagttaaataactgttcagccaattaatctcaactaatcgtccttttgatttgcagacaacagagtcttcccctcctcatcaaagcaacagtggcaaagacatccgatatgccccaggtttaattcctaacggaggtaggctatctcctccagttat

SEQ ID NO: 85590 - DNA, 989 bp, Oryza sativa
ctatagggcgaattcgagctcggtacccaattatattgtaacttgcatgtaactttataaaaatcttgtgataacatgctattttcacgaagcggaggtcatgataccaaaccctcttacttgtgtgtgcgttttgatttttgcttcttcacttgcacagatcttaaagcaaatctaatggtttcaaaatcacatgaaagttacatatcaattacgttgtaattacatgtaataagttataatgtaattacattactattgtactatatttacatttgacaaatttccaagagaaatgtatagatagtccctagtaaaaaaaaattacagtgtactccctccggttccatagttcttgatgttttggacaatgacacagtcttcaactatatgtttgactttgtttttatactataatatatacaataaataaatgtgtatgtctacttttttatatagtactttgaaagataaatctatatatgttattccagatcgtttagttcactaaacatttttaaagttactgatacttaaagttacaaaagtttaatcttaaccttgtccaaaacatcatgaattacggagggagtactaaagtaccagggctctatctagttattgaggccttgtttagatcaaaaaattatggccaaaaacatcacatcaaatgtttggacatatatatgcgtggggcactaaatgtgggaaaaacaaaccaattgcacagtttgtatgtaaattgcgagacgaatcttttgagcctaattacaccatgatttgacaatgtgatgctacagtaaatatttgttaatgacggattaattaggcttaataaatttgtttagcagtttacaggcggaatctgtaatttgttttgttattagtctacgattaattaggcttcaaatatgtgctcatatactttaaaaactttacacgtacccaaagaactaaacacaccctgattgcctttttggatatccgta

SEQ ID NO: 85591 - DNA, 718 bp, Oryza sativa
gcacgcaacaattcaactggcatttccctgcctaaaaatgctgccacaacaggttgtgtttgcaatgcatgaatcacactatcgaatttactcatgcaatactctgtaagcagcccaaagaaggcatcaaatgatgcttgccatagagctctgttttgcatgctgtaggtagaggccacattctgatcagtgagaagctctgttgctctgtccagtacagactttatgatgaaagaagccccatcacctgcagcatgtccaaggggtcgcagagggggttgcagcgaagaacacacaatagctgcaaggcaagcacttagtccactcaactccaaccgaacaacacaggttgatacagcagtagcaagttttgtcgttgtctcaacagcactactatcagatggcaaatttccaaatataaatcttagatgccggaagactgccatgcaagcaattctagcaagctcactgccagaactcacaagttcaaggtaacgagaaagtagcttgcggcccttcggaagagagactattcggagaaacaccagatcatcatttggtgagagaggtgcattgttactaggtgtaagtggatcaactagttgcagcgattctgccagctgctcaaggagggcctgtctcctgtttctcagttgcaagccaccatcttgctgctggctaaattgcagcaagcgatcaatatcatctacatcaagca

SEQ ID NO: 85592 - DNA, 506 bp, Oryza sativa
aattaacaattttgtaacttaatcaaattacaaattcgtgaaagattcatataagtgatcagtccaagttggtacatatgctaacattgagatggtgacaaactgacaaataataggaaaaactgagatgttaactatgtgaaatgatgatcttctgtgtgctccaatttcagggtataagagaaccataccagtaaacttgaaaactgaggaagatgttgcacttgtatgtctccctgtgagctctccatcgtacttggttgtgttgtgtttgaatatacatgatctgaaactgatggcagattgtattgtagacttgacacatctacagcaccctgcgtcagaatatcaggctgtgaaactgaaggttcatcagtattctccatgctagtgccaattctggcttcaacgtccccatttgttgaagaatttagagcaacattgttgtcttgattcctgcaaggccggccttatcagaaaaggctaatttcttgtcatgaatacag

SEQ ID NO: 85593 - DNA, 836 bp, Oryza sativa
tattttgaaagtgcaagaagactcgtccaatgtactgtgcaatagtaatcattttttgcttctgcaagcccaacttgtattcagctatctcttcgggagtcttgtccttcagctactctgaccctagtgataacctcacggtatgttgtgtttgacagatcctaattggatccaggaatccgataagttcttttttctccttagcatccatgtattgcatcctacaaaagaagtttaaagaagtttgttagtaataatcacatggttttgtattgtacatatttttcatgtaattaatgtaaactcatactcacaggcacccagcagcgacatagttgacgtccatcttttcccgacgatatatggcgtggagatcttcaaaatctagccagaagtaaccgttgccgccgaaagcatctatcggtgatcgaactgttatattacttaggcctttcttgctagtgtccatataccatttatgtaaccttctcatctcccatggaccgtcatcaagtgcaaaatccggtcatatttctttcccatgttcgtatttttccgggcaatcatcaattgccaagtttttttttcccggctagtgcagcggccttcttggggtcatcttctctgaggttggcatgttccttaccccttctaaagacggataccatgaacttctccttttgatcatctttggacttggaattgtggctcctaagcactctaggcacttcagacttctcagtggccttgtcattgaccgggggttcttgcacctcagggtctttcgcaggattagggacttcaaagatttctagatctgtaccgtcccattccaa

SEQ ID NO: 85594 - DNA, 635 bp, Oryza sativa
tgagatggattacttaaatactgatgcacatcatacctccaatcatcggctgacactgctgcaatttcaactttaacatctttgatcatcggcttataccccgatgccccttgggccaaatcattagcttcaagatattgttctcgagatacatgcttcaaagtaaccagtcgaaaccctttcattagttccaggcacttctcattataaaccatcaatgtatcgttcttgcattcatattcccctgccaattggctgattactagcaaggaatcccccatgatttcaatggtatcggctacaacttccttgagtaattgcaaccccttgagcactgcttcatactcagcctgattattggtcgcatatggtttaatagtataagcaaactcgaaacatgcccccctaggggaaattataactaagccgatgccacaaccatgagtgcataccgatccatcaaagaataaagtccatggtactatctcaaccgagccgattgaatcatcacgatgttctacaataaaatcggcaatagcttgtcccttaatcgcttttggcgattcataccgaagatcaaactcagtcaaggaaaatatccactttccaactcgtccctttaatattggagccga

SEQ ID NO: 85595 - DNA, 901 bp, Oryza sativa
catatttggaaatttgccatctgatagtagtgctgttgagacaacgacaaaacttgctactgctgtatcaacctgtgttgttcggttggagttgagtggactaagtgcttgccttgcagctattgtgtgttcttcgttgcaaccccctctgcgaccccttggacatgctgcaggtgatggggcttctttcatcataaagtctgtactggacacagcaacagagcttctcactgatcagcatgtggcctctacctacagcatgcaaaacagagctctatggcaagcatcatttgatgccttctttgggctgcttacagagtactgcatgagtaaattcgatagtgtgattcatgcattgcaaacacaacctgctgtggcagcagttataggcagggaaatgccagttgaattgttgcgtgctagccttccccacacaaatgagtatcagcggaagcagttgctcggttttgctcagcgcacggtgcctgttaacaaccatagttctcatgggtccagtaatggacccatgacatcagaatctatcccaagttcagaaagctggaaaatatgagtgaaagcatagtgtttttgcttctttgggtaatcagtatactagatacaatggctctttaaaatggagactcttccctcattttcccagtaaagaaaagtcaatagtaatatgaatccaggaaacaaagatcgagagggttggagcatcgataaacagtggtaatataaggcaccaagtttactattgttgcgacatgtctggtttattatgttttgtagggatgcaatctgttttgcatgtattatgcagatggatgtgtttttgttactgggaagtttcttcctgagttttgttgctcatgaaacctgcctggtatctatctctggc

SEQ ID NO: 85596 - DNA, 690 bp, Oryza sativa
atatcagataatgggtgccattactggaatactaaatggttctatctggtagactactaattatcagtataaagacagtaaattctgacgaaatatcccaacataataatgcatatttatttggattaaactttaaactcatctgtcacctctattctaaaaataaaatcagcagcagccgttccaagtcattagacttgataaaacagcaatcaatatttatgcattcataacattttggagaaaatgaggtggtcgatgcctagataacaagaaaacacagtgtaaatctgaagaacaggcctaaacattaatacatttgcggtactgtgcaaggttccaaaagtgaactagatgtagtgatgtttttgtatacagtgtaataatccaatgtattgaggatgtttacgtatgctatgactatattttccttacatactgaggaaatctagaatgcagaatgccaatcattagcacaagtaatagaagaacactgtaacaacgaaatttaacaacatccatatcattattttatagtgataggtggccatcaagcaaaatcaccatacctgtgaatcttcactaccactagcaataaaggcctgctcggatccaccaaaacaagaccttatcacaaaccggctgcgcttatgaccagcataccggttaactcgaatggggcaattcctt

SEQ ID NO: 85597 - DNA, 548 bp, Oryza sativa
ctagggaacagatcgaaaaatgcacctcagattgagatgccctgtaaaacctagtaaattcagtccctaacatacccaaccattttcctaattgccacggaccggggcagtatcgtaaatatttcgcatgcgaacttgctgcaccgtattaccaccaaggcaccactcaattcgaagttggtgagtaaaaaagctcctaaaacaaagttctaatctatgcaaggaaacaattcgattaataaaaagaaaaagaaataagcccccggtaacagcagcaccaatcacctcgtggcaagagccagccacggcacgcactgacagaccaggcaaatccacacaaagagaaagggaaccagataatacacgcacatgaagtagaagaaggcggtgggcggcttcttggggcggcgccggtcgacgaggggctgccccttcttccgggacggcggcggctgcggctgcggcggcggcggcttgggccgcggcttgacaggaggcagccgcaccgttttcagcggcttcggcgccgtctgcgacctcgtcttcat

SEQ ID NO: 85598 - DNA, 701 bp, Oryza sativa
atatatcttgtcctgtcttctgcaacttccgtaacctcaaaatctggaataattttcctacttcagatctatatatggcatagagctactggagatcttattgaaactctgctggtcacaccggcacggtcaactgtgtgagctggaatcctgcgaatccgcacatgcttgcatctgcaagtgatgatcacacaattcgtatatggggtttaaagaaggccaatctgaagcgcaaggatgttggcagcagcaatgggatctatgcaaatggtaatacacccagcaatggtgtggtacaccagtgcaacgggaacagcagcaaatgaacatggcttgctaaccaatggatggatgactggcatttgtaaatccccttttccttccctttcctttagtttcctatccatcagggaggacgccatagtaaaacaaagctctgcagcacatagtgtggggaaacctgctgggtttcatgcacgatctctcatgtattccatcttactgtttgtcacatttatttcttaattcatgctgaaaagatatttcgatactatattgcaccttaaaggtctttctgttcccttcattcttagtgcttatggtaacaagtgttgtgatttaagtgctgattgatcaagcacagaacagattgtaactgggtaacctatggagaaaaggtcatctttaatgtaatgcaacat

SEQ ID NO: 85599 - DNA, 1379 bp, Oryza sativa
aaagcattgttgcaggggagaaactgtgagaccaagaaattaaaattttattttatgccaacctgctgcaaagagatctaatgaggattcgaattgtgaagaagacttgacgaaaaaaattgaagaataagtttcaaaaatttaatgtccttgggcatagatataccagatgactataagctcagctaattaaactgaaaatgacatgcataagaaccaacttagattaggtggaatgtaagacagactactgtgaccagatgagaaaatatgcactttcatggcaatagttacaagctaggaaaaaaggtgttatactacaagttcatagggcaaaattggcaaatatctatattagattccttgctgataaagctagctggagataactctcaagtagactgatgaaatgatcagataaatggcaatattttatcttaattttcagagatcgttttttttttcagaattcacttcagacagaagtaacagcagagacacaaaacttgagggtgtacagaagggattgttctaagaatgtctcggatttaattcaatgaaaggatccaaatcctcccacccaatcaggcttgaatgaacttgtgcaaaatcatgatttgacgaaaggtgcaaaatgggaagttcagggacaacaggctattggactgctaaacaaacagctccatgcaaataagccactatgttcatggatagattcgtaatttttaccttccatatgattgcggatttatcatttgatgctgaggctaaatactttccattgtttgaaaattgaagaaaccatacttcatcacggggtgcacgcagaacctgcaacaagaattttaatgtgcgattagtaccagtgaattttgagatatggagctgccagcaaagagaagtcttggcgaataacttaacgggaaaaaaaaaagcagttgatcacccaacggtaaaaaaaatgagtatatgacaaagcatggttatagaaaaccacaaagcaaatccaccttgcacattagggcctgtttggtagagctctaactcctaaatttagctccagaagtttggtctggagtggagttgtggagcagcctaaacccagctaaacctctctagttcattttgtgtgagtgctccacccagctccgctcccattttaggtggagctgaaactgtttagctaggctccagctccagaagatgtggagctggagctggagctggagctgtgccaaaaaggccctatgtttacatttctccatgcaaatttcccacaaaaacacaccaaagcccagccacctagccacaacacggattcaacttacacctcatgtttagcgtttagacaggcaaatttcccatagcaaaaagctagg

SEQ ID NO: 85600 - DNA, 960 bp, Oryza sativa
ttcaaagttttggaagaaactttaggaagagatgggttccaagttgaacttcagtaccgcttaccatccgcagacagacggacaaactgaaagggtaaatcagattttggaagacatgttgagagcttgtgctttagacttcggtggatgttgggataagaatctgctttacgcggaattctcgtacaacaacagttatcaagctagtcttcaaatggctccttatgaagcactgtatggtcggaagtgccgcactccgcttttgtgggatcaaatgggagaacgtcaggtttttgggactgatatcctaagggaagcagaagagaaggtaaagatcattcaagaaagattgcgtgtggctcattctcgtcataagagttatgccaacaatcgccgcagagatttaagttttgaggaaggagatcatgtgtaccttcgtgtcacgcctcttcaaggggttcatcgttttcacactaaaggaaaattggcaccgcgttttgtgggaccttataagattgtcagtagaagaggagaggtcgcttatcagttggagttacctcaatccttggcaggtgtccataatgttttccatgtgtcacagttgaaaaagtgtttaagggtacccaccgaagaagctaatctggaacagatagtggtccaagaggatctgacatatattgagaaccaatccgtatcttagagacagatgagagaagaaccaagaatcgagttatccgtttctataaggttcaatggagtaatcactcagaggaagaatctacttgggaacgagaagatgaattaaagtcagctcatccgcatcttttcgctagttcttccaaatctcgaggacgagattctgtttaagggggtaggtttgtcacaccctaaaaatcttaaatatataaattgttgtttaattggaatcattagaaatgaattttaaaagcctagaagaga

SEQ ID NO: 85601 - DNA, 1236 bp, Oryza sativa
tttcttattttataaattttagttcttttctctttttttaaacaccaaaaaccatgagaacaaataatataaaattcaccatccataaaaaattcatcgtccatcatgtcacacattcatatgtaaatattcattgattcatatttatattgaacagcgactacatttattagccgttcacattcttccttactcctttattcctcatgtacggcttcggcgattcactaattgtttcttctacaagcttaatgtagtttccaaaatccatgaatagtgtcatgttctcgtattgattgtatgcctcaacatcttcaacatcaccaactcccaaaatcctttgttttccggaaataactatgtgtttcttcaactgagatggggttagtcacgtaaaaaacttgggtggctcgatcggcaagtaccaatgggttattcttgtggcttacgttgtcaaggtcagcaattgtccgtctaaatttgtccacaaacacgccagctgggtgtttcactcattgacaccgaaacggtggaatctgcatattgggttcgtagtcccgttcccaaatttcttctatgaattcatagtatgtgctcttttgacctgttgtgtcgatttcctatacttgaacgccattattttgagatgcactccttttgtctcttgctttggtataaaatgtgtacccattcagatatacgctcaccatgaggtgtacactcttgaatgcccgtcagccaaacttttcatagttttttccttcgtgctatcaccatatggtcggccgaggtcctttaaccattcggtaaagtcagatttgtgccatttcatgatccatgcttcagagcgcctgacatttcttgcttgtaattcctttaggtgctgctctatgtacagctccactatcacaagctgttacaggacaatgaaatgagcatctttcactgctttgtagtcattgtcgaggattcttttttcctttttgtccctcttccagataacctacctttatgtcgaggtactagtaaaccaattgctttcccatcttgcaagtaaccaatgcaacactcaatgactttcttggtagtgtatccctctatcatcgaaccctctgggtgggcacggttccgtacatagcctttttagattggacatatactgttcgaatgtccacatctgatgaaggtacaagggcccaagcacaagtatctgaggcacgatatgagggctgcagg

SEQ ID NO: 85602 - DNA, 760 bp, Oryza sativa
  unsure (1)..(760): unsure at all n locations
tttttgcaggtactattcaggggtacgcattggttacgccaatgggcgaagctgcaacggcatgaggatctgcgttcacagttgatcgcggcatcgcaacatcttgagtcatcagctttgcaatttnttagttccaatggatggttatcagctagacacatcggtctttagtcgtctgaacttttatctcggttttgtttccaagtgttactctgtaagaacgtttgttataattggcatgagtctatcttttgatagatgaagccgggtataaaatatccattatctaaaaagaaaaatttgataacactcatgccacatatctatataacttaataaaattttaggtccaaactgatcaactcactagtcgagatataaaaaacaaattcaacgtatgaatagtgacatactgttcactatatatactttatattatcactttttgaaaaaaaatcgtaacacagtttgtatttaatttaaaagaaaaaggtatacaaagggatatcccttcgaaggattagaatccactctctcagatatttaaccaatattttctaatgatgagatttttttctagacaccacaactgtgtgtggtagcatttgtatttttatgacttaattattcgtcgctgatgtcgtggggtctaataaggagaggacaaaatgaaactactgttctagtttctttcgatctaaaatatagttacctttatatatatatatacactctctccatcctaaattatgggctgcag

SEQ ID NO: 85603 - DNA, 687 bp, Oryza sativa
aatcttgctgtcagcacctatacaattcgtttgatttttgcattatgtttctgaagcatgacagagaatgaagttcctggaactgcacatgctggagccatgtcatcagagatggctgtgagtccatcatctgcaatgtcaagcaatcatgtttctttcactcctgatatatcagggatggatgtggatgcatctactgtaaatgccacctttggagatgatttagggaatggaggacctctgcaaataggaccaaatggtggtgatagctcttccttggggcagcagatctgggatttcagtctttctgatttatcagcagatttgacaaatctgggaggtaatgtcctatgttgtgagatattatcttgtataacacttgcatttttaattaattctctgggattctcattgcttgtttgatatcttggttaattagttgaacttatgccatatatagtgttgtatttctctcctcaattttgtttaccccttgttggagtaaatcaagatcttcgcttggctaaaatgtttgagtagtgctgcttctgttctcccccacatactgaattacctgacttatagacagtattctagcagtgtagtatttgaaaacaagctcctgaatgtgcttttcactttttgtcagtgcttaaaagaatatatttctacttaatatttttctgg

SEQ ID NO: 85604 - DNA, 2112 bp, Oryza sativa
agtggcatagatttccacctctctatccaggtgccaacactgatcaaggacaacatccggcagtgcttgcttgacacattccgatcggttggaaacatggatcctaattggaatgacctcttctgggcagtgcaccctggtggccgtgcgatccttgacaacatagaaggcgagcttcagctgcaaccagcaaagcttgcggcaagccgccatgtgttgaacgagtatgggaatatgagcggcacgacgatcgcgtttgttcttgatgacttgcgtcgccgtcgggagaaggaaggagatcagcatcaacaacttgagtggggagtaatgctagcctttggaccaggtatcacaatagaggcaatggtgctgcgtaacccactctcatgaagtcttaaggaaaattaattgccactatcttatgcttgtctggtatcttattacggtatatgttaattaatcaatgcatgacactaaatcaattctgcatgcttaagtggaattatgacctaccggtgatgtattgatgttgtggagttcctatctaatgtttattgctgttttttctgtatttgtaacaaaatttgtaataccctgtgtataattgaaaaagcatattgcttatatgagttgcttcaatccgagtttggatcaattgagatgtatctttcaagaaaacacttgaataagatcaagtcagtattttgcaagtgaaaaaatgttccaaaacaagataaaaagatgcaatcaatttcaacttaatctttagtaattaagattgtttttcttctcaaatatacatgagatgttgtgtatcattgcattaatggaagaacggaggcgtaagatgcaaatacaaataatcagaaaagacaaaaagtgagaaaacaaaacacgagcaaaagaagaacaaagtgcctaaccgaggctctcccaacaacctgaatcatgggccttcttaaccgggatctataatcaacgaaattcccctaggctcaataggtgagcctcgtcactcgctagaactagtcgagaagatgattggagcagcctcgttgaaaacacaggcgtttcgatgcttccaaatagaacatgccctaagaatgatcatattatttatacccttccttatagcccgttttaccaaattcttgtgtcttagctagggagatcgatctgctttcagaaccggcggcgcgttcatcttctcgtcgttcgatctgatcagcgagaacaattctgacaccggtgtgttcttcgatagatccatctgatcggcggcagcatacgcgcttcatcccacggcgagttctttgatgaatctggttggtggcggcaggcgtgcgtcctcctgtcgtctcatcgagttaatcggctcgacgtgattgagttttcggcgcagcaatccgaagcggagttcttttttgctaccacgcatccaccgaaaaagcagcagcgcatagctgcacggctctggaggaggaagaaaaatcaattgaagatactgctcgcttcgtgtttatgtgaagttccaaattcctgttggatttttgtacgtccacaaagactttatatcagggaatttcttttcttttggaatctattatatatattttttgatctggaattgtttctccaacatgtcatgtatcaaatttgacattgagaagtttgatggcaagattagtttttgcatatggcaggttcaaatgaaagttgttcctacacaagttgatgttcggaagcgaatatgattgatcaaggggaagataggctgtgttatctgtgtgaatggtaccgtatacaggttcttaagaaggaatcacaaataccgttccaaagcagcatatttcgacaacactgaatagcttgatgatccaccaggaccatgcaagggtgatagagtgttccaaatgacgaaaaatctcaaagtttttttttgagaaggcaaaaaagaaggaaaccaagcggaagcgaaatgcggaaggaccaagcgttctattcaatagatatatagatacatcattttatcggtgtcatgcacctagagaaaaatgtgttctatagaaccattgggactttagtagccataccaagcaagacaaatgatgg

SEQ ID NO: 85605 - DNA, 1522 bp, Oryza sativa
gctaaatgtagtgcaaaatgggcatacttgctgcatcggtctcatatttaaggaagataaatggagaacgctggaaggtacaaaccttcagaacaccagcatggcctccacatagtacaccttcttccataacatctaggcaggcctggtgctgtggcaagtttgctgcaaccttcttcgcttgctgtcttgcactatttaatacagaacgagcttcagacagtgaaccaagcctatctgttctggcaagagatcttatccaaggtttacggtaattagctatctccagagcccaaaggcgtgacatctttatcaactcatcaggggagcacagggcatcaacaagaccaccttctttcccttcctttgctgtgatgaactttgattgctgtgaacaaaacatcatgaatcccatgttgaaaaatatgaaattgtgttcgacatgaattattacaaccataacccaaaagtatgatagtaaatcagatagaaggtagagagtacaaggcatcaaccatttaaaatggagaatgctttttcagtttttgattttgttcctcggaaatgttaaaactgtatgaggtgaatataactcattttgccaaagaaaaaatatttgcaaaaacatggccaattgtctagttggaacattttttagcttttgaccaaaaactgtattagatagaaagaatgctactacgatagtgcgaccaattaattaacttaggcaaatgatatattagactcaccagcatcatttctattgctttgggcagacctacaagccttggcagacgctgggttccttcataataagcaaacttaatcagatcatgatatgaactaatacaaagcaagggatgtagaatagtggagcactagttcaatctgacatagaaagaaacactaatacctccaaatccaggaattatgcccagagtcaactctggtagtccaagttgagcttcaggggtagatatccgagcatggcaaccctgaagaatttgtcatttatgtaataaacataatttagattaaacccttgagcaaggttagggatcaactgataaatattctgcataacaattcacataccatggtcaactccaaaccgccaccaagagcaaggccttgaatggcagcaactgaaggctttttgcccgctgcacatataaatagctctatagtcagatccaggcataataatcttggtaagaactaaacacatatacacaaaggatgccagcgctcatgttggtgatataagagggagtgagaaactatgacaaaaataggaagtagagatggccaaccttccatcaaattcgacacaagctcaacagatacatcaggcataagagatacatttcctgcaagccaatgtcatgtttgtaatgaaagtgagcaatatgctataagaagcaagctcggagcaaaacattaatcacatgtacatatgacaggaccatttaccagtcttgtgaacttctgtgaacacattgatatcaaagcctccacaaaa

SEQ ID NO: 85606 - DNA, 545 bp, Oryza sativa
tcaaaatggattttggatattcctgaactagctcaacaggtataagtttcaggtaaccagcaagtagaatgaagtctaccctgagttccctgtttcacataagaaattaaggatagattgagaatcttgagacctattgcaagtgaccaaaacaaatatccgcagtaggcaagccagtcttgtagaagaggatataagtgaagtgggaactacaaacaccgtaaaacatgcagtggctattcgtgaaaaaatcaacagtggtacattacagtatatcagctaggcaataacaaaatggaagctaatctgactgactgtgtgggcacactgtacaactgatgaagaacacactccaacaggttccggactaaacgtcaacccagagcataaaactgatatcaaagttcatctggcaaaacaaggtagtggcacacattcaataagtaaacactaaaatcatttaaatagttaccaattcatcttcgtttaaaatcatttaaacgctactcgcacacataagacagataaatggattagaaaacttt

SEQ ID NO: 85607 - DNA, 1124 bp, Oryza sativa
ttgtcatttgtcaatgagcccctcttgactagaccctcaagattagctgtcaaataattgctgctacttatcagtaatataacactgaaaaaacagataaagataatcctaaagcacaagcataacaaaaaaaaaaggtcagcattcagtataactctaaggaaatctcaaataaatactgagggcaaataatatcccaagaaacacagcagtaatttaacaaaaatgacctgctatcatcttctgtcccctttgcaggaattgaggatttacttccttaagcacaacggatgtattgctaacaagaagagctgttgcaattccagagcccatcaaaccaccaccaataacagcaacttttcttattttcctaggtttcaattgaacatcagtaacacctggcacctacacacaataaactataagtcataaaatggcaccaagaaatccataacagagaaaggtaaaacaaattttggcgtattaagtgttgtgactgcagaaacttgggttccatgcgttgtatatagattattccatctacgaacctacttgcatagcatccatataaatatcaaggtaatgtggtttaaaatctcatctccacaaacaaatagttgaaaaaacaggatcgagctatgcattagatttttgtgatagtgatacagctcaagaatttcgacatccacatttagtcattggagctcttttttcttcacctattcctttaaatgtttatgctgacatgagtaccaacatggcaaaatccactctaagatcatatagatctactaaaaaaacccgactgcaacaacttctggaagcaaccaagtccgcacagttttataggtatagggtttatacatagtcaatttcctagttcagaggatcaagtaaacttttgaaaagtttaggattgcaaaatggatttattccaatacaagaccaggtaatgtcattcaaaagaacaggtgctacagtctgtaactagacattggcaacatatctagaagatcaaaagaattagaagtatttgtaagaaagttaatgatttgatgcaaaatcaagacatcagtgacaaatgatgaagtgcatcataaaaagaaatgatattgtatgctcta

SEQ ID NO: 85608 - DNA, 662 bp, Oryza sativa
attcctgcagccttgacgagatttatcaaaattgtctgtggccttctctagctcttgtaaagtcatgatcatcctttgaccaatatctgcgttttgtgataccaatcgtcctaatagcaagccatggttttgcctgaaaaaagtctctttcattcttttcatcttgcgcagcttcattttgcttgatataaagggagcacttagtgcgaggagcaaaagaattgtgccaccaccaaccccaagcccgatgcgtagacctaaatctcgtgctagacgaagataaattcaattgagaaagaaactgtcagcaagggtcatcaacacacagtgtttttagtgctatagctagccttacaaaaacgtaaccttatatatactaattaagtttacaaacaaatggaaaatatatgctacattaattattatcaccttgcttcatcggaatgcatccctcctttttcttcgcatccccgtaggttccattgttgcataagcaaatataatctccaggcaaattaatgcacttcccataacacgggtaaatatcatggcgcgcacattcatcgatgtctagatgagtacaacaggcgaataatgtgatcagacatgcattttgatcatggaaaataaatcctattccctccgtttcaaaatgtttgaca

SEQ ID NO: 85609 - DNA, 635 bp, Oryza sativa
  unsure (1)..(635): unsure at all n locations
ttcctgcagcccttcaacagggctgggcggcgcggccagcccggtgcccacgctcgccggcggcgagtacacggtcaacgtcaccgacgacatgggcaccgtccatgtcgggtcgatgtggtccaaccccaagatcagcagcagcgtctactccacccgccccgtcgccgtctacgaggtggacagggtgctcctcccgatgcagatcttcaggaccgacccgcccatggcgccgtcgccggcgccggcgccggacgccaagccggcctccgacgccgccagcccgctccccgggaagtcgtcgagcgccaaggcgaaggcggacgagaagaagagctcgtcgtcgccgccgtcgtcgcgccgcggcgccggcattgccggctacttcttggctcttgctgcatctgcctcagctggattgctgctcctgtgttgatgctaagaaacttttctaattcttttttttttttgcatggattgtttggttgctttgggggaaaaatttaaaaaaaaaatttttttttgggttgtgtttgaaaaatttttttttcccccgggnggnnttggcatagtaggggcattgtgttaggattaagttttatgggagtatttccgtcatatgccttgtatgatta

SEQ ID NO: 85610 - DNA, 9300 bp, Oryza sativa
cggcacgaccgcgctcgtcagcatgtggatccacaacacggcgtgcacggtcatgatgatgccggtggcgacggggatcctgcagaggttcccccgcggcgacatcgacgacggcggcgggcaggaggtgcggcgattctccaaagcggtggtgctcggcgtggtgtacgcgtcggcgatcggcggcatggcgacgctgaccggcaccggcgtgaacatcatcctggtggggatgtggtcgtcctacttcccggagcagaggcccatcaccttcagctcatggatgtccttcggcctccccatggcgatcatcctcttcctcgcgctctggctcaccctctgcctcatgtactgctccaacaacaccgccaaggccctctccgcctacctcgacagaagccatttgagacgagagctcagcttgttaggtatacgtgacatcccgtttcttgatactatctactccctccgtccctaaatatttgacgccgttgacttttttaaacatgtttgaccgttcgtcttattcaaaaaatttaagtaattattaattttttctctatcatttgattaattgttaaatatatacttttatgtatacatatagttttacatatttcacaaaagtttttaataagacgaatggtcaaacacgtttaaaaaagtcaacagcgtcaaatatttaggcacagagggagtatatccgttccaaaatattgctacctagaacataaaaaatgtgtttacctttggttgtatatcactgctaaaaagttgacaattgacctgtggtcatcacttggataattctgattgggctaagtatttttctgcctcaacagttgattaataacagccacaaattcagtatctaattctaagtccatgattgtctgatgaggtgtcatgatctatgacaggtccaatggcttttgcagagaagatggtcttggctgtgtttggggtaaaattctatttctattttttttttctaatccaacactagctatgttctgattttatgaccataaatttcaatatgaagaatatgcagggtttggtttctgtcatacaaattgaaactgattatttgtgctatcttggtaaaactaactgaaatggacccttttttttttcttttttttcttttttttttttgcagggcctagttgtgctgtggatgagtaggaacataacagacaacatccctggatggggagttcttttccacaataaagttggggatggcacagttactgtaagtgctaaaataatcacaaagacaaaaattactgggctagcgagccagttgcatttacctgatcttatacagaagcaaatcactttgcaatgcagatcatgatggccacccttctgttcataatccccagcgggaagagggagggtgagaagctgatggactggaacaagtgcaagaagatccagtggaacatcatccttctcctcggcgcaggattcgccattgccgatggcttcaagacgagcggcctcaccgacatcctctccaacggcctcaggttcctgaaaggggcgccgacgctggtgatcgtgcctgtcgcctgcgttttcagcgggatcatgacagagttcacttctgacgactcaaccacgacgctggtgctgccattgttcgctgaacttgccaaatccattgaggtgcaccctgccttgctcatggtttccggcgcaatcggggcccagttgtcatacttgttgcccaccggatcgccgtcaaacgttgtcggcttcagcaccggctacattaccatcaaggatctggtggccactgggttgcccctgaaaattgttgccattgcagctctgacagtcttactgccaacattaggtaacattcctgcacagatcaacattaaggattagtcagtagttagtaacttactgttgttttctgacttaatctaatgcttttttttgttaatttgatcgttcaggatcaacgatttttggcatggacatcaagtcataggaacataaatatgaagtttttgagaatgtacagtagtttctgtttctgtatctcatgcctgaactattgttgaggggtcagatggcatggtttgtataagagtaaccatagggatttctcagccgttctgtattactgtatctgagacgtgccccgggagatcagatttcttgtcaagacagaagcaaggaagacaagcagacaatagaagaatgatcaaaatgaaacgtattcaaacaatccatatccttcagatgagcgtacaatatgcaggtcttatcctctagaggtgctatagcttattgttcttcacaaaatatgtaaagttaaaagagtgtcggcatatatattaaattgaacagaatatgtggtacaagaaagctgaaagcctgatattgtcaaactactggttgattgcttataagatggagtacatctcaaaaagttactagtgataagtactctcaattattagtagtttgttcatatgtagctgtccatctcagagagtgcgagtgacacacgttctagggaagtgtagtacactagaaaacaatcaaacatcaaaatttgaataagttgcaaaaacaagtaaatgatttagttatggctatgaattgttgaatgagaaaaatcgcaatcctatattaactgtatgaacatcagcatcattgttacagtaccatacctgagtacattctaatggaacagttcacttgcataacgtgagttagcataatatttaactaactttctagagttcagatgactgtattttgtacaaacagattgcttgcactcaatcctgagattgaaataacaatactatgatgtaaaatgcatctagagttccaaagaaacactctgacccttagatcctgatatcttactctgaaaatcattcagaagactgtgacacagaagattaaaaaacaaacaattaacctaattgcttctggagaagccataggacaataattaattcaacatattagttgtcagaccatcctgtattcctgttactgcaaactacaagcatgtgtaacttgttaggtaatcgtatcccaaaaattcagacttcatcctgaagaaaaaagaaagttagatagtcaggtagttactttgtgctgacgattacgtacctgtgatcctgaaatacgctaatgtatcagaagggaacatctgaaatatcagaagtgagctgatcccctttaatctgatcgagcttgatcacttctcaaatcctgttcaattattcattgttaagaacacctcaaactagccgtgcgatcccgcaccttttctgttcgtcacaccgtgcaagcaaaccgataatcttttctctctttatcgaagcaaggaaatggaaatttctaggcaagattcaccaagaacaaaaataaaaaaaaaagattctggataaagtagttcttcacctttgctctcgctagtcatggcatacacctgcgccgcaactgatctccgccaaagctgggttggtcaaggtagcttgcagtggcggctcgccggtgatctgagccccatcggaggcggcgatgcacgattccggccaccgcacaccgccacgcgccgccgtcctcgcgagatcgacgatacttcatcaccagaaaaagggaaaaaaaaagtagaaaaggcgaaatggatcgcagccgtccaaaaaacaccaaaagctctcaccaaacaccatcgcgatgaatctcagccgtccgatctggtgggcccacacttcccccgactttgttcagtttggagttgcgacactgacatgtgggccccacttttactatggcccacacgtcagtgacacaacggcaagctgcacaagggtcaggcgatctcgtctccgcgagttcgctcgcgaccgcttccgagatccgttcaaccccgatctacgccgccgagaacctcgccggcggcgacgacgacgagcacctcgccggcggcggaaggcgatgatgcctgtacgcacgtaccaccaccaccaccaccacaacaacagcaacaaccatcggctacgccgcatcatcccccgagtcctcctcgccgtcttcgccatctacgccgtctcgttcgcggcgtacctcctccgccaccagtcgccgcacccgcacccgcaccctgccgctgaccccgagcgcgacgccgtggacgcagccggaggaggcggaggaggaggagccgtggaccgtgtgcgggtagaagcgccgtcctcgcagaagccatggcctcgcctcccctccttcctcccgtggacgtccgcctccgttcggccgccgccgaagcactcctgtgaggggtacttcgggaacgggttctcccgcctcgtggacgtgctccccgcgcggggcggcggcggcggcgggtggttccggtgccaccacagcgagacgctgcgcagctcgatctgcgagggcgggagggtgcggctcgacccggggctcatcgcgatgtcgcgcggcggcgagccgctcgaccaggtgatgggccgcgccgaggaggaggagctgcccaagtacgagcccggcgcgctgcaggtggaggcggcggcgaagaggacggggccgttggtggaagcggggttcctcgacgcctacgtgcccaccggcgggatcgggatgcacacgatgaggtcgctgctcgactcggggcgcgtcgtgccgcccggcgagctacactgctcgcaggtacacacactctttgcctcagtaaccagtagtagtagctaaaattggaagtgtaaatttgggagaatttattgttgtatgttggatccggttcacatgaacactgacttgcttaaacatttcatatatctatgaagattgcaacaatgatttgaactgtaggagtaataatgagtagagtccatggcaaaaggtgggaagatgtttatagcatgtttcctgtagtaattgcgactaaatttaattaattaatcgattgcgaggaaatttcaagaaggccagggtgtaaaagaatttgattgagtttgggtcctcagtccttgctcttctgctcctgcaacagaggactgaggactagcggcgagcaattgagtttgagttagtttggttcagcaagataacatctgctctgggtggcacccactattggatctggcaaattggcaaatagcaaggcagcaatgttagtgctggccacaggtttattgggctagtatgggaactcctaacaatgagtcaatgagctcctttctttttgtttggtgagggagatgggtgtgggcaagaaatcttacaggctataatttcagtcttcaaagtggttatagttgtttcattccctccctttcttttttgttctactgttgacttggcagtttgatggaattttctttttctcttgttaatgagaaccccatgagaaccaactggctatataatgaataaatattttgattcggttatttggtttagggagaaaaaaaaagctttcggttatttgattagtcaagttaatcgtgccgacgccttgtgcaactgtattgctgtaacatatttgatgccttgattgatgcactgtactcatgcttttggttatttgatttagttctgattggttgcaaatttaccatatcaatacagatgtagttgactatttagcgaattgcttaaaattttgcttggatatgggtagtctgttttgagctttgaagatgtatctttgtagcctttataacactagattttttatgaagaaacacatgaacctctcaagaagcagagcattgaattcattccatgactcctattgttatattgcaggattcatttcttcaccaatgtatacatatcacagtaatattttcgtaaagctcccctaggataaattcctttctaatgttattatatttgttgcagtgggttgaagaaccaacacttctagtaactcgttttgaatatgcaaaccttttccacacaattacggactggtacagtgcatatgtcagttccagagtcacggatttacctaaccgccctaatgtggtctttgtggatggacattgcaaggtacgttacacgtgatgcattttgagttgctacattctttgattgttgatgcactgcagtttagttggtctatttcatgaactatatagcctgagttatggactttatggtaattagtctgtttcccttcctcatttccctgccagccaggctgccacatttccatttcccttcgctcctttataatgtgattctcctctttccgggttattacaatagcttaatttgtagtacattggaatacacttcaggagagtatcaacgtcatcttagagaagtacagttacagacagttgtattgaaatactagaaagtgaaacaagaagcagaactttgactttattggtcataaaatcagtcaactggggttaaccattttgccattttagagcatgcctcttcacccatcatctcaaaacctgctcataaatagcagaacagtttcatcacttcatgactgcactgcatgcgattctttcgacttgttactgtgaagtcaggccaggaccaagtagaataatgataattatattcctcttctatttaatgatgcaacggaaatatctgagtagggtttcttgtgcaatgatttccttcatattgcaaatcaggagcatggtggttcaattttgccattcatataggttttattcaacgaaacctgaaaacatgcatgcagatactgtttgatgagtgcggcagcatattgtgtgattaatgctagttaacaagacggctcattttttactcaataacagtgtatatgcttttgtcttttaacagtatgatctgacattcacaggcacaactggagcaaacatgggaagcacttttctcaaatgtgacatatgttaagaatttctctggccctgtttgttttcgacatgcaattctttcaccattgggctatgagactgcgctatttaagggccttagtgagagctttagctgcgaaggtgcttctgcggagtccctcagagaaaagcctgatcaccagaaaacggcaaggttgtctgaatttggtgagatgattttagcttcttttgatcttctgagggatgacatactgtcatccaaaacatcaaatgggctcaatgttctctttgttcggcgagaggactacttggcccatccacgccacagtggaaaggttgaatctagactaagcaatgagaaggaggtatatgatgcaattgagggctgggcaaaaggtcagaaatgcaaaataaatgtcatcaatggtctttttgcccacatgaacatgaaggagcaactgcgtgctatacaggaagcttcagtagtaataggggcacatggggctggtctaactcacttggtttcagctaccccagatacaaaagtccttgaaatcatcagcagcatgtatcgacgcccacattttgcattgatctcacactggaagagcttagagtatcatgccataaatctccctggatcatatgcaagggtaacagatgttatcaatgagttgagtaatatactgaaaggttttggatgctgagacagagctaggtattcatcaggaaagtcaccatactaacaacacaaatgcttacaatttcaatggatgggaaggaggttatttgcatctgtgatctgtgaactgatgcattaccagggctcatcacttcatcggaggaatttttatgctgccaaatgcagagagagattgtgctgacaagtgacaatctttaatctgcatatcgtgtggaacaagaaggcaatccttccccccttcctgacatcagccgacgacatgaaaaccaatccatgctgcgcacacttttctaccatgaattcatggtcttgaggaccgatcctcaaactgtaattgtaattcatcatttgggacattcggcgacaattcttgtatgttaatgcataatgttgagtgcttctcccccactgttcatatatgttgaaaaacttgcccaatggggcatggcaattgaccaagtgtcatgcccttcctactcccgtgtgcatgatgcatgaccagcctggttttctgccatggtggcctggtgattactctggaagatgaaatggagccgtcaggctcataacaccggtgtacttgcttcactttgttccttttgcctgccattactgtacccctgttttattgatgtgggggaagaagatatattattgatctgttgttgtggacttgtggggggttcgacatgttttgagtcgaagctttgctgctgttatttgtgagtatcatttaatgtttcacctactgtttgtgctgcatcttgatcgatctttgttgattcttgcaggaggaggacaacacaagctaaggggaaggaaaagggagaggaagaagaaggaatggggaggatggctgtgggcacggtggtttgcctgcctgcatgcatcccggaggagcacatgccttgttgctgctgcctggggcgtgaaatgggcgtggctgatgatggacgctagctcgctgggaatcatgcctgtttccttcagcatttatgtgggtcggaggatggagttggaattggctccggtttctgcttggttgggtggcctggatgctgtggcctggtctggactctggacagcgccgaggccttcggatgcggcggtgctgccggtggttacaggggtactgccacagtacatgtacagccttgggctcatgccactaccaattggcaaaggtatggtttattctagctagcaacgaataaatttggcaggtggtctattttttgaacagttctacgaaagaattattattcactttgtttcaaattacttagcattcgctttattatcctaagttaaaaattttctatctttaaacatcaatttctaaaatcaacatgcgaattagttaaatattataaaaatgtttctcatggtggatctaaaaacaaaacgatgttaaaccatataaatttttagaaacccggtagtcaaagatacaaatatttatctcttcatttaagccttcaatgcataaagactacaaataggaacaacttatttgaaaaaactcaaatgtgaaataggtgtaacttttatcgatggagggagtaatttagaaaagagagtactggtatctgacacttgctcaaatttagaatatgtaggactacttagggcatgttcatatgtagagctcataaaaacttttagataatgtatgtttatttagagactatccttacaatagtggagataacaaagattcta

SEQ ID NO: 85611 - DNA, 5890 bp, Oryza sativa
agaagcagcagtagaaactgtagaagaagcagcagcagcagcagcagtagagatcagcttgagaagtgaagtgaagcagccaagcttcctcatggaagacccctacactagcttcttcaagaacccttactactactactgcacctcggctagctccttccccaccgcgcccgccgccgccgccgccgccgctcacctccctccgccgctgccgccgccttacgctgccctgtatcctaccgccggtggcgtcggcgtcggcgtcggcgcgcatcatcatcatcagtacccgccggccgcattcttccacccgccgccggtgcaccagcagcatcaggcgccgccgtcgccgccgctgcgggaagcgctgccgctgctgtccctgtcgcccacgccggcgcgccgcggcggcgtcgtcgacgcagcggctgactcggactccgacgacgacgacgacggcgactgctgctaccaccacctgcaggatcaggagggggcggcggccgggtcgacggccacccccgccgccgccgccgcgcgcgcgccgctcttcgccgacctcaactgcatccccacctgctgcggcgacgacaacgacggcggcgacccgatggacgtggaggtcgccgggacaacggcggacatcgacgccgcggtcgccctgcgcatcggcctgcctgccggcggcacggaggccgatctcctctccgggctcaccggcgccggcgtcgaacacgaggaggaggaggaggactgcaaggtggacggcggcggcagcggcggcgacgacgaggtggtgccgctagggttctcgtcgacgccgatcgggaagctgaacaaagggcagtactggattccgacgccatcgcagatcctcatcggcccaacccagttctcctgccctgtctgcttcaaaaccttcaacagatacaataacatgcaggtcagagctaataatcatcttaattacattcttattagctactcatttgaatatatgattgatcttatattgctgtttaattcttgttcttggacacacaatatgattgtgataactttgcaggtcagagctaataatcatcttaatcacattcttattatagctagtactactagctagaaacatctcatctgaataattgatcttaattcttgttcttggacacacaatatgattgtgataactttgcaaggattggttggtcatgattttgttgattgcaattaaagtagagaggaggtgggtagcaagctgctagctttggagagcagatgcatgccatgaaatagacttgagctcacaggagcatgcaacagtagtggtgtctgccttttgtgtgattgaactagactggcatgccaggagcagctatagctagaggtagagctagagcttaccatgcatgcaatctttatgcttttctctccttgagttgtttggcttttggagatgcatatgagtggccaagctgcagtggagatcccagtgaagattttatctttgcttctctcactgtcttagtacacttccactgatctcatcagattacatatactcctttctggaggtgtagtttctacttgtactagtactagtactacacttgctatcatgcacctagtagtcctgaatcctgatcactcaggactcagggctcaaataagatttgggtagatatatgcatgggggttgtttcaggacaggctttcatggtttggaaagcataagattatggagctgctgctgctgctgaacacatctcccaagaacagcaagagagatctgcagtgtgcttcctgtaggcatgcagccaacacagtgccactctggctgcactctttaaaggaacaacaccaacacattgaacacaacaaacacacaagccaagctagcaaagggggcatagctgcctggagtagtagagccctcactttcaaaagatcacacactagctagcagcagctgcactaattgacatatgcatgcagcagcttcagttcgagtagttctctcaggtttgccgcagctgaatattgctagcaatgcaactatagctgcagtggtgcattaaatacctgcaatatacttactcgaatcatatgctgatgaacattcatttgaaatacatcacctcctttttgttccttttgtttatactagtaggagtaaatgtgaaataatggtgctaaatttcctgaaacaaaacgaacataaacaaaaaggtgatgcatttgaaatgaatgctcatcagcatatgattttagataaagtaagaaacattgagcatgcaatgatacgatcgctagggatctaattaagtgtgttctcatacctggagaggacgatcgacatcccatatatatacatgaagctttataaaaaaaaacttctgaatttgtttttattacattgtatatactactccctctgtcccataatataagggattttggatagatgtgacacattataatgaatctggatagacggaccgcctagatttattttactagatcaatatgtcaaatccacccaaaaatcccttatattatgggacatagggagtattgatttggtgaatatatacattttgatgtcgatcagaaaaaaaaacgagatggaaattaatgaaacttgttgaaaaaaaatgcatggatgcagatgcatatgtgggggcatgggtcgcagtacaggaaggggccggagtcgctgcgcggggtgcagccgacggcgatgctgcggctgccgtgctactgctgcgcggcggggtgccggaacaacatcgaccacccgcgggcgcggccgctcaaggacttccgcacgctgcagacgcactacaagcgcaagcacggcctcaagcccttcctctgccgcaagtgcggcaaggccttcgccgtcaagggcgactggcgcacccacgagaagaactgcggcaagctctggtactgcctctgcggctccgagttcaagcacaagcgctccctcaaggaccacgcccgcgccttcggccacgcccacaccgccctcgacgccgacgacgacgacggcgccgtctccgacgccgacgccgtcgtcagaccttcgtcctccatggctgcctcctccctgcagccgccgccgcgctagctagctactagcatacatatacacccctccatccaaaaaaagttcaatcctgtccaggttcatagctagagtttatgatcaccctatcgatctattagtgatactactatcacttattagttgatgttgctgtttttgtttttgtttgctacgttaattagggttatgggaaaatgtaaggtgtgatctcgtgctcttagtttttcttgatcaatatagcagctagcagctggctggttgtttattagcatgattatatagcaccgatcgatcatatgtatgatgatcaacttattaattacgtgttggtgatgattttgatgtaatcatgccgttctgctatgttaacccatggtggaacaagatcaaccaatgttttcttcagtttcaggtcatgaagcagtacgtaaattaaatctagctccagcccttgttaattactccagttaggactaccgatcgattatcaattgtgtctgtgttcgcaactgtacatgtataacgacgatcgatctagcgctgcatatatacagtgttgacatttattggtaattcggaggatgacgatcgattgccgccaccattggcatgcatgcatgcggtacatcattaatgtcagttctgcatgttgaaaaactttcacccgttttgttgtatgcgagctccagtcaagtttctaccactatttatcgacgtacgtatccccttatgtgcaagcatacactgcacatatacgggccgacctaaacgcttcccaagctaagctagtaataattcgtcgacacgatattgctccaactttaacggccactttaaaactcacgattaagaaaacagatgaatagaaaaaaaatacatgactttgttggcaatgcaaatccaaaaaagagaattacaaaacacggagaatacagcaatggaatgatcatttgattaaactatagaaaaaacgcatgaattgaataagagatgaactcaggaaaatttgcaagaggtgctagagctcctgttaaattttttttccaaaataagctatttcttagtaatttcataggatatgggaagctccaatcctttgttttaaaggacaatataggaaaattttctattggattatttgaatcctacaaaattattccacaaatccaatggcggagccaacgacatcatcaagcccgaacgacactaatagcgtttttcaatgattgactaatttttataggggttgacaactatagataggagacggcgacggagccctggcaactgctcgacctatccaggagatggctccgccacatcacaaatcatttgtttgaagggggcctaagatgaatcctgatatgcataacatacgtatacacatactcgcatacactttattttagcatgcaaaattttagtgagatcatatatttatcaataatctccatatatcgtctaaatgcatgttaaaagtgacgctcatggatctatatatatgcatgtgaatcgtctagggtaaaaacaaccaaaatatactcttgttggcactactataaaacaatttttgcagacaccagtgttttattttttttcagatggggcaataaaaatccttttgtaataatagtgagaaagctcttgtggtatatgttcgtctgcaaaaatcgattttcgtaagtggtcgcttaacacgtctacatgtgaaaataaaactattttcacatacgaatgtcttaagcgactacttacggaaatcaattttcgcagacgactgctaaagagcactagccgtgaaaaacttatccagcaagctagtctggatatgtatcctcctctactaaccatagagtggataagtctcaaccacatcctctcccagtgctcctccctcactccctcacaagggttggtagtggtagggcttgaccgctcggtgcccgctgcggcggtggggctcaacgcaacagatccagtgtcatatcccccaccatcgcgcgccgatctggtgggagctgcgacaacgaatgcggcgatgggcctcggcaggtgtgaatccgacggttgggaggtcagtgacggtgggtccagcgacagcagacggccgctctcgagcttgggcttttacgatttttctgtttttgatttttttttattgtgcaagaattctttttgaagtcaggcagcataacatgccgcatgcgaaaatccatttttttgcgtgcaattgtgttgcctgcctagaaaaatccctatttttacatacacctggggctatacgattgctataccagcatgtgaaaatgcattttagccgtttgggaaaattgttttttagtagtaagggacaggtccagcacaaaagcatagagcagttgcatgcatcttcttctaacactactacagaaatgatttttctatacgaggacccctatagtttgtagacggataataactggtcacaccagcaaaaatcgaccagtattttcgcatacagctccttaagaggctcacatgcaaaaattcgcacgcgaacctcttaacacatccgcatgcaaaaatgagtctatttttacatgcgaaaacagcatgcgaaagtagattttcgtatgcgggctacttacagagcacatggaccctcacactttttaccacaacattttttgaactccccttctttctctacaccacaccattttctcctctcccactcctccaggctaactcctctccctctaccctctccacatctcttctccttccctcccccctctcccc

SEQ ID NO: 85612 - DNA, 652 bp, Oryza sativa
aaataaggagaaataattgatttaatgggtgagtaagataggttattctactttgcgctcacctggaataatttgttgtcaccacctatatgatctgttgtgcacccttttgttcgctgaaacataatttgtatgtttatcttatcgatagcactattgtgcttgtaagtgtggtatattattcaattaatcagtaaaaatcctcacgattttgtttgagtaaagcataagctattgacacatgtatgccaagagtaaaaagtatacaacctgagaaaatgagtaaagtccatcaccggtccctaaacttgtaccgctgtatcatcccggtccctaaactcgcaaatcgaccgttcaggtcctcaaacttgttcgactgtgtcatcccggtccctaaacttgcagatcactcgtttaggtcctccaacttgtttagttgtgtcaccctggtccctaaacaggacggcctaaaaactttatatcaaaaaataattcataactttttcatgtgaactctaatgaagacaaactttatatcaaaattgtagccctcgacacgacctacaactttgtagttgaaaagttttttccattaaaactgtttagggtcccaaaatatgttgcatgtttatagattttgaaattttaattt

SEQ ID NO: 85613 - DNA, 6034 bp, Oryza sativa
  unsure (1)..(6034): unsure at all n locations
ttctgacatatggattaatatcattaggtggcagaaccgttgagggctatggtgatgggagctcctttggaagatgctcgccatcttgcccaaagatacgacaggatgcgtcaggaagccgaagcacaggttatctcactatgaaacatactgtctttactacccttcatatgttgcctattgttatggtgatttctattaaacatactgtctttaccctttttatctgttggctgcctattgtgatggtggcagatttgagtttcacactgatatgttatgccacaattttattttcattgatcatataagaaacttagtaaggtactgtgagttctgcaggctattgaagtctcgaagcgccaaatgaaattaagagaaacatctgggaatggtgatatgatttcaagattagaggctgctgaatcaaagttgcaagagttaaagtcaaacatgggggttctaggcaaggaagccgttgcatcaatgactgctgttgaagctcaacagcaaagactgaccttgcaacgactaattgcaatggtatattctatgcttgtttagtttggccaattgattagttccttgtttgccttgagaaataaaatttctttacatgacactactgacttactgaaggtcgaatctgagagaagttatcaccagagggttctgcagattcttgatcaacttgaaagagaggtactgatgattttgtacagcatccttatcaaacttatacagaaaaggaacttgttaactatcgaaaaagaactgctttgttttggttatcctgattcagtctcttgtttctttacttttacagatggtatctgagcgccaaagaattgaaggagcacctcctccagctgttgagagttctatgccaccaccaccttcatatgaagaaattaacggtgttttcatgaggaatccaacagtcgctgaattggtggaaactgtggaattcttcttggctgaggtacccaatcatcacttcaccacaatgcacaagtttgtagcttactactacagtacttctaataagttttgtctgttgagattttattgctgatttctatgcatggtcatctttttgacaggccatccagtcttatcgtgctgagagtgaaactgagctcaacctggcagctggtgactatatagttgtccggaaggtacggccctatcttcccattggacatgtttctaaccataaacatatctttgctggacttttgtgggcaaagttggctacactaaacttgtgttcattaacctgctcaatcaggtgtcaaacaatggatgggcagaaggtgaatgcagagggaaagctggctggttcccttacgactacatcgagaaaagggaccgtgtgcttgcaagtaaagtcgcccaggtcttctaggcgttcaatgagccatacatacataaccctggtgttgtacactgtattatgatcgttcgtgatcttcaaagaccctctgatcagagaaatcacaaatattcttttgttctattattgtcattatcactaccccttttgtcaaaaccagtgcagccttttgtatgacatcttgttgcatggctagctttctgaatatttcaaaatatacagcggagaggacactgttcatatacattcattctccctaaaaaatacacccttgatagtcttttaggtatatatccgaaggacaaattaatcaatgtttcaaagtcgcaaagaccttttgttgaagaatcacagaatttaaattgagggattaaacattggtttcagctcatttcagctgtatggtgatgtgccgatctcatttttacagtttgtatatgtcttgcgtatgtatatgtcttctgaaagtctgaactaaattgaaaaaaaaacaagaaaatgttctgagctactccctccgtaccctaatataaaagattttgatattgacattttgcttgtactgtttgaacattcatcttattcaaaaaattttagaattattattttttttgacttactttattatccaaagtactttaagcataatttttcattttttatatttacacaaattttttaaataagacgagtgatcaaacagtgcaagtaaaatatcaagtccccatcggttggtaatacttgttataagctataatggcttattagcgattaaaaaatgatatgcgagtaaaacttttgtatgtatgttcgtactgattgaaaagacaaagctaagaaaaaaactatgttgaaaaagcatcaaaatcaaattcaaaatcaagttttaaaattcaaattttggttttggcttgtaagccatagggcaaacgaataaaacgatgaggccctcaaagggcctgtttggaggagttttaaattctgagaagcagctgtttggtaggcagcttcagagaatctggaaaagctctgaaacccagcttctccagcttctggcttattagttcatttttcagaatctcagaagccgtggactgtttggggcagcttctagcagaaacagtttttgaaaaaagctgcagctgagacaagcttacccaaacagggcctaatctcttaggtagtgtttggttgtaaggatgggatgggatgggatgggatgaacccacttttaggggtgtttggttgagaggtgagtgggacgggatggtccctggagaggaatattcctctcagatctgggatgaaacggtccgccaaaatcggccggaccaatccatcccacttcgacggagcccacggcgtcagctcccgtagcctcaagctcggctccgccgcagcgccgccgcctcatccgcgtcgacctccgcctccgcgaccggccgtcacctcgtccgcgaccgcctccgcgaccgaccgccgccgctcgttgtcagctcccacaccctcccgctcagctccgccgcggcaccgccacggccgcccgtccctcccccggcaccgctccttcccctggcgccgctccgtcctcctccgcctgctccctccacctcgcctcgcctccacgaccggccgccgcctcgtctgcgactgaccgccgtcgctcgtccgcgttcgcctctgcgaccggccgccgtggctcgtccgcgcctcgtcgcctccgggaccggccgccgctcgtctgcgcctcgcctcgcctcgcctccacgaccggtcgccgcctcgtccgcgaccgcctccgcgaccgaccgccgtcgctcgtccgcgcccgcctccgcctctcctccgctcgcgctgacgagctcctccgtccccattctcaccactcgctccaacctagccgctgggagcagacggacttaactgtccgtgaaacattgtccatcccatcccatctcaatcctttctaccaaacaaaaaaactataaccatcccataccataaaccaaacacacaactcgaaccatcccatcctaaaaaactgggataggtctaacccatcccacttggtccccaaaccaaacacatcttaagggacggagggagtactatacaggtcatacgtgagacgtggccctgtcaggtgggaccaaagctttgatcacatcttacactgccgggtggggtcagcatctgtcagacggtcccacgagttcttatccccttctctgcttccgcagtttgtgtgggctttgccgctgctgtcccctgcttatcccctcctcctcccgggttcgcattccgtcgaacaccatgacggcggcggcggcggcagcggcggtgaccctcctccgcctccctctcgcccgactctcctcccacctccgctccctccctccccgtcccataccgccccctcggctccgcgtctacacctcccaccgcctcctctcctccctcctagctcccagccacgtccccgccgtctcgtccctggccgaggcggtggctgcgccggatggtgagggggtcgaagtggaggaggaggagnacgaggaggaggaggcagaggcgcgccccaccaccttcgtgctgccgcggctgccgcggccgaagctgagcgtgaaggagcggaaggagctcgcgtcgtacgcgcacggcctcggcaagcggctcaagtcgcagcaggtcggcaagggcggcgtcacgccgtccgtcgtcgccgccttcaacgacaacctcgagtccaacgagctcctcaaggtgcctctcccgtttccccatcctctcgcattataaattcgtgacatgatacaacacatagtttacctacaaatacaatgagaacaaatacatcaatttcagtgtatgatataccaatggaaatgggatgcttcatcatgctgctgaatactgatatacaatgatgtcatgtgattttgtttaactgggaattaggatcactgtagggtatattcatcaatagttattaaagttaactaatgctttttatggttcgaatctgattgtaggagtagataggatgctgaattgctgataaccgcatgcttttggtttaggtagacatgcaatattcaatttaaccatgactaggttgaccttgagttttccttattattggcttgttctctttccacctcgttttgacggccctcatatttcttgttaggtaatgcaaagggtggtttacatgctagctaattctgtgaaaaaaatggtgattgcttttttccaaacaaacaaaccagcatgagctcattattacagtaccttatatgttatactagtcacagtacatgttacagatgtattttcctcctgtttgtattccttccacacaattgcgctggatacagtctttaaacttcttaattgggttgttgttttgaactttacccccatggcatatattagatatccttaacttcttttgttactataggtcatatgcacgcctcttcaaattgagaagttttctgacttctagggtcttaagtgagtaacagggatttcaggttaaacttgttctgattggtcttgtgttagtatttttggtttggctgagttgcataattgttgggcttttttctgtttgcatttggtggttttaacctatggtcagccctgccacaaatcatataggtaacacaaaaccattgttcattcggaagtcattacaacccacaggcctttttttattcaaaagtctctctttcaagaagcagcaaaatttgtgttatagtgcaagcaagcgatctgacttctaacctctgtgaatgcatatagttattaaaccaaaatactcaagtttttcataaatatggaattgacttatactgaataaactccacatctttattctggcctagccaagttgtgacagacaattgttcgaattgagaagctaagtgcctgtgtccaacacttaatttgcacacaaattttccaataaggctgtgttccatgtgtgcctgtgttccattctacgtatttcgtatgtaagagagccaataagcctgtaggatttagtgtcttgtgccttttcttgctttagtgagcccttttgttcggctttcctttctgtgatgttaagttgttcttcaacattcggcatatgttatgacagctaaaaattcatttgaactgccctggagagctgcctgacgtgatactacaacttgaggagtcaaccggatccattgctgttgaccaaattggtcgatctgtcattctatatcgtcctagcaccagtaagatgaaaaagagagaagaaagtgctaggaatagaacaagatttgtaagatctagagaaccatcagaagaacaacctagaagcagcacaagcaagagatttataaaatctggaggagcatttaggccacaacagaagagaagaccattagcatctaaggaatcgtcgtatgggcgaagatagatgccacattcaatccttcatcttgttttttttcattgtctagacttatggaaatcatgtaaactttagaccatctaatttgataatagatattagtgctgagtttttatcaaactatggtccaaccatatgctgtaaatttgtgtaggatcatttcctctttattcaaaaggaagttctaa

SEQ ID NO: 85614 - DNA, 578 bp, Oryza sativa
tcatcacgattcacctgctgtcatttgttgatcattttatgatccttgactataccctacgcttagggagtgtgtagagaagttgcaacttctgggcactcctgaagaaagagcacgcatcattaatgaagatccagaagtacatgttgacccatgtatgtctcctgattatgaatctgctgaagaattggatgttaagaaagctggtatttcatgtctctgaactctctctaactccctattctgctattgtatactgatgtgctctgcttataaacgttgatctttttgcaactttcttgttgactttgtacgcagttgattcgacaagtaggaatggatcagacctgttatttcttggaagaaaaggaatcgaaacaaactctctgcagaatcatagacaaaattgttctgccactagtcatcacacgactacaagtccacctactgagggtatgactcatggacaaggagaagagggtaacattaatttgcttttaagaaatggatgcgatattcttgaacctagcattgatttgaacaatattgcatgtgaaacagcatcgtttgcatcgtca

SEQ ID NO: 85615 - DNA, 1328 bp, Oryza sativa
cgccgtcgcgcggctcgcccacggcttcaactggtcgctccccgacgggatgaagccgtccgagctcgacatgtccgacatcttcggcctcaccgcgccgcgcgccacccgcctctccgccgtcgccacgccccggctcacctgccccttgtactgacggcggccggcgaccgcggcggcgtacggcaagaatggtttgcaggtgatggtgttaaaagttcagacgcgtgtggcgccattggaggagcttggtgtggctagcttagcttcctctgggcctttttttttttgctggtttaattttcttttttttttctcctttgtaatttaatccatgtctccagaacaataagtggattagtagggtataattaagggtgacagtgtgatatatagactataagatcaaagttgtaaatttggtgtccggtgtgcctgtccacataagcacagcctctgaattttcttgtaaaactttgtcatgaaaattgagaaagaaaacacctcgctttccacgcgtacgcttaccaaactattaaatggtgtgtttttttaaaaaaaaattctatggaaaagttgcttcaaaaataatattaattcatttttaaaatttaaaatagttaatactcacctaatcatacgcgctaatgacatacctcgttttgtgtatctttttttttcctctcctctcaaactatcgggttgctatatgttattaaaacgggaaaaaaaaggcaaactccgaatgtttgttgtgaatttacatttctactaaaaatttaggaccgcatgagttgtgatgtagtggcctgagatgtgaatggggagagatcgtacagggccaaatatttccccagcggctgtacagaaagaccacctatacaacttttctcaatgtagtaatattatactccctccgtttctaaatatttaacaccattaactttttagcacatgtttaaccgttcgtcttatttaaaaattttttgtgaaatatgtaaaactatatgtatacatatgagtatatacttatatttaacaataaatcaaatgatatgaaaataattaataattacttaaattttttaataagatgaacggtcaaacatatttaaaaggtcaacggcgttaaatatgtagaaacggagagagtaattttcttaggcatcctaccagcattagtagttagagcacccgcaatggtaaagtaaggtgctatctataaaatatgtacatctcagcaatagactaaattaatagtaaaacacctcaatagtatgtctacataggtatctatagctctctaatcaattgagggctgcaggaat

SEQ ID NO: 85616 - DNA, 3252 bp, Oryza sativa
gaacatggcgttcgcgcactacgggcccttctggcgccagatgagaaagctgtgcgtggtgaagctcttcagccggcgccgcgccgagacgtggctcgccgtgcgcgacgagtccgcggcgctcgtgcgcgccgtggcggcgtcgcgcggcgaggccgccgtcaacctcggcgagctcatcttcaacctcaccaagaacgtcatcttccgcgccgcgttcggcacgcgcgacggcgaggggcacgacgagttcatcgccatcctccaggagttctccaagctgttcggcgcgttcaacatcggcgacttcatcccctggctcagctgggcggacaccaacggcatcaacgcccgcctcgtcgcggcgcgcaccgcgctcgacaggttcatcgacaagatcatcgacgagcacatggagcgcggcaagaaccccgacgacgccgacgccgacatggtcgacgacatgctcgcgttcctcgccgaggccaagccgcacgccggcaaggccgccgccgccgccgccggcgccggcgacggggccgacgacctgcagaacacgctccgcctcacccgcgacaacatcaaggccatcatcatggtacgtgcagttgacaacctactagtaattaattactgccaaatttttcaccaacttaatctctctatcacggtaatgattaattaccacttactcctcccggccgatcaagataaaacccgatcgaaattaggcaacaccaaatccgtaaaattactggaattaatgattcaccgatttagagcaagtttgatagtatagccaactattaactctaaatcatctatagcaaatataatagctaatttatacaatagttacttactatactattaatatctggtcccacctgtcatacacacattacgtcttagagttcgtgctgcagctggctatagattttgtagcccgctgctcttttctctcttgctttatctttttaaaatatatttatagttggcttacttatagcctgctattgtaactactcttacacagcacagcagtatggagtagtaatatatatcttaaactctgacaattaaacatgataaattcatctgacgcaaacacaactgtacgctataaatacgcgtacaaatcagcaacagtagtgtacggggccggattattagtcaggtaatatatcattttattttaggcgattaagtcaggcaaattatcttgatccgtgtagattatttgacagggcagagatctctcctggtatagttgacatgaacaccatgtgcagtccatgtgtgtgttcgcctcgtttgcaggtgaatcgatatgatcaaccgttagatggcgccacgtatgcatcatggatcatagattaagccctgcaaattaaagccactcaatgaaatgctagatttgaggagtaattaattttagtgtagaatacagtggtcctccttgatgcatccctcgcaatgtatctgcacttctacaggcagtcaactcacttacataagcattgtcgactgttcccgaggagatcgacaccgtcagatacggcattaacctatgattatttatacccatatttcaatatacgggtagtaaaatattccgagaattttatggagtagcacgtactcggaggaagtagtaaaaatagctttgtacttatccctccgttgtataaaatatccaatccttaccatgtacttcctccgtaaagtcgttttgaacaacgatacggtctccaaaatacaactttgatttcttgtttctataaaaatatctattaaaaagtaatatatgtatacttttatgaaaatatttttcaagacaaatctattcatataatttttacattttcaaactcaacaacttaagagttattcatgatttatattcctaagatttgacttaaaaacagtcctaaacgacttcctttacaagcacagagggagtacccggatatatacgtgtctagttacgtggctagaaattgtctctctctttttcttttttttcttttttgatatagtagtatatcggatacagctagaagtaactatagtgttagccttttttagcgaataaaggtagaagctaatctttaaccacgttctggtaggatgacagctctaattttatttcacatcttttagatgtggatgttttcagcgtgtaatatatatctcctttttcaaaaaaaaaacctatattttaaacgaacttatataggaattttcagtggtagactgaataagtgttttgacttgctggtagaacgactggatatttgcacacacgaataatcttacagtcgcttggcgcaacagccaacctagcttgaggctcaaattaaagtcagagcacgagcctgaccaacgccggccggcggcgggtcttctccggcgccggcggccggtgatcgatttcatttccaggcttattctccgcgtatgcatgatgtgtcaagctactgagctatagctagccgtctctctcgtgtacgagtctcttaccactcttggctagcaaatctgacgactctttgactgaacgaacaactcgtacgtcttaaaagccaagaaaacaaccccggtaggctgtaggtgtgttcaaggggtattttgatttggtacctatatattcttgtctttatcaattaattcgtttgtaataaattgtacttacatgttaactatttgaattagacctaaagtataccaaatcaatagagtggtgtcaaacaggcactaccaaataaaaaaaatgcctactagcaatttttattagggtttgaaaccatacaaatcctaagttatctttgtgatactattgtcgtcggcctcacccatggtttgcatatggttgaatatatctgggattttttttcacttaaacggacatctccttgttattattttaaaaaaaattgacaataaagaatattatgtaatatttcaatctaaaaatatataagtttaaatttaacttttaaaatatattaaaaataataaatattattttgaatgtctgtatactagctatagtttaatttgtttttttaataacttgtggaagttaaacttagcattattcgtgtgcgaagtgatatatatcatattaatttattttatagaaaaagaatttttttataactgtttgagtggcctaagaaaaataatggaacatcctctcgaggaataaaaattcatctccaatatatttactgtgttgatctttcgctg

SEQ ID NO: 85617 - DNA, 985 bp, Oryza sativa
aaggcttggccggcatccaagcagttaatgtacctggagttgaaaatgtaagtgtgttgcggcattcaactgggccaaaaaatttcctctatacagctaaaaactcgataatatttctgaactcacaggttgatgccagtgagctcatcgttggacattcttcctacttgacacttgtcaatcaaatcctggaccagcttgagctgaacacctactatcctgtcttctatcccagcacaccaaagtgcggcacaccgaagtcaaagtaaccactgtaattgagctgcagaaaattatatatatgttttacgactggaaaagccagatctgtgctttgcaaagaagtgtatatctgatagcttgtggaacaaacagctgaatttagtgacagacaggttgcagtaaataaagctaactgctttcttgaatcaaaagtgcctgcaatatatagtactgcattttactcttaaaaatactgtttataactctttaatagctattagctaggtaatcactctgattcacaaatcacaactacaaatcgctcagatttgcaaggaatcgacagatgaatgaatgaacatctgcttcgttatttccgtgtgaggtcatgagcaagggaggagactcggtgcactgacctcgtcggcggtgaggaaattggagcggtgccatcgagtcgggacgaatcagacggaggagaggatggcgctcgccggcgccggtctggagagctcatggcgatttactcatgggcgatttccggccgccgtggcggcggcgaaaccccattttacagcttctccagaacatgggctgtactacggccaacaaaatcagccaggctaacatccgtgcggcccattcaacggtaggattgcgttcttttctctcctttcctcaattgtaaattgtactccctccgtttctccgtttcacgtaactcaggtgtgtttggtggattgggattcggtgatattccccc

SEQ ID NO: 85618 - DNA, 719 bp, Oryza sativa
ggggacgccgaggaggaggggggcgagccggcgaggtcgtcggtggcggggagcccgtgggcggggagcccgctccccgagggcatcgcaccgtcgcctgcgccgtcggcgaccacgccgaggcggttcttcaggcggccgttcccgccgccgtcgccggcgaagcacatcaaggcgtccctcgcgcgccgcctcgggcagcggtcgccggccacggcccaggcgcagcaggccgcgaagccgcccgccgaggtcccgatcccggagcacgggggcgggggcggcgccgccgccggggaggtggagcgggagctcgacaagagcttcggctatgaccgccacttcgccgccaagtacgagctggggaaggaggtgggtcgcggccacttcggccacacctgcctcgcgcgtgcccgcaagggcgacatgagaggccaactcctcgctgtcaaggtcatctccaaagccaaggtctgaccattcgtgatctcactctcctctctctctctctctctcaaaaaaaaaaaaaagaagtgcacaatccatcgaatttctttagacttagctcgtacatagagtcgccactttgctatgatccatcgatgagttttatgatggatcaggattggtggtttggtttggcagcaagtatttagccacctggtaattccatcagcagacattgcaacagcgatttaatcatttgcttgttaggataa

SEQ ID NO: 85619 - DNA, 1668 bp, Oryza sativa
gtctgtagactacccctcgggtggagcgtataagtcatactcctaggtctttagtaagcttcctagaagattcacccaaaatcttcatagactgcaaccaacagtcaagctcacaaaggtgagttccttcaagaatgctctgcaggacaacatctttgctaattaaagccaacagaactcattaaggcatagccaacctgccttgcagctcacaagagtatatgcatcttcacttggatagggtatatatattggtactctcctctagtttattaatggtttgttcttcccaggatctaattcacgggatctccgatcacatagactgggttaccaccatagtataactcacatgggtctcaaacccatctccttcgatgcattgtctatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagtcggcaccggtttttcaacaacaggcagatccattaatagatcacgcagccattctgcctcaacagtagcagtatctagtgccgttagttctgcttccatggttgacctcgtcaaaattgtctgtttgcaagacctccatgaaacagcaccaccacccagtgtgaaaacatatccactagtggctttgatctcatccacatcagagatccagttagaatcactataaccctccagtaccgcaggatacccagtatagtgaagtcccaattccacagtacctttcagatagcgcattactcgctcaagcgcacgccagtgatcatctcccggattagaagtaaatcggctcaacttgctcacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagagtaatcccattctcacctctaattagcttaatgtttaagataacatcagctactcccaaatctttcatatcaaaattttgagacaagaatgatttaacctcatttatcacctcaaggtttgtcccaaatatcagtatgtcgtcaacatacaagcacaaaataactccctcacccccaccatggcgatagtacacacatttatctgcctcattgactgcaaagcctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcaaagaaatcttcgccttctttctgagt

SEQ ID NO: 85620 - DNA, 830 bp, Oryza sativa
atttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccggacatgcatgttggtacaattatggagtctcgtgatgctaccttctttgagagcttttttccaatgaaggatacacatagtggttcgaaccaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagtgaaatggattc

SEQ ID NO: 85621 - DNA, 1188 bp, Oryza sativa
gcatatttttcacccaccaacttccacaactggacaaataacaatctgaacccattcgacaatgatttttttatcacattgtagtggcattcgcttgtgtaaactgtaaactcctgttatgattgttttgcttatatgggtcctatttagttaggtccgcataaaaaaaaacttacttaataggagattaggagtttgtgccagtaaactaccatctgaatcaaaaaaaaaatcactggaatagggttggggttttatttctagttttcatagttcggggtgagatataatcatttttttttggttcagcgtgaaaaggtggacttcaagaagaatttgagagcaactttacaaagatcaaaacaatcaactatgtaaggatggaaagtcaacaatatcttaaggaaagaaaagaaacgtactccatgattatgtagacattaagggcatcctcacatgcatcataaaatttgacaagattcgaatgcccagataaagccttcagaattttcacctctctacgcacatcctcaattgatattgctgttgtcatctgataaaaaggaacacaaaattgagatcatgttccaaaggtaaatgtgaatatgtaataggacaacccatagaacttctattttatttggccaagtgcaaacaaaatttgtgctaactgattgatcatcctattagatacttgttcaagcattaaaattaggtacttgtgtaaaaagaaaccattgccgacatgctgatacatactatatatattacagaaaggaatgcaattacatgagatgcaaatagaacaaaatacgaaagaattgaactacattaaacaataaatatgattggggctcagtaatttatggaagtagtcttctgcagtgaataaaattgttgtgaaatggaatagtcaataacaatgcaagtaataatgctcgatcaaaatgtgtttacatgcacaagaaacatcaatgctctcgtgcacatatacgtgtacgtacatttgttatgacaatgtatactagattttggcggcaatttgttgggctgacataaagaaacaggaaataaagattgaacagtgtctaattcagtaatacatgtgatttcaaggacaatcatcttattatcaagattactcaactaaggaaccaaaatatagaagatacttattcaccacacaaa

SEQ ID NO: 85622 - DNA, 609 bp, Oryza sativa
agcagaattttcatgggaatcattcctttgacattaacacgttataagcatctaaaatactgtcacaagaagacttcttggtcttcaacttaggaaacaccaaaagtaaatccagatcatacacaagtaaacagaaaaaaaaactgtccctttgcaaattaaacaccaagaatagatcaaatcttagcagaaagccacatctacttccacatactactcaatgaagttcaaaacaaagttaatataggaatcatggaagaacaaatcacttcagctagaccatgaactcactaaagaacactgtgaagaaagaaatggcaccaagaaatctgtcatgttttagctaaaaagaagacgaatcaaagcttgggccgtgaaagattcctctcaaatccaagaacaacccaaagatcccatgcttatttagctaaaaagatttgacccaaacaacactctccacctcacctgcaaccggcagcaatggcggcgaggcccgcggtgctgaagccgtcgcaggagacgaggcggagcacctggaagttcctgaaggacgcggcgatcatctcgaggcactcgtcggtgaccaccatgcgcttgaagctgaactcc

SEQ ID NO: 85623 - DNA, 588 bp, Oryza sativa
aattcagttcaccccgtccaacccagttatcggattcagcacaaaacttaactgctacatagtccaggaaccagcattacaatcttacccacatactttagttatatccagtatatcaatgcattatatattgactacttgtgtgttgagtgtctcaagtactctttgggtttcaggtcaataacaaaagaggaaacacgctattgcaacaatgatgctatttgacagttcaactccaagagaaaagtcgcaccttagagcagattggtagtgggaaagtgcatcagaaagcatattcatagctgcaaaaacttgagccaacttgatgtgtagagaatcatctgtccactgtcttagatatctttcaagcagcaatactgcatccttatttcttccttcagcgacatgcagatcagccaaagccaatgcatgtccagaaatccaggttcaagacgaatggcggattcataaaacttcctagcctggaaaatgcgcaatgaatatatcaaagggtactattattgatgggaagtatgcaaactataattgtgaccaagtgacttactgaccattaccaaaatataattg

SEQ ID NO: 85624 - DNA, 734 bp, Oryza sativa
  unsure (1)..(734): unsure at all n locations
gctaaggtagaccatgatctgaagcaggtaatatccgagcttcaaagccttcctctcgttgcctcctatgtcgccggccgccgcagcatctctgacgaagctcgctccttcctcctcgccttccgctccaagtctttcaagaagagccatgagaacgatccacccgaggacaacaaggcctctaagcccaatgccgccaccgccgccgacggccagaagccgccggcgaagaagaagccggccgcgaggcccggcgacaccaccgccgcctccgccaaggttgccggcgtcaagcgcgccccgtctgatcgccaggaggagcttgccaccaagaagaaagccaagctcaacaagatcaacacggtcgccactgacaagaaggccgccggtctggagctcgccggcgcggcgcctgcggcggcgaggaagaatgatgcgatcgcttgccaggaagaaggagaaggagccggctctggctccggcgatcaaaacgccaatcgcgacggcgctgatgatngaagttccgccgaagaccacgctgccatcggtggcctccctcaaggcaaggttcgcgcggttcggcccgctcaacgtcgacggcatccgcgtctactggaagtccacatgtgccgcgtcatctacaggttcaagtccaacgccgacgtcgcgttaaagtacgcgcgcgccaacaccaccatgttcgggcagggcgcgcccaactactacctccgcgg

SEQ ID NO: 85625 - DNA, 2015 bp, Oryza sativa
gtaggagaacttgccaccaactttgtcctcctctctaccaggaccaaatctacttgggtcatatacattagggtccttatagatgtagggcagtctgttgccgacagtcgtacaggtggccaatgtatgtcccttggggatttgatacctgtggccttgtcttgtttgtacgctgaagctcttgcttgcgtggcgtatcagcaggtttgctggagggtgcaaccgtagggcctctttgatgcagtgagtcagtgtggtcatctgtagcaagatgccccagtttatgcgatccccatgttgctggatgattcttttctgctcttggatggcggctgccaagtagcttcggtggccatggctgagcaggcaagctcctgtccatgtgctggtgctggagctcgtgtgctgcgcagcaaacatcatgcaaatgagtagcccggcgatctcattctcggtcatgcagcggccgttgatgtatttggagtctaggaatttctgtagcacatcatcctcagctacgcctgaattcctgcgtgatctcactgcctcgtggatcatctccccgagcatagcacgggctttgtcgcgccgacggtgctgtggggtagggagatatgggaagaagaggctgatcaagtggaaaccgttgtcgaagagctcatggaggagtgtggatacttgttccaacttactctccccgaactgttttccaagcaagcatcggtttgcaatcagcaggatcaggttccccatctcatactttatgtccactacgccatcttccccccactgtgcaaagtagccctacaaattgcagtggccaatcaatctagctaggatcaaaattgagacatatataatacgcatgggactagctctggcatctatactaagtcataacgcaaaataaaacatatgaaaactctctctctctctctctctctctctctctatatatatatatatatatatatatatatatatatatatatatatatatatatatattactaaccagcaaattgcaaaatcgcatataaatatataggaaaaatcaaaccaaaagtcaaaagtatgcatgataccacataatcaaagaggcagatctcctgccctgaattattcagtgagatcatcaaatggtaaaagttcacgctagcaaattaacctgctaacaaagaatgttgttcaatcaataatataattaatgttcatcatcatctcctgttggacatcactacaccaggcatgcctgctagcttgcttgcttatcacatatagccaagggcgaagatagcatcaaaacaagggggtgtgcactaccattgaaaatttataaaattttaatgcaatactatacattttagtgttttcaagtgagaaattatgaatttaggggggttcatgtgcaccctctagtttcaacatggcttcgcaactgcatctagctagcgcctatatatatagatacatgaagtagttcttctggaagccggatccgtcacactggcaaacattttgatatatgatctctatatatgaataacatgtacaccaattgagtggaaatattcaatccctttctaaatatttgatgccgttaacctttttaaatatatttgaccattcgtcttatttaaaaaatttaagtaattattaattcttttcctatcatttgattcattgttaaatatacttatatatatacgtatagttttacatattccacaaaattttttgaataagacgaacggtcaaacatgtggtaaaaagttaacggtgccaaatatttagaaacggagggagtaataagttaacatgcatgcatggaagaaactaaaagaccaaccagctggaggataacatatagtgtttgcatattgctcacctccacctcatgaaccatagaatcaacgtggcctctcaagttgattggcttgatcgagtcggtacagaagcttatctgcctgctcctggtagccaagtccacgtcgtacagaaccccacggccgaaa

SEQ ID NO: 85626 - DNA, 2829 bp, Oryza sativa
gcacgagcagcggattcgacgacggggtgtacccagagggccagatcctggaggcaccaaacctcaggacattcacattcattgagctcaggacagccaccaagaacttcaggccggatagtgttcttggggagggaggctttgggagggtgtacaaaggatgggtggatgagaagacgatgaacccggtgaagggcggcaccggcatggttgttgctgtcaagaagctcaactcagagagcatgcaaggttatgaggaatggcaggtaaaaatcaggttctttgtttagaaagaaagaaaagaaatacttgaattgcaggatgccaagttggttagcatgagcataggaatcttgcatgcttatggggtttgactttagttttgattactgctgtataataaacttaacaagttagaggatgggatcactttctggcattgcaccattaatggacagataaaaaatgcaccaaacttttgaagtttctcctcatggtcatctcatgcttatggttctttatgtttgtttagcttctgatgacttggctgtctgttttataagctgcaatgtcaattctttaataggcctatgtaatctgggtagtgccaaacggccaatagcccaatgctgaccagaaccatattaatgttataatactagactcttcataattcctgaccagaagcatcctataaaccacatgtttatcacaatgcagtgtttctctgggtcagttttggtattccaggcaaaatattacagctacctcccacatgcctttgcaaactttaacaagatatactactcaattaacttagtttactctaacagatgcgattttttgtcaacattaataacatctaatcatatttctcaatgtgtaccctgcagtcagagataaactttctgggtaggctctcgcatccaaacctagtcaagctcttgggctactgctttgaggacaaggaacttttgctcgtgtatgaattcatggccaaagggagcttggagaaccatcttttcaagagtgagttcttattggtttgttgctaatcatttccatcatcttatttatatcatgaatgaagttctcttaggcatttcactgaaaatttggggtgattaccttgctatgcacactgtatttctttccccctgcaatactttgtcttctggagtagaaaattctaaatctgcaaacatataagtgcatgatgtgagaatatctcggggcagttacttgacttgattgagaggtatactgatgatgaaactggccgcatctcttttcagaaggatgtcctccactatcatgggaactgaggctgaagatagccattggtgcagctcgaggacttgcgttcctgcatgcctcagaaaaacaagtcatctaccgtgactttaaggcttccaacattcttctagatgctgtaagctttctgctatttaatgtgcctgcaaccttctcattattgagttcaaatgctgatggtgttctttggcagaactataatgcaaagctctctgattttgggcttgctaagcttggaccaactggtagcaactcacatatcacaacaagggtcatgggcacatatggttatgcagcaccggagtatgtagccactggtatgtgtccttacgcctaccctgcagttaattatcaacacttaacactgcatgtgatagtcatagtacagctgaaatagcaatatgtgtggaatttgacctctcagtcttcatatgttcccaaatttagcgtttttgattgtcaatcatgtcacttacatttttggatgcatgctatatctcctccttctgtccaatgataaaattcggaattttagctaacagacaatataaatagtccatggatgttgaatagaagtcaagtgtgaaaatgaatattgcctaactagaaaggaagcaataccaagtcattgaatatatagaatagtgggtatgcactagctaagtccagagtctagacatgtatacgcatgtgactgtagggctccatcttggacagatatggatgagtaacatgagttagcacctactgccatccaagtggatgatccatcttaggaaaatgtgtgctaacaatcctttttatgtacggatattcgcctaatgtcactttccactcaaaaaaaagttgacacagtgcgcacccaactttcctcaactcgtaccattaatatttcagagttactagttagttttgcatcccacatgaaattcagaattcaagtttctataatacattgtcaaattattattagctctgaagtacagtttactatctgtagatactttcttagctgccggtggttattttcgctttctcactatctgctctactaaatcatgactaggtcatttatatgtcaagagtgatgtttacggtttcggagttgtgatgctggagatgatgtccggtcagcgagcactagaccccaaccgtcctaatgggcagctcagccttgtggactgggcgaagccctacttggcggaccggagaaagcttgcccgcctcatggacccccggtttgagggccagtataactccaaacaagctgttcaggcggcgcagttgacgttaaattgcctggcaggtgagcccaggagcaggccctcaatgaaggaagttcttgagacactcgaaaggatcgaatcaatgaagagccgagcaagggatgcaagaggaagcggttcatcaagggaccatagccatggtcgcaccacagcgcaccaacggtcatcgccgcgccctgatggtcgccgtggatcaaggaccaatggtcacgccacggggtgcaggaat

SEQ ID NO: 85627 - DNA, 1117 bp, Oryza sativa
aactattcctgctagtggtcccatgcaagtgatgaaagcttcacccaaggaacctcttagaattggaccagtttcaatgcctgaacaaaccaacaccaccctgattaaatctgagcaggatccagaaaggggtatccagagaacacctgggagaagtgattacaatggtgaaagggggaaatctttgccagcagaaagtggttcagcagacgctgagcaggcaaaaagagctgcctcatcaagtagcgtgcctactcccaacagagatgtttcaagaaaataccatgggccactatttgactttccatcctttaccaggaaacatgattccatggtgtctgcaaattacaacagtaatctagcactcggttatgacgtgaaggatttgttagctcaggaaggcatgatagttcttggcaagaaacgggaggataatttaaaaaagatcagtggcttgcttgcaattaatctagagaggaaaaggatccaaccagatcttgttttaaggctgcagattgaagaaaagaagctgaaactccttgaatttcaggctcgtatgagggatgaagttgaacaggagcaacaagaaataatggcaatgcctgatagggtgtacagaaagtttgtcagacaatgtgaacgccagcgtgttgagcttacaaggcaagttcagcagatgcagaaagcctcaagagaaaagcagctcaaatccattttccagtggcgcaagaagcttttggaggcacactgggccattcgtgatgcacggattactcgtaaccgaggggtagccaagtaccatgaaaggatgctgagggaattctcaaagaaaaaggatgatgatcgaaacaaaagaatggaggcactgaaaaacaatgacgtggaaagatatcgtcaaatattattggaacaacaaaccagtgttcctggcgatgcagctcaaagatacaatgttctatcttctttcttgacccagactgaggagtatctctataaacttggagggaaaataactgctgccaagaatcatcagcaagttgaagaggcggcaaatgctgctgctgctgctgcccgagcacaggtatgagtatgacattctttgctctggaaaatgata

SEQ ID NO: 85628 - DNA, 644 bp, Oryza sativa
tggtgccaaatgttctccagttctccccatacgttgaaattaacgcttcagagagagagagccttcagtttcaggcaaagaaagagaacatgccactcttcttttgtgccgggtaggccgaaaggttcggtcgaccaatttcattaagattaggagtaaaataaacgaaaattgtttgcttacaacgacagaaccctgtcgcagcggcagtgaggtagagcctccctactaacaagcgagaaaactcccgccatcttccagatcattagttcctcctttatgtcatgcactagctgttcaggtgctcttgatctgtgctcgaaaatcctcccgttacgctctttccagatgaaccagcatgtgagcatgaaaacagtgtcgaagagctccctgtagcccgtccgaaaatgctgtctagcttccaaactcgccctgtaaactgacatgagacaaataggtgctggcagtcctcctgttctcactgacagagagcacagctctcctcatgtggccatcccctcttcaccaaattatcagccattaggcataaacaggccacttttctgacgagctgaatgatcaaggaaattagtttcagaattcagacacactagctatctgttctaggacatcacagaaactag

SEQ ID NO: 85629 - DNA, 4641 bp, Oryza sativa
gaactttcagcccacactccactctgccatgttcttttttccttttctcttcttctctctcattttctcagcaacgcaatcctgttggtctctatcaaaccaaagagcttagtagcttgcgatggtatcgtcaacatgaatatatgatcgattattatgctgttcattcatgtttggctgaatctcaaagccagaggtaggtttattgatggtgctcaacacatttcttcagatttcagtacactacttcagttcagccctcttatctgtatccggcacttatcttttgtctcatctcaatcctcttggttaatgtagaaagaaaacagaacgtaaatttgtttttttttcttttggtttatcggtatacatttgggacgtaaagcatctgaaaaaagagattccatttcccagttctgataccaatctctgcaggtaaagcttctgaaaaaaggcatgaacaataaaagaaacacaatagcactcgcaccataaataaaacagtaagtatgtggcatgatgtacaagtacaacagactactacatcaactgaaaagactgaattggtgaattctctcttcttctcagaagctgctcataaggtatccacacattttgatttcatctgcattagttttgtcatttctcttctgcaaaatccttgtgctgatcaagtgactgacccagccttaacaccatctgcttctacagaagttatgagtgagaggaagaggactcaaatcgatggagggcaagggagcagctgcagcagtggctctctgctgcattctcatcctgctgtcaggtgatcagcttcatcaggtggctgccatgtccaagttctgcagatgctacttgcagtgctaccctgactgcaggaagagcctgcctcggttcatctgcgtgctcaaatgcatcgatgattgcagccccaacaagaagaggatggccgtcggcgactgcaacaaattttgcctgctcgccatctgcggcatggcgttgaatggtaagatcagatagctagaacaatctgcattttgtgtatgtcttttgtgcatcgtatttgggagattatcctgactgattcctcaccgaattctcactgctgtgtctgcttatatgccttgacagggcaagctgatgttgcatcttgcgtagatgactgcaccaagaacccagatctacacaccaagttcctttaagatcatgggattgattgattcgtactgttgtctgtcaagagcatatcaactctagcataatgcatactacagatctatagtccacttttgagtgttgaacgatgatcagtggtaataataataataatcagcttatgtttgccacttgtctggtttactggttccacaactttttttaagttctgtttgtttctttccaattctcatgtatcatccatgaccattccttcgtttcttctagtccatggaagtgtgcaagaactgagcttacgcaggtgaacaaggtagcagaagtacatcagcatgcactaacagctcacgaaagagaactttgcataagtgcaatacatactgttcatcaacatcagaattcagaagcatgaaaaggattggaaatagtatcagagagatcatttgtatactaatgatttgcctcaagttgttggtcaacatatctatgcaagttaagacatagtaagttccagaatgtgatgccatcatgccaatcaaatagtgcatgtctactgccaaacgaattacaggctccatgtacatagttaagatttcttctagttacaggtgacaaatttggcgacccgatgcattgcgcagcaaactgccccgctatctgttcattccatcacacaacacttgtgtagtttcaatgtaagttacaacacattgtgactactcatgcgtaaaatcatctcaactgccggctctgtacaaaaatgagcaccaatgttccctcaaaatagtttatccgtgtaggattcattcatcggggtacagtgttctgcttcatggtaccatgaattcagccactcctagaatatgggcagctatatgtctatctttcgttgatcatgcagaggtaaccacccccagcattccgctccagagggtacctggtggcacctctcatgtactccagatgcttcaaggcagcatggcggacaacagatctttttggtgtcttccctttctcgcgcttctttatcatggtgcaagagctcaaagggccctcgcttccagccccaggtctcctatagtgcattttgcaacgacgaagtttcaagttatacaacatgtggcataatgacatatctgattaatttagttaatttaagcaccagaaccaagcagatgaaaatcaatatctagtaactaagtatctaagtggggttgccatggagtgattgacgaatggaagcaagaaccatactaaataaaggtaggccacaaaacttacttcaacagtttctcagaagcaaccctagcagcttcaatggtgtccttggttggagcccactttactactctgccaggatcacctcgcataggtgagtggatttttacaagctgcacatgtttatatttaaaaacagtaagttatctcttcacactataacagtgtggctaagtaataatccttccatgtaggaatggtttgattagttcggattaggggaaatgagaaactcacaccaagacattccatcatttgataatatgctctcccatgtaatggagtgtgtccctttctggactccgaaaagtacctggtcctgaaagatcatcacatcaactgtaagcagatctgcacatcaacatacatcatatttagtgcgtaagatcgatcgcaccaaccattccttgtatcctgggtcaactgtaaatccatacatgtcgacactgtcacacatagacagagcgaattcaagagccttaagcccagttcctttagcagaggaaccaaacgatgtgcctagcatgaggtatactggattggttattggaatttcctacatagcaagaattccagcaggcaggtaagagaacacagaatatgtacccaagctaccgtatttttcttaaataggacagctaaattacccggatcatttggttcatgatatcatgtattgttgtcttaacgataagggcttccttttttgtttctgcaaccataaaaattagcatgccttagtatctcaccaaatgggaaaataggtggctgacagacctaccatctaactcaacaactttatctagagcctttgcagatcctctgttaagaagtcgaaatgtactctttgtcccaacatattctgtataattcttcaataaaaatagaagtcagtttatgttcgagtggaacgacacaagagcagcaaacataagtatcttaaagaaacctggatgggtgcaccgttctctctaataacgacatcataagaatcaatttcatccccaaatttggttttaagaagatccccagagtttccaactacagcacatctaccaaattgccgaggtacatatggtggtgtctcaggaagaactaatgaaagtttttccatgcaaagagtcctgttctggcacttgttcctgcaatttcaagactaaacatgctcaataatctgtttgtggagttaatcatgctgcaaatcttgatgaaactgcaagtatgtgtacccacagatggattcctttattgatcctgcgccatgcatactcctcccaaccatttggcaacgcatcgatgtactcctttgtaagtattgttgtgctattgcgaacctaggaaaaaagcaactgagtgaccataagtccataaaaatagctaatactgtgatctaacaaatatctggacacagtgtttacatactgaggattgccatgttttacattatatcatataatattaaacttcaatgcatctgcaaaaaaacacatacatatgtcagttgaatgaatgctaacctgctcccatgaagccacagcttcacagagattgaactcaaatgataaaccttcaggttctccagtttttggatctttctgcaaatatcagtgcataagaactaagaaaaacaaacacacgcatcactagggatgggaattttacccatgggtccaggtatccgtggatacccgacccgatgggtacgggcgtgggtgtgactttttacccatgggcacgcccgcccgagacccgaagacgttatgggtaataggtgggtttcattttttacccgtgggtaaaccatgcccaatccgatacatatgtattagctaattttgactcatttcttaattcttataccatttctctcggttcatttgtgatgctaattgatactaagttatgatgtaattcaaattattgttgataaccgataatttggtaaattattgattttatttctctttgttaaattacatatctttcaagttattattcatgtgagattcattgggtacccgccagatatacccgcgcccgccgggcacggagttttgcccgctacctctagtgggtagggtttgggctggcaatgtcgggcatcgggtcaggcatggttttgctctacccatgcccgacccgacccattgccatccctacgcatcacaaaaggtggcacgagtatgcaat

SEQ ID NO: 85630 - DNA, 2346 bp, Oryza sativa
ctcacagaggaacaggagagagccctccaacttctcacctccctccaacaacttgaattttccaaccaccattatcttgagtcacttcctgcaaatctacgaagcctcgactccctcgaggcgttgcatatcaatgggtgccggagcattcgaaggctaccagagatgggcctcccgcccttgctcacatgccttaatttaattggctgcagcaaggagctatgtttgcaaggaaaaatggcacaaacggagaagctcatggtctacactgcctgatcgcgtaacacttctgtcttaaggtacatttctgtcttaacaagtaatcgatgcacttacactttgcttgcttaaaagtagattatctttcagcagtttgagtcagtatggtgtatcactgccttgtctgacatcgcgtggctgctggccatcgtcatggacttagggtcgcttaccttgagttcaaggctgtcagagaaagctaaaaaggggacatcacgtttgctctggagacttcgaaattatcatgttaaatggtgaaaaaaaggtaaagatctacaccatctgattgtggtgggtttagatttaatggtggggattggtcgaaatagttttatacttgtattacataaatagaaggttgtatatccaaatatgaaatagaccatgagcttctccgttagtgccatttttccacataaatagaaggttgtatatcaatttcccacacaatttaaataaatttcctacacaatttttaaatatactttaatctagctcagtgcaaaattgtgtgggaaattcagttagtctagcattagcgaccaccattttgtattttccatttgttttcctcacttccctggagtaacagaaaataaggaatggcaggtatgatgtagtttggatgaaaaatataccattttgattttgcaaatgtgggtttgtgtatctgataatttcagtgaaatgagcatagcgcgagagatgttagagtaggtgtcaaatataaccagttttgaggcactgcaggagacccttttggaggaaaattagaaacgctagatttctgcttgtattggacgatgcatgagaagatagttccaggagcagtcgatcaggtgcaatgagctattaactatactgagaccattttcttaaaaaaaaagctatattgagacgtaatgaagcaaaaggctgcatgaagtggtttcagtttgttattgtccgcttataatcaatttcaaacttcactggagtatagaaaataagaaatatatcgagttatatagattgtgaatgaaaaattacaagatggttgaaaaatacattaacacaacttagcagtggtatggacttgtatgggcattaacagaaccagctgggagatagcattgagctgactttttatttaattgtttataattgtttgacagtggattattgcattaccctgaattcgttctgtttatgactgacatcaaaattaattaatttcatgatcttgtagtacttggttcaagttcttggcagagtcatctacacaagatgtaacttcatctggccctgctgcagctgatcacgagacgacagtatgagcatgcagcagagagcagctgcacctgctctcttgccttctctctctcagctcctctcactcaccgctgcataggcagaagatgttaagatcgggtcaatcacttgctctgcacaagcattgtgcaaattgagttgacaaatgcagatgaaaacgaaatgcatggacacctgtgagcagctcatgtgatagcctataatcatgccacgccgctgccagtgttagtttatatctctatgcgtctgctggtttttgttccagttcatattttcagaagcctaaaagaaattagcatgaaacttgagttttctttcttgaagatgaccctatgtagctccacttttgatatattgatgactggttctttggtcagggaagttatctcataatttcattgagggcttgtttggttcataaccttgccaaccttttggccttgacaagagttgtccgttgccaaaatttttggcaaaatttggctaggcattcatttactttgctaccaaagttatattggcattcaactaatccaaataatttagtggtgccaaattgtaagctacaaaccaaacatatcacaaactttttggcattaccaaaatattggcttgcttaattttttatccctattcttggagtgcaattcagttgtccatgattcatctcggtctggagtgccatgctgttgccagtgactgactcggtagtcggtaccaacgttttattttcttcttttggaagggagcaaagca

SEQ ID NO: 85631 - DNA, 2655 bp, Oryza sativa
tgctgcttgtactaaccctgaggaaagctctgcatcttcatccactccatcttacattcaacaaataagcaacaggatgaatcaaaatattagttgggttatggatggcaaaaaaaggaaaagagaggaagaggaggagccaactcatagcgtcatgctgcctcctgaggttaaacatggcatttctgagaggatcaatggaatagtgaatcatttacgcattaggggcaatcctgtacagggggttcttcagctagagattttacggcaaattgctttgccaaagcagagtcagaacggacccaggaaatcacgcctgacaatttctcttatgactgaacacaaggtttacgggagggatgcagagagggacaacataatagagttgttaacgaaggggaaatctagtgatctagatgttgtgccattagttggcgttggtggagttggaaaaacgacgcttgctagatttgtatacaacaataatagaattgaaaaccattttgatttgcgaatgtgggtttgtgtatctgacaatttcaatgaaaagagcctaacctgtgaaatgttagaccatgtgtgtaaagatagacaagagtacggaaatattagcaattttgatgcattgcagaagatccttttggagaaaattagacacaaaagatttctgctagtattggatgatatgtgggaagatagggacaggaaaggatgggaaaatctgttagctccattgaaatgtaatgaagcaaccggctgcatgattttagtgacaacccgaaggacatcagttgcaagaatgactggaacaatgagtaagatagacgtgaatggtttggatgaaacagagttttggtcactcttcaaggcatgggcgtttttaggtaatgagaaccaggagcgtgatccaactttgcgatccattgggcaacatattgctgaagcattaaagggcaacccactggctgctcggagtgttggtgcactgttaaactggaatgttagctttgagcactggaggaaaattcagtacaaatggagatctattctggaacaggatgatgatattctagccatattgaagctcagttatgaatttctgccagtccacttgcagtactgtttctcatactgctctctgtttccaaaggaccacaaattttgtgggaaaaaattagtccgtgcttggatatcacaaaattttgtgaagtgcgaatgccataccaagagattggaggaaatagggaagcaatatttggataagttagttgattggggcttcttagaagaggttgagtcccactatgttatgcatgacctaatgcatgacttggcagaaaaagtttcatccaatgagtatgctactgttgatgggttggaatccaagaaaatttcaccaggtgttcggcatttgtctatcataactacttcttatgataaagaagaacattgcaattttcctagcgaaaagtttgaaaaaattatacagaatatcagatctttgcaaaaattaaggaccttgatgttcttcggccaaaataacacaatgctattaaggttcttacatactttatgcaaggagtcaaaaaggttacgattgctaaggatttatttatgtgacaccttcagacatcagctctacacttaatttgttaacgccatatcatcttcgttatctggaattcattgttatctacgccaggtcaacatatggatatctagacattgtaaatacttctattcctcaagctttgacaaaattttatcaccttcaagtgttggatggtgatagtacaggcaatcttgtagtacctattggaatgaatgatctcattaatttacggcatcttattgatcatgaagaagtgcactcagcaattgctagtgtcggcagcctgacctctctccaggaactaacattcaacgttcaagccgctggtaattttagtatcggacaacttagttccatgaatgagcttgtgacacttcgaatctgccaacttgaaaatgtgaaatctgaagaagaggccaagagtgcaagatttatagataaagagcatcttgaagcgttatcattcacatggaatgatcttagcatgacctctgaacctactgcagagaaaacaacagatgatgtacttgagggtcttgagccacaccataacctcaaacacctacagttgactcgatacagtggtgctacatcaccaacctggcttgctagtacagttacatcactgcagggacttcatctatataactgcagagaatggcgagtcgttcgatctcttgaaaagcttccactacttcagaagctgaagttggtcaggatgtggaacttgatggaagtatcaattccttcttatttggaagaattggtcttagttgatatgccaaaattgaaaaaatgtgttgggacttacggtcaagatttgacttctggtctaagggaattgatggtgaaggattgtcctcaactaaaggagttcacgcttttccatagcaacctttttcactcccagcagaaatcatggtttccgtctctcaacaaactcactatcagtcattgtcaacatataatgtatttaccttatttcttgttaatcttgcttgttcaatatagtttcaaaattattctgcgcttactttgcaaaa

SEQ ID NO: 85632 - DNA, 1419 bp, Oryza sativa
agtgttttcgcgctaacatgttggctgctgtggaaagaatgcaatgcgcgtgtctttgaacagaaatttcgaagcatagaacagcttgtgcaagatatcaaggaagaggccattgtctggaagacgacaggagtgttcacaacgtgcaatagcgagatcacgtaatatgcattgtaatctgtagaagttttctagcttaccgggtcagggcttttgccccaatctgttttcgacagcatactgtcgttgtaagctctttaattgtattgtacccttcctttcttaatgaaattggtcgaccgaacctttcggctgacccggcaaaaaaaaaaggaaaacataataaagctgttaacaagtgggaaacctagtgatctaggtgttctgccattagttggtgtcggtggtgttgggaaaacaacgcttgctagatttgtataccatgatgaaagaatcaaagaacattttgatttgcgaatgtgggtttgtgtatctgattatttcagtgaagagagactaacacacgagatgttagaggtcctgtgtaaagatagatgaggttatgaaaatataaccagttttgatgcactgcaggagagccttttagataaaattagacacaaaagatttctgcttgtattggatgatatctgggaagataaggacaggagcagatgggataagctgttagctccactaagatttaatgaagcaaatggttgcatgattttagcaacaactcaaaggacatcggttgcaagaatgataggaacaatgcataaggttgaagtgaatggcctgagtgacacagagttttggttgctcttcaaagcatgggctttttttggtaacgagaaccaggagcatgatccaactatgcagtccattgggcaacacattgctaaagcactaaagggcaatccactggctgcacggagtgttggtgctcttctaaacaggaatgttagctatgagcactggaggaaagttcagtacaaatggagatatcttctagaacaggatgatgatattctaaccatcttgaagttcagttatgaatttctaccggtccacctgcagcagtgtttctcatactgctcactgtttccaaaggatcacaaacttagaggggaaaatttggtccgtgcttggatatcacaaaattttgtggagtgcgaatgccattccaagagattggaggaaacagggaagcaatatttggataatttagttgattggggcttcctcgaagaggttgagtcacactacattatgcatgacttaatgcatgacttggcagaaaaggtttcatcaaatgagtgtgctattatagatggattgggatctaagaatataccaccaaatgtccgtcatttgtcaatcataactactgcttatgatcagaaacggggtgcagga

SEQ ID NO: 85633 - DNA, 6056 bp, Oryza sativa
ctgcaccccgtccaagcctcggtcttcgtccttcacttggcgaagtgtcctgttcggaagagagttgctgaaaaaaggggttcgttggggtgttggtgaggggagttgtattaaaatccttacggacaattggatccctggcttcccgcttgttacctttgccaagtgaggttactgtggccttcttgatggacgatgtgtccaagacatgggatgtagacagagtgaatgcttttttttgaagaagaggttgccagcgctatttttcaggttcccatcagtcgacacggaggggaggactttgcttcttggccacatgacaagctaggtcagtacactgtcagaaaacctcgtcatctttcctagctgcacatagcagtaatggaagaggactcccatcagttctagatgaaactgtcaagaaagggaaggctctttggaagattaaggcaccaggaaagatgaagataaatctgtggcgtgcagctcatgactgtctgcccacgggtttccaactcagacgacgccatataccagcaatggagggatgcatcttttgtaacagggacgatccaattgaacatgtgctgcttttttgcccctttgccagtgctgtgtgggatgaggtcaggaagtcttttaatctccaactgggtcgggcagcactgagtaatatgaagcaatggatttttgactttataagccggggctctgagctacagaacaaggtaatggtggtcacaatctggcacatttggcaagccaggaatgaagcgaagaacaacaactcccctgtgaatccacgtagagtggcgcaatcagttgtggcatatgtgaacatgcttactcaattttgtttcaatctctgtcctgctcccaggtgtgagtccccctcttcagttgctagatgggttccaccgccggcaggaactttcctcatcaacacagatgctgctatcttcaaatctacttgccctctccattgcctgggaagatggtatccaacgggtaatcctggcttccgactgctcttctatcatcagaagaatacaagcctgggcaagggatcgttcttcggttggttgtgttgtctctgacttcaaggttttggcttccaggtttttatcatgctcgttcaagcatgtgaatcgtttatgtaatgctgcagctcatgttttagctcgtcgggccgagcttaatccttgtaattctcaccgtggtgtcatcccggattgcatccaggatgttctatgtaatgatgttacttaatcaatgaaatgctgcattcatgtcaaaaaaaaaagtttaacaagataaacgcctccttgagaaggaattctatagattatagctgcaaaatttgaattgattctcgtcaaaaaaaatgctaaaatttttgtaaaattcctgcctttcaaagcgccacagtgtaagataggagtatagtcaatgaattagagaccccgtacagtacagtattcgttggatgatgctggaaaaatctcttacacgtaaaatagaacggctcattatattagttctagctaactttttaaaaataaatagattaatatgatttcttttaaagaaatttccctatatatttatttttaaaaaatgagatagtatgtgagttaggaacgtcggctgcttgtctgtactgcgctgacataagtaaatttcatcatgggctattttctttttaccggcgtttcactttgggctagagctaaatcaagattttcactttacaccatgtttctttgccaagaattgcactttggggcagggtatgttcacaatctgggtatgtgcgacctcaccgtagatattctgctgttgtggctcttcgccatgcgacagctatgtatttcgttgtaatggtgatgttcgacctgactggcggcgtccggtccaaccggggaggatgcacgtacgagcatggcggcggggcatggcactcagttcaaacaacttcttgatacacggcgtggcacgaacgccttaatttgacgagcatcttgaggcggccctcaggaagtatgaactactccccagtgtaatttagcttagcttgattgctggtcaccgcagccagcgagagggactgtcatgatcaatcggatcatgttgccgcgttgcacgggacgatagtgagttgaagcaaaatgtccaccgcgctgcgctctcaccaggacatggcggcgtatggtcagctagttcacgctcgatctttaaggacgagccacgcgcggttgatacatacgccatcccgctgatgtacagccaccgtcgactgtctatcgtcggccaatattccagcgtgtggtgtggacgctacactacccatcgtagaagaagatgtgtgctatcgtttcatgtatgcagaacttcctttgcatatctaggtgttgccacattgcaatcatctctattgcaagcttgccgatgcccacaatccaatcatctccatcacaagcttgccggcgtcctccctgctctctcttttatctcctgatctactgacatgtgagagtagtacaaagtgaaagcttttggtaaaagaaactagcccaaagtgaaaactttgtctttagaatggtccatgttaaaacttgggtaaaaataactagaccaacgtgcaatttacttaaaaaaaaaggaaagaaaatcagtccttggcgcgcgccactccgtcgacctcgtctccctcagaatcggcggtcggcggcgtctgctccactgtcaggcaatgcaagcatctaccgcatcttcctctcccggattcgctaatccggcgggtgccccgcaacttctcttctaccggcctctcctctccctgcagcgagctattcgtttgcacagtgctctctcaaagctgccgctgatggccacgggtggtgggattccgcgccggcgaaaatcgccgctcccgtccaatccaaaatggaaatattgcagttcctattggtatgaataagcttattaatttacgtcatcttattgctcatgagaaagtgcactcagcaattgatagtgttggtaagttgacctgtcttcagaaattaattttcaaggttcaagatgctgatagttttgagataggacaacttcgagccatgaatgatcttgtaatacttggaatttctcaactcgaaaatgtgaaaactaaaaaagaggccagaagtgcaaggttgatggacaaagagcacctcaaagagttgtcattgtcatggaatgataacatgagctctggacctactgaagagaatacaagatatgatgtgcttgagggtcttgaacctcatggtaatctcaaacatctgcaattaactgggtacagtggtgctacatccccaacttggtttgccagtaaagttacctcgttgcaggtacttcatttagagaactgcacagaatggagaattgttcagtatcttgaaatgctcccactgcttaggaagctgaagttgatcaggatgtggaacttggtggaagtttcaattccttcctatttggaggagttggtcttagttaatatgcctaaattggagaactgtgttggcacgtacggtatagagttgacttcccgtataagggtattgatggtgaaggattgccctcaactaaacgagtttgtgcttttccacagggatcattttcatgctgagcaaaagtcatggtttccatctctcaacaaactcatgataggtcactgttaccgcataatgtaaactatctattcccatcaatcttgctttagtacaattgcgaattttgttgtgcacttactttgttaaatgatttttcagaatgtggaaaatccttcctctagaagaaatgcgagcgctcaaggagttggagttaatggatgtgcctattgtcgaagaattgccagttccttctctggaaaagttggtgttaattcaaatgcggagcctgcaaatttgcagtgggataacagcttcacctgtacaagtttcgacttcccaagtggatcaaaatgaatggatatctagtctccgtgaactcactatctatgattgctccagtttggtagtgtcccttcctattccgccctctcctcttatgtcttactcgtccatcaagagactttcagcatttccaacaatggagataaacaataggaagttcactattgaatctgacgagttgagtgaactggatggcaggatcttatcattccataatctgaagggtgttacatcgatctaccttcgaaggtgtccaaacttgactcgtatttcaactgaaggtttcaaccagctcatcactttagagtgtctggttatacaaaagtgtcctaatttgttccagctacagatctcagatcaggcaaataatacttcatctgctacaaacatccctgccctcccatctctcaaatctctcaccatttcatcatgtggcatagcaggtaggtggttaactcaaatgcttcatcatgttaactcccttgagaagttggacttatttgattgtccacagataaagtttctattaaccaatcaacctacagaaagggaagtaaccagcagtttggcttcagcagagataacctcagcaggggatgaacagcttctgcaaattccatgtagtctcctccattctctaatgtggctctccatttctgaatgtccagacctagagttttgtggtggcagtggtggctttgcaggattcacctctcttgtgcagctacagattaagaattgccccaagctggtctcagcattggtgagcgaaacaaatgataatggattactcccaatgtcacttcaagatcttagcctcagtcctctctcagtctcagaaaacttgcagtccttctcccctgaaggccttccctgcctaagaaggttaagcctatgtaggagccagcatttgaagtccatgcagcttcattcctgtacatccttggagtatctgaaaatctcgggatgccgatccctggttgtgttggagggcctcagctcccttcgaagattggacatccagatgaatcctgagctgtcagctgcatggcatctcaaactgcaagaacaagaacaaggtggcaatcaggctcaggtgtttcctccatcacttgttgaacttcacatctcaaatctcgaaggaagcatcagttcgcaatttctgtgtcttccttcagtaacaaaattagcagtgcgagatagtccagccttgaagtctattcagttgaaacactgcatgacactggaaaagctagagattatcaactgcaagttgcttgcttcaatcgaggatttccactcaattagaaaccttagatccttgaaggtacttggcacccgcagcttatctccatatctgcagcaagaggcctctgggatgtggttccgactggaaagtctaatgattgatgatgcagctgtgctctctgtgcacttatgcatacagctcacatctctaagaatcctacaattctggtctatgggcatggcgagcctgacggaggaacaagagagagcactccagcttctcacctccctccgacaacttggtttctcgcggtgccagaagcttgagtcacttcctgcaaatctacgaagccttgacttcctcgaggtgctacgtatcgatgagtgccggagcatccgaaggttgccggagatgggcctcccgccttctctcagttaccttgatttgtacggctgctgcgaggagctctgtatgcaaggcagaatggcagaaacggagaagcttaaagttgagattatttacaaacagtgaatcgatccctgtaagacactccagaggtacacctttgtttcccacgagtcacatatttagatcatctttcttaagatgtactgcagcaatgccagtcaccgtatgttgtaatgctgccttgactgacatttcagtgttgctgccagcatcggtgtggtcatcttgcctgtgttcaaggctgcctagtctagattatttctacttataatcaattgcaaacttcgctagagtaacagaaaataaggaaattgttagtgtattctttctgctggtgacttgac

SEQ ID NO: 85634 - DNA, 2025 bp, Oryza sativa
cgcttgctctcctcgaggagatggaggccaagggatgcgagccgaatgagcgaacatacaacactctgctcatggggctctgcaagaacaagaagctcgacaaggccgtcgatgtttacaaatccatggttggtgccgcgatgaagcttgaagctccagcttatgcgacattcgtcagggcgttgtgtcgtgcagggagaataccggatgcatacgaggtgttcgactacgggatcgagagcaagagctttgcggaggtgacgttgtatactgagctcgagaactcgctcaagtggctgcaccggatgaaatcataaagtaggctgcatggccagtatctttgtccctggtacttgcttcagccttagtttttttttccatgaaaagctagttgcctgccttaatttgttgtattacaatgaaatatgcaaattcagagaatctgtgatatgattgtttgatctaccaaaatgtacaattgaagctacaaaatcttgaatatgctcttagtccttgagaatcaaaaatggcaagagccctattctgatctgtaccaagcttttctagcttgattcgatgcttttgtgtaaacaaacacaattttttttcttcaaacgatttttttttcaggtgtgaccatgaaaaacatcaacactatgaatcagaatcactaaaatcaaatattgtatctgaataaattatctagtagtgaattgcatgagctaatcaagtacatggatcattagtgcagtgtttttatcatgtacaaaaagcatgctattggactgagattttagctgcttcggacatcttacctattggtatatccctatataaaatcaatgcaaattgacaatagttttctcacagcttcagcaaatgttccaataatttttgctatgctaagtttacatttgatatccacattgtattgttttctcctgactacggtagcactttagttattctctgtgttatattagtgagttcaattgtcttctgaaaggcatttggtcattctcatgatgaacttaatcagttttattgtattaacatcccattggtttgcacttgctagcaatactatgtttctagtgtttcttcaaatcctccaacaaccaccgctagggttagttgtttgcggcatgactctgctgacatccattaacatcttcctattgacagtggagcaccaccttgtgggttagttttggtatgtagtgccccctagcaagcatacaagattaaaaaaacacacagaaaaaccatgcagctgtcagataaccagagatgcacccttttttaaaggcatttctcagccttcattaaaagcataataggtttttcactgaaacacagtgagtttcaggacatcttgaagaatgtggtaaattactcaaatcttgtaattcactaggtactgcaatggttcatgctagcatgggagaaaactgagtcatcatgtcctgccttttccatgaccggcaagctcaacagaaaagatgtccgcagttgtatggttttctgctatctctatattttaaatacctagctagcacaattcatttgttccctttttgcagatccaatatttatgaaagcacagcttgattacttgaatggtctgcatcagatgtttatacccttttgttggtaccgactactgagcaacttcatactccctccgtcacaaaaaaaaaaagacagatacatagtcagggtttgccttttttgagacggagggaatactttggaatgctcattagtctttatgcagcagtggaatctcatgcaaaagaagggatattgtactagaggaatatattggtctttttctattggtgtccccccactttggtccctctgggatcagttttcctgtaaatgtctgaataaatcatccaaatctcaatttctgaaggtccatatggtccatctgtaggagacattaagcttttagtaaactgactgttgtctactggagtaaagcaaaagatttgtggaaataaaaaaaaatcctgcttg

SEQ ID NO: 85635 - DNA, 1032 bp, Oryza sativa
cctgcaccccttgtattgtcatgagctgcttcattacggaccagtgacgtttgtatcccgacagcctgagcaaacctttttttttcccagaaaatcactcaagtttaacatcaatatgcgtgttttttcagtatgtttagaacacttgttaaaattcaagtctcgcaagaataagaatttgtgaaaagattacgacagaaaggcaatacgctctatacaaattgttggcaagtgtcaatgcaacgttgcaacatactttttgcacatcttctgaacgaagatttgttgcaattatattccattttccacactctcacgaaacagagatgagatgggagcatccacatctttgaaagactgcacatttcaaactgatttgagttagacacaggttacaggtgcttgatgagaagccaagcaatgaccgcaagaaacactatagcaacgacagatatcagcagggccatgcacgagcagccacctttgacgcgcttattcagaatagcaagcctcttttgcacgcgctgaatcaaagaaagatttatgtcaaaattcagttcgcataagcttgaaataactatataacagtgaaactttcctgatgattgtataaagaagtaccaaaaatatacctgaagacgtgagtttgtaacatcaacataatcatccaaatcatcctgcaaaaaccacaatagatcagttgttatcaagtgctaggaacataaattcatatggttttgtgagaataaactaacaatcaatcttgtatgcagggtaagttcttcattgactgctagagcaatatgttttgtgctcagtactgtctcttccagcttctcaagaccctcatcttgttctgcggattgttgcaacaggcaagataaatgaattagctacaatgcaataattgtttcccgtactaaaagctactgtttgtaaccatctagatatatacaagtaaatacaaaatgcaactctgcgaacagatcgggccacttagaatatatcaggggtgctttactggggtgcagg

SEQ ID NO: 85636 - DNA, 542 bp, Oryza sativa
cgacctttggcagccaaccataggaagaagcgtactcgggatggagctttgatgtgccaaataagttcgctgaaagggcagatctctcttgccatgaagaaaagttataggctgaagatacagtgaaaagtccgtcggaggaaagcttccagcggatggtgtcttcctctagatttagctcgacagtgtgtacttcatcccagagctggaagaattgtgccatggcttcattggagagtgcaccttgcagatctctgacccatctgttgttggttaaagcttgtgccactgtcagctgtgagcggccaacataagtggacagtaccggccatcgccaagcaatgcttccaccatttagccaattggctgtccaaaactttgtgtctttgccgtttccaacacagaattcagcagctgagttaaagattttctccacgtcttctccaagtttatatcctgacttggcccacggtcgatttttctgctcaagacttttggctaaccattttagtcttagcgcttgaccaaaggcgtcgagattt

SEQ ID NO: 85637 - DNA, 1129 bp, Oryza sativa
tctttgaagaggttgagtcacactatgttatgcatgacctaatgcatgacttggcagaagaagtttcatcagatgagtgtgatactgtagatggattgggaaatccaagaaaatttcaccaggtcttcagcatttatcaataataactactgcttatgatagagaagaaccttgcaattttcctagggagaagtttgagaacatactacagagtatcgggtctttgccaaagttgagaacattaatgttcttcggtgaaaatagtataatgttattaaggtccttaaatactatatgcaaggagtcaaaaaggttacggttactaaagatttatgtgacagctgctgacatcagctctacacacaatttgttcaagccaaatcatcttcgctatcttgaatttattgttgttcccaccaataatatgtttggaagtcgaggcattgtaaatacctctattcctcaagctttgacaaaattttatcacctccaagtgttggatgttagcagtaaagtaaatcttgtagtaccaactgatatgaataatctcgttaatttacgtcatcttattgctcacgagaaagtgcactcaacgattgctggtgttgcaacttgacctctcttcaggaactgatattcaaagttcaagatgctagtaatttcaatataggacaacttcgatctatgaatgagctcgtaatacttggaatttctcaacttgaaaatgtgaaaactaaagaagaagccaagagcgcaagattgattgataaagagcatcttcaagagttgtcgttgtcatgggatgataaaaacatgaactctggacctactgcagagaaaacaagagacggtgtgtttgagggtcttgagccacaccacaacctcaaacacctacagttgactcgatacagtggtgctacatcgccaacctggcttgccagtaacgttaagtcactgcaggtacttcatctagagaactgtagagaatggcaaattattaactctcttgaaatgcttccagtacttaggaagttgaagttaatcaggatgtggaatttgatgtcagtctcaattccttcttatttggaagagttgatcttagttaatacaccaaaactggaaaaatgtg

SEQ ID NO: 85638 - DNA, 1463 bp, Oryza sativa
ccgtaggtgacaacatgagctgattctttctattatcagtgatcatcgttcaacagtgcaagcatgcattatgctagatttcatttgatatgttgttgacagacatcagcgtgaatcaatcaatcccatgatcttaaaggaacttggtgtataggtttcggttcttggtgcaaccatctacacacgatgcaacatcagctgcccctgcaacggcaaatgcagacaccgcaatcagaattcagagaggaaacagaatctccctaatactatgcacaaagacaagctcaaattcagctaggaccctgatgattggagacttcctgatatcggatctcaccgttcgacgccgtgccgcagattgcgagctggcaaaaggtggcgcagtcgcaggcgacaaccttgttcttgttggggctgcagtcatccatgcacgcagatgaaccgaggtaggttcttcctgcactctgggtagagctccctgtagcatctgcagaacttcgacatggcaccaacttgatgcagttcatcacctgacagcaggctgatcatgcagcagagggccactgctgctgctctgttgccctccatcgatttgagtcctcttcctctctcagtcactctgataacttttgcagaagcagatgatgttaagttcagatcggtcacttgatcagcacaaggattttgcagaagagagatgataaaactaatgcagatggaatcaaatgtgtggacacctatgagcagcgcctaagaacacgagaggattatcaattgatgccatatccctactgttttatatatggtgtgagtgcttgactgcttgtgtttcttttattttggtgcatttttttgtacaagctttatgaattatatgagagcgatcagtatgcgacctgttttttttttgttcatttccatatgaaattgcttttctgtcccaattgtaccccggtcatataaaaaccccgaatcaaattagcattctgttttctttctacattaacccagaggatcgagatgagacatgcttaccagctagaggccttgtctacgaaaagaaagatgaagtgtactgcagcaatatgttgatctcaattagggtagcataaatgtataaatcgatcataccattgcaagtttttttggttttgtaaaccccaacagaatgttcaaagaacaatagaaaagaaaaggaagaggactgcaatgctgaggggcagacgggcagtgcgggcgatggaacaaaagaatttttttgaatgggccgtatataggccactcatcttcacgtattagtattgggctataaatgggccgacagacaagatgctcataaaatcctccaaaaagagctcagctcttaaataaaaattaaaagagtaaatatcataaaataacatatattatggtacaataagttgcacaaaatcatatagattttgtatagtgacatataacca

SEQ ID NO: 85639 - DNA, 728 bp, Oryza sativa
ttagagttggttgcacttgtgtgcctggggttgagacttcattacgagataaattagaagcgttgctgtccaggattcctccaaagttcatgtgttgcttccttccttccttcataacactgctactacttaatttctgtttgcgtactaatatgggttgttcatatgttggtgatggaatcacagttagcttgtacaaatcttatggaatctgtcggtcccctgattaacttacgccgcgatcgaattcatttagaattgttacccttacacgttgacctgtccacttttcacccttgtgattcaccttctggatcgaacactaaattagagttggttactcttgtgtgcctgggttgagacttcattaaagtagatgctgttcgatatttctccctatatctgagggattatcggcaattcgggattatgattctagtgaaaaaaaaagattgctactggtattcatgctgttctctcattatgcagcacggacaaggagttgcataagcgacaagacatgctttcaaatctgaaatctagagcaaagcagatggctacaagtttcaacatgtcaaactttgcaaacaggtctgttcttgttctcagatatcaacctggtagcctgatacagttatttgccttgttctctcgaaataaagataactggttgatgctttgacatgttgcaatttgttcagaagcatattaatggaaatctttgtttg

SEQ ID NO: 85640 - DNA, 707 bp, Oryza sativa
tattattttattctcttctcttgtttcttgtactagcatatgctactattgttagggccccattgatttataggaaaaatataggaattttggaggattttaaccctatgaaaaaaaaaatcctatgaaggcctttgaaacaaaggattaaatcatatccaatcctttaaagttcctatgaaatggggtaatcctatgcacattttagagaaaagttagcaagaggtctaacctcttggaacatttcctctgagtctatctctctcatctgattcctgcgtttttcctgtggtccaatcaaacggtcattcctgtgttttgcaatcctctgttttacaattgtatttttgtcagaatcctgtgtttttcctattcctattattttttcattcctacgattcaaaggagcccttaatttgttactgtaaaatttgtgctctacttactcttcttatttcatcagagggcatttacacaccggtaattgataattcagcattccaatttcgctatatttatcttcaaggaaaaaaatattcctgcgcttcaaacaagttcttacaagttacaagaaacagctaatgatcactgaagaatgagcactgctcaagatagaatcatgtaaggaacaaaccatgcacgcaatagaaggagagatattttttggtgctgctgattgatgatcttatctcacatcatgcgctggg

SEQ ID NO: 85641 - DNA, 725 bp, Oryza sativa
aagttggataaagcaaatatcttgagtgatgcagctcgtctgttggcagaactcagaggcgaggcagaaaagcttaaagaatctaatgagaagctacgagaaacaatcaaggaccttaaggtattttgttctcacaattttttaccttctacccctggattagaatgcctgatgccctccacagtcatgtcctgtgtcctaaaatgatatatcgcatgcactgttcccaggaacagagttcaagcagacacaacaaagaaaacttttctaaagtgcgccgagtttgatttctgtgcaattgttggttggttcaccagataataattactaggttcactaccttcactaatggcaagtccggaattcattggtcagacctcccatgcatctacgagaagtcttgatctgaccaaacatgtatgttttatggctctattatttttcaggtggagaagaatgaactccgtgatgagaaagttactctgaaggcagagaaggagaggctggaacagcaagttaaagcattgagtgttgctcctacaggatttgttcctcatctccctcatccagctgcattccatcccgctgcattccctccatttataccaccttatcaagctctgggcaacaaaaatgctcctacgcccgcagcattccaagggatggcaatgtggcagtggtcgcctccaactgctgtggacacaactcaagatccaaagctttgg

SEQ ID NO: 85642 - DNA, 665 bp, Oryza sativa
tctaccaactagtggatcccccttagtatagctatagttgcacgcatggtctgaccaggcagccctggcttttgctgcttctcaatctctagccaaagcaagatcacttaagttctggtttaacctttatgcctggagactgggaagctgcttcaatttgaatgactagtcagaacttttgagttttggtggcactgaaagggagatgctgcatttttgctgtttcttcaggagatatttcaatgccataactcttaattaaagagtttatgttttttgtttttaatttacagacactacaagattgtgaagaaagttgtcaacagcaccaaagcaaggctggagatccattacctgttaatactacaaattgtatccagaagctccatgatgaatttgagacttcaatgtctgatgatcttcacacttcagtagcactggctgctatttctgagccattaaaagttatgaatgacttgctgcatactcgtaaggtaaatcgaatgaaaaccttgtggagatacagttagtgactttcagggatctatgatttgatctgctcgcacgccacaagtaaaatactaaaatcatacctaatgtttcaatctttctctgatatttgagcagggaaagaagcaggaaaaaccggctggaatcactttctg

SEQ ID NO: 85643 - DNA, 1331 bp, Oryza sativa
catattgaggagagggggagcagctgcttctcctattcttggtagatgcggcgtggagtggcgggggccatggatgacgtcggcaatgacggtggcggtcggtttggcatggagcgggggcaaggcggcagcgcgtggcgtcagcggcgcaagggctgatggcggcggcgaccgggtggcgagcgcgcgcgcgggaagggcgaccggcgaattcaaacggcggcggcgggaatcggcgccggggagaggagttcgacgagagagagagagagagaggaaggagacaagagaggcgctgcttctctcgctcggcgcgtgcagcgcacgtgcggggaggaggaggagcggccgagaggagaagatgggctggaaaagggaaaaacggcccaacgaccaagagggaggtgaaacggctgagggagggaggtgggctaagggggaaaacggcccacaatacccgagggaggtaaaatagacttttgtagagaagactgatttggagtggattcgaattggggttttggatttgaattcaaatttgacattcgaactcgatggtttagggaggaatcaagggagactcgaggagaagtcaagaaagagattcaaaacggaaacttggatatttttttttgtagtcggagcgaatgttcggcaaggattcaaaggaagggattgactttcggaatttgatttcggagacttgaattttggataggaaatcttgaggtggaggatttttgatttcgatgagagggaacaacgggattgaattgagatccatggcacgacttaaactcgcacacaaagaacaaaattttcgcaattaggattttaccgaattagtttttaacgtctcacgagaagcggagcgttacacgaggtggggtggcggtcactccttccccaaagactagtcggagaaggctgccccccgatgccacgtggccctcccccgaggggagtcaggcccgaggtggggtggcggaaactccttccccaaagactagtcggaggaggctgtcctcccgatgccacgtggccctcccccgaggggggtcgggcccgaggtggggcggcggccactccttcccagagactggatggaggaggctgccccccgataccacgtggccctcccccgaggggggtcgggctcaaggtagggcggcggccactccttcccaaagactagtcggaggaggctgccccccgatgccacgtggccctcccccgaggggagtcaggcccgagttaggacggcggccactccttcccaaagactagtcggaggaggctgcccccgatgccacgtgggcctccctcaaggg

SEQ ID NO: 85644 - DNA, 643 bp, Oryza sativa
caatttgtcatgtacgacttcagaaaatgtgactcttcgttagaccatccaacaagatattacttccaaacaaaaacatgctcatgacaaatacagttatttttgcacaagtcggaacaattgcttcaggtacaacctttcaagaagaaccaacacttgtaatcacatcattttttgcattcaacaagtcaaataattttgaggttccaagaacaggggtcaaaacagtaaagaatcaaattacttacaactcacaactcagactgagccattatgctacaaatatatactactagggggcttcctctaaaactgctgcactttctaaattcagaccaactgcttacaacagaaacgaccacggccatctaactaccaacgtgagtgggctagaacacccctttacgacaaagcattgagccattgacaccatgaccatcacaatcagatgcaaagatgatacggctaatgagtttggctcgaatcatcatccccaccagaaagcaaccagcgcaggtactcagatacattgtccaacgacgaagcgtcgccgtgcatggtcaccctcttgcgcgtaagagtttcgacagtcacagctttcctcttccgtccacctatcggacacgagagtaactgctcgtcc

SEQ ID NO: 85645 - DNA, 690 bp, Oryza sativa
caatgagcaggactgtaactactgatttcacccagcccttcattgaatctggcttggttatcttggctccagttaaaaaacatattgttaattcctgggcattcttgcagccattcactcttcagatgtggtgtgttactggattattctttcttgttgtgggtgcagttgtttgggttcttgaacatcgaataaatgacgaattccgtggctcaccgcgagaacaaataattactattttctggtatggagctgatttgaacattttgtatcatctgcccacttgtcaatcaatctacagatattaagatacaaaaaaaccttttttgcaatacattgcacatagctagcaccttaaaaatcctgtttctatatttctacacagccaagtcctccaatttgcatgtgtaaatgaggtattgatgagcaatgcacctaaaccttgttttacgtattctctgcatatgcagaatctattgcatatgatagtatgatgcattacttgcacattgcttgcttgatggtgtgcatctttgctaccaaatttgtgaccttaatctcaatttttatattctacaggttcagcttttcaaccttgttttttgcacacagtgagtaaaccaaccttctattatatgttttttggggcaaaagtaatatttcagtctgacacattgctttcatctctat

SEQ ID NO: 85646 - DNA, 1346 bp, Oryza sativa
tcggctgtgtggtactggtaacatatagtacgtatataaactcttttttttctctaaataaatactagtaaatttacggtcctcgatcgaataggtatagaaggtaaaaatttcttattgccgattcaagtggtggcgttgtaactcaatctcactactattttttttttctcccaagcgtagagcctataccatagttacaactggagtcatatattggccggtatactggtatagtacaaggtgtgcaggtgttcaggccaaaaaaaattaggaccacaagtctatcattcgtagtaattatctatacttaattagcatcaaattacaaggcttagtaaacagaagaaaaaaacaaaccataaagattacaaggcccatttacccaatcccattgatgggttgtgcttgatgattcgtttctaattatgggaaagcatgctttggttaaattatactacctctatattttaatttatgacaccgttgatttttttctaacgtttgaccattcgtcttattaaaaaaaggttatgtaattgtcatttattttattgtgacttaattcatcatcaaatgttctttaagcatgacatgaatattttcatatttgcacaaaaattttaaataaaatgaatagtcaaacattggtcaaaaaagtcaacaccgtcatccattaaaatacggagtaatatttaattttagagtctcattatgtgtttcgcagttggaccttcaatccctaggtacgatattagttataacctcagtatattctaaagctgaacatgcacacaagttatatcattacccaacaattattactgattttaaagcacatacaaacatacaatattatttacaaattagtgtataatctagattttaacatgcaaacgtatcaaagtcatcatcaccacatcattttcacatatttcaacatatatcgatataccatttctataatatttaacatatatttatctatatattttcatctagttttttttaatgtcatggaaccataaacgagtggataaaaaaagactcgaatattaggaaaggacctaatatcaaataattagaaatggtgaggctttgaacccagatcatatagcccaccaccttatggagttagccaaaagacccctgggtatttctcgttagacgagtggatgtctacattttttttctcaacgtagaattttttctaatttcatagaacgccgaacaaacaattaaaggctatgtagactcttctatcaaaaccccaccatcgtgatgcagttatagaacgttcgtaaccatgcatgcaagtgtacgtagcatcaaattaagccgtgcta

SEQ ID NO: 85647 - DNA, 2144 bp, Oryza sativa
tacgtggcgtcttgagatcacagttgcttatggctaccattgtacatgccctaaggccgtgtgtagttgcacagccaaaattcttttaagtatacgaacacacatttgaaatattaaatatagactaataataaaataaattacagattctgtttgtaaactgcttgacgaatttattaagcctaattaattcatcattaacaaatgtttacagtagcacacattgttaaattgtgcaattgattttttttatccacatttaatgctccatacatatgtctaaatatttaatatgataaaatttttagatgtttgaagggaactaaacacagtctaaacacagtctaagggggtgaaagagttgtatccatcacgatcgttccgacgccgcctgacgctgccacggtctggcccacctcgacgcagagcaccatcttgttggtcacctcggcaccactgcacgcaacacactgtagttgtggattgcctcagatcagtcgtgtgtgtcggggtacacaagcaggcggcgatggtctccatgcatctccgactcggaggaacggacaaaagagatagcagggagtccataacactcctcatccaaccagccggctgcagcatgatcagtcagtgaaagtggcaaatggttaagaaagaaatctctcctcaatagtaattttgtaggagcattggaaaaagtggtatttttgagagtgacgattccttagagcaggtataatagtagactataagttagctgtaaatatattttaaaaagataaatgagaagagcgaagagcagtgggatacagatttgtagccagctgtagcacggatttcaagacgcggtgtgtgtatgataggtgggaccagatattaatagtgtacagtatgtaactattatatgaatgaactattagatcgactatatatgaattggagttagtagttggctatactattaaacttgctcttagggtgtgtttgaataatgggaaacgggggtgggattgggattaggattggaaaattaatgaatggttaaaattaaatgaaagagagagaatgaatggttaagatttaaagatgtatttttgtaggtgagaaattatttccagtgtcaaatagttcaatttccccacgttggcggattaggatttttctgatgggtgtgcccaccaccttgactatattatcaaattgaaagactttggctatatataccaaatcaagactttgaccatatcaaattcaatgcacgtaggcacgccttgtactctacatagacaaatcaaacacttcaatttgatatggtcaaagtcttaattaaataatcagaaatgtatccagagatagaggtcaagaataacacatcaccaattgcaacttttttctacttaatttctcagttactctttgtctctattctgtagtttaccccatcaccatcatcaatgtgatgccttgctaagtgaagtagaatctgattctgatccgttatttggtgccttgctatagacagaaagtgtttctccttatatttgaatttgattcgatcgattcaatatttcttataagttcgaactctgattggtttcacctcttacatggatggctggatccgcacagctaacgcctgaagctggaccctgtatggctggcatgttgcctgctgatgcgatcgatcagtgcatccttgctgttggccggcctgttgctgttgtcgccggctcgccacaatgccgccgaacccggccagtccccacggcgctagtggctgtcgcctgttgggctgccggcgcatcatcggattgcgaacctctgatttacttgggcccccttgaaagataggattgtcaaaacatagaaatagaaaaaatgtagaaatagaatatcatatttattgaaattcctacgggatataaaaacacaataaagtttcaaaactaccgttcgatagtcacacagaaaagacataggaattcaagacacgggaaaaaaacataaggtaagacatcatgctaatttttctccaaaattccactacaatagtctattccataggaattttaaaggaatggtaggaatcaatcctttatttcaagagtaattttatggtctttgaggaggtatcatgaggtacc

SEQ ID NO: 85648 - DNA, 5190 bp, Oryza sativa
tgcgcgcaggccgcctacggcgccatcttcggcgtcatccccttcgtctcccgccgctcgctcggcatcatctccggcatgaccggcgccggcggcaacttcggcgccgggctcacgcagctgctcttcttcacgtcgtcgaggtactccacgggcacggggctggagtacatgggcatcatgatcatggcgtgcacgctgccggtggtgctcgtccatttcccgcagtggggctccatgttcctcccgcccaacgccggcgccgaggaggagcactactacggctccgagtggagcgaacaggagaagagcaagggcctccacggtgcaagtctcaagttcgccgagaactcccgctccgagcgtggccgccgcaacgtcatcaacgccgccgccgccgccgccacgccgcccaacaactcgccggagcacgcctaattaagaggccaagttaattaattatgcatgcatgtataaactgttgaacgttttgttaccgttttctttatactatctagagtatgtcgtcatggagaaaggcctttgtattacttgcttcgaaaagcgtttaaatgaaaagaaaaaagttaagaaatttttgtgataaaccaacaaaactacccccaaagtttgcaccattgcgttgattttttttcttaaaaaaaaatggaggcaaaagctttgctttgactataccattgcgttcagttattacagatcttatttgaaagtagaattgcatacgagggagactacgtaacaatataccattgcaacagaataattaccgtcaatatggtaccatatgtaccatttatggtatcttcggtatcagatatgacaccccgtatgtatcagatccggtacataggtactatgtacatgacataaaagcaagcgtggtgcatcttttagctctgtgttttataaataaaaccacatttgtacacatcttcagtggttaattaatctctacccatttataatctggatccaccattgaccattgtaacataaatcggcaacaaccaaagccaagagaaagaaccatgatggcctcatggccagatcactgttggggggtgactataccgaatggttatttaggaggtgtctaggattattagctgttcagccagggttatcttttcagtaagagcatctccaacagatgtacaaaattcgaaccccaaaaatcctctattggggatagccaaaaaagaatttggcctaaaatacaccccccttcaagaggtgtcccaaaatgttaaaatttgccacataatcatttgtgggtccttctcaactaattttacagcaaccagtgattgatcgagtcgtctccgtagtgttgctgcatgcgtgcaacaaagacagaagattactgcagcaggatgagggaattacccaagtactgaatagacacaattctgaatataaatagtttgtattgcacagacgtagtaaaccacctaatctagacacaacagacacaattctgaatataaatagtttgcattgcacagacttaataaacctaggtaaatttctaacgaatcttcactaatctgaactccaagtacgattgccaccaaatattgccatctccttccctcccactctctgatctggtggtttccctgttgatagtaatgagatggagttaaaatgaatcagaatacatgtacagattatacagctgccaatttttccaatatattgtaattaataatgtgaacaattctggacatctatgaacatttctgatataatctaaacaaatatttctgaacatttctgaattgccagctagcacaacattctgaaggtttctaaaataaatctgaacaaatacagtagtctttgatgctagaaatctacatccagatcaactcaatcgaaggtaatacagctgaaaatgcaatgcagtatgttaaatcttttggcctcaaagaccaaaattcagaccaagatttggcagtgcatcatgcagcatatttaaaaatatatgcagccccatgtatcagtggatcgaatcagatggtgtagtgcagctgtgcaaaggcagcatttcaacaagatggagacaagaacaagtatatgcatggacaggggcactcaactgaatgtaaactgttatgagacacaaacctatcaaccggaactgttcatgcgacgagcgatgatctcattttgtaaactcttgtagaactgctgctgttagagaggcttggaagaaatgtccagttgaaaaatctaacatagtagagatttggactgaggaagtgtacctggacgtagaagaggaggcaccttggaaggggaagacggtggccggcgctgccctcaatggaggaccagcgacgccctagatgcagggtcgccacgcaccagaagaggggctgccggcgcgctggatgaagggccgccgcccaccggtacgagggccgccggcgctgtggatggaggattggaggcggcctgtggaaacctcggaggtgaactgcggcggcgtgcgcctagctcgagaaagaaacggcgcgagagaagggtagaaaagaaccgggcacctggcggaagaaaaaaaagacgcgggtgtgaaaaaagtggcgcgagatgttgattgggagggcgtatatgttcccaaaatctaggggtttggcactggttttaggcgtgggtaaattttgggatcttgattaggaatctgttggagggctgttttttatgaaaatcctaaaatttaatttttaggaacctttttagccctctcttggagatgccctaatgaaagtggaactatcaaaaggtgtcaactgtcaaccagaagaagcaatattatttgaaaggaaaaaaaaaacagctaaatacttggcaacttagcaacaatttgtgcatgtccaaagttcatggaagtgcattagacaaacatgaaggacagctcaggtacttgttggaccttattaatgtccacaacaaatggcttatctcaccatcttcaaatttataatcgagtaagattatgacatgaaatgtgcacatctttggaaatggtctactgatccaatgtcaacttagaaaacaatatattagatgcacctgtatagttgtgtgtgtgaacttaattggtattgtgattttttgaggtttgctcaaagaaggaagcaaagggtgtccttcctctcaaaaaagaaagaaagaaaaaggtggcaagagtcagattaggcaaactcccaagtgccaagtgtgaactgacagaaaaggggagaaatttggacttttagcaaaatttataaattcaaaattcggttggaactttcaaacaaaatatttgatcaaattttaaatttgaaaaaaataatgtgcaaatctaacctaaattttaagagatgagctttaaccaattatggaatatgacgtgtccagcaaccctccgccatctctcatgcttgtttgcaaatcgagatgccatcgcccccttgcaccatgagatgttagagcaggtacaacagcagactataagccatctataaacacatatcgagaagataaaatatgagagagaagagcagtggggtacagatttgtagccagctgtagcacggactccacgacacaatgtgtgtatgatagatgggaccatgtaagtatatgtttataggtaactattatatgaattggctattaagttgactatagatgatttggagctactagttggttatactattaaacttgctcttaaggagccatcgtatcattttcaacctaacagaatactccctccatcccaaaatataacaacttttagcccttaggatttgtcccaaaatataacttctctaccaacattctctttccaaccaatcacaaccctctactattcacttttcccacctacctccactactcgtccaatcacaatcttccaacattcacttgtacctactttcttaataaccatatccaacttgtcggagaatgaactcctccaccagggaaccgtgaggcccccctttgtgagttcggccgggggcagcgggtgagattcgagggcttggtgagcgaagctgtgtaatcttgaggaggttcaatcccccaaagacgatgaaacaaaaggggtttatacatgttcgggccgctaagaagcgtaataccctactcttgtgcttgattgattgagtagagaacaccagtgtttggggttgcgagacccaagagccagttcgctcggaagtcccccccctctccaccactaggcctggacctccttttatacctcaagaggttaccacatgggcccaacaacctaacctagctccggtggagaagtattataatctttgcattaaatgcatgtcttgtctcttgacttgggaagccaagcgcatgtcatcttgatgatggggcctgtcaaatcttgccgcctgacatggggggtgcccctgttagtcaccatttaatgggtgaagacttctgggctcctattacaccgggaaacgggagccttgctttgaccagagcgagaggaccgactccggctgggataagaggatgataacctgtcaccatcattatttgatgggatatgtcgggttgcacgtcgcctgacacacgcgatggtgcgcctgacatcctgggtcccatcagtcattcgaccggtcacagaccggttgagtgcactgcacaccacattaaatgcggcgtggcgcgaccgctcgggtcgctataaatgcgggtaggtgggcacctggaggtggatacctaacccaccgtacgtggtgacctagagagggggttgggggagcccgacccctagttacgggaggggacggccgccgcccgacctcgggcccgatcccccctcggggggagccacgtggcgcctggggcggccttctccctctagtctcggccagggagtggccgccgccctttctcgggcccgacccccctcgggggagggccacgtggcattggagggcagcctcctccatccagtctctgggaaggagtggccgccaccccacctcgggcctaactccccttgagggagggccacgtggcatcgggggcagcctcctccgactagtctttgggaaggagtggccgccgtcctaactcgggcctgactcccctcgggggagggccacgtggcatcggggggcagctcctccgactagtctttgg

SEQ ID NO: 85649 - DNA, 744 bp, Oryza sativa
tctcttgaagtttttagttggtcttgatatacacttcacttctgcattagtccatatggacagttcatttttctttccttaggaatatttgctaattgcaaacactccagttttcaggttaacttgagtgttgcaattataccaatgtcacaccagtatggttggaactcatcgactgctggattagtccaatcgtcattcttttggggttatgctttgagtcaactgccaggtggatggctagcaaaattgtttggcggaaggtttgtttgcggtaacaaaaccccccttgtgcatagacaaatacaaaagctacctatgattctccatctgcatgggtgttttaatatcttagcaatgcttttttttggtggttgctgttgcttccgggataagcatgtttccaataataaatgcaaatgatgataatggctatttctttctgcaacccatcttgttaggaattaggatatcttacggatttttttgtgtacctttatgggaaagaatgatccgttaagttggtagtaagcaaaattgcaaatagcagtacgaggtcataattttttttggatggtacatatcttcatttattttacccttttccttactcccaattgtttattttaactataaatttgagtaaattcctagttacaatgatttaatagcagcagtaatcaattcaaataaactagaagaaccatatagcaattttaaacttcaggagaaatcattctgcct

SEQ ID NO: 85650 - DNA, 2306 bp, Oryza sativa
gtagcccaactcgatagcaaggccctgaacttgatttcttgttggagatcgaacaaaaccaatgcagccctgctcaaaaactcggcttgatctggataaatttccatcttccaatcgagtttttatttaaccgaatccactaaacaaaagtaccaaattttggtgttatcagtaccttaaagcgataagatgacctcaaacagcatgaggtatgtgggcgatggcaatcagtagcggcaatcaactcagtcgagccctgttccctgcagcgcgtagactaggggtggatagtgagccagctcggctcggctccgctcggctcgctcagctcgtcatcctaacgagctagaaacctagctcggcttggctcgtttgaaagctcgagctagctagttaggcttgcgagccaaaccaacaagcagctggtagaggaggaggaggggaccttcttgccgactggggaagtgcgacggcggcagcggcggctggggaagtgcagcggctgtggcggcctagcggttggcgcggcggcggcagctggggaagtgcggcggtggcggctggggaagtgcagcagctgtggcggccctagcggttggcggcggcggcggcagctggggaagtgcggcggtggcggcagctggggaagtgcggcggcggcggcggccctagcggctggcggtggcgcactggcgaactaaattttgtataaaatttatggtccttactctacagcagaactttacaacttcaaccgtaaaactacagacaatacttctaaacaaaaagtcccatccgagacgtcggatgccaccacaccctatgtactttttctacactgtacaaaacgacacagagatgttttttctccacacatgctccctatcatctctcacatgcatgcactagtgtctctcacaaactctttctttccaaactctcttaagcatgcatgtctggttctattaacaaatataaaatatttttctcataaattacatatttaatctatgatccgatggcaccattttattaattataattaaatatttataacaagatatcacttgattatatttatatcctgagaaaagaaaaatagaggcatttctctatcaagggtcaaaatggtgaaacaaaaatggaggcattaaatttcaaccgttaaaatttaatgtttctacttgatagagaaatgtctcaacaagtatttcatggtgtttcacaaattatttaattgtttcaatgactacttttttatgtttcaccaagtgcatcttgatgtttcataggtagtctactgaaacatttggctgcctcattttttcaatagatttttttaaatgttgtacattgtgttatttagatgtttcaataagtatttttccttatgtttgtaaaatgttgcatgttatattcttttaatgtttcaacagttaaaattcaatgtttcatatataatacaaacatgtttcaattcaaaatataattgtttgttattcataatataatcatgtaagatcttgcttgaatatttaattaattgtagtaaatataacaatgtaatatatctcaaattgaaaaggtaatttaggaaaaaagtttaaagattgttaactaagttacttagggaagagaagagaaataagtgagtgtgcaaagagagcgtgtatgtaaaagtgggggtatgtgggccctacatataacatgcatgtatagagctaaaggagaaagctagaggctacaaaagcacagaagtgggcgttcgatttttcgagtttcatcggacgtcttacacatgggtagcccataaaactacttataatcttatattaattgtcataatactttagagaatcgtccccttactcccctccaacaacaaaagaaccgttccctctagttaaagaaaaaaaatcacttcctcctttaaaaaacgctcaaaaaaaatccaaccaattataaaaaccgacatagaaagaaactaaatcatatttgtatcatctggtaccgttgcaatgcacaggtatgtaactagttaaatataaaaacttgaataattttatttagcttttctcttgtaaaattgatgtacagtgttgtctgaagttaatcacaaagctagcaaaactagtacaggattgttgaccatggaaaaaaatcgcacttgtcattattaagagaggacacaatggaaataagagacagttcgctcaccacgactcggcacctccctgcccccgctctcccattatacatactcggtatacatgtaagaggcatcaaatgcaatacactacacagga

SEQ ID NO: 85651 - DNA, 1560 bp, Oryza sativa
atcatcatttcatgggtactcgtattatggcacccacctatattattcaaatattttaatatttgataaaataggttaataataacttttattttatttgattttaatatcttgtgcataattatttgtaggattaaatatattctcgtaaatcatatctattgcttaaatgtagttcttttctttactttcttagtgatcatttatggtttggcaagcaacaggaatcataacaaccagcatgatgcaaaagttttaaaaagttcgaaattttagtgatttttattgttgggaattttcaggatgttacataggtccaagtttgcgcttcttcgttattggtacattgactttcgccaagcacccccatgtgcgcaaataagaaagtgatggttttctaccaatccatatctcataggtgttttgtcctatttctgttaggaactctgtttaacacatgatttgaggtcaacaatgcctccccccaccatgccttaggcagtcccgcggtgtccaacatggcattcaccacgtcactcagtgtgcggttcttcctttcagcaatcccattagactcgggagaatagggcggcgtcctctcatgtatgatgccatgttcctcacagaataagtcaaactcgttcgagaaaaactctccaccacgatcagacctaagcctttttatctttctgtcaagttgattttcaacttctgccttataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcctcggcagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctgttgatagaagggacatgctgcacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgccctgcaggtgccttca

SEQ ID NO: 85652 - DNA, 1457 bp, Oryza sativa
ggtggtgtgaccaaccacccgtataggcgaagacactagttgcgcgcggatgagggcaagccggtggtgatgttctgactgatccattcctggagcgtaggagataagcttaaagccatgaatcccttttatgcatatctggatctggatcctaaagaacaaacatataggatgagtagtatctgatataaatataatactcgaggaaaatttaagtattttaaaatatttataaatatgtatttctcctcttgtcaattttgatttctccgagcagatgactccttacgtttaaacactctgcctaactagtcatagtccccaagcattgggagtcggcttaggcacttcccaaacatgcatatgagggacatgagttcgtcattaatggaacaaagtttcacggatcagagtttactactcgggtacttttacaattattaagagcagaaaataaattatttatctctatgcttgatttattccgagtaatacttagcaccttgcgttactcggtccatccaacgagcccccggtgctaggaatcggctcaatggcaactatccattggcaaaccaaacggaaatcataggaagatggaactccataactcgataggcacttttgtactcagattatgtcgcgagcaatcaagataaatagtatgaaaattgttgaaaaaatatgatataacatctgtagccaccgactcactagtcaacggcaaaccagttgatgtagtgaggcagagaaaaaagaaaatatcatataaagaaaatttaatgatgacttagctttgtaatattccccttggtgatggcagaggtggccaatgtgggaacaaagtcgtccatcaataacaataaagacaccagttggcggcggcgggagcaagccggtggtgtagatgacgaggtccatcaatggcggcggagtccacaaccgtataggcgaggacaccagtcggcggcgacggaggcaggccggcagtgaagtcgaagacgcccaacaacgacggggtaataggccaaccgtgtaggcgaggacaccagtcggcggcaacggaggcaggccggcgatgaagtcgtagacgcccaacaacagcggcataataagccaccgtgtaggcggagacatcagtcggcagcggcgaaggcaagtcggtcggtgaagccatggacgcccatgaacggtgatgtgaccaaccaaccgtataggcgaggacaccagtcggcggcgacagaggcagaccggtcggtgaagacgtagacacccaacaacgacggcataataaaccagccgtgcaggcggagacaccagtcggcggtggcgaaagcgagccggcggtgaagacgtggacgcccatgaacggtggtgtgaccaaccaaccgtataggcgaggacaccagtcggcggcgacagaggcaggccggtcgatgaagacgtggacgcccatg

SEQ ID NO: 85653 - DNA, 722 bp, Oryza sativa
tcctgcagccccaagtcgatgaagacgtagacgcgcatcaacggtgatggcaaaatccaccaatcatgaagatgaagaaaatagtcggcgacggcaaacgcatccgacggtaatgatgattagcggcaacaaagatagccggctatggtgacgaagttgcccatcaacggcagcagtgtaggtatgttgaagaggcttgacaggatgttgatgaagatgacgatgccggcgatccaatcaatagcggtgtagcagccgatgataatgacgaagacgctcatcagcgtttgcgtagtaggtaacccgtgaaggtgaaataataagtcggcgaagacataatcagccattagcaatagcggagatgtcagggccgatgaagcagagatgctagtgatgatgtcagtgacaataatccatcaaactattgagaagatatcaaagctcgagtagtttccttgatgcgagcgtgtgcataacgaagactgatgcaacgccccttgatttataaagatgccagtagaacttggtcttgtagctgttgcagatgcttcacttggaggaaagtatatgctgttgtccaactcaacaaaactgagctgattggttgataactctaaactcccggacatgtagattaaatctcaaacttgatagttgaaaattttagagtaaattgtggcagcgtctagaaatccaaatgccggtgtataattggagtcgct

SEQ ID NO: 85654 - DNA, 659 bp, Oryza sativa
ggggaatgggcccgtagattcagagtgtaccgatccagattctgataagggtaagcgcgggaagattccttcaatggtgatgtggtacctaccaattaaggaccgcctgaagcgtctgtactcaaacccgactgatgctgagttgatgagatggcatcaagagagctggaaaatagatggtatgattcgacatcccgccgacgctcgccagtggaagacatttgatgcaaaacacccagaatttgctaaggatcctaggaatgtaaggtttgcgttgagcactgatggaatgaacccgtttggtgacttaagcagctcgcacagcacatggccagtccttctcacaatgtataatcttccaacatggatatgtcagaaacgaaagtacattctactcactatcctcatacaaggtccaaaccaacctggaatcgacatagatgttttccttgagcctttgatggaggacatggaggagctttggaaagaggggttacgactatgggatgagtttaagcgggagcacttcaatctacgtgcgatcatattcgttaccatcaatgacctacctgcaaacttttcattatctgggcagattaaagggaagactggatgtctgatatgtctggagaaaacttcatacaaatacctgacgtcgt

SEQ ID NO: 85655 - DNA, 1094 bp, Oryza sativa
  unsure (1)..(1094): unsure at all n locations
agaatagcagcagcacaatgcacaagcatcttttctctgtatacattgcacttcaatcccattgtgctctgtgactctgtcctcaactccacantctgcaaaaagggcnntttggtgncatctgnngcactnntccatgcaagnaacttactctaggcttctcttgtttacttttttatcttggacagatcagctgaattctgtttgtgaggagcctcataaaaaaaataccacttcaatttggaaagctttatgaggagattaattaattaactaaaattgctatggatgacaaaggagataactgaatcagcagtggcatgaaaaaaattgctggtcagagccaagctgcagctgctgcagggtttgtatagtgttcttgtattgtacagggttgagggttccaactccctttactagcactagttattattacatgatggaacatgtcatcatctcatctctgctctcttatacttaattaattaactctcttcattaattaatcactcgattaagctataaactctctgggtgaagcagcagcatccatccaagaaaattaagaagaaatgaaacttaattttccagggttaatcattaattgacccttcttgttcttgtcttggatggatcagcagctctagctagatggatacttggatagctgacgccgccggcgatggcgatggcgacggcgagcttcaccttggcttgaggcggtccaaggcgaggtaggcgatgacgcggtagccgacgaggaggagcgccatgacgcagacgtcgacccagtggttgttgagcccgacggccttgatggccgggaagtcggcgacgaggcagcgcgcgccgccgccgccgcagtcgtagtgggcggcgccgtcgccgaactggatgccgatgaggaggcggtagcagtagaagctgtagttgagccaccggagccagccgacgaagggcgggatgtgctggacgtagtagccgccggcgatgaggaagaccatggtgatgacggaggcgagggtggtgccctgcttgacgtccatgagcacggcgccaatggcgagcccgaagctctgggcgaccaggacgct

SEQ ID NO: 85656 - DNA, 767 bp, Oryza sativa
acttattcggcacaactgagtttggctataaaccaaataaacccttaatctcatgatgcaacacatgcacatgtgggtatttttagaacaaggctaataatacaaccaatctgttggctataagattccttgtagtcttttcttagcctacccatataatagttagctctttacaattaatacatgacccacttatctctctcacttaatttcttagttcttgtatccaagacggctgtaagtttacaggccgcttctcctctctctcctctcttctcttctccacctcagcatttagctggcttatagcctactattatatatttgctcttagtggtaaagtgcgtacgctagtacagaaagtgcaataggtgcactatacgtataggcgtaagtacacgtggtgtgcttaggcgtaagtatatatgatgtatgtgcgtcctatctatactcacagagatgtgcacggccaactaatctgtactcacatttccaccaagattaatgggaacttttactaaccatagatagtgcctaaatacactccttcctagtccaccctgagaaatttattatcacttccaaaaagtattaatatctgtgaaagtacgtgtaacctagtggttacattaggtcctaggttcgactactcatgagagcaaattttccaggatttaacggctttgtgtttttagtggtagatgacgtacctgtcgacagcagacacctatggtgacgtgtgcgtgcgttatgaattttttaggatt

SEQ ID NO: 85657 - DNA, 740 bp, Oryza sativa
tgatgatttgtttgatcagcttaaaggtgccactgttttctccaagatagatcttcgatcagggtatcaccagttgagaatcaaagaggaagatatacctaagacagcttttaccactaggtatgggttgttcgaatgtactgttatgtcttttggacttaccaatgcccctgctttcttcatgaacttgatgaataaggtgtttatggaatacctagacaagttcgtggcggtctttattgatgatattcttatctactctcgaaccaaagaagagcatgaggaacatcttcgccttgcattggagaagctacgagaacatcaactgtatgctaagtttagcaagtgtgaattttggttgtctgaagtgaaattccttggtcacgtcatctcagccggaggagttgccgtcgatcctagtaacgtggaatccgtaaccaattggaagcaaccaaagacagtttcagagattcgcagtttcctaggcctcgcaggatattaccggaggtttatagagaatttttccaagattgctaagcccatgacacgactgcttcagaaagatgtgaagtacaagtggtcggaagaatgtgagcagagttttcaagagttgaagaatcgcttagtatcagctcctattttgactttgcctgatccaaagaagggtttccaagtgtattgcgatgcatccaaacttgggttaggttgtgttctgatgcaagatgggaaggtggttgcct

SEQ ID NO: 85658 - DNA, 583 bp, Oryza sativa
gcatcgagggaaatgggcttgatacccacctaaggttgcataatagtggaaacctgtccattatgatcggagatcccgtgaatttggatggtgaaacaaactattgtgtgactgaagagacccttgaaaagggctcattttcatgatgtgcttctcttctttcctgcatggtaggatggcttatgtcttaatgtgatccgagtggcttttccaagcagagatgttgacctgcagaacatcttagaaggaacacacctatatgagttcgactgctagtcacagtctatgagatttgggtgatctctagatactcatgaaaggcctggagtatgacttataagctccaacccgagggaatactaatggttgcctagtatcagttatggaattgagtgaaacctaactgcacaagactgacaattcaaggtatagtccattgttcagttgtggtcaggtgtagctccttttctaggtgaaagttcaacttaacagtcttcaccgaaacactggtatataaaagctgctatggaatagagagcattctcatgagccttgaaatttggtggggattgttagatttaat

SEQ ID NO: 85659 - DNA, 861 bp, Oryza sativa
gtactgcgtcgcctttcaagaagcactcaattttctttaaatacttagattactggaaggacctagagattcgacatgcaattgatgttatgcacctcgagaagaacgtgtttgatagcaccgttggcacattgctggacatcccgagtaaaacgaaggatggattgaagtcacgtaacgaccttgtagatttgtccatacggcatgaccttcacccagtactgctgccaaatgggaagaccgagattcctcctgcttgttactcgttgacacttgatgagaaaaaagccttctgtaaatgtttacaaggggttagagtgcctactggtttcgcatcgaacatcaggaagctagtatcaatgaaggatttgtccatttcgggatacaatgcgcatgactgtcataggttgctaacggtgttcctaccaattgctataagggcagtcaaaccagtccatacaaaggtggttataacaaagttgtgctactttttcaatcgaatttcgcagaaagtatttgatcctttggaattaggtccgcttcagacatttgccgtcgagactgtatgccagcttgagatgtatttcccaccatcatttttagatatgatggagcatttgatcgttcacatcgtccctcagattattgaacttggtccattatacttacatcagatgtgggcctatgagcgttacatgtcgatcctcaaaggctatgtacgcaatcgcgctcacccggaaggatcaatgatagagggatacacaactgaagaggcagtcgagtgttgtatggactacataaaggatgctaatgccattggaattcctgttcatcgacatgaaggtagattgtctagaaggg

SEQ ID NO: 85660 - DNA, 1560 bp, Oryza sativa
agtctctgcgtgaacccttgtgctacaagcctcgccttatatctcaccacctcattgttctcattccgtttccggatgaaaacccatttgaaacccacggggaaggtttttggaggtgtaggtattacttgtgagaatacctctcttttattgagggaggctaactctgcttcaattgcttccttccatttgttccagtccgagcgcttcttgcactctactatggattttggatctggatcattttggatggtatctgcaactgatgatgcaaagtatatgtggacaattgtagtcttacggttgaatgattctccagattcaacatagtttacggaaatttcatgcaccccagttgacggctcagtatttcccaatatgaccgcgtcggggcgttccaatgtcccatcattataaatttagtgcactgttgatgtgggaagtggatctgatgaatccacttggtgtctctcaacttgaggttgagtttcatttactgtgtcagaggattctttcctatgtttcctcgtgcgctttcgaggatttgccgtacttctcccactctcttttgaggaagggaattgaatagttttatttggtacctctattctttccggcacattccttgcgggaatgtatgattttgtgacacttttactcaagtaaatgagactggcaaattgtttgcagctacctgcaaatcaatgatccttttaacctgaagttcagattctgtggtacgaggatcttcctttagggtgtctaaggcatcccaatttatttctgggcattcaatgtgatacttgaattctccccctaatgccggaaaatgttcttcattgaagatacaatcagcgtaccgggccgtgagtaaatcccctgtaaggggctccaggtatctaataatcgacggggataaatatcccacgtagatccccattttcctatgagggcccatagatgtacgctttggtggtgagatcagtacgtatacagcgcaaccgaatttccgcagatgggaaatattaggaggatcaccacgaaccaattgcaacgggaaagttgtatggtatgcagttgggcgcaattgtattaagtcaccagcgtgtaacactgcgtgaccccaacatgaggttggtaagttacaattttgcaataatggtctggcaatgagttttattctcttgataagagatttggctaaaccattctgagtgtgaacatacggtacggaatgttggacttcaattcctaaagccatacaataatcattgaaagctttggaagaaaattctgcagcgttgtctaatttgattgattttatatggtgttcaggttgatttgctctaagtctgatgacttgtgcaatcaattttgcaaaggcatggttccgtgtcgataagagacacacatgggaccatcttgtggatgcgtctattagaaccatgaaatacctgaatggtccagacaatggttgaatagggccacaaatgtctccttgaatgcgttcaagaaactttagtggctcagcctttattttgagatatgagggtctcaaaa

SEQ ID NO: 85661 - DNA, 2787 bp, Oryza sativa
tgtttgtgttgggccttggctcgtttggctcgcgagctggctcgttatagctaacgagataaaatcctggctcgacttgttaacaaatccaaacgaaccgaaccatgcacgagtcgagtgagctaaggagtgatgagcttttcgtccagccctatctcattgtgaatgatttgataagcttcttgatgcaattattggctattgttccctaattatttatttgcaaatcagtgatcacaaatcctgcatgtttataaggagatgtcgaatctatattatatcggcaagttagcattccaggttgaacatttaaatggcttacaaaatataagcacctagcaaatgagctgaatatttgattgaattttatcaacattgagtacgtaaatatcaccatatctcacatgcgaccgtaccttaaactacaaaaacggggacaggaatgaaggacataagctcttcttttcccgcttagaacagaagaatatctcctaaaaaacttaaaagatgcccttattttgatccattgcatagcacagaaaaggttttctgagaatcgtcgattgcttgcatcttcttcctccaataatcatcgctccaaatgcttcagcaaacaatgattcagaagcaaatgtgtaatgctgccgcaaacaaggcttttcgaatactgacacctgcatggtgaataaacaggagataagggaacatgaaagctatgggcaaaagctgagcttccagttcttaccaattcaggattcaacatctattgtaatgtactgtcataaaatccattcctgcgatccagaaccagaagctggatacgagcacattagttgacagaaacaacatgccagtgcggtaatctgttcctgtcttccggatgtctgatgacccttatcttacctgtaccctgttataatttgactgaggttgcggtcaacagggacagttgggccaagtatgatctttttttcattattgatgctatttttcctggtaatggcaagtatgatcttttggccaagttaaatgtagagactgatgtcgcagttacaacttgcaaactttgcaggaaataacttcttgaaattattcctgaaaaacataaaggcatcataacgatgaaaacctcaaggagattctatttcaccacctatattttttttttgcataatttatttcactatcatattccatgaacacatgttttgtaatagaattcttgtgagaaggagaaaagccatcagaaaacaggtgattacatttagtgtggatttgaaatgaaaaaattccatcctaattacaatatgcagtaacaatcagtgttatatgcgtttgaagctcatgaatttatcaacttaacaaagctattttcctacttgcccaaaagcaactattaaagatattcatcagcatttcaaaagaacgtttctatgtgcatggaaaattagcatcaattatggaaggcgcacacattacatagctaacagaaagatttacgtgttgaacaaagggtgatgataacaaaccaattacggaattcctgatcaatgctcaaagtttcgggggaaccttgtataaatttgttaagctgcccaaacaagagacagcagactccagcattctctgcaactataagaagttagaaagatggagatggagagatggagatggaaaactatggaaactttagctacccaccttgtcaaattttactagtcaagctttgaatatttgaatgtttttttgacgcaaggaatatttgaatgttgatttatgaactgaatgaattaatcgaaatcagtgaaatcaagagaatggacttaagaagcctgaacccaactactcccaggcattttgtttaagcctctttctgccattatctttcttagcctcttaactttctcccatttgtttgcttctgaatatatgttacccaaaagaatataatatccactctctcctggctcaagttcaaagcacttggaagcaacaatttccccaagctcaacattgttgtgcaacctgcaagcaagaagtagagcaccccaaatgctagcatctggcttcattggcatctgcatgatcagttgatatgcttcatccaattttccactacgtccaagaagatctaccatgatggtgtagtgttccattgaagggctaatcttatatttttctgtcatggaagcaaagcaagcacgggcttcttccattagcccggcattactataagcagacaacaaccccacaaaggtcactgcattgggactaatctttgcatcggacatctccttgaacaaactaacagcttcattgaacttgccattcatcccacagcccacgataatcgcactgtaagacaccacatctcgcatccccaaacctctgaacagatcaaaagctctgtcgatccgcccactcttggtatgcaaatccaccagagcggtgcgcaaatgatcatccagctcaatccccacagaccccatgaaactctcagcccacaagccaaacctcaagtctccaagctgcgagcaagccgagatgactgacgagaaggtcttctcattgggcatcacccacacatgaggcttcaacatacgattgaaaacagcaagagcctcccttgcacagccattctttgcgtagcaggcgatcatcgcgttccacgcgtaaagatctttcttgttctccatccgctcgaataattcgccggcagcgtgaacatcgccggagttggcgtagccggatatcatcgtgatccacgagacgttgctcctcacgggc

SEQ ID NO: 85662 - DNA, 936 bp, Oryza sativa
aaggggctgaagaacgaaatggctgaagtcaagaagctgcttaaggtgatgtgtgctagcttgggtgaaggagatcctgaaaagaggccagaaacgggagaagcttcaaaaagggtaagtggagctcctcatgatgtgaatgccactactgctttggctgatataattgatggttctggtccaatgcttactggtactgctcctatcatgagtcaagggggaggatttttcattgagccaaatgttactcagcctagaatgtccaactgcatggcctcgatgccttttgtagctggaagtaatggaacagggcaagtctttccacaacacataccccacaacacatacccacctattccaccacacaacctcagttcagtgtgtttggacagcattttggggcaggtcctagtgttcctaggatggatcagatgagaaatgttcacctgacgcaatgaggtaatgcggtgtatgctgaagcaatcatcaaaggccctaggctagaaatttcattgtttgaaggagatgatgtgattggctggctgaagcaatgcgaaaagttctatgaattaaccggaacacctcatgaacaatgggtaaatttggctttggctcatttgagtggaagagctgcttggtggttcagaggtgtgggaattccgtggcaactaatctcatggccccaacttgcagccatgatgtgtgaccgattttgtgaagctagtgaccatgaggcagtggagcaattacagaatgtaaagcaggctatcttatcagtaacacaatatattgataagttcgaggaatgtgttgatttggtccggagggaacacccatacttgcaagaacaatacctcaacagttgtttcattgggggattaagaggggatatcaaacatgatgtaagtggccaaaaacctcagggattattgcaat

SEQ ID NO: 85663 - DNA, 690 bp, Oryza sativa
ttaaagtgaacagttccaaggacaacatgaagtcatctagacacatcaagagaagactgaaatctgtcagaaagcagaaaaactccggagtgatagcattggactatgtccaaacggctagaaatctggcagatcagtttaccaaggggctaccacgtaatgtgatagacagtgcatcgagggaaatgggcttgatacccacctaaggttgcataatagtggaaacctgtccattatgatcggagatcccgtgaatttggatggtgaaacaaactattgtgtgactgaagagacccttgaaaagggctcattttcatgatgtgcttctcttctttcctgcatggtaggatggcttatgtcttaatgtgatccgagtggcttttccaagcagagatgttgacctgcagaacatcttagaaggaacacacctatatgagttcgactgctagtcacagtctatgagatttgggtgatctctagatactcatgaaaggcctggagtatgacttataagctccaacccgagggaatactaatggttgcctagtatcagttatggaattgagtgaaacctactgcacaagactgacaattcaaggtatagtccattgttcagttgtggtcaggtgtagctccttttctaggtgaaagttcaacttaacagtcttcaccgaaacactggtatataaa

SEQ ID NO: 85664 - DNA, 669 bp, Oryza sativa
tcctgcagcccgtcgaagaagtcctcgccttccttttgggtataacccttggccacaagccttgccttgtacttttcgattgtaccatcaggcctaagctttttcttgaaaacccatttgcatcctacgggcttgcacccatatggacgctcaacgacttcccaagtaccattgacataatcgagtccatttcactgcgtactgcttccttccagtagtcagcgtcaggagatgaatatgcctcttctatggttcttggggtgtcatccacgaggtatacaatgtagtcatctccaaaggattttgcaaccctttgtctcttactcttgcgagtatctacaatgttgtcctcctcaggattttcctcaggcgtttgatcattgtgttctatcggtgcaaagtgctcatggggcatgacagtttctttactagaagtgctaggtgtatatttcataggaaattcattctcaaagaatgtagcatctctggactcaagaattgtaccaacatgcatgtcgggtactccagagtttactattaagaatctataacccacactgtggatagcataaccaagaaacacacaatcaacagtttttggtccaagtttccgctttttggctataggtacatttaccttggccaaacagccccatgttcgtaggtatg

SEQ ID NO: 85665 - DNA, 2513 bp, Oryza sativa
gacaaccacgccatggccatcggcttggccgaggatgacgacgacaccagcaaggccaccgtcgtcgtggcgcggtccagtgtctcggcgcggcagaggaggatgagcgggcggcggcgggggaggaccaagaacggcgcggcgcacttcgccgtcagccccgagctgatccagagcaggaacaggatctacctcaggggcaccgtcagcaaggagctcctcacgcacaagcaggtcgtccacctctcccacaagatcaaggatggcatctggctgcagcagcaaagatcaaagtatgcctccattgccacacactgcaaatatgaaatgatcaatccttcatttgaattatcatttcctctcaaaaacattgaaactgttcaagtatattgtttacatttcatcgtcagcttaagcttcggagtgaagatcgattgatcggtgtatgaaattcaccaaaatacttcaaatgatttaagtgatttgattcgtatgattttcagtaatggccattcaaattgctattctgcattgcactcagtgaccttgcatttgtatgccatttcttcataattttttttagctttcttgatcctgatggtttgttcctccattgttgaaccaggctgaaagagaagctgggaaatgagccctcatacaaacagctggcgcattcgctgaagatatcaccgcccgagctacgatcaaggatgcacgagtcgtttcttgcaagggagatgctaacaatgagcaacctccgtttggtcatttccattgcccagaagtatgataaccttggtgttgagttggctgacctcattcaggtaatggaatcagttaattcagctgcctttgcaattctaacagagtctgttcagtccaatcatctgttggacacactaggaggattttgtgtgcttgagacatgtagtaacgtgttgcgatccaatcacattttgcagggtggtctgatagggttactccgtgggatcgaaaaatttgatgcatccaggggctttagaatttccacttatgtatactggtggatacgccaggtaagagttctctgctatcctgtgctcaggcaaatggatggaagttcagaattacagtcagagattaactcaatcgatacctgatacattgtccttatttcattgtttcgatcgataccagggtgtttcaagagcattagctgaaaactcaaaaacattcaggcttccaacttatctgcacgagcggctgattgcgattcgtggtgcaaagtatgagttggaagatcaaggaattgctccaacaatagaagtaaggcatactgcactaacaaaataaaaatttggctagttctgtttccatgaactacaaaatatttacaattgcagttttctttgtgtattttaatcattgtttctttttatttttaaaattaaaatttaaaacgcagatctgacagtttgccaacctttatgatggttttcagttctgtgaactgcaaagtacttctagttgctgctattgtatttttaaccatgctacttttgtttttctttgaaaaagattatataatttgaatgtcgcgtctctgatggtttgctataaccttttggtggttattctcagaacatagcagggtcactcaacatatcagaaaagaaagtactcaatgctacagaggtaatatatcttcatcttgctcggtggaacttcttttgttaaattcctttgatatttctggcattgtcacagacatttttactggttgaaaaatacaggctgtgaacaaggttctttcgttggatcaacaagcatttccatccttaaacggcttacctggagagacactgcacagtgtaagcagctatatagctactttgaaacaccattatacattttcaattttgaaatgtgccacgagattaaacctttttcgccctttccttgttctcagtacatagaggatcaaaatgtcgcaaatgatccatggcatggatttgaggagtggtatctcaaggtaaccacagagatatttgttccagaagataattgcactaattgctactagtccataatcctgttctttctttgatttttggaaataatccatccacaagacaaaagatcattatgactccaagcattttgtttttaaaagttgactccacaaacatattatagctctgagttggtactggtatatggatgaccagacctcattaccttatgtccttagagaatcattgaatgtgctttaactataaacattctactaataccaggaagaagtcaacaagcttttaaactcaactctcaacgagcgtgagagggacattatccggttatatcatggcataggaaaacaatgccatacatgggaggatattagcagacagtaagtattatttcttcagctcttatggaccaaggtcctgtacatgttcaactgcctagtcaagtttgctcgccataaaaaaaaatctaaaacttttccattattatcaaactattcataatag

SEQ ID NO: 85666 - DNA, 1344 bp, Oryza sativa
aatgttactccaacaatgatgattgcccctgcatattcatcaaaagatcctccacaggataatgcacaggattttgaatatcattggcaacacacaagatattgatgaagcccgccgccaccttaaggcagaatttgagatgaaggatttgggtaaaaccagattttgcttaggtttgcaaatcgagcaccttcactcaggcattttagtgcaccaatctgcctatgtccagaaattattggagaaattcaatatggacaaagcacatccaaacaaaacccccatggttgttcgatcactcgataaagaaaaatacattttccgaccacgggaggaaggagaggggatattaggaccagaatatccctatctcagtctcattggagcacttatgtatcctgcaaatagtactagaccagacattgcggttgcagtcaatctattagcaagacatagtgctgctccaactaagcgtcattggaccggcggaaaacaaatcctcaggtacctaaatggcactaaatatcttggcttattctttcagaaaactgctgatcctagcttggttgagtacactgatgctagctatatgtctgatccccacaacgccagatcacaaacaggctttgtattcctccatggaggaacggccatatcgtggaagtcatctaaacaaacattagtggctacctccacaaatcattcagaaatcatcgcactgtttgaagcatcacgtgaatgcgtgtggctccgcaggatgataaaccacattgagcaatcttgtggcatcggttcatcagaatcacctactattatctatgaagacaatgctgcttgtattacacagatgcaaacaggctacatcaagagcaatatcaccaaacaaattgctcctaagttgttttatccccatgagcttcagcaaagtggagaaataaacatcttatagacaaagtcttgcgataatctggcggatctcttcactaaatccctacctacttcctcgttcgagagatgtgttaagggaattggtatgagactactccgagacttgcaagcttcagggggagactctctgaatgatgtaccttgttgaaacacatcacattgtactctttttccttttgtgagtttttaccatctggtttttctcatacaaagtttttaatgagacaatgttagatacaagcttatgccttatctcatgttttccccacaggagtttttctagagataaaacaaggcatggattactccttaaaccttacaggtttctgatagagtaatcaccaatcatattattcctatttttttcccacggggctttttgaaggaattaaacaa

SEQ ID NO: 85667 - DNA, 636 bp, Oryza sativa
tgggcacgttcatcctgatcttcgccatgctctccaccatcgtgaccgacgcgcagcgcggcggcgtggagggcctcgtcggcgtggcggcgtccatcgggctcgccgtggcggtgctcgtcatgtcgctcgcccacgtctccggcgcccacatcaacccggcggtcagcgtcgccatggccgcgttcgggcgcctccagcccgcgcacctcctgccctacgccgccgcgcaggtcctcggcgccgtcgccgccgccgccgccgtcgacgggatcttccatccggcgagccgagggtggatggtgagcgtgcccaaggtggggacggtggaggcgttcttcctcgagttcgtcaccacgtttgttctcctcttcgtcatcaccgctgtctctgccgatcccaacgcagtataattactacctccgttttatattataaattatcttaatcattatttatctatcaaatttatataaaaaatatctacaacactaaattagtttcattaaatatgatattgtacatttttttttgacgagaatgattatcgtcgggtgaccggcgaaaggagcagaaatcgggcgctccccctgccctccgcgtgcgtgcatgccagggcgcgtgcgctcctcccta

SEQ ID NO: 85668 - DNA, 596 bp, Oryza sativa
cgccttcccgcatcgtgagcgagaggcaggccgggctgccgcgccgattcatgccggaatctgccactggccgggaggtggtcacgctgggtgagggacgcccggcgccacactacccggggcggccgtcttcttcctctctttcgcaatggcagggctagtcccgccattttcttccgtcttcatggatgttctggagctttacgatctccagatggcgcacctcacccccaacgcggtaatgacgttggccatcttcgtgcacctgtgcgagatgttcatcggggtgcgcccatctctccggctgttccggtggttcttccccgtacagccggtgtcgccgccgtcggtagtcggtggctgctacttccagccgcgggggccggcgctgaaccgctacatcccctgcgttctccgcaagaagtgggacgactggaagagcgactggttctacacccccctcgccgacgaagcgcgcctccgacttccgagccagcccccggtgcaggcctccagctggcgggcgccggtagatctgggagacggctacgactccgttctttaccgactggcgagtctgcggacccaggggctga

SEQ ID NO: 85669 - DNA, 1458 bp, Oryza sativa
actgattctctgtgaaagaattgaagtgaatcttacctgttcttcgaaaggcttgggaaggaagtatatgtatccacaatcaaggcaaatgtgtgttgctctagcctgtgacaattcacaactttgcaggttgaggcttaaaagttggaaagagcagacgattgcaggcagcataagctctgagaagcagacagaactatcttgagcttaccttttgtgattccgtcaatttccggccaaatctcggaggcgccggccttttcggaagtcgcttcacatcaacttgtgcacccctgagatggcgcgaaatgacagcaggagatgaaatgtaaggaacttgaaggatccaaagtacttaccatgaaaagtacatatttctactagtattactgtctgaattttgaatataactgcataatgagtgcatgtacaggatttcaaagttacgaaaaaattgtaatgctggggaggataagtccttacctgctaaccacaaagtagacagagtctggctttgcctggatggctgtcttggtgaaccccagcttatctgcaggccatagttcatctccaaagaagctacttgtgtagagcacctggtcacctgatttcaggcctgctcttgccgcgttccctccagaatccacagcctaaagcaaatgccaaatgaactattactagtcactaattataacactttctgcatctccagctctaaggcaagctgtacatactgaaggcaaacagatatttttagcaggaaaagagtttggagttgcatttttaaccgtcgtagtagttcctagcttcaagtcccccccccccccccctttaggcataagccagtctggctgattgctttgtgtaacaaaaactcttttcctgctaatatattgacgtgcaatccttttgcacgttcaaaaaaaaaaacagatattcttgataagtcctaactcatgtagaagttgattcaacaggttgttatagttttctgagaaattaatccactaatggcaaagaactagttttatgaattaggacttgttgaagatattcctaataagtcctaactcatttttcctgaagaaattcttctaaaaatgtaagaatttcttcaggaaatatagtgatcttgagacagcaattcaatgctgccccttttttttctctgttaatggatcatgaagataaaacaagagcagggaatatacagtgaatagcaatctagtatgttcttgatgagacagcaatcaagtggtgaaaatttccattggttgatcatgcagagaaagaagaacaggtggcatcatgcatggaagtatggaagcaagctgtgttatatactgacggtgatgacgacgccgccgccggtcttctggccgagggtgaggccgagcggcttgtcaacctccacctcgatgttcttcgccgcccggccgtcctcgcgttcacctgaag

SEQ ID NO: 85670 - DNA, 668 bp, Oryza sativa
aatggaatcaagaatccagaatttaattgggcttgcagaatacaatcttataatttgggcatctatgattttaaatttatgaagttaaaagttttagattttcaatatctacatgaatcaatatttggaattgcagagaacattcatacaaaggcactatatatgtaatactatactaattgcactacctgctcacttgaaaaggccaatcggcgaagttaaggaaataatctgttgtcagatgcaactcataacaggttattactaagtacagtgtagctacttacggttcaggtacataagtgatagcgagaataacacgttgaacagaatggtgaaccctagaagggcgccagttgcaatccagtaccattccttattggtgaagacacctgaattttctagaactgccactcccaatctctttccatcaggtaccttgatacacaatcagaaagtcaagaagacaagaaccactattacctgcaggaacagaataataagatgatcaagagtcaacttacaaatttgtccatccaccttggagaatgcatttcattggaagaaaaggcaatgtatgcataagtaaggggtgaacaccagtaagcccacacccaccatttagggattgcatctgtaacaatcataatttgaatggttcaaattca

SEQ ID NO: 85671 - DNA, 1287 bp, Oryza sativa
tacatgtgaactgcaacacacagcaatacatggcaggattttctatctctgctggaaatttaaggttctgatggagtaagcatatgtaaaagcgaagaagacagtaaagccagccagcactgcagccacgacgcccatgaagtccgggtcatagccaaaatagtccttgatgaaaggtctgacttgctgatcagattgtccagggaccgtgataaaatcctccacatctccgtactgtgacacaataaggccgtatactgtccatgccactggacaaagccaatagtaccaaacccaccattttgggattttctgcagaaacatacaaaaccagatcaacctacagaaattgtacagaaaaaggtttagagcttaaatatagacaattaagggacttaccggtcttgggatgaagaatcctgaaaagagattgaaaagggtgtaaaaggcagcacccaatatggaagcaacctgaaggtttggtgatacggagacgttcatcatgccatagtaagtgaaatagaggaaggtgaagaatgaaacatagaagaaccagaagaattttgctggtgtccattggaacgacatcattgggtagacaataagtgtgtaaatgacagtctcaacgaacacatacggtatctccacaacaacctgacaaaaattcaacagattgattataaaaagttacttatatattgaaatgaatttatatctcatttctactacatgattgtgaccttctgttgcaaagtttccataatattccattggtctgacatttttaaggtgttctgggttcagttgagatacaaagtaatatcactgacctgagctagagcatatggtatagccgagtacattccagctgcccgctctctgtaaaatacagtcctttccacagcaacaacgggttgaacagttacagaattctcaaaaccaacaaacaagacggcagcatacattgatccaatgatgaccaagagatcttttgaactctccctgcatcaaataagaaacatttaaggaaccagtgataggtattcatgaaaatattcaatgactctgcggataataacttagcctgataaaagtacatacatcttgtgaccaaccctccaaaatatagtccccaacattaaagcagtaaataatgcaaagaaaatcctgacaaggttataatcagggcttctccagtaagtccaccattgtttccagaggcagagcttgaactgattaaaggtgctctgcgagtattgactagggaagtagaggtcatcggaacca

SEQ ID NO: 85672 - DNA, 2229 bp, Oryza sativa
agcccgtctagctcagtcggtagagcgcaaggctcttaaccttgtggtcgtgggttcgagccccacggtgggcgaattctgtttttttatcactcttttttttatctgaaattaatctgacaaatttttacatcagattgtttaccaatcaccatagctatttaggaaaaaaattaacgaaaaatttaaaaaaaataagataattggaataagagcatcactcttttttatctgaaattagtctgacaaattttacatctgattgtttaccaatcaccatagctatttaggaaaaaataacgacaaattaaaataaaaaaaaaagatatctggaataagagtctagagtccatgtggaaatgtggaaatttagaactaactaaaattcgaaaatagaaaacaataaaattaagggatttaaaagtagagtcaggagtaaatacaattttgaaattactaaaattaatttttttttaaaaaaaaagaatattggaggaagattctagagtccatataagaattcaacttagaaataatgaaaaattagaattgaaaaataatgaatattaaaagaagagtctaaagttcatagaaataaatttaaaaataatggaaatttgaaattagaagataaggaatattgaaataagagtccaaagtccatatacgagtacaatatataattaactggaattcataatttaaaataataaatattgaatgaagaatttagagtctaagtatgaataaaatttataaataacaaaaattcggaattaagaaacacataatattggaagaggtgtctatggttcacatagaaatataatttaaaaataacttgaattaaaatataattaatgactatcacgtatatacaattcaatttggttagtttggttaggtaagcacaaaatttagaatcatgttaccatttcaatatattttaataatgaaatatagaaaaataatatgatatttgtaagagagaaaataaagatagtagccgcacaatctgcgccatgctagttagtggaaaagaaatttgtccataattagttgacccgttgacataaaaactagaacaaatcacagtaataccatggaataaacattattcttacttggtcaaactagaacgggcatgatttgtttatgcgtaatgattggtctattttagttcaattagatgaaatagcttttatttttaggtttaaagtgatttttagtttattttttgttaactaggatagacaaaaattacgtgaaccaaacaagttacgcattctggcatgcacatggcaatatgcctttttgttttttcctacgcccggaagcagccaaaatcagagcaggaaagttcaacgtggcgtccattgattcctcttccctgctggaaagcataacatcacattacatgtgcctgcctgagtgccccaatcgccgttagggtatccacaatgtgagacacttatagaataccctcactaactaagggtactctaagagaactcacctttacattgcagggtagcctaatgagtgtcccaacaaaaaaacccatttctctcctcttcatctctttcctattctacccttctcttccccctcccccctctcactgtctttctcacacgcacgcacgcgagagcgcaccgagtcgccgtcgccgctctctctcccaccactctctccctctctctctctctcccccgtggaaggtggcagcggcgacccccggagacggtagatccggcgccgctgtggccggatctggccccccggcggatggagcggcgtcagccgtgccgcattgaggtggcggacggtgagcgcgcggcgagcttgaggcggcggacggcaagccctcgcgctcgaggcggcggatggtgagcttgaggcggcggactcgacgagctcgaggcgaacggacgaagctccgtcggcaagggagacgagagccgcctactttgctgcagatccgtcgccctcgccgcggatttggcatcccagcaccgtcccaggtcgtcgccgcctctcgcctctccctctccttctcccgccacgcctccctctccttctcgccgccaccgccggagccacacctctctcccgtcgctggcgaccgtgactgagcgcgacgaggagctccatcggtatcgccaaggaggagaggggagaggggtggaagaggaaatcctcgcggggggcggggggggggggggggag

SEQ ID NO: 85673 - DNA, 1958 bp, Oryza sativa
aaaatacgaattataaaaaaaattcatataagacggacagttaaagtttgacatagaaacttagggtttgtcttttttcgaaacggagggagtagtatagaaagcactcacgggtgcatcatagaggatagtataacatgggttcttacgcatacatcttgttatcactagaatcctccaacttccccttctgttgcatccccatgctaaaataagaacagcctagccaaaaccctctattaggaacaacagaaagccttaaccaggagcaacactgatgggctccattggcaacggccggaatggctcggaggttggcatacagatcccagcgatggggaacaaggaagtgctggagcgacctgccataccaagatggccacggctaggcgtcgtcatggtggcaactagagctgttgccctggtgatggcagtgctctcaatggctctaatgatctctgccaagcagcggggtagtctcaagatcttcggcatcgagatcccgctttatgccaattggtctttctctgattccctagagtaagtatcaaagctgctctatttcgaaatgtgttaagctcatacagagtactgagtcgttctgattttctgatggtgttgttcgggatttcagatacttggttgggatgtctgcagtttcagctgcctactgtctcgctcaacttttattgactgcacacaaggccgtgaagaatgcccctgtggttcaatccaggaactatgcctggcttctgtttactggtgatcaggttcgtcaatgcttgtccatttggcttgatcttaactctctgaaatcaccggcgcttgccacggccgcaggatgggggggtcgccggcaccggtagagtagggggtgttcgctggcaccggtagagtaggtatgggggttggcctacttcgcccaattggtgggtctgctcctgcccattttgatctgattttgcaatgacgaataggttgccttggttttttatgctgtgatgcttgctagattgcatattttatactctttattttcatgtttcttgtggtacatcaatgacccgttcaggattcctctttgtattttatggaacagtcagtaaccagtactagtataggcagtattgattgggtgtttggggttagttctataaaagatgagcaagttcttgctggcaagtggtatcttggaacagtttatttaatcttcttgttgtcaacttgccacgtccatatgcatgctacatcaaaatactttctgcaacttggtttagatttactgtttttccccaagccataagaaatcattggaatttttctgattcttgtgcatctggttgtggacttacatatggaattgcaatcctttctagatgattgaacttgataacctaatatatgcaagaaatatgcggaatataatcacttcatttaggataaattatttcttgtgtttttgtgggattcgtatttgaaacagacttgcaatatttgaacaatacttctacagatatataatatgtggttttgttgtgatagagccaaaaccaagcaaatccctaagcaccaaaagagctgggatttgcaagaacagaatactgtcgggaacttcttaagcaaactccatacctaacaagcaactaagcaaagagaaaaacaaccatatttgtgcaagatagtggtcctaacctcttatagaaaatgttcttgggatttttttttttggttctacacagtttgtgcaaaaataaaaagtttgatgcacaacaatggtcttttgttccaaaacctcgtagcagttgtcagttgatagctgatgagagtgatggcacttgagcctgagtacacagagctcaagcattttacacaatttcttgagggcacctccacttaatgtttttgtgaatggattttccatggtaaaatgcataaatgtgacgtagatctttcaggat

SEQ ID NO: 85674 - DNA, 2401 bp, Oryza sativa
aggattacaaaaggagcaacctccacccttgcatccatctctctatttatagcctaagacccctaagacattgtctcaaatacccatagggcgaaaccctaccctggacttatcttaaccatccgctgttccttagactcaaaggaagtagtgcagattgctgccacgtagtcgatccgagctccccacgctgtgcggatccgcgtgctcatcacttgcaccaacaggaaaccgccacgcggccacgcaagaccgtgccttgccccgcgcgcgctcgcgaaaccgcgtgggtcccacgtgggactcctccgcatcgaaccagtaagcgccacgtcgtcttggagagcaccctcaccaattcccgcgcgcgccttctcctcccttgcgcgtcgtccgaatttggcgtgggtcacgcgagtagtcgatctcccgcgtgagagcgcgcggtcgagtccgcgcctgccacgtgtccctcacgcgcgccgtcgccgaaacctcctgccttgacgcccttgcttgccgagctgggccgtcgttgcttggatcatgctgtcctgctccatcttggactgggccagtccggtccagccgtgtggcatcctggccgagcccatgatcacgatggattggtggcctccctgccaaccaatcacagcacacatgcacatcacctcgtgcatgcatgcactgctcaagctaatgcacacacacgcacagctcgcatgctagcttgcttgaccaagtcttccaaccaagtgcatgcacgtgcactttcctcattggctgcatgctacagtaccatatgtactgtagcactgcttgctcctttcctctgtcggctttcttcgcgaatcccggcacttgcacttttgcacttgaccttgcgaagtccgttgcaaagacctcctcacacggtgtccgtccaccctgtgcaaccttgtatccaatcttgtcacccggcatccttgatcgttctggacctcaactcctccctgagtctagtcccgatctgccgttgaccaagattgacatcgatcacctgcacacacataaaccaaacaaccgttgtcttggcacagatattgcaacctggccaatgttagtccacgcacacacttcttgcacttccggtacttgtcaatttcccatcacaaaagaactataaccacacatggtttcacagtatgccaagtggatcttgcaagaagagtattctgagtgtatgcttgtcggaatgcctcattgtggacaaccatgattactgtgattgctacacatggtgaggagcacgatgcagtgaacatgtttgatgaaatgccgagggaagggtgccaccaaatagtgacaatgatgaccgtgctctttgcttgtatgcatggagggttggtggatacggggatgagtttgttgaagcggatggaacccggggatatcagagttgtactaactgttgaacactatggttgtgtcatgtgtgatggatatgcttggtaaagttgggcaggtggatgaggcacatgctttgatggagcaaagaatgctaatggaggcaaatgtggtgatatggggaacattgcttggtgcatgtgaaagacatgagaatgttagagttgggcagtgagcggcagagagtacctagaggccgagcgatggaacgatggggtttatgtggtgctttcaaacgtataggctgttgccaggatctggtgtggtgtggagagggtgaggaggaggatgacaatgaggaaaatggcgaagtctgtcagctgtagcctataaatctacaaagggattgcagttgaagtttgttctgtctcattgattcatttgcagtaactagtagacaaatgttattttatgaaatcaataagtaattaatcttatgcctattgtcgttatggtgccattttcaattgctgatagtatagatggcgcatcaaaattatgatagtctaatttactggcataagatgtgtggtaggttaaattgattagttcctttggataatatagacatagtcatgatatagctggtttttatggaatgaaaattagttacatgaataatacttttaactagtggcagataacagttatccttcattaggcgcttgctgcttgtttcaaatgctgtatatgacagctatatcattttttacaattctttcaacacttgatttactcaaattagattaatatgttatgtttctgtccactgctagagatatgttccatcaaattctagtactaatagaatattctgcagtgtgtgagatattaaatcttttagtaaaatgtccacattgaataaatcttaggttccccgcaaaaaaaaaaagaataaatcttaggttaagatttggacaagcatattttacctcagagaacaaaccacatctga

SEQ ID NO: 85675 - DNA, 1232 bp, Oryza sativa
  unsure (1)..(1232): unsure at all n locations
ccggcggcggacctcgacgccggcctctgcttcggcttgctggatcccgtctccaacgccatcgtcaacgccgccgtcttcgccgaagcggaagatgggaacgacaggacggggcgatctctcgacggcgcggtcaccttcctcaccacgttcttccctcacctcccggactgggaggccgtgcgctacctgctcgacgccgacgctgacgtcctcgtcgcggcgcgcctcgtcgtgcgggaccgtggactgaggagattcgggttcgcctcggacaccgccggcgccgccgtaaggttggccctcagatgcgccgcgctggccgtgaagcatccgcatcccgaccggctcgtccacgcgtggctgtccctgtctcgccgcctcgacgaggccgtgtccgcgctcgccaaccacgacgtgcgcggcctcgtcgnnntggtcgtcgacgaggcggaggcgccggcggcggccaacatggagagggcgtgggagctggcagcgtcccgatttctcggccgggacaacggcatcgccgcgccgccttaccggcacgccatgcctctccagaggacgctcctctacgcgatccaggggttctacctccgggcgctcgcccggctgccctccggcgagctgcggtctcactaccaccggagcctggtgaaggccggccattgctacggccccatggaccccgtctccaacatcatcctcaacgtcgtctggtacgacgccgcgcacccgccggcggaggagctcgagctggccatgatcccgcccatgagcatgttccgcgtcgccacgcgttcgttcctcggcctcgtctccttcctctgcacccgctaccccgacctcccgctccatgacgccatttggtgtttgcttgccgcggacggcgaccttggcgccgccgcaagagaagccgagcggcggcagcaccgtccctcctgccnntncaggaggcctacgccgccgccgctgccgcggcccggcaccccaaaccggacgaacaagtggagctcctcagctcgagcagggccatcacgacgacgacgacgacgtcgctgctcctgcagaacggcggccagctctcctcggaagacgttcgccgcctcgccgccggcttactgtccccgaatccctccgccgccgtctcaccaacgcagcgcaaaccaacgaaaccacggcagcgcgggaagctgaaactgcagtcgcagttcatccgtgatcag

SEQ ID NO: 85676 - DNA, 1757 bp, Oryza sativa
ttggcaacgacgatgcggcggcgtcccacgacggcgaccacggcggtggagcccaccgtcctgaaccccgacggctcggtgccgtcgacgcggggggcggcggcggcgacgctcccgacgacctcgccgtccatcctcgcgaagctggccaacatcgcctccttccagcgcacgtcgccgcccgacgcgctctgcccccgcagccgccgcaggctcacctcctccgcgagcacaacgtgcatccgcttcctgcacgcctccgccacccgcgacccgccgtggccgtcgtacaccgcgaagaagtcctcctcgccctccccgccgcccctgatagcgcccgcaccatcccccgtcgaagccatgaacgtccgctcgatggccaccgcgtcctccatctccctccgccgcccgatcaccgacaccgagccgtgcgacacgcacgccggccagctccggggaacaacctccgtcgacgagtcatcagacgacgacccgtccttcaccgaccggattctcttcgccgccgcatcatcctccgccgccagcccgagccgccggagctcgagacgtcggcgccggcgtgccgccgcggccttgccgtcacctccggctactacaacttcgcacgcgtgcccctcatccgtcgcgcccgtctccctcatgtcccacgcgtagtagagagagcaacggaggaatcaaagggaaaggctcgccgaggagggcgaggcgggctttaatacaagcccacggcgaaaggtaggagaagcaacccgagccgtcggatcgcgcgcggacggccagatgcgcgccaccgccgcgtgggacgtggacggacgagatcgccggtggcgcgtggcgtggccgccgtctgggatcccgggccgggagagagaccacgctgcgcctggtccaccggtacgctctcgcgcgcggtccatgtgggcccatgttttcagtgacataggcttaggtggaatgggtccacgtagcgttgggatggttgggccattaggtaggggagtggggcccaggaaggggtttacgtggagggagagagtggaacgaggaagtgtgggggcgcccgctcccgctgcggcggggacaaatgttaaccagcggcaaggcaaaagggcgcggcttacgtgcaaggaaacgagattctacaggagcgagcaaaactgcaaaagccctctgtgtttttgacccaaaccgcgccaaaaccaaacccacgtctcacacacctggattccggaaaaacagtgttgggtcaaacaaaccacgccgcgaacagccggcggatgaacgaggtttcgtttcggcgtttcgaatggcggagatggtcgatggcgtacgcccgatttggagcgtggcgcgggggtgagggccgcgtggcgggcgaggtggacacgcgcggcggatccagaggcgcaagcgcgagagggagctcggctcatgccggggtggaagagccagcgccatggcgcggcctcgggctccgtttccggcgcagcgccactgctgctgctgagtgggggcgacgtggagacgacccgggccgtggtctccgcttcttcgtacgagcagtggtgacgtggtccgttgtggtcaggcactcggtgcaggcgcgggattcgaggggtgccacgacggcatgcgggcagcaaccatgggagggccatgccgttgctagctttcaacttttacggcaaagcttgttcattcatggtgatgcgttggatggcgcttttgtccggtcg

SEQ ID NO: 85677 - DNA, 546 bp, Oryza sativa
agagttcatatagaaatacaatttagaaatagctgaaattcgaaattaaaaaataaggaatatagaagaggagactagagtccatatagaaatacaattaggaaataactgaaattcggaattaaaaataaggaatattagaagtagagtatagagtccatatagaaatacaattaggaaataactgaaattcagaattaaaaatagggaatattagaagtagagtatagagtccatatagaaatacaattaggaaataataaaaatttggaattaaaaataagcaatattagaagtagagtatagagtccatatagaaatacaattaaaaaaaatagaaattcggaattaaaaaataaggaatattagaagtagagtatagagtccatataggaatttaaaactaactaaaatttggaataaacataataaaattaaaagtagagatataaagatacaatttgcaaataactaaaattccaaattaagaaaaacatgggaagaagagtttaaagtcaatataggaatacaatttagaattaactg

SEQ ID NO: 85678 - DNA, 1012 bp, Oryza sativa
  unsure (1)..(1012): unsure at all n locations
gacccctcggggagacagagggaggggcggccacatcaccctcgggcccgacccccccgagggggtcaggccacgtgggtgactgcagctgccccaaacctctagtcaagatacccccggtcccatgtcaccgacagaagtattactagttagtgtgttttcgtcgaaagaaaaattcaaagttcgcagtagttagtttgtgcatagactttaacccgagcaattcgtagaagcgccgtagatcaaaatgtagttgaacgtgtgaaacgtggctagttatttggaaaacgtcggcgatcatgcgcccgatcagcggcagaaaaatcggggcctcccgcgcctccacgccgttgcaacaaatcacccgcatattacagaaacgctctattaagggaatccgcttcatttttagtttcaccaacaatgtttcagtaagtgtactcatgatgtttcattatgtatggatcaaatgttgcattgagttaaaacatcctttcgctatttgctgaaatattgtttttatataaggagaaacagcgcccgagttttttggaaaccgtttttcatacgttgtagcaaatgtttcacaaggtgatttggttgtgtttanctttttaaaatactgagacattttcgatctacttagtgaaacaattccgatctacttggtgaaacagtgcttgatatgtaggcgcctcctagtaatttgagctatataggctgaggtggcatgtgaaacgtacggcaaagtgtacgcgtgtgtgagatatatggcaattgtgcataggattagcaattggtatgcaaagaccagttcttcttcttggcacactgcacacacgtaaagatggccagatggcccgagacctgacagcccggcccaaggcacaacaatttggcccaacccaagcacggcacagcctgactagggtcatgcccgtgccaactcacgcctgatagccgtgccgtgcctgggttgctacctcggcacggtgggccagcacgacccgac

SEQ ID NO: 85679 - DNA, 823 bp, Oryza sativa
taagcgagaggacacacggccatgcatgcacgttactgcaattcaatgcacgctcaagaacaaaaaaaaaaaaagctagagtatcacaagctatggcactaccacttgtactagctggagtagtccagacttacagtttactggtagctagcctccaatgcatgcatgcacaattgtgcgccccggtcctgcaaaagttagccgccggtagccctgccttgcacctatataaactcctgcgtgactcgcgctcctcagggttattcgagtgatcgtgcccacatatctcccccttcttcctcggctgtgtgctctgcaagtgtagctgctgctagctagagcagagcagcaatggagttggggcggttggtgacggtggtgatggcggcggcggtgagctcggcgctggtgatggtggcgaggtgcgacccgcaggtgccgtgctacttcatcttcggcgactcgctcgtcgacaacggcaacaacaactacatcgtttcgctggcgcgcgccaactacccgccctacggcatcgacttcgccggcggcccgtccggccggttcaccaacggcctcaccaccgtcgacgtcatcggtaagacaccaacgttgtgctatctgctgctgctgctgcagcggcagctacgtgtaaagtgtatagtcatgcagattttagctagctgatctccaggggtttatggccgtcatggtgatgcacgtgctgagctcgttgaacgagcgatcgatcagctgatgtggaatagaaaattctgagcagatgttagttaggagaatggggagatggtagcttgttgctgtggta

SEQ ID NO: 85680 - DNA, 555 bp, Oryza sativa
tctgaggcagcagatagcttttgttccaactcagcgctattccggtcattcactcccgatgttgatgcctgtgctctatcctcatgaatttcttggaagttctcatcaagaggaggccacatcacaacacatggtatgtaactgtcagcagtctggtttctcccaagcacaccactgcggcctctgccccaagcccacatcctatacccatcaccagcaacaagaacagtgtgagcagctccacaagtgacctgcactgcaccaagaaatttgaacccatttgtctcaggagactgaactcttatcgggcgtagagcatcccctgaatcaactcctgaaaagctggcatcagggcacaacccaagacctctctccattccccagcaccaaacctctccatcagaagaaactacagttgtatggaacaatccacaatcaagagaaataaggaaggaaccagttggcaagccatcaacaggttgaggagagcaaatggtggcagtggtcccatggccaagctgcccattatcaccaaggccaaacgtccagcaacga

SEQ ID NO: 85681 - DNA, 780 bp, Oryza sativa
tgtgagtcgcacccatggcaattaaggaccggttcacgggaaaccctagaagacttacagcgcttgccacaagcgggagtgggtaactgcttgatctgaagtatagctcgaccctttcctaggcaccggtggcgagggtgggcgtgatggagttgggtaggccggggtgtccggttgtccagctgccggattcgccacggcacaagaggggaccacccactaccttttgaggggtgggggtgaaaccttagcgtggtgtggatggttaggggagggttatgcgaagggtctcgtcacaatcactcgacatggtgacgtgtgcatcatgggcacatgatgacgcggtgacatgtcggtgggttgtgtcttgtgggtatagttgtgcacctctggccagagtaaaactattcgaatagccgtgcccgcagttatgggcgatcgaccagattcaccgtgaatagtctcacacttaataaatcgagtcaatgcactgtagtacaggtgggttggttgggcctgttcaacgtggtgtagcgttgatcagtggagatctaatttacctttattattcaacagttttactgtttgctaaataaaatgttttacaaccgcctttatgcaaatagccacaaaccgtccttgtatccctttgcacgtttgcatcattggtgtggcttgctgagtacggtggttgtactcagccttgctattatttccccttttcagaagtgtagtgcttctaagctgaagacgaagttggaagaccaaggctcagaccct

SEQ ID NO: 85682 - DNA, 1134 bp, Oryza sativa
cggggctcgccacccagaggcagcaacagtccatgttggtgaggaaccacttgtgcgggttcatgctcaccgagtcggcgagctcggcgccgtcgaggtagccctggactctgggcagatcgccgcgctgccggcgtacgtggcgtcgacgtggagccacatgccgtggcggcgcgccacctcgccgagctcgcggacggggtcgacggcgccgatccccgtggtgcccacagtggcgcacaggtacagcgggaccagcccgcgcgccatgtcgccctccaccgcggcgcgcacggcggcgcccgtcagcgcgtaccccgacgccgccgccgtcgggacgacgcggaagttcgccggcgtgatgccgaccagccgcgcgcccttctggaacgtggcgtgcgtctggtcggaggcgtacacccccagcttcacgatgccctcgtgcccaatcctccccagcgcgcggtcccgcgcggcggcgagcgtgcacaccacggcctcgcaggtgctcccctgcagaacaccaccgccaccgccgccgcgccgccgccggagccggagaagaggaagcgatcaggcaagcccaccagcctagccatccagtccaccacgacggcctccagctccacggcagccggcgacgcaacccacatgaacggcacgacgttgagccccacggagagcatctcgccggcgaacccggcggcgctggcgttcatcgggaagtaggcgaagaagctggggctctgccagtgcgtgagccccgggagcacgtcgcggcgcacgtcagcgaggtccgctccgccggctccccgaactccggcgcggcctccgggaggagcctgcggaggcggccaggctcgaggtcggcggcgcggacggggtacttgtcgacgtcgcggtagtagccggcgaggaagtcgacgacggcggaggagtcggcggcgaaggtgtccgggtccagtggctggagcgcgtcgagtggcaagctacccatggcaaggtcacgtagcttgggcgagagtgagagacagctcaaatgttttgtgtggattttgtacttgagcaagacgcgcgggttcgggagctttatatagcgccaaaatttgctactacgagccataattcaatcag

SEQ ID NO: 85683 - DNA, 505 bp, Oryza sativa
gacccagccgatcctaatcgtagccgatctggactccagccgattcctgctctgtttctgaactcgatctccgcctccgacttcgctttgatcaaatcttctttcctgacacagatgttaccaaatttggtcgttaacacccgtgaacccaaaaaccagacatcgcttaccctaaactttcaataccggacgaattacccctccccccctcaatccaatctagagcggttttgtcctacgtggcgtgcacgtggcaggtccaatcagcattttctgttttttaatggtggggcctacatgtcatactctctcacctcctctttctcctcttcccctctctcaggcgtgggcacaggccgcgcgacagcgggcgttcaggtgagagaaagggagagagagaggggaagaggagaaagaggaggtgagagaatatgaaaggtgggcccaccattaaaaaagagaaaatgctgattgaacttgccacgtgtacgccggcactggaaac

SEQ ID NO: 85684 - DNA, 2696 bp, Oryza sativa
ctgatctttctttgatgtaacctgcataaattaccattttttatcagaataactgcattagtgcctaatagcatctctattggtcatatcttggacatttcagtttgttaaaaaaaatcatgaacatttacttataaaggaccattgctttgcaacaggcttaatatagtaggagttgggagtttgtactgacttcacaacaaataattttttgggaaaaaaaaacgaacctcctgcaagaagtcagcaacacctttcctctcggggcagcggaacccacacctctcgaagaactcaagcacatgctcccgggggccctggtacacgatctgcccctcggagagtagcatgacgtcgtcgaagagctcgaagatctccggcgcgggctgcagcagcgacaccaggacggtggcctcgcccatgtggacgatctgctggatgcacctgatgatctggaaggtggtggagctgtccaggccggtggatatctcgtccatgaacaagaccttggtcgggccgaccagcatctccgctgccatcatccacagccgatttcagccaaaggatcggaggggcgaacgacatcaaaagctgaggcggggtggaaggaggcaccccgcgcgcgcgagggcctacgtacctgtggtgaggcgcttcttctggccgccggagatgccgcgccgcagctcgtcgccgacgatgacgtcggcgcacatgtccagcccgaggatctgcacacaccggcgccatcagattcatccgatccagctgcgtcgcgatccgcaagggaagcgagacgagacgagcagcgagctctccccttcctctctgcggcaaacaatcgaacgcctcgcctgcaacttcctcactccctcctgtagaattcgcgctctgctctagctgaagcgtggaacggtggaataaaccaaacgccaacgctctagttcttctgtgtggctatcagctatgtaagatgggctttattaggccgtaagtgggctgctagctatccattagggccaaatatatgggctacgtaggtgaatgtggccttgtttccgttcactctcttatctcttctgagtttataggccaaccagttcatcgattaagcatatttagtatggagtaagaaaaaatttcacagaaaaaaaagagaggttaattcctgtaggaaaagaggatgggaacctgatacgtaccctgagaatgtaatctgtctggagagtgctcccctcaactgaagtagcctacacatcgagcaaaagaattccagacctcgtcacttcgtcggtatgaacgaaatacacaatataatcaggtagtccagggttgaaatatgaaaatggtgaattggtctgtgaaaaggatgaaacaaagaactgcacaccttcatgaacaggtcgacttctggatctgggtatatgcccagctgcctctccttcttcgcgagctccttgagcaactctgcacgcgcactcgtatgtacgggagacgggttacgtacgtacgaatatttccagtattttgccacgtcgaaagggcgatcgcgactcaccgtatctctggccaaccccctgacacttggcggagaagtcgagcgtctccttgacggtcatctcgccagcgtggacgtcgtgctggctgatgtacgccgccgtcttctgcggcacgaactcgtccagcccgtagccgttgtacgtcacctcaccgctcgtctgcatacgccgacgtcaccaggttagtattggaaagtcggctgtgttcttctctcaactttcccaacatctacactttcatttttcacacgcattttttctaaactactagatgatgtttttttaaaaatattctatagaaaagttggtttaaaaaatatattaatctatttataaaaaaattagctaatactactccgtcaaaaaaaaatccaattcaagcaatgaatctggtcacacatgttcagatttattactaggattggtctttttttttttaaacggatggagtatttaattaattatgtactaatcttttgctttattttttatgccgggaggcaaggttatcaagtcaatcgacataatggttgcatgggtcaaaagatcgatgacgagatcatgtatatattcacctcaagagttgggtcgagcttgccggccagggccagcaagagcgtcgtcttgccggaagaaggtgggcccagcagaagcgtcatcctgtgtgcgagtatacgattacaatttgtagctcagctcgtcgaacatgtggctgtgtcgaggcttgtagttcagctcgtcgatcgtaattcgtatgcgtgtaggtatacgtacctggacggcctgacgatgcccgagacgtccttgaggatgtggagggccttcctcttggcgaagttgaggccgacgaggcccagcagagactcgcccacgtcccgcgacacgttcgccagcgtcggcagcgcgcgcgtcccgacgtggcactccgcctgcacgttcacgttcctgaacctcacctccaccgtcggcatctggatccccgccctgccaacaacgatcgagcagaatcaatcaatcacaaggctcgagccgtggcgtccatggccattttcactcgatcgggtggttgttggttcgttttttttttcttttaccggtcgatgcgggcgcggagctttttgaggaagcgctcgttgt

SEQ ID NO: 85685 - DNA, 1558 bp, Oryza sativa
caatggatatcaccgacaatgagcagaaaatcaaggcatagcggctgataattgcattcatctctttgagatcttgaacaaaaaatgcagcaatcattcctccgatggttatagcatagatgggctgcaaggaaccatataccaaagcagagagacttcctatgactgcttgtctccactctggtgcattcatcgcaagaagcctggagaaagatggtgccgggggagaaacagaggaatcggtttcctttgaaatacctggtgtaagtggcattggacttgctctggacatactgagacggctggtactggtccttgccactgaagaggccctaaattggtcaccaccttcttgatcgatgtagctcaccatcttctgcagtttcacaagtcgtgaatatgggccacccttattaatcagttcatcgtgtgtgccaatttcagctatagtgcccccatcaaccactgcaatctgatcggcattcttcactgtggaaagcttatgagctactacctgatcaatttaaatgtataatcagcgccacggtgccaaacaattgtacaattaatcttagcattgtaaagtagggcagtggaggtggtgacgatgtttaccagtgttgttcttcccatagatgcttggtcaagtgcatgctgcaccagcttttctgattctgaatcaagtgcacttgtggcttcatcgagcaaaagtatagccgggttcttgatgactgcccgtgcaatggcaatacgttgcttctggccaccagatagcagtgctccacgctcgccaatctgcaagggcagggcatgcaaccatagagcatcagacacagggataggtgccataatacttgtttccttgtgatgcacataccttagtctcatattcctcaggaagcccccttatgaagttgtgagcatttgctgtcatggctgctgcatacagttcatccattgttgcatctggtttgccaaacaagatgttctcttttatggatgtaccgaagagtgcatgatcttggctgacaagccccatcttgctcctgatccacttgagctggagttctttaatgttgacaccgtcaaccttgacagttccttcagtggcatcatagaaccgttgaaccaatgctattgcggttgacttgccgctgccactggatccaaccaaggcaacagtttgcccagcaggaatctggaggttgaagtctttgaggaccgtcatgttaggcctcgatgggtaaacaaagcggacagactcaaactgaagctctccccggacttgatccaaaataagtcccttggggtcatcagcatttatctctggcacacggtttatccgatcgagaattcttgtggcagcaaccgacgcttctgtgaaatgcttcagttcagggagtgccattccaagggatctgcaaaattttagtagtatggtcatgtttaatcttctgtctaccaaatggattcatgagttcaaaagggaagagagaacagaagaacatacaggccgcctaaaacgaaggaaatccctgcagcatatatccttcctccg

SEQ ID NO: 85686 - DNA, 1535 bp, Oryza sativa
  unsure (1)..(1535): unsure at all n locations
tctccttggcatatagacaaaggctctctcccttattcccttgttgttttccggaccatggtttgaaatttcagtaattttggcccccaccggcaagcacaaatctccccaaaattttcggttttttgtcaaatatttataactttggtcaaattttgttcaaactcagtaaaaaaatatgttaaaaattcaaacaattttggtcaaaagaacctgaaaatcacgaaattttcaaattttaggcaaccaccaaaattgcaaaccctgttccggagcccagttgtgtttcttagttagcctagtgtgctctcccccgtctcacctctaacccccccatgaccagcttcagcgggctgtagttgtaaaaactcttttttttttccttgctaatatatcaatgcgtaaggctttttcgcgttcaggaaaaaagaaagaaagaaagataaattgaggtggcacttagataactaatgcactttatctaaaaagaagtaaactaatgcaaaacttgcaattgaactcctgacaattcaactgcgactatcatattaacgctgaccttgtgagacgtttagacctgacaatatgggaaacgatacaagtgtgaaagagcttgcatcatcatccataatttctgctgccattgcatatattatattcatgataaaaaatggatattgctggctgctgaaagtagagagagagagagagagagagagagagagagagagagagagaccaaagagttctgtaacttccagaagcttcaacacatatggtacttgaagtttaagagaagcgttacctgcatgcagaaatgtgacttccgcatagccatctcatgtgacaacaggcatttatattcttgccaccacagtccgatttttccataagctgatatatgtaaggtgtaacctcctacagttcaacattgatacaaggcccattaagaaagaggaaagggataatgcacagtttgaattctgtacctggaagcatatgaagtctgggttgtgaagttgaataagatctccaagagccgcccagccttctgtgcagttcnatatcctctctgatccagacattgtatgtcatgattttaaggtcttcttgtttaaattattctcaaatttttctgcatgacaagatttgtattttagtgtggccatagcgaagaagaagaataaagtacagctttgaaggaaaaataaacttctaattatctagatagataacataatcacacacatatgtaaaattaactaccagatttggtcatatgagaactgcggcaactccaagatatagatgcaaaatacccgagcaatttgcatatcaactagatcttacacaattgctcaaacaattaataggaagaagcaccgaaagaaaaatattgcatgcttatggcaatttagtagaaaacaaatgacagaatgaaccaggtgaatagtattctgtatcaagagaatattaaattcagatcacatagagcaaacaaagtatttgtctcatcatacatccatcaatactgc

SEQ ID NO: 85687 - DNA, 538 bp, Oryza sativa
acacatttcatcaaaagaaactaagaaagaaccacgagcaagttatcaacctggcttttatgaacagaggagttttatatatctgggaccatgaatttattatctttttctgcttagagcctcaaccttttctgttcaaaagcattactgactgtccctaatttcggttgcaacagtttttttcttctagacttctttcactaatctgattcaattgcaaacaaatgcagatgagcaaattaccggtgagcgaatcgaaccccatcccattttcgaaatcaataatgaagagggagctatgcgtagcggtcgtcaaaacgggagagatccatttggctgtgggcacaagtcacctagagagcccctgccctctacctcctctgtgggatctgaagtacagcgagaagcgagtagctcaggcaaagcagtctctggagattcttggacaattgcgcaatgcaatcttctgcggcgacatgaactgggaagacaaagtagatggtccattccctctacctgacggctggattgatgcttg

SEQ ID NO: 85688 - DNA, 3145 bp, Oryza sativa
ggcccggcccgtcaacgaaggcccatgggctttccgtggcatcaggtctcacgccacgtggcaagttatcactcgctcgcgcttcaggcacgtgtccatcaccttctccccacttgctgggacgcacacgtggcctctcctaccaccgtatgtcagtcaactggccccacccgtcagtggctcatcagtagatatggataaatcgcattttacataaacacccccacatcaaacggtatttgctaacaacacctcttctccatcctcttctgtcttctccatttccatttccttccaagaagaggttgcagcggcgcgcacccaaaccctctcggcatccagggaaaaccaaggtgcgaaatttttttttgtgggtttttttggctgcttccatttcgcaatccactgatggagtacgttgctagcagtcgttgcaatttctcagtaattttaccgatttactatttatgcaagcttacactggtgaatttttttcagggtaaattaggcctgcgtgattcaagaaccgcacctaaagtttgtatttttccaatggattctatgggggtttatgttgttttttcgtaaagatgatctgatccgtcatccgtgaatattttgttgtctgaacgagttatcctattagtaaacaaggaagttcctgtgttcttgatagagattttgactgatgattaggtagtagtgagctagtgatattcattccaaaggagcagtagaagtaatagcatcagcaagaatgcgagggagacggcggagagctcgggaagctgaccctgtgcctgagccattcaccattgacgatgaggtctcccatctcaccaggattagatcagagccaagtcaaaagactcttggtgctttttacgccggtcgcaagaggggcatctcaacgttcgggctgttgtccgggagggagtctggccgttcgggtgctggtggattctctagagccgattgcgcttacgctgcccggaaacacctgccaacaaaaggaccatggtgtgtggatgacatgactagtgaggcgtatgtgtcgcagttctctagtgatggttcactgcttgttgctgggtttcgggtaggtgattttgctgctgcagagaataatctaccttgatatgttttcttgtggttctattagtgaaagttgtgcatacagaagtttcagagctaattggtaatgtttctctccacaaaattttgatgataagggaagccgcatcagaatttacgatgccgataacgggtggaaggttcataaggatataagctgccgaagcctgcagtggacggtttcagatattgctctatcacctgatcagcaattacttgtaagtctgtctatgatgcatctaataaacaggactcgatctaagaccttagccctgttgtttggatgaaggaaaatatataggaactgatttgtaattgttacggggaatgataaccatagtggtaacatttatccaatctgaaaaactacttgctatctccatgtagatgctatatagaaaatagaagacatgttgaaaaactattttttctcttttgcatgctgatattggtgaagttcactttttttatgatttgttatttagtttaccattttaaaattcaatgatatatcaattgacaaacaatagccgttgttttatgaataaaattatctccgtggtgaacggtctgttttgcatcgaactgggtgctgacattaatcatttagcactctggatgtttcattttcatgtgtgtgcttgttttccctcaagtctatttgatcctttcacaggcatattccagtttgtcgcctactgttcacatagtgaatgtgcagagttctgcaaaggaatcacaagctaatgttactgtatgttctatactccgaagctttccctatattatactagcttttgaaagcatgagctgcctagctttgttgaattcataaaatgctagtaatgttcttgtaaccagccatgtttcaattgttcgttttctgcaggaaattcatgatggtttggagttttctaatgatgacgatgatgaatattcttttggaatattttctgtgaagttttcaaaggatggtcaagaaattgttgttggcaatagtgatagatctataaatgtttatgatcttagagcaaataaagtgtctgttcgcatccgtgctcatgcggtataaattagctgatttgccatatgctttttggttcaatcagttgtatgactggtttttgccttgttcattccatttcatgacctagctatctcatttataccaatcttctagttttttattttacgcaattgtataacacatttatttgctatcttattttcttctcaattggttctgtaaggctgatgtcaatgcagtcaccttcgctgatgaaagtggtaatctattgtactctggaagtgatgataatctctgtaaggttagtgttcttgttaattgttggaataatgccttcttaatcttgcttcaatatgaaaacgtactctatcaattggaaagaagaactatcacaaactatgtgtataatgagcataacaagagttgaataggtgatggtgaagggtagggtttacggtttggaaatggaataatacagctcctagcatctagatgctagaatgcatttgtgaaggaacagtagtaaatccaataaatagactcttaaaacatccaatcttgtagtcagtgcttgtcctaacaatattttatgatccttaggtgtgggataggcggtgccttgctagagaaaaaccagcaggtgttttgacaggacatttagatgggattacatttattgatagccgtggtgatggacgttatttcatatccaactgcaaggaccaaacgatcaaactttgggatgtgaggaaaatgtccgcttctattaaagggtatagtttttgctctacggccattcattactttcacttctttttcttgcgaggaattacatttacaatgttgatccccatatttattatatatatttctaagactctctatcgcctgttcttgcagccgtcaaccgagattttttgactgggattacagatggatgtcattcccgttggaagctcgacactgtaagcatccaaacgatca

SEQ ID NO: 85689 - DNA, 2740 bp, Oryza sativa
gctactaatatgcataaaaaaacatgaattctttgtttccaggattgcttttatgatttccttaagagcatccaactttgtgataaatagttgaagcttgcttgctcactaattgccttatctgggaggaaggttcaaggccactgatgccaataggcttcgtgctgaatacaacaggctggttgatggattggcacagaggggaaacctgccaagtgagtaccattttttctttcactaattctgtgtcttagactgctcattgtggttggtctttctgggtcagttaatagtttacgataaaatatttcttgttatgtagtatcggatgcttggctcgcgaacccggccttgcctgaggacattctgaaggaggctgtaccaggaaacatcaggagggctgagcattttcttgctgttttgcggaggcttgtcaggttcctagatggacgcctggaaacagagaatgttgagaatgaaatgcctgttgcctttgttgcttcaatccattcccaggctggaattgaccagaaaatgttaaggttttgttatgatcggctacactctctaatgcttaccttggagataaccgatacagatgagttcatgcacatccagacaatttgtgactttgccacattgattggaacttatacacggggcttttctataataatagaaccctatgatgagagaatgcctgatatccgtgatcctgtgattcaggtactcattcttctctatatgacaataatctctaatcttaactgtcatcaaaagtcgtcaaagtgcattattgatatcctaatcaatttctatgtgttgcagctcagttgccatgatgcatcgcttgcaatacagcctgtttttgagcgttttcaaacagtagtcataacttctggtactctcagcccaatagacctctaccctcgccttttgaactttaatcctgttataagcaggagcttcacaatgtctttaacaagggattgcatatgtcccatggtcttgacaagaggaaggtatggaccgggccttcaaaatttcatgtggcatatattattttgaaagcaagcaactaatttatccattgcatgttttaaatactagcatagcatctattgaatctttcttcatcctttagagcatcatcgcatgaacttagtttagtttttgtattgggttttggctctcaaaattctagtcttactggtgatattgcaaaatcttgatgtataacttcaaatattccatcacattttcagtgaccagctacctgtcagtacaaagtttgatatgcgtagcgatcctggcgttgtaaggaattatggtcggctcttgctggagatggcttctgctgtgccagatggcatagtttgtttttttgtcagttactcttatatggatggcattgtcaacagctggaatgagatgggtattttgcaggttagtttctttaccagtacattattctggtatcgagcagtctatagaatataaatctagtgcaaaactcttcatggattatgacattgaatctcgttatgtcaccatataaagtctaacaattgcacaaatgcattgtttcagttggaaaaacttgtagtactgctctggaacagtcacttgtagtactatatatggtgtctaagcctctaatgttcttattacatgtgcagtttattgtactgctaaaaagtgcattgtctgagctgatttcacatgattaatgcttttactgttctcatgaatacagcattcttggcaaagccttgataacacgcaatgcattagcacctaatatgaaaatcttatgacttcaatttgcaggacatcatgcagcataagttggtattcattgaaacaccagatgttgttgagacaacattggctcttgataattacagaaaggcatgtgattgtggaagaggtgctatattcttttccgttgccaggttggttcactttatattggttttgtcggaaagcacccttcaaatttagtgtcagtgttcagcttcgcaattgattggattgcttgagactattacagctattttaacatcgacccaagtaggtgataattatgtcaaaggtgatatataattactggttggccaatggtttctttattcctagtatatccgaaacaacgaagacagtattagtcaaaaataggtgtaattatgtgttaaccaaaataaatgaatgtcctagttggtacagcaattcagtaagtaatttcagaaaatgcttcaatcaggcatccaccaatatttcattgatgtgtaaacatgaggaactcatacgttgagtttttaagtttatttcttgcaaaaaaaattatcttgtccctgaatgctcaaataaattgctgccattagctcatcatctggctgatcaataggctacaataagcataacccagtaggcaccacgagctaatttaccatcattacagtatattgtagattggctacttctgttcaagtgttattattataaatgtttaagtggtcttgactcatggctacataatatgatggacatatgactcatagctaactaccactatgctcaatccaggggcaaagtagccgaaggtattgattttgatcgacactatggcagacttgtgatcatgtttggtgttcctttccagtacacactcagcaggtgaggacttattgtctgaacttaagatccatttttttgtgcaacccttgatctctatacctga

SEQ ID NO: 85690 - DNA, 4088 bp, Oryza sativa
gtactgatgagtatgtagaatacatgtcaagagttccatattctagtgttgttggttatttgatgtatgtcatggtttgctcccatccggatttatctcatgctatgagtttagttagtagatacatggctaatcctgttaaagaacactggaaagctgttcagtggattttcaggtacctcagaggcacagctgatgcttgcttgaagtttggcaagactgataagggacttattggctatgtggattcagattttgctgctgatttggataagagaaggacactcacaggttatgtatttactattggtagttgtgctgtgagttggaagacaacattgtagcctgttgttgcccagtctaccactgaagcagaatacatggctattgctgaaacatgtaaagaaccagtttggctaaaaggattgtttgctgagctttgtggagatgattcttgcattaacttgttttgtgacagtcaaagtgccatatacctcactaaagatcatgagaggacaaagcacattgatatcaagtaccattatgttcgcgatgtagtcgcgcaaggtaagctaaaggtatacaagataagcactcatgataatcctgctgatatgatgataaagcatgttcctgttgctaagtttgagttttgctcaagcttagttggtatagtggtttagcccaagaggccatttggcgctgaaagtgttttttgcttttgttgtgaaggattgattcatgctataagaaggaatttgtcttaaggtggagtttgttgagttgtgatccaaattcatttgcacttaataaagaccagcttctgccggagcgaagtggaagccttgccgaaggccccgtggtacggatcgtaataccttttagggtttcacctcatatatataactcttgtaagccgccgtgtggcgttgtaacctcaccccgatatagtgaagatattttgctggctggcgcccgtgttttttctctcctgctttgggagggttttccatattaaatctcgtgtcttttgtgattgatctattgttatttatcgtttgtttgcctatctttttctaacatgatttggatttttttttcttttgatattttccttctgccacttgagttaaatttgattttagagattggagtttttttttcatacccttctgccacttgatttggattattttttcatttgatattttccttctgccacttgagttaaatttgattttagagtttggagtttttttttaatgccacgtgagttgaatgagttttttttccctcctgcgcttgagttaaatttgagttcttttcatttcattttgagtgtttttttttgtctgttttgagttcttttttcatgccacttgagttgtatttgagttttttttccatcttgagagagttagtttcagtttttcatttcattttgagttttttttcgtttcaaaagaaaataaaaatcgtccaagaaaacatcccttacaattcgagttgcgagaagtaaaaaatcgtcgttaagccaattcatatcctggcaacactcgcacacggtacagcacacgtcgatcggatcactgtttctaagaaagaaaagagcagatgtatcaattgaaacgcccgagcagtcaggagtaacgtgcaaaaaggtcgtacacatctccacccttctaccaaaaggtccaaaaccccagaaccaacctgattacccatttggatccacagtatcaatacgatcaaacactcgctcctttttttttctctgtttatcagacaagtttaatcgatcatctcttgatctaagcacaacataatttattgttcacacacctataaatttaattaatcacaacacggttcgcttacaaacattcatcacgctctacaacgagcgacgggataaagcctcaaagctccccgtccaatctaacttcgacaaccttgtatagctgcgctgtgcaaagcagcgtcccacactggggacatggtgtacagtcattacaaccttcttactcctgagtaaacaatgaactaatcatgtacactaaagttacaggtaaaccacccaaagtacatacaactcgattatttgctcatcattccattctgtcctttaaaattggtgtagatgagagggaccgggaagcacatagcttcgcttacgatttgaagctctgaacggttgtgtagcttccaaccgaggagatgaagtcatatcaactacactgaacactgaagcgtcacaatgaactaatcaccagatgaacaccttcgacaaacagggggcctgtgatgtgatgctcggctgcaggttgtttggatgtataatgtatgtaccttgtgactggtaaagagatttccgtcaagaaacatggatcaagaagctggaggtggttcaacgatgtatcatatataagcaagagaatttctgtcactagcagactgtggccgtcctctagttggtgtaggtggccgttgtatgttaagttcctgcatatgatcagaaattgtgcaaacaaatcattaaatgagccatacattcagagcctaatgttgagtttttttagatgaatcagaacctaatgctgttgataaaaagttgttgctcacaatcaagttgtgccttgccttatctcactagagaaatgagaagaaagaaatactcattctaacctgcatccatgtggcgtccatggcacgttctggggaagactctggagaattaactggtggaggaagtggatgaattaactttggaacaataactagtcccctgcccaccacaagtatggccccagcgttgtttgcagtacctggtgcacgcatggtcttagcaaaaaacttggttgcatacttgcataggtaacaaaggaagttagaggagacataccacaatagttagtggctgaaaataaagttatcaattgcccatgagcaaaacgctcaaacccatccataacacactcatgagctcttatgattagttgcaatctgtttcgtttacagaattcagtcactcgatcaggctgcaaagtagacaggaaaaagtttaacaagcagattacagtatgatttatttcataaaaaaagaagcatgtgtagtttaatttgatgttgctagcactcaaacttaaaaggaaaacaacgagcatagtaggagagctcaattatcatatcataccccaaatgtcaccaagccaggccctcgtgcatttggtctcaaaccctccacactatcattttctgtaggatcggacctgtatttatacaaggaaagtactcatgaattgtcatatacagatgaatgtagaagacaacaaaataagaataggtaccataaaaggtccatgagaataatagatccaacatccattgtgataggccgttcaagtttctcgatttgctcgatagtgtttattgaccttccaatgccaccatgcatgcaaattattttcttttctatcatggcagcaagtgggagataattaaacagttgattgaatcttgtccaagcccatatgccatcactttcaccctgcataagagttaagacaattaccacatcaaaaaacttctatagttcaaatatgtattaagtattataataactaccattctctctatgcattcaaggcggaacccaaaaagtgcattgatgtcagcagcctcgtgatttcccctaatcaagtggacgttttcagggtactctatctgcaggatatgttttcaatggctcagaaataacttcatgacaatagtgttgtggcaatcaatgtatttcaattaccagaaataaagactcactttaagagcaagaagcaatgttattgtttccaagctgtgctgacctcggtcaacatagtctcccaagaagagataatcaatatacctaagaaaaatagaaacaggtgtttagacaaagaaaagcacgtgttcaaagtatttggaaggatataacaacagaaaaaaatggatatatttggaaacatctagtacactctagtagctttgaaaacaaaatatgattaaaaagttcagcagcaactaacgttatatcaccagcagctgatggataa

SEQ ID NO: 85691 - DNA, 5028 bp, Oryza sativa
  unsure (1)..(5028): unsure at all n locations
ttcattagaacgcaggaactcttgtagcgttaaacaagatgagtatggaacctgaaaccagaagctatctcgtgcctgttatttgtagtgggagaatctgaattaaaattgtggtttctattttgattttctgcccttgggactctgtcgtacatagatgaagtaaattctgattggataggtgcattatcagcaacaagaaaatcgtcgaggagaatatctgtttgaaaagaacatatattagattttcaacagcatgaatttggagatatatcaatcatcacaccaaaaagtaaaacttggaataatccacagttgacactgaaatataacaatgcagagtaacggaaatgaaaagcatgccattttcccatctactcatcagttgcttacaaaaactttgtggccttgatataaataggaaattctatcattatctaatatctgtaccttgctaaaacgctgaatagttaaatggaatatttcaattctgttagaaaattgccagactacaaatttgattgtctaaacatgtgtggattgtctacactaaacacatcgaggtgacaactgccaaccccactacattgagaaacaaatattaagtatagtaatgccatctagtgacagcaaaaggaaaaatacagttcagacaacaatggtcacagtattgtttgaaaaggtttctccaattctcagatggacaaatacaaaatgaggcagccaatcacgaaatgggcatccaaaaccagttacctcccctcagaccaccataaatgtatatctgcgttccaacagaagcagctgcatgacgacaacggcgaagtagatccgaagaagcatcatggtcatgtgaagacttcaatgtgcgagaggtcacaatgccatttctatccaaccaaactccagcagcagtgtccagaacttcagaaagtgtggtatggttgagtccaagagagtagaaataagcatatgaaagctgtgggaacaaaaggaggtaaactcacctgctattgcaccctctccctcaatggctctccctcctctaaggactccaccagtaacatgcaaccgagcaccaacaaagacctaaaacatatgaccacgagccatcaatataagaaaagcagaatattgtatgtgcttgagtgcagaaattagatcaataaatatgaggcaagattttaaagaaagaaagtcattgctgaaaccaaccaaccaggagaacccgttaacaccatctgagcaccaattcatcatcaacaaataaagaaattcagctctcatgtatggttaacttacagctgcatgctgatatcttggagatggagatacccctggagctagtgtccactcccactggccacttgtatgcattagtagtccataagcatcagaaagtggctgcacatacattgcacgtatcataaattaatctcaacataaaattatttaatgacacaaacctaatgttcaaccagcatcttataataataaaactacttcctccgtcccaaaatataaacatttttagctatgaatctggacaactgtgtgtctagattcatagccaaaagttgctatattttggaacggaagtagtagataacttgattggcatgataaagcaatcctaattttagtacaagtcccactgcctataaaatatgcataacagtacaacacattaaaaatgctaaaacaccatgcttaagaaacttgctatatacttgatgcagaacccctcgaagataagagagagagagagagagagagtatgttttttttcatcctagtgatattatccataacaaacagtgattcaattccattaactatatttaaagatttcatctctttagttatgctcgtttgctatctttaaatgcttgccttccaaagttccaacttccaaagatagataattaggaagagagcattgataattagcatattaaatgtgtaggagctatcctaagaatatattaatccattactacctccgtcccaaaatgttgctaactaggatgggatttgacccatcctagacaacgaatctgaataaaacctctgtccagattcgttgtctggtttagggtttaggtagcaacattttgggacagaggaagtactaaataatgaatggatgttctcagccaccagaactcatgcattacataaagccatcgatgatcttcattcaccatatatgcatatgaggttcttgcactagcagaccatagttaaacaatgacacataacatcatataaaaacataatatgacattatgctaaggagaatattttagagctaacaaacagntaacaaaagcatagactaccatcccagaagcatcccttccaccgcaaagtaaaagcatgccatcggtgcgtgcactggcagtagcatacctacagtgatttagaatgaaacaaagtaagacattgcacgtttatacaaacagtgtaaattaatgcaatggctacacctaagaaacttgtgaagtgctagtttcattttacataaaagcatgctgaattaagtgctacatgctgtaatttacaatgccatttatgctgtgagtttcatccagatacatcatactatttatttgtacgctgtcagaacaattaccatagtgttatgtgcagaactcaacattgttactacggttataaaacagtacttttatgctctatctttatccctctcactaaatttcacaagtaattaagcgttattattagtggaatagtggcaggccaaaaatcggacccttgattagctttaaaaatattgattttcattttttatagcatagaagaattacgtgaaactgaaaagcaaacccagacaagcctgtaaaaagacaaaataccagattgtatgcataatacaggctcgtctatacagttatttttccttcttttctttaatgtaagagtgcttgcaaatatagctagaaaacaaggctaacaaagattcaacagtttccaacatggagtaatattggaagatgagaccgtttgcagtttgtccaagaaagtcaaatacaacaaatacatagtaggttgccaatctactaaaaaggaggtcaggttgaccactcgcaaggggctggatagaagaaaataaacaaatatgtagtaacaatgaaaagtgaattgatctgatgcagtgaagctctctaaagtagtggactgactcacattctcgctgaaggtctatcgccatcagggttaagtttctgccacctatatggtttctgtgctgtgtccagagcccaagcatccgataagactcgctttcctgtaccaaaagaaacattatttgacaagtccgacaactattaaaagttattccaaaacatgctagcgaaatccttttagaaggcaataaataagcaacccatgtgaaatcttctaatgggttgagaacttcaggctacttaaaaagttggctgaactataaatctataacaataatagacaagttatctatagttttgttactgaatacggatagccaaggtactgaaatgtccatatatatttgcagtgaaagcgtttttgtaccaaagaaactgttctagttccatgttttctttttataaattgaacaagtgcgagtgaaattcaggccatatttcctcttccacttgggtgcatgcacttttgttagaaactgtccttgtttagggaacaagttatatagatatgtttaataaatactctattgtggagagccctaactggcaggcagttaaaacttataagcaggtatattcattagagtgttacaacttgccagtcaaaacaaaatggacttccataaatagtaaggaggtggaacgccataaaaattattatggaaatacaattcactgatttggagaatttagcatcgaagggctaaccatcatttccagagacagttacaagataacgttgggctaccagatccatacagtgaccatagcgaggaccaggcccagccccctgaacaacaaccctgcatccaatggcagaaatgtagacatcacatatccatccaatgataagcccaaaaagggcaaatgcatccgcaaacaaaaaggctggtgtctttaacattcacctgtgccatttaaacttgtcgtttgtcaggtcaagaacatagagatcatctgtcgagtgccccgctggtccaataccaccctatgcaaacattgcatcactcacaattaattaattagaagtaagtagacaggtaccgaacaaaaaatcgaagatcccaagttccaaatacctggaaaacaaccatcgttcctacggcagctgcagcatgtgcagccctcggcgatggaggctctccagctggatgcaatctgcgtcattaagaattgaacttaaaccctgattatttgaacccataatcccattccttcccttaacggccaagttaagcaaattagttgaatgggtggaatgcatttctcatcctaaacgcacgacagcacaaatataagacaatgatttcatcaccatgtataccataaccctaaaagactatataacacagaatatacgaaattgaacctcaaataaactccaagggatgaggagacctggaaattgagctaaaccctagatttctgagcagccatatgaaacaaaatctaaacgcgagcagcgcccgtacctcgtccacctgcgcgtgtccacatcatacgagtgcaccgagttcgtcacccccgcgagcccttcaagcagagagaccccaaaacccccaaaccattagagcaccaccacatcacatcacaaggggagatagagagaggagaaaagctcaagcaaacacgacgcgcgcgagacttcaaaaaaaaaaaaagagcaccgtactgatgcccggcatgcctgaggatgcgccggcctcgatggcggtggcgccgccgaagaggatgagccgcgggccgtgccccttggtgggcgcgaccaccgtcagcgagtggccgcacctgaaccccggcgagtcgtcccccgccccct

SEQ ID NO: 85692 - DNA, 710 bp, Oryza sativa
gattatgataggtatttaagtgtaaacagaggattgcaaaacacaggaatggtcgtttgattggagcgcaggaaaaacacaggaatcggataagagagatgaactcaaaggaaattttccaagaggttgaagctcttgctatatttcctccaaaatccacatgcaatgtgccattccataggaatttcataggatttaaaaatcttcaatcttttaaatcaaagggccaaataggaaaattttctataggatttaaatcctataaaattcctacctaaatcctttgattcaaagggagctattttttttctcccttcttttagatgtgataggctgatagccattgattagaataggatcacatggatcctagtactcagattgtcagatgggcaagtttgctggaccagccaggaaggacagtgctctgtttgtggttccacaattctagtacttctgatttttttagaaaataaaataaaagataaaataacaagaaaaagggagaaaagaagtactcctacttgtagtgcactgcacgaaattgcaacatctagatgtatagtgtgtagtcaaggatgaacatgccaactagtagcaaggaaggaatctttgcatttgcacctgtttctgatgacatatgcatgtgaaaactggagtgtgtgtctagctatacatgaataacagatactaccatttttctcccgtca

SEQ ID NO: 85693 - DNA, 803 bp, Oryza sativa
gtatgaaaatttttagtgcaaaccgaaggtatcaaaatttacgctagaaaatatagtaccttccagtacgtccttaaggattgtaaaatcactcaaagaaataaagtgatgcggtaattggggtgtgccaatctttcggtgagttgcagaaaaccctaattaatgcattcttgcttccaatagcacaaaaccccccttatcccctctctctagttgtcatgctcatgcttggtcgccggcgccgtgaacgtctggtaggtcacggtgccggcgccggggaagacctcggcggcgcggcaatggcacgccaggccaagcggctccagggcttcggccaccggcgtgcagagcgacgacgcggcgctggaggtgtgggagatggagaccgagacggtggccgggcggaacgcggcgacggcgcggcggatggcggcgagcgcggcggcggcgtcgtcggtggcgcactcgaagctggcgtagcagtggccgtcctccggcgtgacgtgcacggtggcgtagcgcgcgccgtcgagcgcgttcatggagtagccgcacggcgcgaacgcgtaggcgcacaccagggagcgcgggtcattctcgtccaccacgccgccgatccccgacgccgccgtcatctcgtcgccgatggcgtggctggtccggccgtcgccggggcgctggtagaaccgcgcggccatgccgcggtccagctccgtcatgcacacctccgccgtgagccgcgccgcgccatccgcgtcggatgacgacgccgacgacgacgccgagtagacgtgccacctgtg

SEQ ID NO: 85694 - DNA, 577 bp, Oryza sativa
caagtctttgatttcttaaaagcttttatcaagctttgttgagcctaaaacccaaagaagctattaaaaactttcagtcctcgcagactaagtagaaaaaatcaaacaaggcaatgatagaccaagtaagcaaattaaattgataaaaaatcacactccattattatgataatagcccccgactgacaacggcaagaagaaaacttgatgttgacagtcaagatagggaagtacaatgataaacttaagcgtagaaacgccgaagatgttcaatgttccaagagttgtcgacaagagtaccgtcttcgcgcttgagtcgataagaacctggccgggtgacttcagagataataaatggcccttcccatagaggagataacttgtgccgatctcgtgtagtttgaattttcctcaaaaccaggtcaccgactaaaaaggcacgagatcgaacgttgcgattatgatagcgccgcaacccttgtaaatatcgagccgactgaatcaaagctgcttcgcgggcttcttctaatcggtgcaagtcatccacccggtcctcttcgtagcgttcttcacggaa

SEQ ID NO: 85695 - DNA, 552 bp, Oryza sativa
ctggagttgaaattacacaagtaaatatttcttatctttatttgctttcattgtcaatgttcaattttgtaccatttaacccttgtcgatgctcactattgtttcatcaccttctacttgtctaggtatgacagggtgagaacaaagaaggtgaaagactgggggctagagcataatagatacattgatgaatggaggacagccggaaggaacgacaggtacatcgagactatacaccaaaatcatcttttatcagagtaccttcgttggctgcataggacatatagactgttcctccgccctacttggacggaagccgacatagaggatgaccgcgactccgatgaggggcggaatccctatgatgtccggactagagttggatatcaaatggagcacgccccacttagagacagagtcgtaagttttcttgcatttgtcaaagttatttccatttgcaccctagaccctaacatatatcttgtcacgctttcagtcgagagagctcctcaggagtgtgaatgaaatggggcatgccctccaagctccgag

SEQ ID NO: 85696 - DNA, 1222 bp, Oryza sativa
cccagagggggaaacttcagggcgtgacaatgtcgctcccgccatcgctgtttggcgctaccgcgcgagcagccgcgcgaacttcgccgccgctcggccatgcgtcgccgacagctcctctcgacgttttccccactgtcgctctcccagagaccccttcaacccccctcctttggccgccccgcctctttcctctagccgccggcctcccatccccttctatcgccgccgctctgcttccgccgctgccgcgcacaaccgcgcgccgtcgtcggccattccccgtcgattcctctcgcctccgccctcttggagctcccgtggccctccccgaaccgccgccttgaccgccggccttccttctcgtgcccgcgccgtgccacccatcccgccgccgcacggctgtcgtcgccggccgccgtcgcgccgcctccccatcatccgagccggtggatggaaccgcctcgaccccctctcgcctccagtgcccgcatccccctccgatttgccgccgctcgccggaacccgtcggctgccgtgcaccgtccgatctccgggcgcgctcccctcccctctcgtcatgccagcgtggacgccacctcagcccccgggcccgcttgaccgagtcaagccggcgcccagtcagcctcccccttcatccctttcccccgtgcgcgcggtccatggcgagcccaatggctacgcgtgggtccgccgctatcccgtccaaccggtgcacaccatgtgagccgcatccaccgattcaaggcaacgcgtcccgcgtgcgcccattcttccgtggaccgtctcaccgacaagcgggccccactcgggaccccgcgaagtgaacttggtccaccggaccgcctctctctccccacccgggctctaatgggccaatctcctttgggccacaccaatgccacccgaaacaagtctaatatatatccctccttgatttcctttccacccttgttccataaatcattttcctatattccaaaattccatgaatcattttccttggtcccgcatgtcaatgactgtcaataatattcttgagaatattatttctataaatttcaaaaatcaatttccccttgttccacaaaatatcttcccttgtccagaaattccaattaatcttccaaaattcatatctcgcgtaattccgattgactccgttccacttccagtttttctctaaaattgagatctattt

SEQ ID NO: 85697 - DNA, 517 bp, Oryza sativa
ttattaaatttacctagctatccacaggctgatcaatctggtcgtgcgggaagcaagcagcccgtaagaaacgcggcatgctttaaaaaaaatatatggaaaaatcggagcgacggagccttcgatactcaccgagacgaacgccgggtagaagacgacctgcgcgcggcccccgaggacgtcgacggcggcgtcgtggatgccctggagccgcttgacggccttctccaccgagcccgcgcacgcggcgcacgtcatcccggacacctcgaacaccgccaccttctcctcctcctccgcccccacggccgccgcctccagatcgccgtcgcctcctcctcctcctccttcccctccctctccggcgaccgcggcgtagcaatgtttgtgcaccaacatggctaagccacatcccacgtgcgtgggaggctgggcagctcagcacgactgcacgaggttggctcagcccgcactgtccacgcatagtgatgggtaccgagctcgaattcgccctata

SEQ ID NO: 85698 - DNA, 1189 bp, Oryza sativa
accctcagtcggatggccagactgagagggttaatcagtgcctggagatttatctcagatgttttacacatgcaactccttctaagtgggcagtgtggcttcatttagctgaattctggtataatactgcattccactcagcactgaatacatctccctttgaagttctatatggccacccacccaggtattttggaattcattcagaggattgtgctattcctgaactacaagtttggctcaaggagcgtagactgatgcattcattgattcagcagcaccttaaccgagcccagcaacacatgaaaaatatggctgacaagaaacgcagtttcagatcttttgaattgggtgactgggtttatattaagttacagccctatgttcagtcttctgtcgcagctagggctaatcataagcttgcattcagatattttggccctttccaagttattcagaagtttggctctgtggcatacaagctccaacttcccactactagttctatccaccctgtgttccatgtgtcccagcttaaggcagccaagggtttccaaggagcattgcactccactctgccttcttctgatgatgctttccagtatcctatcatgctcctggataaccggctgattaagaaaggtaacaccaccgtttcccaggttttaatacagtggtctgatactgcagttgaagatgccacctgggaggaccttgaggatctccgggcgcgttttcctgaagctttggcttgggggcaagccactttccaaggggaagggattgtcaaggcgtcaggcgaggaggagccgagtgcaagcgccaagctgaagatgaagcctgtgccggatggtgagcaggaaggaggagaagaagacttgaggccggccagagtcattaggcctaatcgtaaatatgttgggccggaatgggccatgtaacctgtatcgctggcatgagctggcatctgtcttgtgagaggggaaggaagggagttggtagcgagagagagtataagaactgaggtttctaaattgtaagggacttttggcaatctggtggcgaatggcggcggcggctcaaccctgttgggttggagcaagattatcctagcaaaagattgcctaaacacatctctgttcttcctgagttgttcgaagttcttcccttttccttttcaatttcctta

SEQ ID NO: 85699 - DNA, 649 bp, Oryza sativa
cccttagatgaatttcagcagctacaagttgaattgaatgagttacaacttcaaatacaaagggagatccttagtctgtcatatggaacagccgtgtttgttcctcagaattttcacgggctgaattttgtgaatcattctccccctagtcaccatttggctctggaaaactaaatgtgtcgtcaagaacaaagtatttatgtggctgatgttgtatgatcgattgaataccggagacacgttggacaaaatcacaaaaaactattgtgctctagaatgcagatctaccttgtgttctttgcttactggttctagggagacaacaatgcatcccttcttcgatcatgtgtcgagaccgtattagagtaagatggaatgctaatcttgagtttttccaaatggtggtcttggcacgaccgaggtttaagcaaaagagtttcttggatataatgttcatagcttgctggcatatattgaagcaatgaaatgaaataatctttcaaaaattgttaccagaagaagacaatttgttccattcttttaacaatgaaattctcttgcatatgtgcaagatgaataagccccttaatttagtcatttttgactgattacaacatttacaataattattttgatgtgatactcttgc

SEQ ID NO: 85700 - DNA, 643 bp, Oryza sativa
aggtgcaacgaaacctctactgacaatttccaaatttaatctttcaaattccttgcataacttcaatggcaactgtcgtccttccgtagcattgcaatagcctttcctgtgagagcatctgctacaacattggcctttcctgggtgataatgaattcccatatcatagtccttaatcagttccaaccatctctgttgtctcatgtttagatccgactagataaaaatatacttcaaacttttgtgatcagtgtacacctccgtacgagtaccaaaaagatagtgacgccaaatcttcaacgcatgaaccactgcagctaactcaagatcatgagtagggtagttcttctcatgcggacgtaactaacgagatgcataggcaaccaccttcccatcttgcatcagaacacaacctaacccaagcttagatgcatcacaatacacttggaaacccttcttaggatcatgcaaaatcaaaatgggagctgatattaagcgacttttcaactcttgaaaactctgctcgcactcttctgaccacttgtactttacatctttctgaagcagtcgtgtcatgggcttggcaatcttggaaaaattctctatgaacctccggtaataacctgggagacccagaaaactac

SEQ ID NO: 85701 - DNA, 631 bp, Oryza sativa
caagatgggtaagagaaaacttgcttttgggatagaagaaaagacggtcgcaatgagcgtgggacgaacctgcgagggggtcggttaaatgaccaccttggaggggaaattaggtttccccgggatggttctgtctcccccatcttgcgcagccgcttcttcttgcgctccccctcgggctgcgatgttggcgcggccccctccgggcgcctgctgctggcacgcaccgccccgccccctcggggaggagatcttttgcagttttgtttagttgcaagaaaatttggatttggtttgttttgaaaacatttccaaaaatccggtgcctgaaaaccgcgtggagttccgataagttacccccgaattatcccggtcggttacgcggagtggagatcgtgccggcaccctgatcaagcgacctatctttatataaaccgagccaccgccttcacgcaaaacacatgaaatcaatctagggtttgcctcctcctctgtgttgcgtcgtcgctcgtggactactccatcccgctcgtcagtgtgcaccggcgatcggagagcaggtctccggaacctctgcctttcgacgtcctgcacctggagaaggcggcgataaggtttttgggaagcgctt

SEQ ID NO: 85702 - DNA, 611 bp, Oryza sativa
ctgcacgccgaagcaaccacttcatgttgtgagccgattgatgagtaccatagatcccttcgggaactccgccgattgcaaccttatcctgatcggcactcaagcacttaagtaataccccatcaatcgcccgataataaagctcatcattcaataacggatactgtaatgccttatatgttaatttcctagaagccgatcgagataggattacttaaatactgatgcacatcatacctgctatcatcggctgacactgatgcaatttgaactttaacatctatgatcatcggcttataccccgatgccccttgagccaaatcattaccttcaaaatattgatctcgagatacatgcttcaaagctaccagtcgaaaccctttcattagttccaggcacttctcattataaaccatcaatgtatcgtacttgcattcatatgaccctgccaattggctgattactagcaaggaatcccccatgatttcaatggtatcggctacaacttccttgagtaattgcaaccccttgagcactgcttcatactcagcctgattattgggcgcatatggtttaatagtataagcaaactcgaaacatgcccccctagg

SEQ ID NO: 85703 - DNA, 696 bp, Oryza sativa
ggagggaatgatacgcagctggagggacactatgattacggtagctagcatgcctgcaaggcggatactacatgatgccctatgaacaaatggtttcgcgaaaaatcaattattttgacaacaggatgtgcgaactcgaagtttgacacgactctctttaccaattctgccccgaattacacttaaaacgactcagcagcttaacgttggctagccacgcattacttgactgtaaaactctcacttttaccgaacttggccgtaacctgcctaccagagcgagaacaaaacataacatcagacgaatcgaccgattggtgaggaatcgtaacctccacagagagcgactcgctgtataccgttggcatgctagctatatctgtgcgggcaatacgatgcccattgtacttgttgactggtctgatattcgcgagcaaaaacgacttatggtattgtgagctacagtcgcactacacggtcgttctgttactctttatgagaaagcgtgcccgcttacagagcaatgttcatagaaagctcatgacctatttctagccgaccttgcgagcattctaccgagtaacaccacaccgctcattgtcagtgatgctggctttaaagtgccatggtataaatccgctgagaagctgggttggtactggttaaggcgagtaacaggaaaagtgcaatatgcag

SEQ ID NO: 85704 - DNA, 2725 bp, Oryza sativa
tgccagagtacgaggggctccttgccggactcagagtggcagggggactggggatccgccgtctcttggtgttaggcgactcccagctagtcgttaaccaagtctgtaaggagtaccggtgctctgacccgcaaatggacgcttacgtacgccaagtgcggtgtatggagcgccattttgacgggatagagcttcggcatgtgcccagacgggataacatgattaccgacgaactctcacggctcgcgtcctcgcgagcccagaccccaccgggcacctttgaagaaaggcttacccagccgtcggcgcgacccgaccccctaggggagacggatgtgcctgaccggcccccgaggtccgtcggagtccaggcctcgggacccgaagggagcgctgcaagctcccttagattgattgcttggatctccgagatccaagcatacctcacagataagactctacctgaggaccgcgaagggagtgaacgcgtccaacgcatttccaaacgctacgtgctggtagaagggatcctctatcggcgcgcggctaatggaatcctcctgaagtgcattcctcaggaacaaggcgttgagcttcttgccgatatccatgaaggcgagtgcggagcccattccgcctcgcgcaccttggttggcaaggcctttcgtcaagggttctattggccgacagctctcaatgatgcagttgatctggtccggcgatgcagagcgtgtcagtttcacgccaagcaaatccatcagccggcccaggccctgcagatcataccactttcgtggccatttgctgtctgggggctcgatatcctgggaccgtttaagcgggccccgggcgggtttgagtatctgtatgtcgcgatcgacaagttcactaagtagcccgaggcttatccggtcgtcaagatcgataagcactctgcacttaaatttattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcatggcgattcatggatcgaggagttaccagcggtgctctgggcgaaccgaaccacaccaagccgagcaaccggggaaacgcctttcttcctcgtctacggcgcggaagcggttctcccatccgagctcaccctgaggtctcctcgggctaccatgtactgcgaggttgatcaagatcagcttcgtagagatgacctcgactacttggaagaacgaaggcggcgtgcggccctccgagctgcacgctaccagcagagcctgcggcgttaccatcagcgccacgtccgggcccgatcactctgcgttgacgacctcgtcttacgccgcgttcaaacgcgtgctggattgagcaagctctcaccaatgtgggagggtccgtatcgagtgatcggtatcccccggccgggctccatacggctggccacgggcgacggcacagagttgcctaacccttggaacatcgagcaccttcgtcgcttctacccctgagggggggtcgggtgtcaggtttcgggctcgggtcaaccccgcaccccccctcgggtgtgcagggttgaccgggggctgccacacatgcacattctcatttctctcatttcagtatttcaataaaagcagtttcaatttcctaagggctgtatctgtgccgtttttttttcctttttgaagaattttgacttgaaataaggtcactcgtgctcaaccttgccctcgggggctcggttcggtcagctaaaatcgccaaacggggcccagaaccgagccgtgcccggggcgtggtgaactccgggggggaatcggcaaaaacccacaatcgggtcacccataaccctcggtcaccacgttcccggcctggccagtctcgacatgcggatctccccaggcactagtcccgacccgcgcttttcgaggactgggacttgggcacgggcccttaaatcaagctaagacacaaaaagaggatcacggcacagatcatcctcatctcattcgcatagcaaaataaaattaacacaaagaattttttcatcatttttgattgcagattgtaagttgatttatacaaaaaacaggcccgagggccttagaagaaagaaaaagaagaaaattgaagattggcgggggcctgggggctcaatccgatgcgcccgggtcgccggcctcgtcttccacgtcgtctgcaccgctggcatcgccctcctcgtcggagttgggggcgaacgcgagccgaggggccgacccctcgaaactgtggacgatgtggtcggcggcatcccggacccgcgcgcgcgcgtcgtcctcggtcccgggagggaactcttccagcgccatccatggagagaagttggggtccctggcctggtaactcgctagtacgagttcaaccgctccttgggcgaggtccctcgaggatgacttgatggtcttctcgagctcctcggggagttgttgaagagcccaggccatcttcgtgaggtgcggagcgaggccttccaggttggtggagtgcgtccttgtctggcctttccagaggcccgcttgctggccggcgcgatcca

SEQ ID NO: 85705 - DNA, 659 bp, Oryza sativa
attgagcgtctgcatagcgatgtcattgctggccgtaagcggctgcaagtcgccgccacctgtgcaaagtcaacgaccggagccagcagcatgggcgatggagaaagcccaagacttacagcagatgctgaactcaattattaccgtctccgaagtggaatcgacaggataaccgcgcaggttaactacctgcaggaatacatcaggacgcaatgcctgaaataatttttttgcaaatcacaaagtcaatttaatgagcctcgcgatgcggggcttttttatgtccgcagtaaacgcgcatctcacgcgcatattaacgagagcctttcagtaagcgagcctgagaaatgccgttataggtggcgacctctctcgggcggcttttctgtgagacaggctcactttctaaaaggtaaagacgctatgaataatccgtcagttattccggccttcgacttccgcgaaatggtcacgaccctcgacaacaagataatcaccacatcactcaaggtggcggattactttggcaagcgacacaaagacgttttgcgtgccatacgtaacctgaaatgctccgatgacttcacccagcgcaattttgcgcccattgatttcattgataaaaatggcgatgttcagcctatgtataacatcacccg

SEQ ID NO: 85706 - DNA, 3061 bp, Oryza sativa
tagtatgctaatggctatttctcagcaagccttatggggaactgaatccaatagatcagtcaggttaaggggatgggtgcaaggacctgaactgcttatgctaatagatctaagatagtcacattcttttattgatctaggtgtgggaaagaagttgccaggaatctctcctttgcctaagccggtcactgttaaggttgcagatgggggaaccatgagttgtacacatgaaatcgttgattgcagctggtggatgcaaggacacaattttaaaaacactttcaaactattgcaattgggaagttatgatgtgattttgggtatggattggttagaaagattcagccccatgcaagtagactgggttaacaaatggatggatgttgaactatctggtaaaattgtgagattatttggcattactccacatacaacaacctgttgtcctattacctctgaccagttggaaggaatggctaaatgtggctcaatactttgcttagtgcaattagcttcagttttacagactaccactgatccaattccggcatcagtacagcaaatcattcaggaattttcatctgtctttgaagaaccaaagggcttacctcccaaaagagcctgtgaccacagcattcctctaattcctgatgctaagccagtgaatctgaggccttatagatacaaccctgcattgaaggatgagattgaagcccaagtggccgaaatgctacagtcaggggtaatacagcacagtcagagtgccttctcttcgccagccttgctagtacgaaagaaggatggaacttggaggttagtgattgactaccgacaactaaatgccattacagtcaagagcacatacccaatgccagtcattgatgaactattggatgagttatcaggagcaaaatggttctccaagcttgacttgagagctggttatcaccaaatcaggatgaaggcaggtgaagagtataaaacagcattccaaacccacactggacactatgagtataaggtaatgtcctttggtctcactggggctcctgctacatttcaaggagcaatgaatgccacattgcaatctgtgctcaggaagtttgctctagtgttctttgatgatatattaatctatagtcctgatcttgagtcccatttggatcacatcaaacaagtactatccctgttgcaaagacaccaatggcaagttaaattgtccaaatgctcatttgctcaacagcaattaacctacttgggtcatataattagtggagcaggagtatcaactgatcccagtaaggttcaggaggtggtggattgggccattcctactactcctaaaaagctcagagggtgccttggattggctggctattacagaaagtttgttaaggggtttggcattatcagtaaaccacttactcaactattaaggaagggggttccctacaaatggtctgccgagactgacaaggcattccagacacttaaacaagcactggtaacagctccagtgttagcccttcctgatttcaatcagccgtttacagtagaaacagatgcaagtgattcaggcattggagctgtactgtcacaagggggacacccaattgcttttattagcaaggctttgggtcctcgtaccaaaggactttcaacttatgagaaggaatgcttagcaatattgatggcagtagaacactggagatcttatttgcagattggggagttcactattcttactgaccacaacagccttatgcatctttcagatcaaaggttacatactccatggcaacacaaagcttttaccaaactgcttggattgtcatataagatatgttacagaaaagggagtactaatgcagctgctgatgcactttccaggaaattccaagatgaatctgagttaaacttggtttccagttgtactccaacctggttgttggatgttgctaagggttatgagactgatcaattttcattagatttgctcactgctctagctcttaaaccagatgcaaagcctgggtacaccttgcagtcaggaattataaagtacaagggacgaatctggattggtcagaacagcactatgcaaaatgcgttacttgcagcattccatgccagtcctattggagggcactcaagattcccggttacttatagcaaattgaagaaactttttgcatggcctggaatgaagcaacagactaaacaatttgttcaaacctgccaaatctgtctgcaagctaaaccagacagggcaaaataccctgggttactgcagcccttacctgtgccagaagggtcgtggcaagtggtgacactagattttattgaagggttgccaagatcttcatcttacaattgtatactggtggtggtggataaattttcaaaatatggccatttcttgcccttatcccaccctttcacagcaatagatgtggcaaaaacttttatgctgaacatttataaactacatggtcttccccagactataatctcagacagagataagatctttacaagccaattgtgggagcagctgtttactagatcaggaacacaactgcatctgagcactgcttatcaccctcagtcggatggccagactgagagggttaatcagtgcctggagatttatctcagatgttttacacatgcaactccttctaagtgggcagtgtggcttcatttagctgaattctggtataatactgcattccactcagcactgaatacatctccctttgaagttctatatggccacccacccaggtattttggaattcattcagaggattgtgctattcctgaactacaagtttggctcaaggagcgtagactgatgcattcattgattcagcagcaccttaaccgagcccagcaacacatgaaaaatatggctgacaagaaacgcagtttcagatcttttgaattgggtgactgggtttatattaagttacagccctatgttcagtcttctgtcgcagctagggctaatcataagcttgcattcagatattttggccctttccaagttattcagaag

SEQ ID NO: 85707 - DNA, 618 bp, Oryza sativa
tggcacctatataggtttattatttgaaatgttgagatcaacgaagaagagctcaaaatcggcatggaaggtgttctttgagatatggcgttcaagttttttatattgccagaaaataattttatagcaccttgcagcaaaaggggagaatgtgatacgcataaaattgttttgtaactcctaggttcttatcatggacaaacttacggtgaagattatgtcattttcttgcaagatggcagatgtgatggaagaaggtgtttcatgtaagtatgttttttaccttattaagaagccatcagtgttttactgtttcgttccttacgaaatatttgatgtgtccatactccatttgttcagtttcagtgcatttgaatttatgcggcaatatatgaagtatggctaagaccctacaatagtggtacacggtgaagattgtactgcgaagtttgtcatacagcctaaatcattttagcttatcagtctagggactcttaagtggtcctggtgaagccacgtgaatatctattggtagtttcttgtcccgagatgtcatgaaaatagcttatgccatccttaaataagctttatattatgctagttgcctagttctacaac

SEQ ID NO: 85708 - DNA, 705 bp, Oryza sativa
caaaatagcactgcatgggtacacattcattcactgtgttgaaaggctagcagctgcctcgctatctgttggcatgggaggaggccaacggcctgctggtaaccaggtagccctatcggcaaatggtttgcggatatgacctgtcagcatgtgtttttgccaagaggacctgtctcggtgacggccactccggacacatgtccaccttttcagcacgccacgtgtcgacagggctagtcggcattctgcttgggtatatggcgtgctgagtgagtgctattttagcaaaagaatttgaaacccgatacttacaattttccattaaaaatattactaaaaaagtaaaagaactatttgacgacttatcgagtcattcaaattttattttgttgtgttttgctaatatttgtttgggtgtctattttcttaagaaacttttggcttaaaaaaacttctttgtgccatacattttacttaagttgtttgctttcaattattttaggaatttcctcgtgtgcactatcgtgttgccaggacgattgatgcttctactttgacaacactacgagatttggcacccacaaagcttgctgctggtgtgtggaattgccttgcaagatttaaggctatgatacctgaattccctcagactgaaacatgtgaattacttatcgtagaccgatcaatagatcaggggtgcaggaa

SEQ ID NO: 85709 - DNA, 686 bp, Oryza sativa
aattgaacagaagttgcacatttatgatctctgccccacctttccccacaaacaaaacagagtcccttggatctacgataagctttcaatgaagccaatctgtcatccttggccttggatgcatcgattgcccttttatcttctgtcataaccacagtaggagtcctaggactatgattcactggactgaattgattagttctaggaacctgcctgatgctagaagaagattcagttcttttgctgctcacagtcttgataccctccaatatttcctcttgtaacaaagctatagaacaagctgagtctaaatcttggggcctttgcaacattactgctcccctgatctcatcccttaacccttcaatgaacttttggacaaagtatacaggagttaaggcactgtcataagccataagttggtgcattatgctgtcaaatttttccacatattctgagactgaactggattgttgtgcatgaaaccactgacggattagagcttcctgtctatcacgggtaaatctagcacacaccaattcacagagagtctgccaggtaatccccacaatttgttgcctaattgactgcaaccagaacgctgcattgcccccaaaattgagcgtagctaccttaacccagtgtataggatgaataccatatatgtcaaaatactgctcacaatt

SEQ ID NO: 85710 - DNA, 2615 bp, Oryza sativa
ctacccaaaaagaaaaaagaaagaaagtggccagagttaccaccttccattgaactttttgccacgactgtccacttgaatttgtgaagtgcccaaccaggaggaatgctttgccttgttctaggtttacaactttacatgttaagccactaactgtctttctattttaaggccccattcgtttgcttagtttggaggagcttttcagccgctgtgaaatgagaaagcccattagcacatgattaattaagtattaactattataaacttgaaaaatggatttatttgattttttttaaaaaaaacttttctataaaaagtttttgcaaaaacgcgccatttaatagtttgaaaagtgtgctgatggaaaacaaggaagttgtagtttggagttgaagaaaagaactaggcctgaatttaagatcagtaatatgctgatgcatgctttagcattttaaaagaagacaaaaacatgctcatgtacagtctcacaattcctctaataactttaataaactttcatattgcagaagaagcggcacctggattttcaggtcacacactacagacattcacagttgagaggttgcgtgcacttctgcgacagaggggcctcatgaccaaagggaaaaaggcaagcaaaaattgtcgttccaagttctcttgttctaaatttaagtggtttcatgcttttaattctgtcactagtatatgtatttgaatttttgcttgtagaatttattttagtagaatgtcagctaagatgactggatatccaccatttttgaacgtttggatgattctgtagtgtctgacacctgatattttcctaggaagcttagtcagttacagaatttgtccattagtattccaaatgttccctcaggacttattcgttgcatggcatatggtaggattttgtttctgtagaagcttcataattttttagtgaaagttggctttacaaaataaaatgaatgggatgataagagcctgagctttgtcatgtaactgcagtattgtgcctaatagattattttaagaacaaaatatagaagttcccaaaacaagcttcttctagagatgcttgtgttgtcagtaggctgttgcttttttctttcagtggcagcacattatggtttttgttatatttacactatttgattttgacgccgcggatgtggcattagtaaatgaactttcttgttaataaagcattgacagtcttcattcttgcacattagaaaataacacaggttcccaaataagaattattttcacataattgatcatgcctacattgatctacctaggccataatcttttgtgcgagaagtgtattcaattttttgatgtatgatgtccttcctactgcaggatgaactcatcgctcgcttaagagaatcacaggactgatctagagaaagctcgtgccgtactctctttgtaggttgatgcaatgtgtttcctgatttgctatgtcaagctttgctgggagcagaatgagaaccaggcttcatctgttggctggatgttaaggctctaggagatgtagtcacttaggttgggccttgagaacttgtgcctaattgcattagcttgtcagaaatttgggcttgggttccctgtttgttagggcttatccagtgctttacttggtacatgtagaaggctaatctggcagtgtttgtaaccttttgtctcatactggaggagttaccatgctaatttacaagcatagttaaaagctaatcgtaccatgtttgaccaattgagctatggaagaaagcataggcgtgaacccagctcagaagtgaatggcagatagcaaaaaagaatagacttggaaatggaaaaaaatggagcgaaacaaaggcatacaaattggaaaatcagcaggaaatgtgctgattactcgtatcgattgctttaggaaatatcgcagtcttgagcagataaattctttttgtgtgtgtgatctcaattctacattgtgttaggtgcaaacatcacttctttaacctaatgcttcctgcaactcgagctgttttattgggtggctgcaaattgcaatttactacttatcttccaacttataaccctgaaagaacagcattacagaggccgtttcttcctatgtttgcccctttatttcttactccctccgtttcacaatgtaagtcattctagtatttttcacattcatatatatctatctagattcattaatatcaatattaatgtataaaatgctagaatgacttaaattgtgaaacgaaggaagtatatgctttgctgcgagatagaaaatatggaatacaaaggagcctcagtaaactagaagcaaacagtcgtagagatggtccaaagtagtggtcatctgtcaattgtcatcctctcagattttaaattttttgctgatattttttttctgattttaaatgtcatctgtcaattgtcatcacttataaatcttttgctgattatctttgtattttttttctatgacaaatggaatagtttcaacagaaaattagacaaaagacagtacaatcaaaataaaatgggttttactccctctatcccatattaagttcacttttggttactctcat

SEQ ID NO: 85711 - DNA, 705 bp, Oryza sativa
ttgttaagatcgagtgacatcataacatgaaaaagttagtgaagcataattattaccttatgcttacaataggtttactccaatctgcttccatgtcatcaacgtggccaccaagcatgtcacctatagacagggataggaacatgaaactttgagattatttcctatcatttatatcaatctaaaaggacagtcactgttgaaggagcaaattacatacttgggccataatagttcactatggcggcctctggcttgaattcctctccagatggcatggctggaatggccatcttttttgcaagagcagataggaggtctggaatcttgttatgtggaagtgatacatcatagttgcgctgtagtgacagaaggattttacacaagaagtcattagcatccttggttaagttgtcattaggaagagctaattgtacaacctttgcatatctccgtaatgtcaaaagattgccagtatgcctcaaatttcaagctgaacaagatgatataattatatgatgtaagcactgtgagattattttgacattactttcaggggttgtaatgttcaggcacatagcttgcagaacagccatactaaaataaaattccttaagtccgtagaattggctgtgtatatcccacttgggcatagaggtcagatttttatcaattatttaaaaataacgtatgtgagcatgtctt

SEQ ID NO: 85712 - DNA, 711 bp, Oryza sativa
actgtggtaatccgctttgatattctttttagaaaatcataaggtacaattagaagtccgtattttacctcaagttagcatgcatgtttttttaaagatattccttctacgactccttttgtatttccaaaagaaaataagcttaaaatccaagccaaacgcggatctatatttctaaaagcgaacgaacttaaaaaccgactcaaacacgggtgacgtaccaaaatacagcaaaaacatctttaatttttataatagtagagaaatgcagtctaataacgaaacaaataacagaatccacctgtaaaccgcgagacgaacttattaagcctaattaatccgtcattagcagatgtttactgtaacaccatattatcaaatcaagcgtaattaggcttaaaagattcatctcgcaatttacatgcaatctatgtaattagttattttttttcgtttatatttaatactccatgcatgtgtccaaacgttcgatgtgtgttaacgacgaaatttggtatgcccgaagttatcatcggcctaaagtcagtatcggcttcagagtcctggaatcggccgatgagaattaccaagtcgccaatagccgaattcctgctatattcggttaaggaaattaatatattaaaggaagcttatccagaagtgaccgagttcaaggaggatgcagcacgacaagttatctattaattagaa

SEQ ID NO: 85713 - DNA, 1141 bp, Oryza sativa
attgaatatcgtttttctatatatattattttgtatatataccgatccccaaaagtcgttgttttatcttaagtgtgacagagacacctatttgtcgttaaatatttgttcttggcaaaaggttgttcataatttcagggaaaatactttgtaccagtgctgctgagatattaattcctggaattccacaatgttgtcatcgctccaaccagcaaagtcacaatctgatggtgctatgcatgtgcttgcctaactagctagctatgtacgccttcatatatataattttataaaagaaaaatgttgatatcgtacatgcacatgtattgaaattcgatcgattccccaaaacaaaataatttattaattattatgtcctttttgttctatttttattttgtaacatatgtagcaagagcaaaatgaggaagtaaaattcagcaaattcatcgtaacatgtctagttatactccctccatactcgtaaagaaagtcattttggacagcaacacggtctccaaaatacaactttgacttcttgttttaataaaaatatttattgaaaagtgatatatgtatacttttatgaaagcatttttcaagacaaatctattcatataatttttacatttttcaaactcaacaacttgagagttattcatgatttatattcccaaggtttgacttaaacattgtcttaaacgactttctttacgagtacggagggagtatagtttaaacaaaaccaacaagatgcaagagtacctagacatttgtaaaattcagccatattacttatcccaattttgtatgatttatttaaagaaaatcaaaatgggtgtggtttcttatatgtgtttttagcctattttttcttacgcatagtgttatggtctgattgtttgatctacggctgataagctgtgaaaaaaaaagaactaagcaaatgaagaagcaaaacttatatatctatattattatattttaaaactaaaaccaatgatgaaaataaactatgacaaagaaacagaaatcaattctaaaaaacttaaaattcaaattcaaattttggctatggataataagataacgagtaaacgacgagagactatttttctgacgcaagtcttcaaaccatgca

SEQ ID NO: 85714 - DNA, 2370 bp, Oryza sativa
cgtgatgcacctcactaagaacctgtgcgtaatccttcttggcttcctaggtgtatacggaaagtcgaaagatacactggaagcacgtaatgatctgaagcatatggaacaacgtggcgaccttcacccggaaccaaagaagaaaggaagccattacttgagtccagtcagctacactcttagcaaggcagagaaggaaagtatgtttgaatgcttggaaagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagatatgtgcattcatgaacgcaatttcgcagaaggtcatcgatccggatagattagaagcccttcagaatgaagtggtgcaatgtctcgtcagttttgagttgatatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataacgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtcgatcgcgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctatcaaggttcctctgttccggtgccaatgggttaggttgactggtggaggcgtaatgattgatgacagtgggatgacaactgttgaccttaacaaggttggatactcggacgaatcttttgtccttgccaatgatgtaacgcaagtctttttcgtgaaggacatgtctaacaaaggaaagaagggcagggggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgccgtaattattgtgtacacgatgtaaactattttggatgtattgattatccatataaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatgttaattagagtttttagcatttaatttaatataattcctacgctaagtacatatgatgattacaatttttattaattttaaatcatgcagtatgtacatacatatcttaattagagtttttaccaatataataatatcattcatatatatgctaagtatatatgattattggaatttttattaattatatttgcttattacgatttatccacttaatttattacagacaaaaataatttttcgaagtaattgtcattaatctttgtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttagtcccggttgttgagaacaaccgggactgaagatagtctttagtcccgg

SEQ ID NO: 85715 - DNA, 1722 bp, Oryza sativa
ccacgtaagccagtcaacccagtcagaggcgctttggacctaaatgattcacttaaacaagatcgcggacccgaatgacgattttcctagatcatggacctaagtgacacctcgctccaacatttaagggaccggccgtgtactttactcttctttttttatgcagttacacataaatcttcatgaaccatgctgtttcctgtactgtaaaataattggctgtgccttgtgattatctagaatgtattatgggaacatttatttgatgcaagaaattaatgcccttcagttcatacagtacttttcagttaatcagtagttagaaatatctccattatggaacagtaccatcattaatttgaagatgctgaacatccttttccattctgacatgactcctgaggcatatcaatcgtttgtctaaattcaggtctttctcctggagagtttgtccatgttattggtgatgcccatgtctatagaacacatgtgcgagctctggaggagcaaatccagaagctacctaaaccatttccagtaagcaactcaataatttaaatttatttcattcaaaagcatggaacattcagatatgaaacagcactcctgagttttgtgatgattcaccttacttatcaatggtgatgtctataaatccgtttaattatatgaatactatgtgcaggttttgaagattaaccctttgaagaaggatatagattctttcgtggcatcagacttcaagctggtcggttatgatcctcaccagaagattgaaatgaaaatggcaatataatttggtattcctctagcatttatactcgtactgacgcttttcatgtttcaatatttgcttgctgtctgatagaagattatggtaccagtacttatgatgcacgctgtactgttgatagagctcgcccatcagttttcaacattgttctggtgtccatgatacaacctttctgttgcaatactgctctcttttatgtccatgctaactagataaacatatgattactgagctgcaacggatgacaagtggggtttttgtgcataatattgctttccctctgactcgtgtccataattttgcaggtggctaagctgggacccccagtcactatgtgagcttggagaaacttaagcaggaaaaccttatgcgaacatcgcactagcttacttttttttttttagtggtggtgctggatgttcatttggacctatgttctccatttatccgcgattgtacttttatctcggtcgccgatctaaaccctacgaaaacaccggtcactggctcccccttttatttggacccagtgaatgatgttagagcttgtttcgagttgacaccatgttggaagaggccaaccgggcgttatgtgtagctcggcgatggatgtcatgtaccctgactgcgacacacattttggtcattttggtgaagcttcggagtgcctctggtgttgctggacgacacctactaattgtctccatctgagatttttctttccacatgtttggaacaccagatgatgggtgatgatgctgacctgtggatttggagttgttcagcatatgttggcactttttctgatgtttgtgaaatgagttgtgttgcgtgcttggaaattgcgcttggtggcggcgcttgcaggcaaggactgaaaatgagatcttttgacattgacgttaccttgttatttttcttaaaaaaaa

SEQ ID NO: 85716 - DNA, 3958 bp, Oryza sativa
cgcaccgccgccaaggtcgacgccaccgtgtcccgcgccgaggccgagggcgcgctcccggtgctcggccaccgcgacccgcggggcttcgtcctctccctctccaggccccgcaccgtcgtgctgctcgtccaggccgggcgcgccgtcgacgccaccatcgacgcgctcgtcccctacctcgacgccggggacgccatcgtcgacggcgggaacgagtggtaccagaacacggagcggcggatcgaggaggccgccgcgagggggatactctacctcgggatgggggtctccggcggcgaggagggcgcgcggaacgggccctcgctgatgccggggggccacatcgacgcctacaacaacatcagggacatcctcgagaaggccgccgcgcagacggaggatggggcgtgcgtcaccttcgtcggccccggcggcgcgggcaacttcgttaagatggtgcacaacgggatcgagtacggcgacatgcagctcatcgccgaggcctacgacgtgctccgccgcgtcggcggcctgtccaactcggagatcgctgacgtcttcgcggagtggaaccggggggaattggagagtttcttggttgagattactgccgatatattcacggtggccgacccgcttgatggcagcggcggcggtgggctggtggacaagattcttgacaagacggggatgaagggaaccgggaagtggacggtgcagcaggcagcagagcttgcgattgctgcgcccacgattgcagcatcactggatgggaggtacttgtctgggttgaaggacgagcgtgtggcggccgcaggggttctagaggcggaggggatgccatcagggctactcgagacgattaatgttgataagaagatgctagttgacagggtgaggcaagctctgtatgcgtcaaagatttgcagctacgcgcaggggatgaaccttctgcgagcaaagagtgtggagaaggggtggaatcttaacctcgcagagcttgcaaggatttggaagggcgggtgcattatccgggcgaagtttcttgataggatcaagaaggcgtatgacaggaaccctgagctggccaatctgatcgtggacagggagtttgcaagggagatggttcagcggcagaatgcatggcggtgggttgtggctcgtgctgtggaggctgggattagcactccagggatgtctgctagcctttcatactttgacacctacaggtgtagtcggctgcctgcaaatctgatccaagcacagagagacttgtttggggcacacacctatgagcgcattgaccgtccaggttcgttccacacagagtggactaagctggcgagaaagagtaatggtgcggccatttgaggacttgaatggtatcagtaactctgtgtggtgtctctttgtgggttctctttgaattcactactgttgtctttatgattctaggtctgaattctgtactttgaataatgaagtgtcatgtgcggtatgcatggaaggaacattcatgtagcttgtgcttttatatggtctaggtgcacccattcagttttctcataaatttggaatgcaatggttttaccctcttatcaaatccctgtaattttgatctggcatgtgtcattatagctagtaagacacgtgatgtttggccacctttatgaatctgtggtagaatgttgaaggtatacctcaaaaattgcatgataagtcaaacagcgtctctccagaaagtagcagtggaagacctgaataccggattgcttgggcatgatggaatctctctctaaatcaatgttctgcgcttatttattttctcactttctgtacaaaaatatgagtgacgtgaagccaaagggtgatacatttatatgctttcctgcactgttcctggtattgaacacatatctttgattattagtagtgctgacttatatatgtatataagcatttatgtcatctgtaggagatctaattgttaatttgtgacgttaagttcttggtctcagtggtaagttattttttttacattgagcctgatatttttcctctttattggttggttggtaaccctgccgtgatctgttttgtactccctgtaaagtagaagcactcctcatgaatgaaatgacatactcatttatactagagctgtcaatgggttgtgtggaatagggttcatcatgtcatgctgtcaggttttagtgctttccttaatgaacctggataatattgcctagtttttccatcagggtggtttggtcaaattggttcatgcaatcttgagctactaagttctcatgtcagttttctctatcgtatggttgaaattgtactcttaacaaattcatttgcatggtcacctccagcagcattatggtgaacctatttagagctattgttgccatttgtattgtataactggttaacacagaaaatggtgtggagacaacatggtgtttatggcattccctgatgcaaaactaacagtaagctcatttcagttttccaggagcggagttaatgaatgttaggctaaattcttgcatcaatcagcaagtgattgaaacattccctaatgccatagttctgcaaactaagtgatacaaaatcaacaaaatgcgtcgaacaaagtcctttgcacatttttcatattagaactttagaagttccaattcgaggttaggttgaccttttctgctcattgagaaccgtggttagcactagcatagctgtcacgcaaagcttgcttcaatcattgcttacagtttctggctagtcaatttgttgtcatttttttattgccattaagattttgactgtattttttttctttaatctcgtattgttgctccaactccatttgatgcacaggttgacatgatattgtaatattatcatttatcttctggttaacatcgtgcatttcatataagactgaacttgagtatattaggatatagaagttgagtgcgatgttaattaagtacagatgaaattgaaaccttgggttagatttgggcctcaaattggtcctcgtgtcacatgatgaaattggccagcccactgttgtgcaacatatataaggatgtgccagataaagaacctagttgggctaatgggcctatagcactccacatttgcatgattcttacatggaaatatgaagcttgcatgattctcagtttattgttttccttttttttttcctttctagatgacgaaacaatcaataagaaaattttcttttgcagtttattttggtctcaactcttattttgattctagtgctgcaacatggtcaacattcttgaatgctaataataggattatatggtaccacagaggcaaagataagttctcaaatctctgctgcacttttattttgttatcatgtggtttccacatggtttgtgtactgatgatgacagattatctaatcgctcttttctctccaggaggagctacacaatattgtcaattgtatgactccaattgaattggaatacagtaatacacaacagagattgtttattctgatttcagtggctttaatggtatggagctaactactgcagtccaattatggaggtgctgcaacttttttttttttcactttgtatgatatgatcaaaagaaaggctaattgtcgtgatttggtttgcctctgaaagatatgattttggggatgtaacagctaacgcatccattcatttactttagcctgtggagatgttgacaaaaacacatggagtctggtttacttgtatttcccataagcaggtgataactgataacccacttatgctttttctcaagatttatcttttcaaaaaataaataaataaatgaaagcatttgccatttgttaaactgttcgaaaaattgatttattttttatgattgtggaaggcatgatggcttatctaataggtaggatcgtcag

SEQ ID NO: 85717 - DNA, 782 bp, Oryza sativa
aaaaagtcaacggcgtcgtacatttaaatatggaggtagtatatatttgaacaaacgttactacactatgagttttgtgtgttcttgtttgaagatatacttgtttgggtgaagggaaagagatcgagcacaaggattgcatggatgatcaatgaagtttatttgggaccatgtgaagtccttccccaagtgtaacaccccagcccgtttgaagcctagtagtgtgtgtttggcccatgtggtgtttggcccatatggccctgaagtggatgtgtagtggtggtttagtaccaccttggaagtttaggtgggtgagggcctgcttataagccttggtgctccaaccatggtatccccgggttaacccttttacacgaagcgaggacgaaagtgtaagcgggataccatgcgtacgtgggtccgctcaacgtgtagagcggactaatgcggattttggaggcatggtgttacagttggtatcagagcataaacctccgctgtatgatgtatgtgctttgggccatggtctgcaccggagggggttctgggcctctgccgtgtaaacggtgagctgccggggcgtcagcccttaagggggggtgaatgtaacaccccagcccgtttgaagcctagtagtgtgtgtttggcccatgtggcctagaagtggatgtgtagtggtggtttagtaccaccttggaagtttaagtgggtgagggcctgcttataagccttggtgctgcaaccatggtatccccgggttatcctttttacacgaggcgagg

SEQ ID NO: 85718 - DNA, 573 bp, Oryza sativa
cctattctcgtcctgacgccgcggcgagccaggaggcagcgagttattttactcgatatctcgcgttttctcgtcactcagatctgatctgatctgacccctcacagtgaggtaacccctctcgcctcgccacctccccccctgttttctccatttctcctcccaatttttttctccgcatccgcagaaattctgtcccctcctcctcctcctccatttccgatgtattttattcgatttcgagatttgttttccggtgcatagagctcacgtacaaccgccgcgccgaacggtgcatgtgaactgttcggcgaaacgcgcaagtgaggagaggtcgcgaggagcggctgctgcggcggcggcggcggcttcgattcaggtgggggtgggtgccctagggtttcgctgccgggatggatggccgggagcagcagcagcagccgcgcgtgagctcgccgccgccggccggcggcggcgtgatgatgcctcatcacccctactgcgccgcgccggcgatgcccgccgggtcggcgaatgttatgcacggggtgccgctctcgttcaaccccatgg

SEQ ID NO: 85719 - DNA, 514 bp, Oryza sativa
cgcgcgtcgtgttcctcaacgagcgcccccagccgaggcccggcaagggcgtcaccaacacctgcgaggtctgcgagcgcagcctgctcgacaccttccgcttctgctccctcggctgcaaggtacgttacgtccccccgttggccgccgccgcacgaacacctggtgttgcatcgcattgtgctgacagatgccttcttggacgcgcagatcgtcggcacctccggcgactaccgcggccggaagaggcacgccggcggcggcatcaagaagacgaagaagctgcacaagggcgcggcggcggtgccgtcggactcggacgactcctccacgaccacaagcggcgggagcgacaagagcagcgtggtgcagagcttcaccccgtccacgcctccggcgaccgccaacagctaccgcaccggcaagcgtcgcaagggcgtcccgcaccggtcgccgttcggcagcctcatggtggagttctaaagcagggcagaagcaatgccgccatgccggc

SEQ ID NO: 85720 - DNA, 758 bp, Oryza sativa
agcttctgaaggtactgcatatcccatgcttgaagtttgagtatcttcatgcttttaagaacttctgtcgttgacttcattctaccatctttagctgccatgatcttggcctgcaaccttttctgcattctggtcagtggaatattgcaagccattattgccagtgttgctgctaaaccagcccaggctccaacccctagattttgatggagaacatagacagcaagagaaagctgtatgggtaacatccaaatatagttggtgtaccatataacatcagttatcctttgtacatctacactcatgtagttaatgatctctccacttgtgtgtttctgccttgaactgcaggataggcggagtcccttttgatagatatgtgatatcaaagccgcccgcagccgcatcccgagctgtcgagccccgaaaatccattgtctctgagcaactgtttccacaactttggcactgagaaaagcaacagccagaaggtaacctcttttgagtccatactgcctctctccccctaggtacttcaccaagtcattgatcagggatggtccaacataggatgcacttgcacttaagactgcaaatcctgcattcattatagcttttcttctaataaataggaacattgctgtgtaaattgatttagtatttagaccatgcctgttctcaacatcatctatgatttttttgaatgaatcagaaaggaactcagcggagtccttcccatagacatttggcacatcatt

SEQ ID NO: 85721 - DNA, 781 bp, Oryza sativa
gcggaggcaccactcggcggcgacggaggcaagccggcggtgaagtcgtagacgcccaacagcggcggcataataggccagccgtgtaggcggaggcaccaatcggcggcgacggaggcaggccggtggtgaagtcgtagacgcccaacagcggcggcataataggccagccgtgtaggcggaggcaccaatcggcggcgacggaggcaggccggtggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgcagatgacgatgcccatcaacggtggtgtgaccaaccgaccgtataggcgaggacaccagtcggcggcgacggaggcaggccggtggtgaagtcgtagacgcccaacagcagcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataagccagccgtgtaagcggaggcaccactccgcggcgacagaggcaagccggcggtgaagtcgtagacgcccaacagcggcggc

SEQ ID NO: 85722 - DNA, 601 bp, Oryza sativa
caatttgcaaccattttccactttgcggcgaaaaatagcatttaggttgtgtttagttccacactaaaattgaaagtttgaagaaattgaaatgatgtgacggagaagttggaaatttgtgtgtgtagggaagttagatgtgacggaaaagttgtaagtttaaaaaaaaagtttgaatctaaacagggcgttagccgcatttgtgctctatcaatccgatatccagtgcatgtgtattatcatattctaatcgatagactagcgcgaagttttcatacgctaaatcaaaacagtaaacaaactcacgagggagttgagcttctccacagcagcggcggcctcctccgccgttgccatcgtgacgaacgcgaaccccttcttcttcccatccttccccttgatcaccttcacccaaaaaaaaaaaaaagccacgcgtgtctcagaacaccatagcccagaactcaagctacgcctccataagcatggcaactgggccgtaccggttactcacctcgacgtccttgacggcgccgcactgcgcgaagagcttctcgatctccggcgcggtgaaggaccaggggatgttggccacgtacagctt

SEQ ID NO: 85723 - DNA, 513 bp, Oryza sativa
ccatcacatcaactgttgtttcagcaaattttgtacctgatatctctttccagggaaagacaatcagattgtaaacttcagctctgtttcagacggcccaaatatatattttttcctgtcattgccacaaatggtaacattacaaagtcgttttcactattcatccgtatataatactctatcgcatgcgtgtacatcgaagtcagaagtaacaaaagaaaaggaaaaaacatgaaaatgatggtctattccaagtgttccacggcattgccgacaccgaattggggatcactcaatcctctgatggtacacattaaggacatagctgttcagaaggtcaccaaatgtcttggttgagaacttctgcacaacatggccccttgcttgtttacccatcttaactgctagatcgtgatcgttcacgagcttcagcatggcttttgaaaattcaaaagcagagggctcacagagaaaccctgtctcgtcatttatgactgtttccactggcccacc

SEQ ID NO: 85724 - DNA, 555 bp, Oryza sativa
  unsure (1)..(555): unsure at all n locations
atattgaggaatttccaggtctctttcatgctatcccaataatgaatcattaattcctccatggggcatacgttcctcggccactttgtgccattaatgtgcatgccccctccatgtcattatcattgcttgaatcatagtaacattattactgttctagtttactctcgctgacacaactgcttcgctctagaatcgcgatgatgctaggtatgctaggttgatttgatctgtcgtctctgcacttcactgtcgctcacttgcttgcttttaattggtcggcgtgtagggcgaccaggcgtccattgtcggcggcgccattgatttcgtgaaggagctcgagcagctgctgcaatccctcgaggcgcaaaagcgcacgctgctgatgcagccgccgccgccaccgcagcagcagcgggagcccaagtgtgatgccgcggactccacgagcgcggccgatcaggaaacttcngcngcngccgccgccgcggcggcggctgatggaccgccgttcgcgcggttcttcacgtacccgcagtacgtgtggtgccacaa

SEQ ID NO: 85725 - DNA, 668 bp, Oryza sativa
ttgggataagtttttccaggggtctatttgcgaaataagttttttaaaaggaccaaaatgtaaatcatatccatcctgtacccacactcgatgagacggcgcggctgcctggtgcgcgcgagatccctgagcgacacgaacacgtgccgccccacgccttcctccacctcgtccccctccgagtagtagtagcagtactcgggccccggcacgcacgggtgctcgagaggcaaacccagcagcaaatcctcggccatcttggtcgccgtcgcggagcgccgcggcaggaagggcagtatcgcggtgtggaagccgtcggtgtgctcgacgcacgggaggctgcactcccggcacagcaccctcctgcagcagctacccgcgtacacgcagcccatgcccctgcagccgtcgccggccgactcgcatgtgcggaatacgcaggaagcagccgcaggctgctcgccgacggtgatcttcacgtgttgcggctggtagtagcagggccatccgccgtcgtcgtcgcgaagagtcggggcgacgtaatctggcggttcgtcgttctggatgggcaccaagctattcccgtacagcatggggaatgccatcttgcactggggaagctttaacttgtccagcgagtccaggtgtcgatgcttctcgtctcgaga

SEQ ID NO: 85726 - DNA, 527 bp, Oryza sativa
ccctacaccaaaacgcatcagtagtggaatggttttgcagggtgaaacacagcgaagaaaaacgacaatatccaataacatgtcattccaatcttaattaagattcgtacacgccgaatactagcgagaaaagaaaaaggtgtacaaacattcataagaaaaccgtacaactaggctgacaactgacaaagcatgctaaataagctaccgattgagaaaaataaaaattagctacctgacaggccaagccatgcgctggggctacttatttgttcctgatctcttttgttcaggcattgtgatactgattactactagcgcaccggattattggccaacgctgccggtggtgtcggtgcaggaaacactgaatccctgatccctacactctactgggtcaacagctaacagagcttaaaaacacaggattatctagtcggtcatcatcttcaggtcgggatcgtaacggccttgatttccagatagcgaccagctaacaggagcatacgaagaatgcatgggatgac

SEQ ID NO: 85727 - DNA, 1481 bp, Oryza sativa
acgtgccatctctaagagataacacgctagctccggcttgagacgagtgcctagaggctttcgtcttgacgggatggggcaaggcgtgcgtcagaccgccagtcgccacctaacccgtgatttgaccggtctgtgactggtcacagaccggataaaggaacgcgctgtactgcgttgcatgcagcgtgacacgcttgaccagactgcaataaatgctgttaggtgagcacagctgtgctcacttatcccatatatgtggcgcagacttccttaaggggtcggggtgcctcggccctcggggccggggcaagcgcaacccgacccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacagtagcccccggcgttatgccagagcaatttcccttcccaagggaagcggtcaggtgtgacgccacccctaaagcctggtgacaggtgggaccggtctccgtagttgggcaaaatacccaacggtctcaatccatgcacattggtattggtaactttggttgtccataatgggcggtctattcaagactgccacaccacttgagcagcgcgcgaatctgggtgagcagattggtctcgcccggagatacggtaacgccgcttcggtcggcgagcgtaattaacgcgcgcacgatacaatccatttcgattgccacaaccgcatatccacttcatgcgccgtaagcgggcgaatgggattagtggaagcgtgggcacgggaaacgagggagcgagatagcgagatacgagggagcgaggtagtgggcgcgagaaacgaggagccaggcccagcgatggcaagggtataaaagcatcgagaaaaggatttgcttccttcctttcgccattgttcctcttgccttcgccgcctgagctctaactctttctctgctacgccctactttcgccacacgcgctcgttctcaatcatctcttcctccaccgccatggcacggggctctgctctgctcgacggcagtgtactaccgccttcccgcatcgtgagcgagaggcacgccggactgccgcgccgcttcatgccggagtccgccaccggtcgggagatagtgatgctgggcgaggggcgcccggcaccagactacccggggcggtccatcttcttcctccccttcgcaatggctgggctggtcccgccattttcttctttcttcatggatgtcctggagttctacgatctccagatggcgcacctcacccccaatgcggtgatgacattggccatcttcgcgcacctgtgcgagatgttcattggggtgcgctgtcacgtcctgataaattcatcccgaaataaaaatcatcttctaaaaggaataatagaattaattaaaattcgaaaagaaat

SEQ ID NO: 85728 - DNA, 544 bp, Oryza sativa
ttgatatcacatatctatcaaaagggactccgcctatcctgcagttcaaggcagaaacacacaagtggagagatcattaactacatgagtgtagatgtacaaaggataactgatgttatatggtacaccaactatatttggatgttacccatacagctttctcttgctgtctatgttctccatcaaaatctaggggttggagcctgggctggtttagcagcaacactggcaataatggcttgcaatattccactgaccagaatgcagaaaaggttgcaggccaagatcatggcagctaaagatggtagaatgaagtcaacgacagaagttcttagaagcatgaagatactcaaacttcaagcatgggatatgcagtaccttcagaagctagaagctttacgaaacgaggagtacaattggctgtggagatctgtgaggttgtccgctgtaacaacattcatattttggggggcacctgcattcatatcctccataacatttggcgcatgcatattgatgggaattcctttgactgctggtactg

SEQ ID NO: 85729 - DNA, 928 bp, Oryza sativa
acgcccaacagcggtggcattataggcccgccctgttaggcgaaggcaccattcgggggcaacggaggcaggccggtggttaagtcttaaactcccaacagtggtgggataataggccagccgtgtaggcggaggcaccaatcggcggcgacggaggcaggccggtggtgaagtcgtacacgcccaacagcgggggcataataggccagccgtgtaggcggaggcaccactcggcggcgacggaggcaggccggcggtgaagtcgacgatgcccatcaacggcggcgtaatcaaccaaccgtataggcggggacaccagtcggcggcgacggaggcaggccggcggtgtagatgacgatgcccatcaacggtggtgtgaccaaccgaccgtataggcgaggacaccagtcggcggcgacggaggcaggccggtggtgaagtcgtagacgcccaacagcagcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggcggtgaagttgtagacgcccaacagcggcggcataataggccagccgtgtaggcggaggcaccactcggcggcgacggaggcaggccggcggtgaagtcgtagacgcccaacagcggcggcataataggccagctgtgtaggcggaggcaccactcggcggcgacggaggcaggccggcggtgaagatgacgatgcccatcaacggcggtgtgaccaaccgaccgtataggcggggacaccagtcggcggcgacggaggcaggccggcggtgtagatgacgatgcccatcaacggtggtgtgaccaaccgaccgtata

SEQ ID NO: 85730 - DNA, 611 bp, Oryza sativa
atcatggaagaccttggtgatgaatattttgcaatacttgccgatgaatctagtgatgtgtaccaaaaagaacagttggctctttgtttgagatatgttgataaaaaaggaagggtagttgagaggttccttggtgttgttcatgttgaaaatactacttccttgacacttaaagctgcaattgaatcattgcttatggagcattccttgagcttgtctaaggtccgtgggcaaggctatgacggtgctagtaacatgaagggtcatgctaatggactaaagaaattgattatggatgagtgcccttctgcctattatgtccattgctttgcacatcaactccaattaacacttgtggctgttgctaaggaaaacccagattgtgtgtggttctttgagcaacttagatttttgttaaatcttcttgggaattcttgtaagaagacagaaatgcttagagttgcacaagctcaaagaattgtagaagaactagatttgggtgacattgaaactggaaagggtttgaatcaagaaatgggtttgggcaggccagcagatactcgttggggatctcactataaaactgttatgcatgtcctatctttgtatcc

SEQ ID NO: 85731 - DNA, 605 bp, Oryza sativa
cgctaacaaagtagatgggccgctgcacctttcggcggggccgatcctctccgccaggggccgcatctccagggcgctcttcatccgagaggccacgcggggcgccctcggcttctgcgccgacaacctcggggtcagagggcgacaggcgcggccttcccgcagtggccccggggccatcctgggggtcgggggcgcctggcaccgtcggacaagcaggcggagggccagctccggccgtcgggggccttgggccaccgttcggttcgggggcctctcctccctgctctctcccgggtcgagtcgacacagggtggggatgcgcggagtgagggttgtcctcatcgcgctccacgaccaacgccgagctgaccacctgcggggttgccgccaggtagagtagcaacggctcatctggctccggggcgaccaggactgggggagaactgaggtacgccttcaattgaatgaaggcccgctcagcctcctccgtccagtaaacggcccggagcgtttgaggagcttaaataggggtagcgccttctctcccagcctcgatatgaaccgacttagggcggccatgcagccagtgacgcattgcacat

SEQ ID NO: 85732 - DNA, 533 bp, Oryza sativa
atccatatgacaaagaaaagtatgacaagataatacaagcttgtgcgctgactaaagatcttgagttgtttgcaaatggtgatttgacggagattggtgaaagaggaattaacatgagtggtggacagaaacaacgaattcagatagcaaggtcagtatatgaagatgcagacatatacctttttgatgatcctttcagtgcagtggatgctcatactggaagccaacttttcaaggtttgttctgtttgtttaaaactttcaataaatgctcaagtatgaaggttatgtcttaactccattcttcgtggcattaactccattcttcgtggcataacgttaataaaaaaaagggcaaaacctatttcgttacttttagaccaataatcgttagactctaagcaaatgaaacaaattgccttggcaggattgcctgatgggaattcttaaagacaaaacaatactgtatgtgacccaccaagttgaatttcttcctaccgctgaccttatactggtatgtatctaaaatacttt

SEQ ID NO: 85733 - DNA, 582 bp, Oryza sativa
aagagggacgtgattgaaggtgtccgagagtttttgaaactggagaatggaaggaaggaatgaatgatactgttattgtcatgattccaaaaacgaatgcaccggtggagatgaaggatttcagaccagtcagcctttgtaatgtgatttacaaagtggtggctaaatgcttagtcaatcggcttaggcctttgttgcaagagattatatcggagacccagagtgcctttgtgcccgggcgtatgattacagacaatgcattagtagcctttgagtgctttcattccatacataagtgtacacgagaaagccaagacttctgtgcgttaaagctggatctttcaaaagcttacgacagagtcgactggggattcttggatggagcattgcaaaagttggggtttggaaatatctggagaaagtggataatgtcatgtgtgacgtctgtaaggtatagtgttcgactgaatgggaatatgcttgaaccgttttacccaacaagaggtttgcgggaaggagacccactcaatccatacctatttctttttattgctgacggcctatcaaatattctgcaaagaa

SEQ ID NO: 85734 - DNA, 1199 bp, Oryza sativa
  unsure (1)..(1199): unsure at all n locations
ggcgtgtcccttttgaatgccncatgaccaccattggacagacgncatcaaaatgttcacatccacaaggcacgattggtggtgaaaggtttcagacaaattctcgccagttgccatgctaaaatctattcagattgttttagcgattgctacctatttcaactataagatatggcaaatggatgtcaaaacagctttcctcaatggaaatcttgatgaggatgtgtacatgacacaacccaagggatttgttgatccacaatcagctaaaaggatatgcaaattgcagaaatccatttatgggttgaagcaagcatctcggagttggaaaatttgttttgatgaagtagtcaaggtcttgggctttgtcaaaaacgaagaagagccttgtgtatacaagaagattagtgggagcacactggtgtttctaatcctatatgtagatgacatattattgattgggaatgatattcctatgcttgaatctgttaagacatcattgaaaaatagtttttcaatgaaggacttatgggaagcagcatatattctgggcataaggatctatagagatagatcaaagaggttaattggattaagccagagtacatacattgacaaggtgttgaagaggtttaacatgcaagattctaagaaaggtttcttaccgatgtcacatggcattaatcttggcaagaatcagtgtcctcaaacgactgatgagcgaaacaagatgagtgtgattccatatgcctcggcaatcggatccatcgtatatggtatgctatgtacacgtccagatgtttcatatgcacttagtgcaacaagccgataccaaggatatgttcctagtccaggtgagagtcactggatagttgtaaagaatattctgaagtacttgagaagaactaaggatatgttcctagtctatggaggacaggaagagatcgttgtaaatggttacactgacgcgagcttccaaaccgacaaagatgattttagattgcagtttggatttgtgttctgcctgaatggaggcgctgtgagttggaagagttccaagcaagatacagtggctgattctacaatagaagccgaatacattgccgcttctgaagcaacaaaggaggcttgttggataaagaaattgtttctcaactatgtgtgatgacttgtgcttctaggcctatggaccctctatg
